United States Patent 11,931,406 (FLAVIVIRUS VACCINE) - sequence listing, part 63

SEQ ID NO: 22195 - RNA, 9876 nt, Artificial Sequence
  derived and/or modified CDS sequence (opt6) from DENV-2__KP188549__SS-prME
acagcaggaguaauuguuaugcuuauacccacagcuauggccuuccauuuaacuacaagaaauggugaaccucauaugauaguuggaagacaagaaaaagggaaaucucuucuauuuaaaacagaagauggagugaauaugugcacccugauggcaauagaccuaggagaauugugcgaagauacuauaacauauaaaugcccacuauugagacaaaacgaaccagaagauaucgauuguuggugcaacucaacgucaacguggguuacuuauggaaccuguacaacuaccggggaacauagacgggaaaaacgaaguguugcucuaguuccccauguggggaugggauuagaaacgagaacggaaacauggaugaguucagaaggagccuggaaacacguacaaaggauagaaacauggauacuaaggcacccagguuucacuauaauggcggcaauuuuagcuuacacaaucggaacuacucacuuccaaagagcucugauauucauacuauuaacugcaguagcgccaaguaugacaaugagguguauuggcauuucgaacagagauuuugucgaaggaguaucaggcggcagcuggguagacauuguacuagaacauggcucauguguaacuacuauggcuaaaaauaaaccaacauuagauuucgagcugauuaaaaccgaagccaaacaaccagcaacuuuacgcaaauauuguauugaagcaaaauuaacaaauacaacuacagaaagucgcuguccuacgcaaggagagccuuccuuaaaugaagaacaagacaagagauuuauaugcaagcauuccauggucgaccguggcugggguaauggauguggauuauuuggaaaaggaggaaucguaacgugugcuauguuuacgugcaagaagaauauggaggggaaaauaguacaacccgagaaccuagaauauacgauagucaucacaccucauucgggagaagaacaugcuguuggaaacgacacaggaaagcacgguaaagaaaucaaaauuacgccucaaaguucaacaacagaagcagaacuuaccggauaugguacaguuacaauggaauguucuccacguacaggucucgauuuuaacgaaaugguauuacugcaaauggaagauaaagcauggcucguacaucgucaaugguuuuuggaccucccucugccuuggcuaccaggugcagauacucagggcucuaacuggauucaaaaagaaacauuaguaaccuucaaaaacccucacgcaaagaaacaggauguagucguuuuggggagucaagaaggugccaugcacacagcauuaaccggagcaacagaaauacaaaugucuaguggaaacuugcuauuuaccggacaucuaaagugucgacuacgaauggauaaacuacagcuuaaagggaugagcuauucaauguguacggguaaauucaaaaucgucaaagaaauagcugagacacaacauggaacgauaguuaucagaguacaauaugaaggugacgggaguccaugcaaaauuccguuugaaauaacagauuuggaaaaacgucacguacugggaagacuaauuacaguaaaucccauaguaacagaaaaagauucuccaguaaauauagaagcagagccaccuuucggugacaguuauauaauagugggaguggaaccgggacaacuuaaacuuaacugguucaagaaaggauccucuauagggcaaauguuugaaacaacuaugcggggugccaaaaggauggcuauacuuggggauacagcaugggacuuuggaucgcuagggggugucuucacaucaauugguaaagcacuacaccagguauuuggagcaauauacggugcggcuuuuucuggugucucauggacgaugaaaauuuuaauuggagugauuauaaccuggauaggcaugaacucgagauccacaucucucucgguaagccuaguuuuaguaggagucguaaccuuguauuuaggugcaauggugcaagcugauucaggcugcaucguaucguggaaaaauaaagaguuaaaaugcggaucagguaucuuuauaacugacaauguacacacuuggacugaacaguacaaguuucaacccgaaucaccaucaaaacuagcaucugcuauacagaaggcgcacgaggaagggauuuguggaaucagaucgguaacucgauuagaaaauuugauguggaagcaaauaacacccgaauuaaaccacaucuuauccgaaaaugaaguaaaauugacaauaaugacuggagauauuaaaggcauaaugcaagcugguaaacgcagccuaagaccgcaacccacggaacuuaaauauagcuggaaaaccuggggaaaagcgaagaugcuaaguacugaaucucacaaucaaacauucuuaaucgacggaccugaaaccgcggaguguccaaacacuaauagagcuuggaauagccucgaaguugaagauuacggauuuggcgucuuuacaacaaacauaugguugaaguuacgagaaaaacaggaugucuuuugcgacucuaaacuuauguccgcagcaauuaaggacaaucgagcaguccacgcugacauggguuacuggauugagucagcucucaaugacacauggaaaauggagaaagcuaguuucauagagguaaaaucaugccauuggcccaaaucacauacucucuggucuaauggaguguuggaaucugaaauggucauuccuaaaaacuuugcagguccugucucucaacacaacuaucgucccggguaucacacucaaacagccggaccuuggcaccuaggaaaacuugagauggauuuugauuuuugcgagggaacaacggucgucguuacugaagauugugaaaagaggggaccgucgcuacgaacaacgacagcuagugguaaacuaauaacugaguggugcugcagauccugcacucuuccaccucuaagauaucgcggagaagacggauguugguacgguauggaaauaaggccguugaaggaaaaagaagagaaucuuguaaauagucuugucacggccggucacgggcagauugauaacuuuagcuuagguguauuaggcauggcauuguuuuuggaggagaugcugcgaaccagaguggguacuaaacacgcuauacuauuaguggcccuaucuuuuguaacucuaaucacuggaaauaugaguuuucgagaccuaggaagggucaugguaauggucggugcuacgaugacagaugauauaggaauggguguuacguaucuggcguugcuagcagcguuuaagguacgcccaacuuuugcagcaggauuguuacuucgaaaauuaacaucaaaagaacuaaugauggccacaauaggcauugcgcuccuaucgcaaucaacacucccugaaaccauccuugaacugacugaugcauuagcauugggcaugauggcgcugaaaauagugcgaaauauggagaaauaucaacuagcagugaccauaauggccauaucaugcguuccaaacgcagucauccuacaaaaugcauggaaagucucuuguacuauccuggcugcuguaagcguaucaccacuguuacugacaagcucacagcaaaaggcugauuggaucccauuggcccuuacgauaaaaggauuaaacccaacugcuauauuucuaacaacuuuauccagaacaagcaaaaagcgaaguuggccacugaaugaggcuaucauggcagugggaaugguaaguauuuuagcgucuagucucuuaaagaaugauauucccaugacgggaccucucguggcaggaggguuauuaacaguuuguuauguguugaccggccgcucugcagaccuugaacucgaaagagccgccgauguaaaaugggaagaccaagcggaaauauccggaucuucuccuaucuuaucuauuacuauuagcgaagacgguaguaugucgaucaaaaaugaagaagaagaacaaaccuuaacuaucuugauucgaacuggauugcuaguaauaagcggaguuuuuccugucaguauaccgauaacugcagcggcuugguaucuaugggaagugaagaaacaaagagcaggaguauuaugggacguaccaucuccaccaccugugggaaaagcagaacuugaagacggugcauacagaaucaaacaaagaggaauacuaggcuacucgcaaauaggagcggguguguacaaagaagguacauuucauacaauguggcaugucacuaggggugccguguugaugcauagaggaaaaaggauugaaccuaguugggccgaugucaagaaagauuuaauaucauacggcgguggguggaagcuggaaggagaauggaaggaaggagaagaggugcaggucuuggcacuugagccgggcaaaaauccaagagcgguacaaaccaaaccuggaauuuuuaaaacaaauaccggcacuauuggggcggucagccucgacuuuucgccuggcacaaguggaagcccaauuguagaucguaaaggaaagguuguaggucuguauggaaacggaguaguuaccagaucuggagcauauguuucagcaauagcacagaccgagaagucuauagaagauaauccggagauagaggacgauaucuucaggaagaaacgacuuacaauaauggaucuacauccaggggcgggaaaaacuaaaagauaucucccagccaucguucgagaagcaauaaaaagaggcuugcgcacgcuaauccuugcuccuacaaggguuguugcagccgagauggaagaagcacuaagagguuuaccgauacgcuaccaaacacccgccauaagagcugaacacacugggagagagauuguugauuuaaugugccaugcuacauuuaccaugagacugcuauccccagugcgcguucccaauuauaaucucauaauaauggacgaagcucauuuuacagauccagcuaguauagcggcaagaggauauauaagcacgcguguagagaugggagaagcugcaggcauauucaugacggcgaccccaccgggaucacgagacccauuuccucaaucaaacgcaccgauaauggaugaagaaagagaaauaccagaaagaucauggaacagcggacacgaaugggugaccgauuuuaaggguaaaacaguaugguucgugccaucgauaaaggcggguaacgacaucgcagcaugucuaaggaagaacggcaagaaagucauacagcuaucccggaaaacuuuugacucagaauauguaaaaacgcgagcaaaugauugggacuucgucguaaccacagacauuuccgagaugggcgccaauuuuaaagcagagaggguuauugauccucguagaugcaugaagccuguaauacuaacugauggugaagaacgaguaauacuugcuggcccaaugccagugacacauucuagcgcugcucaaagacgaggaaggauuggaagaaacccuaaaaacgaaaaugaccaguauauauauaugggugagccccuagaaaacgaugaagauugugcacauuggaaagaagcuaaaaugcuucuagacaauauuaacacaccggaagguauuaucccauccauguuugaaccagaaagagaaaaggucgaugcgaucgauggagaauacagacugcgaggagaagcccgaaaaacauuuguagaccuaaugaggagaggagacuuaccuguauggcuugcguauaaaguagcggcagaaggaauaaauuaugccgaucggaaauggugcuucgauggaauuaaaaauaaccagauacuagaagaaaauguggagguagagauauggaccaaggagggugaacgaaagaagcucaaaccuagguggcuugacgcaagaauauauuccgauccucuagcguuaaaagaauuuaaagaguucgcugcugguaggaagucacuaacauuaaaccuaauaacugagauggguagacuucccaccuucaugacccaaaaagcucguaacgccuuggauaaucucgcaguauugcacaccgcugaaguugguggaaaggcuuauacacacgcuuuaucagaacuaccggagacccuggaaaccuugcuauugcucacguuauuagcugcugugacagguggaaucuuuuuguuuuuaaugucaggaaaaggcauaggaaaaaugacacuugggauguguugcauuauaaccgccucaauauuacuaugguaugcacaaauucagccccacuggauugccgcuucaauaauccuggaguucuuucuuauaguacuacuaauaccagaaccagaaaaacagcguacaccacaagacaaucaauuaacauauguaguaauagcuauacuuacgguaguugcugcuacgauggcgaacgaaaugggauuucuagaaaagacgaagaaagaucuuggauucggguccaucaccacgcaagaaucagaaucaaauauauuggacauagaccuacguccagcuucugccuggacgcuuuaugcuguugcaacaacauuugucacuccaauguuaagacauucaauagaaaauagcucagucaauguuaguuuaacagcgaucgccaaccaggcuacaguccugauggguuuaggcaaagguuggccuuuaagcaagauggauauuggaguuccauuacuagcaaucggauguuauucccaaguuaaucccauuaccuugacugcggcccuacuucuguuaguugcacacuacgccauuauuggaccuggauuacaagccaaagcuacgagagaagcccaaaagcgggcagcagcagguauaaugaaaaacccuacuguggauggaaucacagucauagaucucgaaccaauaccuuacgaccccaaauuugaaaagcaacuuggacaaguuaugcuucuaauccuuuguguaacccaaguucuaaugaugagaacaacuugggcgcuuugugaagcacuaacucuggcaacggguccuauaucuacgcugugggaagggaauccaggaagauucuggaauacaacaauagcggugucaauggcuaauauuuuuagggggaguuacuuagcuggagcaggccuauuguuuaguaucaugaagaauacgaccaacacacgacggggaacugguaaugucggagagacuuugggcgaaaaauggaaauccagacuaaacgcgcuaggaaaauccgaguuccaaauuuacaaaaagucagggauucaggaaguugauagaacuuuagccaaggaagguauaaaacgaggggaaacagaccaucacgcaguaagcagaggaagugcuaaacuccguugguucguagaaaggaacauggugaccccugaaggaaaaguuguugauuuaggaugugguagaggcggauggucguauuacugcggaggucucaaaaacguuagagagguaaaaggauuaacuaaaggagguccugggcaugaagaaccuauaccaaugaguacuuauggcuggaaccuagugagacuccaaucuggaguggaugucuucuuuacaccaccagagaaaugcgacacucuucuaugugauauaggagaaucaucgccgaacccgacaaucgaggcugguagaacacugagaguauuaaaucuuguggaaaacuggcuuaacaauaauacacaauuuugcauaaaaguauuaaacccauauaugccuucuguaauagagaaaauggaaacgcuacagagaaaauaugguggugcguuggugcggaaccccuuaucuagaaauaguacccaugagauguauugggugaguaaugcgacgggaaacauugugaguucagucaauaugauaucgagaaugcuaauuaaccgcuucacaaugaaacacaagaaagcgacuuaugaaccugauguagaucuagggucgggcacuagaaauaucgggauagaaagugagacaccuaaucuagauauaauaggcaaaagaauugaaaagauaaaacaagaacacgaaacaagcuggcacuacgaucaagaucacccguacaagaccugggcauaccacgguaguuacgagaccaagcagacugguagugcaagcaguauggucaaugggguagucagacuguuaacaaaacccugggaugucguaccgaugguaacccaaauggcaaugacagauacaacaccauucggucaacaaagagucuuuaaagaaaaaguugacacaaggacucaagaaccgaaagaagguacuaagaaacuuaugaagaucacggcagaaugguuguggaaagaguuagguaaagagaaaacaccgcgaauguguacacgagaagaguuuacuagaaaaguaagaaguaacgccgcgcucggcgcuguauuuacagaugagaauaaauggaaauccgcaagagaagcgguagaagauggacgcuuuugggagcuaguagaucgggaaagaaaccuacaucucgagggaaagugugaaacuuguguauacaacaugaugggcaaacgcgagaagaaauugggugaauuugggaaagcgaaaggaucuagagcaauaugguacauguggcuaggcgcaagguuuuuggaguucgaagcacuaggauuucuuaaugaagaucauugguucucaagaggaaacucauuaaguggugucgagggagaaggauugcauagguuaggauauaucuuaagagagguaggcaagaaggaaggcggcgcaauguaugccgaugacaccgcagguugggauacaagaauaacacucgaagauuugaaaaaugaagaaaugguaacaaaccacaugaaaggagaacauaagaaauuggcagaagcuaucuucaaguuaacauaccaaaauaaaguaguaagaguacagcgacccacacccagaggaacuguaauggacauaauaaguaggaaagaccagagagguaguggacaaguaggaaccuauggacuuaacaccuuuaccaacauggaagcccaauugauaagacaaauggaaggggaggguauauuuaaauccauacaacaucuaacagccacagaagagacagcuguacaaaauugguuggcgcgagucggcagggaacgcuugagccgaauggcaauuucaggagaugacugcguaguuaaaccaaucgaugauagguuugcuagcgcgcugacagcccuuaacgauaugggcaagguccgaaaggacauucaacaaugggaaccaagucguggcuggaaugacuggacucaggugccauuuugcagucaccauuuccaugagcuaguuaugaaagacggacgaguuuuaguagugccaugccguaaucaagaugaguuaauuggcagggcacgcauaucucaaggugcaggguggucauuaaaagagacugcaugccuagguaaguccuacgcacagauguggacauuaauguauuuucaucgacgcgaucuacggcucgcagcuaaugcaaucuguucagcgguaccaagucauuggguucccacgucucgaacuacuugguccauacacgcaaaacacgaauggaugacuaccgaggacaugcuugcggucuggaacagaguguggauucaagaaaacccauggauggaagauaagacuccuguugaaagcugggaagaagugccguacuuaggaaagcgugaagaccaguggugcgggucucuaauuggacugacaucuagagccacaugggcuaaaaacauacagacggcgauuaaccaagugagaagccuaauagguaaugaaggcuauacugacuacaugccaagcaugaagcgauuuagaagagaggaggaggaagcugguguguuaugguga

SEQ ID NO: 22196 - RNA, 9876 nt, Artificial Sequence
  derived and/or modified CDS sequence (opt6) from DENV-2__KP188550__SS-prME
acagcaggaguaauuguuaugcuaauuccaacaguaauggcguuccauuuaacaaccagaaauggagagccacauaugaucgucggacgacaagaaaaaggaaaaucacuucuauuuaaaacggaggacgguguaaacauguguacauuaauggcuauagauuuaggggaauuaugugaagauacuauaacuuauaaauguccacuucugagacaaaacgagcccgaagauaucgauugcugguguaauagcacauccacauggguaacguacggaacaugcacaacaaccggagagcacagacgggagaagagaagcguagcucuaguaccacaugucgguaugggauuagaaacucggacagaaacauggaugaguucugaaggugccuggaaacacguucagagaauugaaacauggauacuuagacauccuggcuuuacaauaauggcggcaauuuuagcauauacaauuggaacaacgcauuuccaaagagcguuaauuuuuauacuacuaaccgcgguagcgccauccaugacaaugagauguauaggaauuagcaauagagauuuuguugaaggaguaaguggaggaucuuggguagacaucguuuuagaacauggcagcuguguuacuaccauggcuaaaaacaaacccacauuagauuuugaauuaauuaagaccgaagccaaacaaccggcuacguugagaaaauauugcaucgaagcaaaauuaacuaauacaaccacggaauccagaugcccaacacagggggagccuuccuuaaacgaagagcaagauaaacgcuuuauuugcaaacacucaauggucgaccgaggauggggaaauggcugcgggcuauuuggaaaaggagguauugucacuugcgcgauguucaccugcaagaaaaacauggaaggcaagauaguccaaccggagaaccucgaguauaccauaguaauaaccccacauagcggagaagaacaugcaguuggaaacgauacgggaaaacauggcaaagaaauaaagaucacgccccaaaguucaacaacugaagccgagcucacuggguacgguacaguuaccauggaauguaguccaagaacuggcuuagauuucaacgaaauggugcuauuacaaauggaagacaaggccugguuaguucacagacaaugguuccuagauuugccauugcccuggcuccccggagcggauacgcaaggcaguaauuggauacaaaaagaaacccucguuaccuucaaaaauccucacgcuaaaaagcaagacgucgugguucuagguucacaagaaggugcaaugcacacagcauugacuggagcaacggaaauacaaaugucgagcgguaaccugcuuuuuacgggacauuuaaagugucgucuacgaauggacaagcugcaacuuaagggaaugaguuauaguauguguaccggaaaauucaagauaguaaaagaaauugcagaaacacagcacgguacaauuguaauucgcguacaguaugaaggggaugggucaccuugcaagauucccuuugaaauaacagaucuagaaaagagacauguauuaggacgauuaauuacaguaaauccaaucguuacagaaaaagacucaccugugaauauugaagcugaacccccuuuuggugacaguuauaucauaguaggcguagaaccaggucaacugaaauuaaauugguucaaaaaagguucaucaauaggucagauguuugaaacgacaaugcguggugcaaaacgaauggcuauuuuaggugauacagcuugggauuuugggucucucggaggagucuuuacgaguauagguaaagcgcugcaucaaguauucggggcuaucuauggugcagccuucagcgguguuucauggacgaugaaaauauugauaggagugauuauuacauggauaggaaugaacagucgaucaaccucacuaucaguuucucucguuuuggucgguguuguuaccuuauaucuaggagcgaugguacaagcggauaguggcugcaucguaaguuggaaaaacaaggaguugaaauguggaucuggaauauucauaacggacaauguacacacauggacugaacaauauaaauuucaacccgagagcccaucaaaacuagccucggcuauucaaaaagcacacgaagaagguaucugcgggauucgcaguguaacacgacuugaaaauuugauguggaaacaaauuacaccagaauuaaaucacauauuauccgaaaaugaaguuaaguuaacgauuaugacaggcgacauuaaagguauuaugcaagcuggcaaacguucguugagaccacaacccacugaacuuaaauauucauggaaaacauggggcaaagcgaagauguuaucaacugaaucacauaaccagacauuccuuaucgacggaccagaaacagcagaaugcccaaauacuaacagggccuggaauucacuugaagucgaagauuacgguuuuggcguauuuacuacaaauaucuggcucaaguuaagagaaaaacaagacguauuuugugauucgaaacuaaugucugcagcgauaaaggacaaucgggccguucacgcagacaugggauauuggauugaaucagcauugaacgacacuuggaagauggaaaaggcuucauuuauagaaguaaagucgugucauuggccaaaaucgcauacucuauggucgaaugguguacuagaaucugaaaugauaauaccuaaaaauuucgcggggcccgucucucaacacaacuaucguccaggauaucacacacagacugcaggacccuggcaccucggaaaauuagaaauggacuucgauuuuugcgaggguaccacuguaguugugacagaagauuguggaaaucgagguccgucucuuagaacaacuacagcgaguggaaaacuaauaacagaauggugcugccgaucaugcacguugccaccacugcguuacagaggggaagauggguguugguacggcauggaaauaagaccccugaaggaaaaagaggagaaccucguuaacucguuagucacagcuggacauggucaaauagacaacuuuucucuaggaguacucgguauggcacuguuuuuggaggaaaugcuaaggacaagaguaggaacaaaacaugcgauauuauuaguagccuuaaguuuugucacucugauuacaggaaacaugucauuuagggaucuuggacgaguuaugguuaugguuggcgcaacuaugacggacgauauaggaauggguguaacguauuuagccuuauuggcagccuuuaaggugcgaccgacauucgcggcaggccuccuacugcgcaaacuaacgucaaaagaacuaaugauggcuaccauaggaauugcgcuauuaucccaaagcacgcuaccugagacuauauuagagcuaaccgacgcucuugcauuaggaaugauggcauuaaaaauagucagaaacauggaaaaauaccaauuagcagucaccauaauggcaauauccugcgugcccaacgcaguaauacuacaaaaugccuggaaaguuagcugcacaauacuagcagcagugagugugaguccuuugcuucucacuucaagucagcagaaagcugacuggauaccacuugcauuaaccauuaaagguuugaauccgacugccauauuucugacgacauuaucaaggacgucaaagaaaagaucuuggccuuuaaaugaagcaaucauggccgucgguaugguauccauauuggccagcagccuccuaaaaaaugauauacccaugacuggaccccuaguugcagggggccuguuaacaguuugcuacgugcuaaccggaagaagugcugaucuggagcuugagagggcagcugacguaaaaugggaagaccaagcugagauaucaggaucuucuccaaucuugaguauuacaauuuccgaagaugguucaaugaguauaaaaaaugaggaagaagaacagacauuaacaauuuuaaucagaaccggcuuauuaguaauaagcggugucuucccaguaucuauacccaucacagcagcggcgugguauuuaugggaagugaaaaagcaacgagcgggcgucuuaugggaugugccaucaccaccaccugugggcaaagcugaguuggaagacggugcauauagaauuaaacaaagaggcauuuugggauauucucaaauuggcgcugguguguauaaagagggaacuuuucauacaauguggcaugucacacgaggagcaguacuuaugcauagaggaaaacguauugaaccaucaugggcggauguuaaaaaagaccuaaucagcuaugguggaggguggaaacuagaaggcgaauggaaagagggcgaggaagugcaaguuuuagcauuagaaccgggaaaaaauccgagagcgguacaaacaaaaccggggaucuucaaaacuaacaccggaacaauuggagcugugagucuugauuuuucaccaggaaccagugguuccccgauuguagauagaaaagguaaaguagugggcuuguaugguaauggagugguaacacggucaggcgcuuaugugagugccauugcacaaaccgaaaagucaauagaagauaauccagagauagaggaugauauauuuagaaaaaaaagacuuacaauaauggaucuacauccaggugcgggaaaaacaaagagauauuugccagcaauaguuagggaagcuauaaagcgaggacuuagaacccucauacuagcccccacacguguagucgcagccgaaauggaagaggcguuaaggggucuucccauuagauaccagaccccggcuauucgagccgaacauacaggcagagaaauaguagaucuaaugugccacgcuaccuuuacuaugagguuauuaaguccagugagaguuccaaacuacaacuuaaucauuauggaugaagcacauuucaccgauccagcaucuauagcagcucguggguacauuucaacaagaguagaaaugggagaagcugcuggcaucuuuaugacagcuacgcccccaggcucacgggacccguuuccccagagcaaugcgccaaucauggacgaggaaagagaaaucccagaacguuccuggaauuccggacacgagugggucaccgacuucaaaggaaagacugucugguuuguaccaaguauuaaggcggguaaugauauagcugcguguuuacgcaagaauggaaaaaaggugauacaacuaagccgcaaaaccuuugauucagaguauguuaaaacgcgagcgaacgauugggacuuugugguaacuacagauauuucugagaugggagccaauuuuaaagcagagcgugucauagauccaagacgcugcaugaagcccguaaucuugacugacggagaggaaagagugauauuagcgggaccaaugccaguuacacacucuagugcugcgcagagacguggaagaaucggaagaaaccccaagaacgagaaugaucaguacauauacaugggagaaccacuagagaaugacgaagauugcgcacauuggaaagaagcaaaaauguuacucgauaauauaaauacuccagaaggcauuaucccuaguauguuugaaccagagcgagaaaaaguugacgcaauugauggggaguaucguuuaagaggcgaagcaagaaaaacauuuguggacuuaaugagaagaggagauuugcccgugugguuagccuacaaaguggcagccgaggggauaaacuaugcugaccguaaaugguguuucgacggaauaaaaaacaaucaaauacuggaggaaaacgucgaaguugagauuuggacaaaagaaggugaaagaaaaaaauuaaaaccgcguugguuggacgcacgaauuuacucagacccauuggcauuaaaagaauucaaagaauuugccgcgggacggaaaagucucacacuaaacuugauaacugaaaugggcagacuaccaacguuuaugacacaaaaggcccgaaacgcauuagauaaccucgcaguacugcauacagcagagguaggaggcagggcccacacgcaugcacuaucagaauuaccagagacucucgaaacucuucuucuuuuaacauuacuagcaacuguaacggggggaauauuccuauuuuuaaugucugggaaaggcauugguaagaugacacuuggcaugugcuguaucauaacagcgaguauccuacugugguacgcccaaauccaaccacauuggauagcugcaaguaucauacucgaauuuuuccucauuguucuguuaauaccugaaccugaaaagcaacgaacuccacaagauaaccagcuuacauacgucgucauagcgauauuaacaguuguagcagcuacuauggcgaaugaaaugggauuucucgaaaaaacuaagaaagaccuuggcuuuggaacaauaaccacgcaggagagcgaaucaaauauacuagacauugaucugcggccugcaucagcauggacccuauaugcuguugcgacaacauucguuacccccauguugaggcacaguauagagaauucaagugucaauguaagccugacagcaauagcaaaucaagccacgguucugaugggauuaggcaagggguggccacuaagcaaaauggauauuggugucccauuauuagcaaucgguugcuacagucaggugaaucccauuacacuaaccgcugcauuacuccucuuaguagcccauuaugccauaauaggaccaggacuucaagcuaaagcaacaagagaagcccaaaaacgugcagccgcaggcaucaugaagaauccaacagucgauggaauuaccgucauagaccuugagccuauaccauaugaucccaaauuugaaaagcaauuaggccaggugauguuguuaaucuuaugcguuacucaaguacuaaugaugcgaacaaccugggcauuaugugaagcacuaacauuggcaacugggccgauaucaacauuaugggaaggaaauccugggagauucuggaacacgacgauagcuguaaguauggcgaacauauucagaggaucauaccuagcaggagcggguuuauuauuuagcaucaugaaaaauacuacuaacacgcgacgagggacuggaaaugugggggaaacgcuaggagagaaguggaagucgaggcuaaaugcucuagguaagucagaauuucaaauauacaaaaaaagcggaauucaagagguggaccguacucuagccaaagaggguauuaagcgaggugaaaccgaucaccaugcagugucucgagguucugcuaaauugcgaugguuuguagaaagaaacauggugacuccggaaggaaagguaguagaucuuggaugugggagagguggguggucauacuacuguggagguuugaaaaaugucagagaaguaaaagggcuuaccaagggagggccaggucaugaggaacccaucccaaugucaacuuauggcuggaaucuagugcgauugcaaagcggagucgaugucuuuuucacaccgccugagaagugugacacguuacucugugacauaggggagagcucaccaaauccuacaauagaagccggaagaacauuaagaguauugaauuuaguugaaaauuggcuuaacaauaauacucaauuuuguauaaaggugcugaauccguauaugccgucggugauugaaaaaauggaaacauugcagcgcaaauaugggggagcauuaguaagaaacccucuuagucggaacucaacucacgaaauguauuggguuucgaaugcaacagguaacauaguuucaucagugaacaugauaucucgaaugcuuauuaacagguuuacaaugaagcauaaaaaagcaacauaugagcccgacguagaucucggcucaggaacacguaauauugggauugagagugaaauaccgaacuuagauauuauaggaaaaaggauugagaaaaucaagcaagaacacgaaacuucuuggcauuacgaucaggaccauccauacaagaccugggcauaucacggaucauaugaaaccaaacagacuggaagcgcaaguaguaugguaaacggugugguacgcuuacucacaaaaccgugggaugucguccccauggugacccagauggcuaugacugauaccacuccauuuggucaacagagagucuuuaaggaaaaaguugauacacguacucaggaaccaaaagaagggacaaagaaauugaugaaaauaacugcaaaauggcucuggaaagaacugggcaaagaaaaaaccccuagaaugugcaccagagaagaauuuacacgcaaagugcggaguaacgccgcacugggagcgauauuuacagaugagaauaaauggaaaagugcgcgugaagcuguugaagaugguagguucugggaguugguagauagagaacggaaucugcaucuagaaggaaagugugagacgugcguauacaauaugaugggaaagagagagaaaaagcuuggagaguuugguaaggcaaaagguucccgggccauaugguauaugugguuaggagcuagguucuuggaauucgaagccuuaggauuucugaaugaggaucacugguucucaagaggaaauagccuaagcggaguagaaggugaaggacuacauagauuaggauauauacuacgugaagucgggaaaaaagagggaggggcaauguacgcagaugacacugcaggcugggacacgaggauaacacuagaagauuuaaaaaacgaagaaaugguaacgaaccauaugaaaggugaacauaaaaagcuagcagaggcaauauuuaaguuaacguaucagaacaaaguugugagaguacaacgaccaacaccuagaggaacagugauggacauuauaucaagaaaagaucaaagaggauccggacaaguaggaacauacgguuugaauacuuucacuaauauggaagcucagcuuauucgacaaauggaaggcgaaggaaucuuuaagaauauacaacaccucacugcuaccgaagagaucgcaguucaaaauuggcuggcaagagucgggcgagaaaggcuguccaggauggcaauuagcggagaugauugcguggugaagccaauugaugaccguuuugcaucugcauugacugcuuuaaaugauaugggaaaaguucgaaaagacauucagcaaugggaaccuucucgggguuggaaugacuggacccaagugccuuucuguagccaucauuuucaugaacuuguuaugaaggauggcagaguguuaguugucccuugcaggaaccaggacgaacuuaucgggagagcgagaauuucucaaggugccggguggucuuuaaaggaaacugcguguuuaggaaaaucauacgcacagauguggacuuuaauguauuuucauaggagagaucuacgacuugcugcuaaugcaauaugcagugcugucccaagucacugggugcccacuaguaggacaacuuggaguauacaugcuaaacacgaauggaugacgacagaagacauguuggcuguuuggaaucguguauggauacaagaaaacccuuggauggaagacaaaacgccgguagaauccugggaagaaguuccauaucuaggaaaaagggaagaucaguggugcggaaguuugauuggguuaacuagucgagcaacgugggcaaagaacauacaaacugcgauuaaccaaguuagauccuugauagggaaugaaggauauacggauuacaugccauccaugaagagauuuaggagggaggaggaggaagccgggguacucugguga

SEQ ID NO: 22197 - RNA, 9876 nt, Artificial Sequence
  derived and/or modified CDS sequence (opt6) from DENV-2__KP188553__SS-prME
acggcaggaguuauuguaaugcuaaucccaacggcaauggcguuucauuuaacgacuagaaauggugaaccgcauaugauaguaggaagacaggaaaaagggaaaucauugcuauucaaaacugaagacggggugaauaugugcacauugauggcuauugauuuaggcgaauugugugaagacacaauuacuuauaaaugcccacuucuaaggcagaaugaaccggaagacauagauuguuggugcaacagcaccaguacauggguaacuuacgguacaugcacuaccacaggagaacaccgacgagagaaaagaucuguagcccuaguuccgcacguagguauggguuuagaaacucgaacugaaacguggaugucuucagaaggagcauggaaacauguccagagaaucgaaacguggauacuacgacauccaggguuuacgaucauggcagcuauauuggcauauacaauaggaacaacacauuuucaacgagcauugaucuucauauugcugacagcgguagcgcccuccaugacaaugcgcugcauaggaauaaguaaucgggacuuuguugaaggaguuaguggcggaaguugggucgauauaguauuagaacacgggucauguguuacaacaauggcgaaaaauaaaccaacauuagauuucgaauuaauaaaaacagaagcaaaacaacccgcaaccuuaagaaaauacugcauugaagcaaaacuuacaaauacgacaacugaaucgagauguccuacacaaggcgaaccuucauugaacgaagaacaagauaaaagauuuauuuguaaacacaguaugguugaccguggauggggaaauggaugcggccuuuuugggaaagguggaauaguuacaugugcaauguuuacaugcaagaaaaauauggaagggaaaaucguacaaccagaaaaucuagaauauacuauaguuauuacgccacauucgggagaagaacaugcgguagguaaugauacggggaagcacggaaaagaaauuaaaaucacuccucaaucauccacaacagaagcagaauuaacaggcuaugggacagugaccauggaauguuccccucguacagguuuggauuucaacgaaaugguauuauuacaaauggaggacaaagcauggcugguacaucgccaaugguucuuagacuuaccgcucccuuggcuaccuggagcugacacucagggaucgaauuggauucaaaaggaaacauuagucacuuuuaagaacccccaugccaagaaacaagaugugguaguucucggaucacaagagggggcaaugcauacagcuuuaaccggugcaacggaaauacaaaugaguucagggaaccuucucuucacagggcaccugaaaugcagacuuagaauggacaaauuacaauuaaaggggaugucuuacuccaugugcacuggaaaauucaaaauaguuaaagagauagccgaaacacaacaugggacuauaguaauaagagugcaauacgaaggugacgguuccccgugcaaaauccccuuugaaaucacugaccuggagaaaaggcacguuuuaggaagacuuauaacuguuaacccaauaguaacagagaaagacucgccagucaauauugaagccgaaccaccauucggagauagcuauauaauaguagggguagagccgggccaauuaaaacuaaacugguucaagaaaggaucaucgauuggucaaauguuugaaacuacaaugcgaggcgcaaaacgcauggcgaucuugggugacacagcuugggacuucgguucacugggcggaguuuucaccucaauuggaaaggcucugcaucaaguauucggagcuauauauggagcggcauuuagcggcgugucuuggacuaugaagauauugauuggugucaucauaacuuggaucgguaugaacucaagaucaacgucgcuuucgguaucucucgucuuagucggaguuguaacauuguaucuaggagcuaugguacaagcagauucagggugcauaguaucauggaaaaacaaagaguuaaaaugugggucuggaaucuuuauaacggauaacguucauacuuggacugaacaauauaaauuccaaccugagucaccuucaaaauuagcuagcgcuauucaaaaagcacacgaagagggaauaugugguauacguaguguuaccagacuugagaaccuuauguggaaacagauuacaccugaacucaaucauauauugucugagaaugaaguaaaacugacaauaaugacuggagacaucaagggcauaaugcaggcaggaaagagaucucuacgaccacaaccuacugaauuaaaguauaguuggaaaacaugggggaaagcaaaaauguuaucgacagaaagucacaaucaaacauuucuuauagacgguccugaaaccgcagaguguccaaacacaaauagagcauggaacucguuagaaguggaggauuaugguuuuggggucuuuacgacgaacauuugguuaaaacugcgugaaaagcaggauguauuuugugacagcaaacucaugucagcagcgauaaaggacaacagggccguacacgcggauauggguuauuggauugaaagugccuuaaacgacacguggaaaauggagaaagccucguucauagaggucaaaucuugccauuggccaaagucucauacacuguggucaaacgggguauuagaaagugaaauggugauacccaaaaacuucgcuggacccguuucacagcacaauuauagaccggguuaucauacccagacugcaggccccuggcaccuaggaaaauuagaaauggauuuugauuucugcgagggaacaaccgucguaguaacagaagacugugaaaaacgaggcccuuccuugagaaccacuacugcaagcgggaaacucauaacugaauggugcugcaggaguugcacuuuaccaccauugcguuaucguggagaagauggaugcugguacggaauggaaauaaggccuuuaaaggaaaaagaagaaaaucuggucaacagccuaguaacggcagggcauggucaaauagacaauuuuagucuggggguuuuagggauggcauuauuucucgaagagaugcuuaggaccagggucgguacaaaacacgcuauucuucuuguugcauuaucuuucguaacuuuaaucacaggaaauauguccuuccgagacuugggaagagucauggucaugguaggagcaacaaugacagaugauauugggaugggugucaccuaccuagcucuacuugcugcauucaaaguacgaccuacuuuugccgcgggacuucuacuaagaaaacuuacgucuaaagaguuaaugauggcgacuauugguauagcauuauugagucaaagcacacuaccagaaacaauccuugaacuaacagaugcccuagcuuuaggaaugauggcuuuaaagauaguaagaaauauggaaaaguaucaauuggcgguaacgauuauggcaaucagcugugugccaaacgcggucauccuucagaaugccuggaaaguuuccugcaccauuuuagcagcagucagugucucaccucuauuacuaaccagcagucaacaaaaggcugacuggauaccuuuagcuuugacaauuaaaggacuaaacccaaccgcaauauuuuuaacuacauugagucgaaccaguaagaagcgaagcuggccacuaaaugaagcaauaauggcaguagggaugguuucaauauuggcgaguucgcuccuuaagaacgauauucccaugacuggaccuuuaguagcaggaggccugcuaacuguauguuacguucuaacagguaggucagcagaccuagagcuagaacgagcugcggauguuaaaugggaagaucaggcggaaauaaguggaucaucuccaauucucucaauuacaaucagugaagauggcagcaugagcauaaagaacgaggaggaagaacaaacccuuacaauccugauccgaaccggccuccuagugauaagugggguauucccaguaaguauccccauaacugcugcagcuugguaccuuugggaagugaaaaagcaaagagccggaguucuaugggacgugccaaguccaccaccuguaggcaaagcagaacuugaggauggggccuauaggauuaaacaaagagguauucuaggcuauagucaaauaggagccgguguguacaaggaagggacuuuucauaccauguggcauguaacaaggggcgcgguuuuaaugcaccguggaaaacguauagaacccagcugggcagacgucaagaaagauuugaucucauauggcgguggcuggaagcucgagggugaauggaaagaaggugaagaaguucaaguuuuagcccuagaaccggguaaaaauccccgugcaguucaaacaaagccuggaauauucaagacaaauacaggaacaauaggagccguaaguuuagauuuuucuccugguacuucagguucgccgauuguagaccguaagggaaaaguaguaggucuauauggcaacggugugguaacaaggaguggugcauauguaagugcaauagcacagacugaaaaaucuauagaagauaacccggaaauugaggacgacauuuuuagaaagaaaagacugacuauaauggaccugcacccuggagccgguaaaacaaaaagauaucugccagcaaucguuagggaagcaauaaaacguggauugcgcacacuuauuuuagcaccgacacguguaguagcagcggaaauggaagaggcuuuaagggguuuaccuauacguuaucaaaccccggcaaucagagccgaacauaccggcagagagauuguugaccuuaugugucacgcaaccuuuacgaugagacuauuaagcccaguaagagugccaaacuacaauuuaauaauaauggaugaggcccauuuuacggacccagcaagcauugcagcacggggguauaucaguacgagaguggagaugggugaagcugcaggaaucuucaugacagcaacgccaccaggcuccagagauccuuuuccucaaaguaacgccccaauaauggacgaagaacgagaaaucccagaaagaagcuggaacuccgggcacgaaugggugaccgauuuuaaagggaaaacgguaugguuugucccuucaaucaaggcagguaaugacauugccgcauguuugcguaaaaaugggaagaaagucauaccguauucgagaaaaacauuugauucagaauacguuaaaacaagagcaaacgauugggauuuugucguaacaacugauauuucagagaugggcgcuaacuuuaaagcagagagggucauugacccaagaagaugcaugaaaccagucauauuaacugauggugaagagagagugauacuagcugguccuaugcccguaacgcauaguagugccgcacagcgccgagggcguauugggaggaacccuaaaaaugaaaaugaucaauauaucuauaugggagaacccuuagaaaaugaugaagauugcgcacacuggaaagaagcaaaaaugcuucuagauaauauuaauacaccagagggaauuaucccgagcauguucgaacccgagcgcgagaaaguggaugcuauugacggagaauaccgucuaagaggcgaggcacguaagaccuucguagauuuaaugaggcgaggugaccuaccuguaugguuggcauauaaaguugcugcagaaggcaucaacuacgcagaucguaaguggugcuuugacggcauuaaaaauaaucaaauccuugaggaaaacguagaaguugagaucuggacaaaggaaggagagcgaaagaaauuaaaaccuagaugguuagaugcaagaauauacucggacccguuagcacuaaaagaauuuaaagaauuugcagccggaaggaaaucacuuacucuuaauuuaauuaccgaaauggguagacuccccacauuuaugacgcaaaaagcaagaaaugcacucgauaaucuagcuguauuacauacugcggaggugggaggaaaagccuacacacacgcccuuagugaacuccccgaaacccuagaaacacuacuuuuauuaacauuacuagccgcggugacgggugguauauuuuuauuucuuaugucgggaaaagguauuggaaagaugacacuugguaugugcuguauaauuacggcaucaauacuacuaugguacgcccaaauacaaccucacuggauugcugccucuauaaucuuagaguucuuuuuaauaguauuacuaauuccugaaccagaaaaacaaagaacaccacaagauaaccaacugacauauguaguuauugccauauugaccguggucgcagccacaauggcuaaugaaaugggauuuuuagagaaaacaaagaaagaccuagguuuugggagcauaacgacccaggaaagcgagucuaauauuuuagauauugauuugcgaccagcuagcgcuuggaccuuauaugcgguagcgacaaccuuuguuacaccaauguuaagacacucuauagaaaauucaaguguaaaugucucacuaacugcaauugcaaaccaggcaacgguacucaugggucuuggaaaaggauggccuuuaucuaaaauggauauaggugucccucuacuagcuauaggguguuauagucaagucaacccuauaacccuaacagcggcauuacugcuucuaguagcacauuaugcgauaauugggcccggucuucaagccaaagcuacuagagaagcccaaaaacgggcugccgcgggaauuaugaaaaacccaacaguagauggcaucacaguaauagaccuagaaccaauuccuuaugacccaaaguucgagaagcaauuaggacaggucaugcugcugauauuauguguaacacaaguucuaaugaugagaacuacuugggcguuaugcgaagccuugacccuagcaacaggucccauuucaaccuuaugggaaggaaaucccggacguuuuuggaauacaacgaucgccgugucaauggccaacauauuucgcggaucguaucuugcaggggcuggucuauuguucucaauaaugaaaaacacuacgaauacccgacgaggaacagguaacguaggcgagacacuuggugaaaaauggaaauccagguuaaaugcccuaggaaaaucagaauuucagauauauaagaaaucaggaauacaagaaguagauagaacucuagcaaaagaagguauaaagagaggugaaacugaccaucacgcaguaagcagaggaagugcaaaauuacgaugguuuguagaaaggaauaugguaacuccagaaggcaaagugguggaucuaggauguggcagaggaggauggaguuacuauuguggaggacuuaaaaacguacgcgaagucaaaggccuaacaaaaggcggacccggccacgaggaaccgauaccgauguccacuuauggauggaaucuuguaagacuccaaucuggcgucgauguauucuuuacuccuccagagaaaugcgauacauuguuaugugauauaggagaaucuuccccaaacccaacuauagaagccggcagaacacuaagggucuugaacuugguugaaaauuggcuuaacaauaacacacaauucugcauuaaaguguugaacccuuacaugccgucgguaauagagaaaauggagaccuuacaaagaaaauaugguggcgccuugguuaggaauccgcucaguagaaacucaacacacgaaauguacuggguuucgaacgcuacagggaauaucguuagcucaguaaacaugauuucaaggauguugauaaaucgguucacaaugaaacauaagaaagcgacguaugaaccugaugucgacuugggaucuggaacacguaauauuggaauugagucagaaaccccuaaccuugacaucauagguaagcgaauagaaaagauaaaacaagaacacgagaccaguuggcacuacgaccaagaucacccauauaaaaccugggcauaucacggguccuacgaaacuaagcagacuggauccgcauccaguaugguuaaugggguuguucgccucuugacaaagccuugggauguugucccgaugguaacacaaauggcaaugaccgacacaaccccauuuggacaacaacggguauucaaagaaaaagucgauaccagaacacaagaaccaaaagagggaaccaagaaauugaugaaaaucacagcggaaugguuauggaaggaacuaggcaaggaaaagacaccaagaaugugcacacgagaagaauuuacucgaaaagugaggucuaaugcagcuuugggagcaguauucacugaugaaaauaaauggaagagugcaagagaagcuguagaggauggccgauuuugggaauugguggaucgagagcgaaacuuacauuuagaaggaaaaugugaaacuuguguguauaauaugauggggaaaagagagaagaaacuaggugaauuugguaaagcuaaaggcucuagagcuaucugguauauguggcugggugcaagauuccuagaguucgaggccuuaggcuuucuaaacgaagaucauugguucucgcgagggaacagucuaucaggcguagaaggggaaggccugcaccgacuaggauauaucuuacgugaaguugguaagaaagaaggcggagcaauguacgcagaugacacugcuggcugggacacgagaauuacgcuggaagaucucaaaaaugaagaaaugguaacuaaucacaugaaaggugaacauaagaaacuggcagaggccauauuuaaauugacguaccagaauaaaguggugcguguccaacgcccgacaccucgaggaacagugauggacauuauuucuagaaaagaucaaagaggcucuggacaaguagguacuuaugguuuaaauacguuuacgaacauggaggcccaacuaauacgccaaauggaaggcgagggaauauuuaaauccauccaacaucucacagcuacagaagaaaccgcuguucaaaacugguuagcaagaguaggccgugagagacuuucgcgcauggcuauaucaggagacgacuguguaguuaaaccaauagacgacagguucgcgucugcacuuacugcuuugaaugauauggguaaagucaggaaagauauacaacaaugggaaccaucaagaggauggaaugacuggacacaagugccauucuguucucaucauuuccaugagcuaguaaugaaggauggaagaguuuuaguagugcccugccgaaaucaggacgaacuuaucggacgagcuagaauuucucaaggagcagguuggagucuaaaagaaacugccugcuuaggaaaaaguuacgcucagauguggacacuaauguacuuucaucgccgcgaucuacgucuagccgcaaaugcuauuuguucagccguuccuucacauugggucccuacgaguaggacuacaugguccauacacgcaaaacaugaguggaugacaacagaagauauguuggcgguuuggaauagaguauggauccaggaaaacccguggauggaagauaaaacacccguugaaagcugggaagagguuccauaccuggguaaaagagaagaccaaugguguggaagccuaauuggacucacaagcagggcaacuugggcuaaaaauauacaaacugcgauaaaucaaguaaggucuuuaaucgguaaugaaggcuacacagauuauaugccaucuaugaagcgcuuuagaagagaagaagaggaagcaggagucuuaugguag

SEQ ID NO: 22198 - RNA, 9876 nt, Artificial Sequence
  derived and/or modified CDS sequence (opt6) from DENV-2__KP188556__SS-prME
acugcuggugugauugugaugcuuauaccaacugcaauggcauuucauuuaacuacuagaaacggggaaccucauaugauaguagguagacaagaaaaagggaaaaguuuacuauuuaaaacugaagauggggucaauaugugcacauuaauggcuauagauuuaggggaauuaugcgaagacacaauaaccuacaaauguccuuuauuaaggcaaaaugaacccgaagacauagauuguugguguaacagcacuucaaccugggucacauacgguacuuguacaaccacaggugaacauaggagagaaaaacguucaguagcuuuaguaccacauguugggauggguuuagaaacacgaacggaaacguggaugagcagugaaggcgcauggaaacauguacaacgaauagaaacauggauucugagacauccuggguucacgauuauggcggccauacuggcauacaccauagggacuacacauuuccaacgugcauuaauauuuauacugcuuaccgcaguggcacccuccaugaccaugagguguauaggaauaagcaauagagauuuuguugaaggagucaguggugguucauggguugauauagucuuagaacacggcucuuguguaacuacaauggccaaaaauaaacccacauuagauuuugaacuaaucaaaaccgaagccaaacaaccagcuacccuaagaaaauauugcauugaagcuaaacuaacaaauacuaccacggaaucuagauguccaacucaaggggaaccaucauuaaacgaagaacaagacaaacgcuucaucuguaaacacagcauggucgaccgugguuggggcaacggaugcgguuuguucgguaaagguggaauaguuacuugcgcaauguuuacaugcaagaaaaacauggaagguaaaauaguacaacccgaaaaccucgaauauacuauuguaauaacuccacauucgggagaggagcacgcuguagguaaugacacugggaaacacgguaaagaaauaaaaauaacaccacaauccucgaccacagaagcagaauugacgggcuacgguacaguuaccauggaauguucuccacgcacuggacuagauuucaaugaaaugguccuauuacaaauggaggauaaggcuugguuaguucaucgacaaugguuccuagaucucccacugccaugguuaccaggggcggacacgcaaggcucgaacuggauacagaaagaaacucuuguaacuuucaaaaauccacacgcuaagaaacaggacguggugguacugggaagucaagaaggagcgaugcacaccgcacuaacuggagcgacugaaauacagaugucuaguggcaauuuauuauucacaggacaucuaaaaugcagauuaagaauggacaaacuacaacuuaaaggcaugucguacucuauguguacgggaaaguucaaaauaguuaaagaaauugcugaaacacaacaugguacaauaguaauaagaguacaauacgagggugaugguaguccuugcaagauaccauucgaaauaaccgauuuagagaaacgacacgugcuuggacgauuaauuacuguuaaucccaucguaacagaaaaagauucuccagugaauauagaagcggagccgcccuucggugauucuuauauaauagucgguguugaaccaggucagcuaaaacuuaacugguuuaagaaaggauccagcauaggccaaauguuugaaacaaccaugaggggagcaaaaagaauggcaauuuuaggagacacugcaugggauuuugguagucugggcggaguauuuacaaguauaggaaaagcauuacaucaaguuuucggcgcaauauacggagccgccuuuuccggugucucauggacuaugaaaauacuaauuggaguaauaauaacauggauaggcaugaauagcagaaguaccaguuuaucagucucccuaguauuaguuggaguaguaaccuuauaucugggcgcuaugguacaagcagacuccggauguaucgugaguuggaaaaacaaagagcuuaaaugcgggaguggaauuuuuauaacugauaacguucauaccuggacugagcaguauaaauuucagccggagagucccucaaaacuagcaucagcaauacagaaagcgcacgaagaaggaauauguggcauuagaucaguaacucgacuagaaaauuugauguggaaacaaaucacaccugaauuaaaccauauauugucagaaaacgaagugaaauugaccauaaugacgggagacauuaagggaauuaugcaagcggggaaaagaucuuuacgaccucaaccaacagaauugaaauauucguggaaaacaugggguaaggcaaaaaugcugucuacugaaucucauaaccaaacguuuuuaaucgacggacccgaaacugcugaaugccccaacacgaauagagcuuggaacucacuugaaguggaggacuauggauuugguguuuuuaccacaaacauaugguuaaaacucagagaaaaacaagauguauucugcgauucgaaacugaugagugcggcgauaaaagauaaucgugcaguucaugcagauaugggauacuggauagaauccgcacugaacgauacguggaagauggagaaagcauccuuuauagagguaaaaucuugucauuggcccaaaucccauacgcuuuggucaaauggaguccuagaaucagagaugguuauccccaaaaauuucgcugggccuguaucacagcacaacuaccgaccgggcuaucauacacaaacagcaggcccguggcaucuaggaaaacuagaaauggauuuugauuucugcgaaggcacaacaguuguagugaccgaagauugugaaaagaggggaccaucauuaagaacaacgacggcaucagguaaauugauaacagaaugguguuguagaucuuguaccuuaccaccacuccgauacaggggagaggauggaugcugguacgggauggaaauacggccacucaaagaaaaagaagaaaaccugguaaauagucuagugaccgcaggucauggucaaauugauaacuucucucugggaguacuaggaauggcacuauuccucgaagaaaugcuuaggacucgaguugggaccaagcaugcaauuuuauugguagcauuaaguuuuguuacacuaauaacagggaauaugucauucagggacuuaggaagaguuaugguaaugguaggcgcaacaaugacggaugacauaggaaugggugugacauaucuggcacuacuugcggcuuuuaagguccgaccuacauucgccgcaggucuauugcuuagaaaauugaccucaaaggaauugaugauggcuacuaucggaauagcguuacuaagucagagcacacuccccgaaacaauauuggaacucaccgacgcccuagcacuaggaaugauggcguuaaagauagucaggaacauggaaaaauaucaauuagcgguaacaauaauggcaauaucuuguguuccuaacgcuguuauacuacagaaugccuggaagguaaguugcacuauucuagcagcgguaagcgugagcccccuacuucugacaucaucgcaacaaaaagcagauuggaucccgcuugcguuaacuauaaagggacuaaacccaacagccauauuucucacaacgcuaucaagaacuagcaagaaaaggagcuggccacuaaacgaagccauaauggcugucgguaugguaagcauucuagccagcucauuacuuaaaaacgauauaccuaugaccgggccuuuggucgccggaggacuucuuacagucuguuauguccuaacaggcagaucagcagaccuggaguuagagagggcagcagauguuaaaugggaagaccaagcugaaaucucgggaagcucgccgauccuaucuauaacaaucucagaagauggcucaaugucgaucaaaaacgaagaagaagaacagacgcuuacgauucuuauacgcacaggccuauuagucauuucugggguuuucccaguaucaauaccgauuacagcggcagcuugguaucuaugggagguuaagaagcagagagcaggcgucuugugggauguaccuagcccuccaccaguaggcaaagcagaacuagaggauggagcguacagaauuaaacaaagaggaauacuaggauauagucaaaucggggcugguguuuauaaggaggguacguuucacacuauguggcauguaacgcgaggagccguucuuaugcauagaggaaaaaggaucgaaccaaguugggcggauguuaagaaggacuuaauuuccuaugguggaggauggaaacuagaaggcgaauggaaagaaggggaagaagugcaaguguuggcacuagaaccaggaaagaauccacgggccguacaaacaaaacccgguauuuucaaaacgaauaccggaacaauaggugcuguuucccuugacuuuaguccaggaacaucagggucaccuauaguugacaggaaagguaaggucguaggccuauacgggaauggcguuguaacaagaucaggugcuuacgucagcgccauagcucaaacagaaaaaucaauagaagauaaccccgaaauugaggaugacauuuuuagaaagaaaagauuaacaauuauggaucuccaccccggggcugguaaaacaaagagguauuuaccagcaauaguacgagaagcgauaaaaagagguuuaagaacacuuauacuggcaccuacgcgcgugguugcagcggaaauggaggaagcucucagagggcugccuauuagauaucaaacuccugcaauuagagccgaacauacgggccgcgaaauuguagauuugaugugccacgcaacguuuacuaugagacuauuaaguccagugcgaguacccaauuacaauuugauuauuauggaugaagcacauuuuaccgauccagcgagcauugcagcaagaggauauaucagcacacgcguagagaugggcgaagccgcuggcauuuucaugaccgcgacaccaccaggcagucgugacccuuucccgcaaucuaacgcacccauaauggaugaagagagggagauccccgagagaucuuggaacucaggucaugagugggucacugacuucaaaggcaaaaccguuugguuuguuccgucaauaaaagcagggaaugacauagcugcaugcuuacguaaaaacgguaaaaaggugauucaacuuucgaggaaaacuuuugauucagaauauguaaaaaccagagcaaacgauugggacuucguaguuacgacggauauaucagaaaugggcgcaaacuucaaggcggaaaggguaaucgacccaagaaggugcaugaaaccgguuauuuuaacggacggugaggaaagaguuauuuuggcaggcccaaugccaguaacacauaguagugcugcacagagaagaggcagaauaggacgaaaucccaaaaacgaaaaugaucaauacauauacaugggggaaccauuggaaaaugaugaagauugugcucauuggaaagaagcuaagaugcuauuagauaauauuaauacaccagagggaauaauucccucgauguuugaaccagaaagagaaaaaguagaugcuaucgacggagaauaccguuuaaggggagaggcaagaaagacuuucgucgauuuaaugagacggggagaucuuccgguaugguuggcauauaaaguagcagccgaggguauaaauuacgcagauaggaagugguguuuugaugggaucaaaaacaaccaaauccuugaggaaaauguagaaguggaaauauggacgaaagaaggagaacgaaagaaauugaaaccaaggugguuagacgcaagaauauauuccgacccauuggcucuaaaagaauuuaaagaguucgcagccggaagaaagagcuuaaccuuaaauuuaauaacugaaaugggccgacuaccaacguuuaugacccagaaagcaagaaaugcacuagauaaccuagcaguucuacauacugccgaaguaggagguaaagcauauacucaugcacuuagugaauuaccagaaacguuagaaacacuauuguuacucaccuuauuagcugcugugacuggaggcauauuccuguuuuuaaugucugggaaaggaauaggaaagaugacuuuaggaauguguugcaucauuacagcaucgauacugcuuugguacgcucagauacagccacauuggauugcagccaguaucaucuuagaguucuucuuaauaguauuauuaaucccagaaccagaaaaacagagaacaccccaggacaaucaauuaacguacguugucauagcuauuuuaacaguggucgcggccacgauggcgaaugagaugggauucuuagagaaaaccaagaaagaucuuggguuugguucuaucacuacacaagaaagugaaucuaacauuuuagauauagaucuaagaccugccagugccuggacauuauaugcaguagcuacgaccuucgucacaccaaugcuuagacacagcauagaaaauaguaguguuaaugugagucuuacggcuauagcaaaucaagcaacuguacucaugggucuggggaagggguggccacucuccaagauggacauuggagugcccuugcuugcgauaggauguuacucacagguaaacccgauaacuuuaacagcugcuuuguuauuauuaguagcucauuacgcuauaauaggaccuggucuucaagcgaaagcgacgagagaggcgcagaagcgugcugccgccgggaucaugaagaauccaacgguugaugguaucacagugauugaccucgaacccauuccucaugauccaaaguuugaaaaacaguuaggucaaguuauguuacugauucugugcguaacccaaguuuugaugaugcguacaacaugggcacucugugaggcuuuaacauuagcuacaggcccaauuucaacauugugggaagguaacccgggaagauuuuggaacacaacaauagcggugagcauggcuaacauauuucguggaucauaucuagcuggcgcugguuugcuauuuucuauaaugaagaacacuacuaauacucggagaggaacugguaauguaggugagacucuuggggaaaaguggaaaucaagacuaaaugcgcucgguaaaagcgaguuccagauuuacaagaaaaguggaauccaagaagucgacagaacauuagcuaaagaagguaucaagcgaggugaaacagaucaccaugcgguuucucggggaagugcaaaguuaagaugguuuguagaaagaaacauggucacgccagaagggaaagugguagaucuaggaugugguagaggaggauggagcuauuauuguggcggacuaaagaacguucgagaaguuaaaggucucacgaaaggagggcccggacaugaggagccuauaccaaugagcacauauggcuggaaccugguuagauuacagucuggggucgaugucuucuucacuccucccgagaaaugcgacacguuauuaugcgacauaggcgagagcaguccuaauccaacuaucgaagcugggcgaacacuuaggguacuuaacuuagucgaaaacugguugaacaauaacacacaguuuuguauaaaaguauuaaaucccuauaugcccagcguaauagagaaaauggaaacguuacaacgcaaguacgguggagcauugguuagaaauccuuuaucaagaaauucgacgcaugaaauguacuggguuaguaaugcgacggguaauauuguuagcucuguaaauaugauaagcagaaugcugauaaacagguucacgaugaaacacaagaaagcgacuuaugagccggacguagauuuaggaagcggcacgagaaauauugggaucgaaucagaaacacccaaucuagauauaaucgguaagcgaauugaaaagauaaaacaagaacaugagacgucuuggcauuacgaucaggaucaccccuauaagacuugggcguaucacggaucguaugagacgaaacagacagguagcgcuucaucaauggugaacggaguuguacgucuucuaaccaaaccaugggacgucguaccgaugguuacgcagauggcuaugacagauacuacgccauucggucaacaacgaguuuuuaaagaaaagguugacacacggacacaagagccaaaagaagggacuaagaaauuaaugaaaauuaccgcugaauggcuguggaaagaacuaggaaaggagaaaacaccaagaauguguacacgagaagaauuuacucgcaaaguaagaaguaacgcugcauugggcgccguauucacagaugaaaauaaauggaaaucagcgcgagaagcaguagaggacggaagauuuugggaacugguagaccgagaacgcaaucuacauuuggaaggcaaaugcgaaacauguguauauaauaugauggguaaaagagagaagaaauuaggugaguucggcaaagcaaaagggagucgagcgauaugguauauguggcugggagccagguuucuggaauuugaagcacuaggauuucuaaaugaggaucauugguucucgagaggaaacucuuugucuggugucgagggcgaaggauuacacagauuagguuacauauuacgagaagugggaaagaaagaaggaggggcaauguaugccgaugauacggcggguugggacacucguaucacauuagaagaucuuaaaaacgaagagauggugaccaaucauaugaaaggugaacauaagaaacuagcagaagcgauauuuaaacuaacauaucaaaauaaaguaguucgcguacagagaccaacuccacgcgguacugucauggacauaauaucacguaaagaucagcgaggaucgggacaagugggaacguauggauugaauaccuucaccaacauggaggcucaacugauucgucaaauggaaggagaagggaucuucaaaucaauacaacauuuaacagcaacggaagaaacagcaguucaaaauuggcuagcuagaguaggucgagaaagacuuucaaggauggcaauaaguggggaugacugugugguuaaacccauagacgauagauuugcuagcgcacuuacugcacucaaugacaugggaaaaguccgaaaagauauacaacaaugggaaccgucgcgaggguggaacgacuggacccaagucccauuuugcagucaucauuuccacgaacugguaaugaaagauggacgugucuugguugucccaugccggaaucaagaugaauuaauugguagagcgagaauaagccaaggagcagggugguccuuaaaggagacugcuuguuuaggaaagucuuacgcccaaauguggacacucauguauuuucaucgcagggaccuaagauuagcagcaaaugcaauaugcuccgccgucccgucgcauugggucccgaccucacggacaacuuggaguauccacgcuaagcacgaguggaugacuacugaagauauguuagccguuuggaauagagucuggauucaagagaauccuuggauggaagauaaaacuccaguagagaguugggaagaaguaccauaucugggcaaaagagaagaucaaugguguggcucgcuaaucggcuuaacaucacgugcgaccugggcgaaaaacauacagacagcaauaaaccagguuaggucccugaucgguaaugaaggauauacggauuauaugccaucuaugaaacgauuucguagagaggaagaagaagcuggugucuuaugguaa

SEQ ID NO: 22199 - RNA, 9876 nt, Artificial Sequence
  derived and/or modified CDS sequence (opt6) from DENV-2__GU369819__SS-prME
accgcaggcgucauagugauguuaauaccuacagcaauggcauuucauuuaacuacgagaaacggcgaaccacauaugaucgucggacgucaagaaaaagggaaaucuuuguuauuuaaaacggaagauggagugaauaugugcaccuugauggcgauagaucugggggaauuaugugaagauacaauaacuuauaaauguccauuauuaagacaaaaugaaccagaagauauugauuguugguguaauucaacgaguacauggguaacuuaugguacaugcacgacuaccggagaacaucguagagaaaaacgaucuguggcuuuagucccgcauguugggauggguuuagaaacaagaacugaaaccuggaugagcucugaaggagcauggaaacacguacaaagaauagaaacauggaucuuaagacauccggguuuuaccauuauggcugcuauucuugcauacacgauaggcacgacucauuuccaaagagcauuaaucuuuauacucuuaacugcaguagcgcccucaaugacaaugagaugcauugguauaucaaauagagauuucguagagggggucagugggggcucauggguagauauuguauuggaacaugguucaugcgucacgacuauggcuaaaaacaaaccaacacuagacuucgagcuaaucaaaacugaagcaaaacagccugcaacauugcggaaauauuguaucgaagcgaaauuaacgaauacaaccacggaaucacgauguccaacccaaggagagccuucuuuaaacgaagaacaagauaaaagauucauauguaaacauucuaugguugaucgugggugggguaauggauguggcuuauuuggaaaaggagguauugugacaugugcaauguuuacuugcaagaaaaauauggaaggaaaaguaguucagcccgaaaaccuggaguauacgauagugauuacgccacauaguggggaggaacaugcuguaggaaaugacacaggaaaacacggcaaagaaauuaaaauaacaccucaaucgaguauuacagaagcugaacuuacaggcuaugguacgguuacaauggaauguucuccaaggacggggcuagauuuuaaugagaugguauugcuacagauggaaaauaaggcauggcuaguacacagacagugguuccucgacuugccacuaccauggcugccuggugcugacacgcagggaagcaacuggauucaaaaagagaccuuaguuacuuucaagaauccucaugcaaagaaacaagaugugguugugcuaggaagucaggagggagcaaugcacacagcauuaacaggagcuacagaaauccaaaugucuucagggaaucucuuguuuacagggcaucuaaaaugcagauuaagaauggacaaacuacaauuaaaaggaauguccuacaguauguguaccggaaaguucaaaauagucaaggagaucgcugaaacccagcaugggacaaucguaauaagaguacaguacgaaggugacgguagcccauguaaaauaccauucgaaauaacagaccuagagaaacgccauguacugggaagacuuauuacaguuaauccuauagugacagaaaaggacucgccugugaauauagaggcugaaccuccguucggugauaguuauauaauuauuggaguggaaccaggucaacuuaaguugaauugguuuaagaaaggauccaguaucggccagauguuugagacuaccaugagaggagcaaaacgaauggcuauauugggugauacagccugggacuuuggaagucuagggggugucuuuacaucaaucggcaaggcgcuacaccaagucuuuggagcuauuuauggcgcagcauucucgggaguuucauggaccaugaagauuuuaauuggagucauuauuacauggauaggaaugaacuccagaagcacaagucuaucggugucucuaguucugguaggaguuguuacguuauaccuaggagccaugguuagagcugacagugguuguguggucaguuggaaaaauaaagaguuaaaauguggaucaggaauauucauaacagauaauguacauacauggaccgagcaauacaaguuccaaccagaauccccuagcaaauuagcaagcgccauucaaaaggcucaugaagaaggcauuugcgguauucgcagugucacucgauuggagaauuuaauguggaagcagauaacgccugaacucaaccauauacucucagaaaaugaagucaaauuaacaaucaugaccggagauaucaaagggaucaugcaagcaggaaaacguagucuucgcccacaacccacggaguugaaguauucauggaaaaccuggggaaaagcgaagaugcugucuacugagagccauaaucaaacuuuccuuauagacggaccagaaacggcagagugcccaaacacaaauagagcauggaauagccuugaaguugaagacuauggauucgguguauuuacaacgaacauuuggcucaaacuccgggaaaaacaagauguauuuugugauuccaaacuaaugagcgcugcgauaaaggauaaccgcgcgguacaugcggauaugggauauuggauugaaucggcacugaacgauaccuggaagauggagaaagcuaguuuuaucgaaguaaaaagcugucauuggccaaaaucacauacuuuauggaguaacggaguccuagaguccgaaaugauaauccccaagaauuucgcuggaccuguaagucaacauaacuauagaccaggcuaccauacacagacagcuggcccauggcaucuaggaaaacuggaaauggauuuugaucuaugugaagguaccacaguaguugugacagaggacugcggaaaccguggacccagcuugagaacgacgaccgccaguggaaagcuaauaacggaauggugcugcagaagcugcacccuaccuccgcucagauauagaggggaagacggguguugguacggaauggagauaaggccauuaaaggagaaagaagaaaauuuagugaacuccuuaguuacagccggacauggacagaucgacaauuuuucuuuagguguacuaggaauggcauuauucuuagaggaaauguugagaacacguauaggaacuaagcacgcgauacuauuaguggccguuucauucgucacauuaauuacuggaaauauguccuuuagggauuuagggagaguuaugguaaugguaggugcuaccaugacagacgauauaggcaugggcguaacauaccuagcgcuacuggcagcauuuaagguuagacccaccuuugcagcagguuuacuacugcgaaaacugacaagcaaagaauuaaugauggcaacaauuggaauagcacuauuaagccaguccacgauaccagaaacgauccucgaacuaacugacgcccuagcauuaggaaugaugguucugaaaauaguccgaaauauggaaaaauaccaauuagcaguaacgauaauggccauaucauguguacccaaugcagucauucuacaaaaugcguggaaaguauccuguaccauucuggcugcgguuuccguaucacccuuguuauugacaaguucacaacaaaaagcagacuggauaccuuuagccuuaaccauuaaaggauugaacccaacagcaauauucuuaacaacucuuagccguacauccaaaaagagaagcuggccgcuaaaugaagcaauaauggcagucggcaugguaucaauacuagcaucaucacuguuaaagaacgauauuccaaugacaggcccauuaguagcuggcggucuacuaacugugugcuacgugcuaacagguaggagugcugacuuggaacuggaacgcgcggcagacguuaaaugggaagaucaggcggaaauaucuggguccucacccaucuuauccauaacgauuuccgaagaugggucaaugaguaucaagaacgaagaggaggagcaaacguuaacuauuuuaauaagaacaggacuguuaguaauauccggaguguucccuguuagcauaccuauaacagccgccgcaugguauuuaugggaagugaagaaacaaagagccgguguucuaugggauguaccgucuccgccacccgucgggaaagcugaguuagaggauggcgcauaucguauaaagcagaaagguauucuagguuauagccaaauuggagcggguguguauaaagagggaacauuccacacaauguggcauguuacucgcggugcagucuuaaugcaccgugguaaacgaauugagccuaguugggcugacguaaagaaagaccuuaucuccuauggugggggcuggaaacuugagggcgaauggaaggagggagaggaaguucaaguccuugcuuuggagccugggaagaacccaagagcaguacaaaccaaacccgguauuuucaaaacuaauacaggaaccauaggugcaguaaguuuagauuucaguccagggacaagcgguagcccuauaguagauagaaaaggaaaggucgucggccuuuacgguaauggcguuguaacuaggaguggagccuacguaucugcgauagcucaaacagagaaaagcauugaggacaauccugaaauugaggacgauauauuuaggaagaaacgauuaacuauaauggaucuucauccaggagcgggaaaaacuaaacguuaccuaccagcgauugucagagaagcaauaaagcgcggucugagaacacuaauacuggccccaacgcgaguaguggcggcagagauggaggaagcacugaggggacuaccuauaagguaucagaccccagccauaaaaacugaacacacgggcagagaaauuguggaccuuaugugccaugcaacauuuaccaugagauuacuaucuccaguaaggguacccaacuacaauuugauuauaauggaugaagcucacuuuacagauccagccucuauugcggcuagaggauauauaucaacccgaguugaaaugggagaagcggcuggcaucuucaugacagccacaccaccagguucgagagauccuuuuccucagucuaacgcuccaauaauggaugaggaacgagagauacccgaaagaucauggaacucagggcacgaauggguaacagauuucaaaggaaaaacaguaugguuuguaccgagcauaaaagccggcaaugacauagcagcuugucuuaggaaaaaugggaagaaaguuauccagcugagcaggaagacuuuugacucagaauauguuaagacuagagcgaaugauugggauuuugugguaacgacugauaucagcgaaaugggagcgaauuuuaaggcggagagaguuaucgacccaagaagguguaugaagccaguaauacuaacugacggcgaagaacgugucauccucgcuggcccaaugccugugacccauaguagugcggcucaaagaagaggaagaauagggagaaaucccaagaacgaaaaugaucaauacauauauaugggggaaccccucgaaaacgaugaggauugugcucauuggaaagaagcaaaaaugcuucucgacaacauaaauacgccugaaggcaucauuccaagcauguucgagccugagcgugagaaaguugacgcuaucgacggggaguaucgccuuagaggagaagcaagaaaaacuuuuguagacuuaaugcgacguggugauuugccugucugguuggcauacaaaguugccgcagagggaaucaauuacgcugaucgaaaaugguguuucgacggaauuaagaauaaucaaauccuagaagaaaauauugagguugaaauauggacgaaagaaggugaaagaaagaaacuuaagccacgaugguuagaugcgcggauauauagugaucccuuagcacuuaaagaauuuaaggaguuugcugcaggaagaaaaucauuaacccuaaaucugauuacagagaugggucgucuuccuacuuucaugacacaaaaagcaagaaacgcauuagacaauuuggcaguauuacacacagcagaagcaggaggccgggcguacaaccacgcuuuaagcgaguugccagaaacacuagagaccuuauuacuucucacauuacuagcgacuguuacugggggcauauuuuuguuuuuaaugaguggucgagggauagggaaaaugaccuuaggcauguguugcauaaucacugcuucuauacuucuaugguaugcacaaauacaaccgcacuggauugcugcaucaauuauauuagaguucuuccuuauaguauuauuaauaccagagcccgagaaacaaagaacgccacaagauaaucaacuaaccuacguugugaucgcuauucucaccguaguggcagcaacuauggcaaaugagaugggauuuuuagaaaagaccaagaaagacuuagguuugggaaguaucaccacucaagaaagugagucuaauauauuggauauugauuuacgcccggcuucugcuuggacacuuuaugcaguagccacgacauuugucacgccuauguuaagacacucaauagaaaauucgagcguaaaugugagucuaaccgcaauagcaaaucaagcaaccguccuuaugggacucgguaagggauggccuuugagcaaaauggauaucgggguuccucuacuagccauuggguguuacucacaggugaauccaauaacucucacggcagcguuacuauugcuagucgcacacuacgcaaucauuggucccggguugcaagcgaaagcgacaagggaggcgcagaaacgggcggccgccgggauaaugaaaaacccaacuguggacggaauuacaguaauagaccuagagcccauaccuuaugacccuaaauucgaaaagcaauugggccaaguuauguuauuaauccuguguguaacacaaguacuaaugaugagaacaacaugggcacuaugcgaagccuugacauuagcaacuggcccuaucucgacauuaugggaagggaauccaggucgauuuuggaauacgacgaucgcaguaaguauggcaaauauuuucagggguagcuaccucgcuggggcaggacuuuuguuuucgauuaugaaaaauacaacuaauacacgccggggaacgggaaauauuggugaaacauuaggugaaaaauggaaaaguagauuaaaugcacuaggaaaguccgaguuccaaguguauaagaaaucggggauacaggaagucgacagaacuuuagcgaaagaaggaaucaagagaggagaaacugaccaucaugcggucagccgagggucggcaaaacuaaggugguuuguugagcguaacaugguuaccccagaagguaagguaguagaucuuggguguggcaggggugguuggaguuauuauugcgggggacuaaagaauguucgagaagugaaaggauuaacuaaagggggaccuggacacgaagaacccauaccuaugucuacguauggauggaacuuaguucggcuacaaucggggguggacgucuucuucacacccccagagaaaugugacacacuacuaugugauauaggggaauccucuccaaauccaacgaucgaggcagggaggacacuuagaguccuaaacuuaguugaaaauuggcucaacaauaacacacaguucugcauaaaaguacuuaacccuuauaugccaaguguuauagagaaaauggaagcauuacagagaaaauauggcggggcucuggucagaaaucccuuaucucguaacucuacucacgagauguauuggguaagcaaugcaacuggaaauaucguaagcucugugaauaugauuagccggauguuaauaaauagauucacuaugaaacauaaaaaggcgacauacgaaccugauguugauuugggcucgggcacacgaaacaucggcaucgaaucagaaauaccuaauuuggauauuauagguaaacgaaucgagaaaauaaaacaggagcaugaaacuagcuggcacuaugaccaagaccacccuuacaagacaugggcauaccaugggaguuacgaaacuaaacaaaccgguuccgcaaguucaaugguuaacggggucgugcgacuauuaacaaaacccugggacguguuacccaugguaacucaaauggcaaugacagacaccacgccguucggacaacaacgagucuuuaaagagaagguggacacacguacacaagaaccgaaagaggguacuaagaaauuaaugaaaauaacagccgaguggcuauggaaagaauuaggaaagaaaaagacuccaaggauguguacucgcgaagaguuuacucggaaagucagaucaaaugcagcgcucggugcaauuuuuacggaugaaaauaaguggaaaagugcacgcgaagcagucgaagauggaagauucugggagcuaguggauagagaacguaauuuacaccuagaagguaaaugcgaaacgugcguauauaauaugaugggaaagagggagaagaaacucggagaguucggaaaagccaaaggcagccgugcaauuugguauauguggcuaggagcacgauuucuagaguucgaggcauugggauuccuuaacgaagaucauugguucucacgaggaaauucucuuagcgggguugaaggugaagggcuacauagacuugguuauauucucagggauguaggaaagaaagaaggcggagcuauguaugcagacgauacugccggcugggauacccggaucacguuagaagaucuuaaaaaugaagaaaugguaacgaaucauaugaaaggggaacacaagaaauuagcagaagcuauuuuuaaauugaccuaucaaaauaaaguugugagaguucaaaggcccacuccacgaggcacaguaauggauauaauaucaaggcgugaucagagggguaguggacagguuggaacauacggucugaauacuuuuaccaacauggaagcacaacuaauucgacaaauggaaggcgaaggaaucuuuaaaucuauacagcaucuuacggcaacugaagaaauagcgguacaaaauuggcuggcgagagucgguagagagcgauuaaguagaauggcaaucucuggagacgacugcgucguuaaaccaauagaugaccguuuugcuagugcauuaacagcacuaaacgauauggguaaagugcgaaaagauauucaacagugggaaccuucacgcggcuggaaugauuggacucaaguacccuucuguagucaccacuuucaugaauuagucaugaaagacgguaggguacuugucgucccuugcagaaaucaggacgagcuuauagguagagcacgaauuucacaaggggcaggauggucacugaaagaaacggcgugucuuggaaaauccuaugcacaaauguggacgcuuauguacuuucaucguagggauuuacgguuagcugcaaaugcaauuuguagcgcuguacccccucauuggguaccuacgaguagaacuacauggucaauccaugcgaaacaugaguggaugacuacugaagauaugcuggcaguauggaauagagucuggauucaagagaauccauggauggaagauaaaacgccuguagaaucaugggaagaagugccauaucugggcaaacgagaggaccaauggugcgguucucuuauuggucugacaagcagagcaacuugggcgaaaaauauacagacagcuauuaaucaaguuaggucacuaauagguaaugaagaauauacagauuacaugccauccaugaaaagguucagacgugaggaagaagaagcaggcguacuaugguga

SEQ ID NO: 22200 - RNA, 9876 nt, Artificial Sequence
  derived and/or modified CDS sequence (opt6) from DENV-2__JX649147__SS-prME
acagcugguguaauuauuauguuaaucccuacagcaauggcauuucauuuaacgacaagaaacggagaaccacauaugauuguggggcgacaagaaaaagggaaaucauuauuauucaaaacugaagacgggguaaacaugugcacuuuaauggcgaucgacuuaggagaacuuugugaagauacuauuacguacaaaugcccacuauuaagacaaagugaaccggaagacauugauuguuggugcaauaguaccucaacuuggguaacuuacgguacauguacaacuacaggagaacacaggcgggaaaaacguagcguagcucuuguaccucauguugggaugggucuugaaacacggacggaaacguggaugucaagcgaaggugccuggaaacacgcacaacguauugaaacuuggauuuuaagacauccuggguuuacaaucauggccgcuauacuugccuauacaauaggcacaacacauuuucaaaaagcacucauuuuuauccuacuaacugccguugcacccaguaugacgaugagaugcauuggcauaucaaaucgugauuuuguagaaggaguaucaggcgguagcuggguagauaucguauuagaacacgggaguuguguaacaaccauggccaaaaacaaaccuacucuugauuuugaauuaaucaaaacugaagccaaagaacccgccacucugagaaaauacugcauagaagcaaaacucacaaauacuacaacagaaucaagauguccuacacagggugagccaucacuuaaugaggaacaggacaaacguuuuguauguaaacacagcaugguggauaggggaugggggaacggaugcggcuuauucgggaaagggggcauagucacuugugcaauguuuaccugcaagaaaaauauggagggaaaaaucguacaaccagagaaucuagaguacacuauaguaauuacaccccauucgggagaagaacaugcgguaggaaaugacacagggaaacauggaaaagaaauaaaaauaacaccacaaucuaguaucacugaagcagagcucacgggcuacggaacaguaaccauggaaugcucuccaaggacgggacucgauuuuaaugaaauggugcuucuucaaauggaagauaaggcuuggcuuguacaccgacaaugguuccuagauuugccucuuccuuggcuuccaggugcggauacccaagguucgaauuggauucagaaagaaacccucguuacauucaaaaauccccaugcgaagaaacaagauguagucguacucgggucacaagagggugcgaugcauaccgcccugacaggcgcaacugaaauucaaaugucaucaggaaacuuauuauuuacaggucauuuaaaaugccguuuacguauggauaaacuacaguuaaaagguaugucauauucaaugugcacgggaaaauuuaaaauuguuaaagaaauagcagaaacccagcaugggacaauuguuauuagaguccaauaugaaggggacggaucgccgugcaaaauaccauucgagaucauggacuuggaaaaacgucacguacuuggacgacugauaacgguaaaucccaucguaacagaaaaagacagcccuguaaacauugaagcagagccuccauuuggcgacagcuauauuaucauagggguugagccuggccaacucaaauuaaauugguucaagaaagguucaucaaucggacaaauguucgagacaacgaugcgaggagccaaaagaauggcaauucuuggagauacggcuugggauuuugguucacugggaggaguauuuacgucuauagguaaagcucuacaucagguauucggcgcaauuuauggagcagcguuuucgggaguaucuuggacuaugaaaauucuuauagggguaauuauuaccuggauagggaugaacagucgaucuacgucauugucugugagucuugucuuaguagguguuauaacuuuguacuugggagcgauggugcaggccgacaguggcuguguaguuaguuggaaaaauaaagaacuaaaaugcgguagugggauuuuuauuaccgauaacguucauacuuggacugaacaauauaaauuucaaccagaguccccuucgaaauuagcuucagcaauacagaaagcucaugaagaagguaucugcggaauaaggucaguaacacgacuggaaaaucuaauguggaaacaaauuaccccugaguuaaaucacauacuaagugaaaacgagguuaaauugacgauuaugacuggugacaucaaagggauuaugcaggcgggcaaacggucucugcgaccacagcccacagaacuuaaauauucguggaaaacauggggaaaggcaaaaauguuaagcaccgagucacauaaccaaaccuuucuaauugacgggccagaaacagcagaaugucccaacaaaaauagagcauggaacucguuggaaguagaggauuauggauuugguguauuuacaacaaauauaugguugaagcuaagagagaagcaggacguauucugcgauucgaaacuaauguccgccgcuauuaaagauaauagagcuguacacgcggauauggguuauuggauagaaucagcucuuaaugauacguggaaaauggaaaaggcaaguuuuaucgaaguaaaaaguugucacuggccaaagagccauacucuauggaguaacggaguucuagaaucugagaugauaaucccuaaaaguuucgcagguccugucucacaacacaauuauaggcccgguuacuacacccaaacugcaggaccauggcauuuaggaaaacuggaaauggacuuugauuucugugaagguaccacuguagucgucacggaagauugcggcaauagaggaccuucauuaaggacuacuacagcgucuggcaaacuaauuacugaauggugcugccgaaguuguacacucccaccauuacgguauagaggggaagacggauguugguauggaauggagauucguccccucaaagagaaagaagaaaacuuaguuaacagucuagugacugcaggccacgggcaaauagauaauuucagcuuagggguucuaggaauggcgcuuuuucuagaagagauguugaggacccgaguuggaacaaaacaugcaaucuuacuuguagcgguuagcuucguaacgcugauaacagguaauaugucauuuagggauuuggggcgagugaugguaaugguaggugcgacuaugacggacgacauagguaugggcguaacuuaucuagcauuguuagcagcuuucaaagugaggccuacauucgcggcuggacuacugcugaagaaauuaacaagcaaagaauuaaugauggcuaccaucgggauagcgcuacuuucccaaucaacuauaccagaaacaauauuggaacucacggacgcuuuagcacucggaaugaugguguugaaaaucgugaggaacauggaaaaauaccaauuagcagugacaauaauggcgauaucaugcgugccaaacgcgguaauacuucagaaugcuuggaaaguuuccuguaccauacuagcagcaguuucagucucaccccuacuacugacaucaucacaacaaaaggccgauuggauaccccucgcguuaacaauuaaaggguugaaucccaccgcgauuuuucuaaccacgcugagucgaacgagcaagaaacgaaguuggccguugaaugaagcaauaauggcaguaggcauggugucgauucucgcgagcagucuacuaaagaacgacauuccgaugacagggccauuggucgcaggaggacuauuaacaguauguuacguucuaacaggaagaucagcagaucuugaauuagaaagggcuacagauguaaaaugggaagaccaagcggaaaucucuggaucaagucccauauuauccauuacaaucucugaagacggcucaaugaguaucaaaaaugaggaagaggaacaaacucugaccaucuugauucgcacgggccuacuggucauaaguggacuauucccaaugucgauaccuaucacagcagccgcgugguaucuaugggaaguuaagaaacagcgggccgguguauuaugggacguuccaucacccccuccgguagguaaagcugaauuagaagauggugcuuacaggauaaaacaaaaaggcauucuugguuauagccaaauuggggcggguguuuauaaagaaggaacauuccauacaauguggcaugucacacggggagcaguauuaaugcacagaggaaagcgaaucgaaccuuccugggcggauguuaagaaagaccuuaucucauauggcggagguuggaaauuagaaggagaauggaaagaaggcgaagaaguacaaguucuggcauuagaaccgggcaaaaacccaagagccguucaaacaaaacccggucuauuuaaaacuaauacaggaacaauaggggcaguuucucuagauuucaguccgggaacuucaggauccccaaucguagauaggaaagguaaaguaguagguuuauacggcaacggcguaguuacaaggucaggagccuaugucucugcgauagcacaaaccgaaaaaucuauagaagacaauccagagauugaggaugacauauuuagaaagaaacgccuuacgauuauggaucuacacccgggugcaggaaagaccaaacgauaucuaccagcaauugucagggaagcuauuaaaaggggguuacguacacugauauuggcuccaacgaggguaguagcagcagaaauggaggaggcuuuaagaggauugccaauccgauaucaaacgcccgcuauaagggcagaacauacuggacgagagauuguugauuuaaugugucaugcaacauucacuaugcgguuauuaucaccuguuagaguuccaaauuacaauuuaaucauaauggaugaagcccauuucacagacccugccucuauagcagcaaggggguauaucaguaccagaguggaaaugggggaagcagcagguauuuuuaugacugcaacgccuccuggaucaagagauccguuuccacaaagcaaugcuccgauuauggacgaagaaagagaaauuccugaaagaaguuggaacucaggccaugaguggguuaccgauuuuaaagguaagacggucugguucgugccuucuaucaaagcaggaaaugauauagcagcgugcuuacguaaaaaugguaagaaaguaauacaguuaagucgaaaaacguuugacagugaauauguaaaaacgagaacaaacgauugggacuucguaguaacaacugacauaucagaaaugggcgccaauuucaaagcagaaaggguuauagacccuagaaggugcaugaaaccggucaucuuaacagauggggaggaaagagugauauuagcuggaccaaugccaguuacacauuccagugcagcucagcgucguggccguauuggacggaaccccaaaaacgaaaaugaucaguacaucuauaugggagagccacuagaaaacgaugaagacugugcucauuggaaagaagcuaagaugcuacuagacaauauaaauaccccagagggaauaauaccuucuauguucgaaccugaaagagaaaagguggacgcgauagacggggaauaucgguuacgaggcgaggcacgaaaaacguuuguagaccugaugcgacguggggaucucccaguauggcuagcauaucguguugcugcggaagguauaaacuacgcugaucgacgaugguguuuugauggagucaaaaacaaucaaaucuuggaagaaaauguggaaguggagauauggacaaaagaaggagaacgaaagaaauuaaaaccacgcugguuagaugcuagaauauacagugacccuuuggcgcuaaaagaguuuaaagaauuugcugccgguagaaaaucacuaacacuaaacuuaauuacagaaauggguagguuaccaacuuuuaugacacaaaaggcaagagacgcacuagacaaucuagcgguuuugcauacugcugaggcaggcggaagggcuuauaaucaugcacuaagugaauuaccggagacauuagaaacguuauuauugcuaacacuacuagccacaguuacagguggaauauuuuuauuucuaaugagcggcaaagguguagguaaaaugacacuaggcaugugcugcauuaucaccgcaaguauucugcuaugguaugcacagauccagccgcauuggauagcagccucuauuauucuagaguucuuuuuaauuguucugcuuaucccagaaccagaaaaacagagaacuccucaagauaaucagcugacauacguuguaauagcaauuuuaaccguagucgcagcuacuauggccaaugaaaugggauuucuugagaaaacaaagaaagauuuaggcuuggguagcauugccacacaagaacccgagucaaacauucuugauauugaccuucgaccagcuucugcguggacccucuaugcaguugcgaccacauucguuacaccuaugcuacgacauaguauugaaaauaguucaguaaaugucagccuaacagcuauagcaaaucaagcaaccguauuaauggguuuaggaaagggcuggcccuuaucaaaaauggacauugggguaccauuguuggcaauagguuguuauagucaagugaaucccauuacuuugacugccgcccuacugcuacugauugcucacuaugcaauaauugguccgggacuccaagcaaaagcaacucgugaagcgcagaaacgcgcagcagcaggaaucaugaaaaaccccacuguagauggaaucacuguaauagaucuagaucccauaccauacgacccuaaauuugaaaagcaguuaggucagguuaugcuauugauauuaugcguaacacaagugcuuaugaugcgcacaacgugggcccuaugcgaggcguuaacucuagcaacaggaccgauuucgacacucugggaagguaacccuggccguuuuuggaacacaaccaucgcuguaucuauggcuaauauuuuucgaggaucauaucuagccggcgcuggacucuuauucucgauaaugaagaauaccacaaacacccggagagguacggguaacauuggugaaacauugggugaaaaguggaaaagccgauugaaugcccuuggcaaaucggaguuucaaauauauaagaaaucugguauccaagaaguugauagaacccuugcuaaagagggcaucaagcguggggaaacggaccaucaugccgugagcagaggcagugcaaagcuaaggugguuugucgaacgcaauauggugacacccgaagguaaaguugucgaucuuggguguggaagaggaggcuggaguuauuauuguggcggacuuaaaaauguaagagagguuaaaggacuaacaaaaggaggaccgggucaugaggaaccaauccccaugucuaccuacgguuggaaccuaguacggcuucagagcgggguagacguauuuuucaccccacccgaaaaaugcgacacuuugcuaugugacauaggugagucaagucccaacccgacgaucgaagccggacgcacucuucgaguuuugucgcuaguugaaaauuggcuaaauaaugacacacaauuuuguauaaaaguucuuaacccguacaugccaucgguaauagagaaaauggagacacuucaacgaaaguaugguggugcauuaguaaggaacccauuaagucguaauaguacccacgagauguauuggguuucuaaugcaaccgggaauauuguaagcuccguuaacaugaucucacgcauguugaucaacagguuuacgaugaaacauaagaaagcuacauacgaaccggacguugauuuagguucaggcacaagaaacaucggcaucgaaucagaaauuccaaauuuagauauuaucggcaaacggauugagaaaauaaaacaagaacacgaaacaucuuggcacuaugaucaagaucauccauauaaaacaugggcuuaucaugggaguuaugaaacaaagcaaacgggaucggcaagcagcaugguaaacggcgucguaagauuauugacgaaacccugggacguaguuccaauggucacacaaauggcgaugacugauacaacacccuucggucaacagagaguuuucaaagaaaaagucgauacaagaacacaagaaccgaaggaaggaaccaagaaauuaaugaaaaucacugcagaguggcuguggaaagaacuagggaagaagaaaacuccgagaaugugcaccagagaagaauuuacucgaaaaguacguagcaacgcagcuuuaggugcuauuuucacggaugaaaacaaauggaaaagugccagagaggcaguagaagauucgagauuuugggaauugguugauaaggagcggaacuuacauuuggaaggaaaaugugagaccugcguuuauaauaugaugggaaaaagagagaagaaauugggagaguucggcaaagcaaaaggaucaagagcgaucugguauaugugguuaggugcuagauuccuagaauuugaagcauuaggauuuuuaaacgaggaccacugguucucucgagaaaacucucuuucaggaguggaaggcgaggguuugcacaaacuaggauacauauuacgugacguaagcaaaaaggagggaggggcaauguaugcagacgacaccgcugguugggauacucgaauaacauuagaggaucucaaaaaugaggagauggucacuaaccacauggagggcgagcacaagaaacuagcagaagcaauuuuuaaauugacuuaucaaaauaaagucgugcgugugcaaagaccaaccccucgcgguacaguaauggacauaaucagcagaagagaccagagaggcucuggacaagucgguacguacgggcuaaauacuuuuacaaauauggaggcccaguuaauccgacaaauggagggugagggcauuuucaaaucuauccagcacuuaacagucacggaagagauagcaguacaagauugguuagcacgaguaggccgagaaagauuaagucgcauggcaaucucaggugacgacugcgucgucaagcccuuagacgacagguucgcaagcgcgcuuacagcguuaaacgacaugggaaaagucagaaaagacauacaacaaugggagccuucacgagguuggaaugauuggacucaggucccuuucugcucacaccacuuucaugaacuuauuaugaaagaugggaggguauuaguuguccccugucggaaccaggacgaauugauugggcgagcgcguauaagccagggcgcagguuggucccuuaaagagaccgcaugucuagggaaaaguuacgcacagauguggucuuuaauguacuuucaccgccgagacuugagauuagcagccaaugccauuuguucggcaguaccgucccacuggguuccaacgucuagaacuaccuggucgauacaugcaaaacaugaguggaugacaacagaagacaugcuaacaguauggaaucgaguauggauacaagaaaauccauggauggaagacaagacaccgguagagaguugggaggaggucccuuauuuaggaaagagggaagaccaauggugcgggagccuaauaggauuaacuagcagggcuacuugggcuaagaauauucaaacagcaauuaaccaaguccgaagucugauaggaaaugaagaguauacagauuauaugcccaguaugaagcgcuuuagaagagaagaagaagaggcgggggucuuaugguaa

SEQ ID NO: 22201 - RNA, 9876 nt, Artificial Sequence
  derived and/or modified CDS sequence (opt6) from DENV-2__KF704356__SS-prME
acugcagggaugauaauaauguuaauuccuacaguaauggcuuuccauuugacaacuagaaauggcgaaccccacaugauaguuucaagacaagaaaaaggaaaaucucuucuauuuaauacuggagaugguguucacaugugcacauugauggcaaugcauuuaggagaauugugugaagauacaauaacauauaaaugcccccucuuaagacaaaacgaaccugaagauauagauuguuggugcaauuccacaaguacauggguaacauaugggacaugcacuacaacaggugaacauaggcgugagaaaaggagugucgcacucguaccacacguuggaaugggacuugaaacccggacugaaaccuggaugucaucugagggugcauggaaacacgcgcagcgaauugaaacauggauuuugcgacaccccggauuuaccaucauggcggcgauacuagcauauacaauuggaacaacacauuuccaacgagcgcuuauauuuauuuuguugacugcagucgcucccucaaugacuaugcgauguauugguauaucaaacagggauuuuguggagggcguuucuggggguucaugggucgacauuguacuagaacaugguucguguguaaccacaauggccaaaaacaaacccacacuagacuuagaauuaauuaaaacugaggcaaaacaaccagcaacguugcggaaauauuguauagaggcaaaacuaacgaacacuacuaccgaaucaagguguccaacccaaggagaaccaagucuaaaugaggaacaggauaaacgguuuguuugcaaacacucgaugguagauagaggaugggguaacggaugcggguuauucggaaaaggauccauaguaacaugcgcuauguuuacguguaagaaaaucaugaaaggaaaaguaguacaaccggagaauuuagaauauacgaucgugauaacuccgcauaguggagaagaacaugcaguugggaaugauacaggaaaacacggcaaagaaauaaaaaucaccccacaaucuucgaucaccgaagcagagcuaacaggauaugguacagucacaauggaaugcuccccucguacuggucuugauuucaaugagaugguacucuuacaaauggaggauaaagccuggcuaguacaccggcaaugguucuuagauuugccacuaccuugguuaccgggugccgauacacaagggucaaacuggauacagaaagagaccuugguuacauuuaaaaauccucaugccaagaaacaagauguuguuguguuggguucucaagaaggugcuaugcauacagcauuaaccggcgccacagaaauacagaugucgucaggaaacgugcuauucacaggacacuugaagugccgucuucgcauggacaaauuacaauugaaaggaaugaguuacagcaugugcacugggaaauuuaagguaguuaaagagauagccgaaacucaacaugguacaauuguaauacguguacaauaugaaggagauggaagcccuuguaaaauaccauucgaaauaauggauuuggagaaaagacauguauuaggacgauuaauuacaguuaacccaauuguaaccggaaaggauucacccguaaacauagaagcggaaccaccuuucggugacucauauauuauuauaggaguggaacccggucaacucaaacucaacugguucaagaaaggauccucuauaggccagauguuugcaaccacgaugaggggugcaaaaagaauggcgauuuugggcgauacagcgugggauuuuggaaguuuaggagggguauucacuuccaucggaaaagcacuacaucagguguucggagcuauauacggcgcugcauucagcgguguaucuuggacaaugaaaauauuaaucggaguaauaauaaccuggauaggcaugaacucacgcaguacaucucuaagugugagccuaguucuaguggggguugucacauuguauuugggugugaugguacaggcugacagcgguugcguuguaagcuggaagaauaaggaauuaaaaugcgguagcggaauauuuaucacagacaauguacauaccuggacagagcaauacaaauuccagccugaaagcccauccaaguuagccucagcgauacagaaggcucacgaggaaggaauauguggaauuagguccguaacucgucuggagaacuuaauguggaagcaaauaacuccugaguuaaaccauaucuuguccgaaaaugaaguuaaacuaacaauaaugacuggagauauaaagggcaucaugcaagcaggaaagcgaagucucaggccgcagccaacagaguuaaaauauucauggaaaacaugggggaaagcgaaaaugcucucaacggaaagccauaaccaaaccuuuuuaauugacgguccagagacagccgaauguccuaacacaaaucgagcauggaacucacuugaaguagaagacuaugguuucgggguauucacaacaaacaucuggcuuaaauugcgcgaagaacaagauguuuucugcgacagcaaguuaaugucagcagccauaaaggauaaccgggcuguacaugcugauauggguuacuggauagaaucagcccuuaaugauaccuggaaaauugaaaaggcgucguucauagaaguuaaauccugccauuggccaaaaagucauaccuuauggucaaauggagugcuugaaucggagaugauaauaccuaaaaacuuugcaggaccagugucgcaacacaacuaccgcccuggauaucauacgcaaacagcagggccauggcauuuaggcaaacuggaaauggauuucgauuucugugaagguacgacuguuguugugacggaagacugugguaaucgaggacccagccuuagaacaacuacagcaucaggaaaguugauaacggaguggugcugucgaucaugcacacugccacccuugagauaucguggagaagacggauguugguacgguauggaaauaagaccauuaaaagaaaaggaagagaaccuagugaacagccuaguuacagcaggucauggacaaauagauaauuuuagucuaggcguccuaggaauggcacucuuccuugaagaaaugcuacguacuagagucgggacuaaacaugcaauccuauuaguugcugugucauucgugacauugauuacagggaacaugucauucagagaucuagguagaguuaugguaauggugggggcuacaaugacugaugauauugguaugggaguuaccuauuuagcacuccuagcagcauucaaaguccguccaacauucgcagccggucuauuguugcgaaaacuaacuagcaaagaacuaaugaugacaacaauaggcauaguauuauugucucaaucaaccauaccagaaacaauauuagaauuaacugacgcgcuggcguuggggaugaugguacuaaaaauggugcguaagauggaaaaauaucaacuggcaguaacaauaauggcaauccuauguguucccaacgcgguaauauuacaaaauacuuggaagguuucuugcacuauucuugcuguagucuccgugucaccacucuuccugacuucuucacaacagaaagccgauuggauaccccuagcacuuacaauaaaaggacugaauccaacugcgauauuccuaacaacauuaucaagaacuaacaaaaagcgauccuggccacugaaugaagcaaucauggcgguugguauggucucuauauuagcaucuucuuuacucaaaaacgacauacccaugaccgggccgcuaguugcuggaggucuuuuaacugucuguuacguacucacaggucguagugcagaccuugagcuggaaagggccgcugacgugaagugggaagaucaagccgaaauaucuggaagcagcccaauucuuucaauaaccaucucagaagaugguaguaugucuaucaaaaaugaagaagaggaacaaacucugaccauucuuaucagaaccggucuuuuaguaaucagcggacuuuuuccuguuagcauuccaauaacagcugcugcaugguacuugugggaggucaagaaacaacgagcaggcguacucugggauguucccuccccuccgcccguagguaaagccgaacuugaagauggagcauacaggauaaaacagaagggaaucuuaggcuacagucaaaucggagccgguguuuauaaagaagggacauuucacacuauguggcaugucacaagaggagcagugcuuaugcauaaaggcaaacgaauagaaccuucaugggccgacgucaagaaagaucugauaucguacggugguggauggaaacuagaaggagaauggaaagagggagaagaaguacaaguuuuagcacuggaaccagguaaaaacccaagagcaguccaaacgaaaccaggauuauucaaaacuaaugcuggaacaauaggagcagucucacucgacuuuagcccagguacgagcgggagcccuauuauugauagaaaagguaagguuguuggacuuuauggaaauggaguugucacccgcucuggagcauacguauccgcaauagcgcaaacugaaaaaucaauagaagauaauccggaaauugaagaugauaucuuuaggaagcgcaaauuaaccaucauggaucuacauccaggugcagggaagacaaaacguuauuuaccugcuauagugagggaagcuauaaaaagagguuuaaggacacuuauauuagcuccaacgagagucguagccgcggaaauggaagaagcucuaagaggccuuccaaucagauaucaaacgccagccauuagggcugagcacacgggcagagaaauuguugaccucaugugucaugccacauucacuaugcguuuguuaagcccugugagagugccaaauuacaaucuaaucauaauggacgaagcacacuucacugacccagcaaguaucgcugcacgaggauauauuucaacucgaguggaaaugggagaagcagcggguauauuuaugacugcuacaccuccagguagucgcgacccuuucccacaaucaaaugcuccuauaauggaugaggaacgagaaaucccagaacgauccuggucgagcggacaugaauggguaacagauuuuaaagguaaaacggugugguuuguaccaaguauucgagcuggcaaugauauugcugcuugccuuaggaaaaauggaaagaaagucauucagcucagucggaaaacguucgauucugaguacgugaagacacguaccaacgacugggacuucguaguaaccacggauauaucugagaugggagcaaacuucaaagcugaacgagucauugauccaaggagauguaugaagccaguaauauuaacggacggagaagaacggguaauacucgcagguccaaugccagugacgcauucuucagccgcccaacgaagaggacgaauaggacgcaaucccaaaaaugaaaacgaucaauacauuuauaugggggaaccauuggaaaacgaugaagauugcgcacacuggaaagaagcaaaaaugcuacuagauaauauaaauacgccggaaggaauuauaccuucgauguuugagccagaacgagaaaaggucgacgcgauugacggagaauacagguuaagaggggaagcgcgaaaaaccuuuguggaucuaaugcggcgaggcgaucuaccgguaugguuagcauauagaguagccgcagagggcauuaacuaugcggaucgaaggugguguuuugacggcauuaaaaauaaccagauacuagaagaaaauguugaagucgaaauauggaccaaagaaggugaacgaaagaaauuaaagccaagaugguuggacgcccgaauauauucagacccauuagcucuuaaagaauuuaaggaauuugccgccggcaggaaaucauugacacugaaucucauuacugaaaugggacgucuuccaacuuuuaugacacagaaagcuagagaugcauuagauaauuuggcaguauuacauaccgcugaagcuggaggcagagcauauaaucacgcacuuucugaguugccugagacacucgagacacuacuccuauugacguuauuggcgacagugacugggggaauauuuuuauuuuuaaugaguggacgaggcauaggcaaaaugacguugggaauguguuguauaauaacugcuagcauucuccucugguacgcucaaauucaaccacacuggauugcugcaucaaucauacuagaauuuuuccucauuguuuuauuaauaccagaaccugaaaaacaaagaaccccacaagauaaccaauuaacauaugucguaaucgcuauacuaacggucguugccgcaacaauggcuaacgaaaugggauucuuagagaaaacaaagaaagaccugggguuaggaagcauaacaacgcaacaaccagaaaguaauauuuuagauaucgauuugaggccggcuuccgcuuggacguuauaugcagucgcaacuaccuuugugacacccaugcugaggcauaguauagagaacucuucuguuaacgucaguuuaacagcgaucgcgaaucaggcaacagucuuaaugggacucgggaaagguuggccgcuuaguaaaauggauauagguguacccuuacucgcgauuggauguuauagccaggucaaucccauuacucuuacugcagccuuauuccuuuuaguugcacacuacgcuauaauaggaccggguuuacaagcgaaggccacaagagaggcucagaaaagagccgcugcaggaauaaugaaaaauccaacuguagauggcauaacggugaucgaucuggacccaauuccauacgaucccaaguuugaaaaacaacuaggucaagugauguuauugguacuuuguguaacucaaguucuuaugaugagaacuacaugggcgcucugcgaagccuugacauuggcaaccggaccgaucucaacucucugggaaggaaaucccggucgguuuuggaacacgacaauugccguaucuauggcaaacaucuuuagggguucguaucuagcaggagcuggucugcuauuuuccauaaugaaaaauacgacuaauacgcgucggggaacgggcaacaugggugaaacacucggcgaaaaguggaaaagucgcuugaacgcguuaggcaaaucugaguuucaaauuuacaaaaagucaggcauucaagaaguagacaggacacucgcaaaggaggggauaaagagaggugaaacggaucaucaugcagugagccgcggaucagccaagcugcgaugguuuguagaaagaaauaugguuacaccggaagguaaggucguugacuuaggcugugguagaggcggguggaguuauuauugcgguggacucaaaaacguuagagaagugaagggacucacuaagggaggaccuggccacgaagaaccgauaccaaugucaacuuauggguggaaccuagugagacuacaaucgggaguggacguauucuuuacaccgccugaaaaaugcgauacgcuucuaugcgacauaggagaaucaucaccaaauccuacaguggaagccggccggacauuaagaguucuaaaccucguugaaaacuggcuaaacaauaauacacaauuuugcauaaaaguucuaaaucccuauaugcccaguguuauugagaaaauggaggcuuugcaacguaaauacgggggugcgcuaguuagaaauccguuaucaaggaacaguacucaugaaauguauugggugaguaacgcuaguggcaauaucgugaguaguguuaacaugauaaguaggauguuaauuaaccgcuuuacgaugagacauaagaaggcaacauuugaaccugauguugacuuaggaucgggaacucgaaacauagguauugaaagugaaauuccaaaccuugacauaaucggcaaaaggauagaaaagauuaagcaagaauacgagacaucuuggcauuaugaucaggaccaucccuauaaaaccugggcauaccacggaucguaugagaccaaacaaacagguuccgcaaguucgaugguaaauggaguaguacguuuacugacgaaaccaugggauguaguaccgaugguuacucagauggcgaugacagacacuaccccauuugggcaacaaagaguuuuuaaagaaaaaguggauacgagaacgcaagaaccaaaagaggguaccaagaaacuaaugaagauuacagccgagugguuauggaaagagcuagggaaaaagaaaacaccgagaauguguacaagagaggaauuuaccagaaaaguaaggucaaaugcugcucuaggagcuauauuuacagaugagaauaaauggaaaucagcccgggaagcagucgaagauucaagauucugggaacucgucgacaaagaaaggaacuugcacuuagaaggaaaaugcgaaacgugcguauauaauaugaugggaaaaagagagaagaaacuuggcgaauuuggaaaagcuaaaggcagcagagcgauuugguauaugugguuaggugcgcgcuuucucgaguucgaagcucuagguuuccuaaacgaggaccauugguuuucucgagaaaacucgcuuucugguguagaaggggaggggcuacacaaauuagguuauauucuucgagauguaagcaagaaagagggaggagcuauguaugccgacgacaccgcggguugggauacaaggauuaccuuagaggaucuuaaaaaugaagagaugguaacaaaucauauggaaggagagcauaagaagcuggcugaagcuaucuucaagcuaacauaucagaauaaagucguaagaguucagagaccaacuccacggggcaccguaauggacauaauaucacgucgagaucaaagagguucuggacaaguaggaacauauggacuuaauacuuucacaaacauggaagcccaacuaauccggcaaauggaaggugaaggaguuuuuaaaaacauucaacacuuaacaguuacugaggaaauugcaguacaaaacugguuggcgcgaguuggacgagaaaggcuaagcagaauggcuauaucaggggacgauugcguaguuaaaccacuagaugacagauuugcaucagcacuaaccgcacuaaacgacaugggaaagguaagaaaagauauccaacaaugggaacccagccggggauggaaugacuggacucaaguuccauuuuguucacaccauuuucacgaauuaauaaugaaagaugggcgcguauugguagugcccugccgaaaccaagacgaacuaauagguagggcccguauaucucaaggggcaggauggucgcuuagggaaacagccugccuagguaaaucguaugcccaaauguggagucuaauguauuuucaucgacgcgaucuuagacuagcugcgaacgcaaucugcagugccguacccagucacugggugccaaccuccaggaccacguggaguauucaugcgaaacacgaguggaugacaaccgaagauaugcuaacuguuuggaaccguguguggauccaagaaaaucccuggauggaagacaaaacucccguagaaaguugggaagaaauaccuuaccugggaaaacgggaagaucaauggugugggucucuaaucggacucacaucccgugcaacuugggccaaaaacauccaaacugcgauaaaucagguacgaagucugauaggaaacgaagaauacacugauuacaugccaucaaugaaacgguuucgaagagaggaagaggaggcugguguacuuugguaa

SEQ ID NO: 22202 - RNA, 9876 nt, Artificial Sequence
  derived and/or modified CDS sequence (opt6) from DENV-2__KF704355__SS-prME
acugcagggaugauuauaauguuaauuccaacuguuauggcauuccauuuaacaacucguaauggcgagccacauaugauuguaagucggcaagagaaagguaaaagucuacuauuuaaaacuggggauggugugaauauguguacacuaauggcaauggaccugggcgaacuuugugaagauaccauaacauauaaauguccguuucuacgacaaaaugagccagaagauauugacuguuggugcaauucaacaaguacuuggguaacauacgguacuugcacaacuacgggugaacaucgacgcgaaaaacgaaguguagcacucguuccucaugucggaaugggucuugaaacacgaacugaaacauggaugaguucggaaggugcauggaaacacgcccaaaggaucgaaacuuggauauugaggcaccccggauuuaccauuauggcagcgauacuagcguauacaaucggcaccacacauuuccaacgagcuuuaauauuuauacuguugaccgcuguggcuccaucaaugacgaugcgauguauagguaucuccaauagagauuucgucgaagggguaucaggagggucaugggucgacaucguacuugaacauggaaguugugucacaacaauggccaaaaauaaaccuacacuggaucuugaacuaauuaaaacagaagcaaaacaaccagcaacccucagaaaauacuguauagaagcgaaauugaccaacaccacaacggaaucaagaugcccgacucaaggggaaccaucauuaaaugaagaacaggacaaacgauucgucugcaaacacaguaugguggaucggggguggggaaacggcugcggauuauuugguaaaggaucaaucguaacaugugccauguuuacuuguaagaaaauaaugaaaggaaaaguaguacagccggaaaaccuagaguacacuauaguaauuaccccacauucaggugaagaacacgcuguagguaaugauacuggaaaauauggaaaagaaauaaaaauaaccccacaaaguaguauaacugaagcagagcuaacuggauauggcacgguaacaauggaguguucgccacgaacgggccucgauuucaacgaaaugguuuuauugcaaauggaagauaaagcauggcuuguucauagacagugguuucuugaucucccauuaccaugguugccaggggccgauacacaaggaucaaacuggauccaaaaagaaaccuuaguaaccuucaaaaacccacacgcgaagaaacaagacgucgugguuuugggcucucaagaaggugcaaugcauaccgcccuaacuggcgcgacagagauacaaaugucuucgggcaacguguuauuuaccggacauuuaaaaugucgccuacgaauggauaaacuucaacuuaaaggcaugaguuacagcauguguacugguaaauuuaaaguaguaaaagaaaucgcagaaacgcaacacgguacgaucgugauuagagugcaauaugaaggagacgggucuccuuguaaaauuccauuugaaaucauggaccuugagaaaagacacguccuggguagguuaauaacagugaauccaaucgucaccggaaaagauucgccuguuaauauugaagcagaaccacccuuuggagacuccuauauaauuaucggcguggaacccggacaauuaaaauuaaauugguucaagaaaggcagcuccauaggacagauguucgggacaacaaugcgaggugccaaacguauggcaauccuaggagacacugcaugggauuuuggaucacuuggagggguauucacaagcauaggaaaggcuuuacaccaagucuucggugcgauauacggagcagccuuuaguggcguuucauggacaaugaagauccuaacagguguuauaauaacauggauuggcaugaacucccggucuacaucacugucgguuucacugguauuagucggaguagucacuuuauaucuggguguuaugguacaggcagauagugguugcgugguuaguuggaagaacaaggaauugaaaugugguaguggcaucuuuauaacagauaacgugcacacguggacugaacaguauaaauuucaaccagagucuccaaguaaauuggcaucggcuauccaaaaagcacaugaagaaggaauaugcggaauaaggucagucacuagacucgaaaaucucauguggaaacagaucacgccggaacuaaaucacauauuaagugagaacgagguaaaacucacaaucaugacaggagauauaaaagguauaaugcaagcugguaaaagaagccuuaggccucaaccaacugaacugaaguacucauggaaaaccuggggaaaagcuaagauguugucuacagaaagucauaaucaaaccuucuugaucgaugguccugaaacagccgaauguccuaauacaaacagggccuggaacucucuugaagucgaagacuacggauucggaguuuuuacaaccaauauuuggcugaagcugagagagaaacaggacguauucugugacagcaaacuuaugagcgccgcaauaaaagacaauagagcgguacacgcagacaugggcuauuggauagaaagugcacuuaacgacaccuggaaaauagaaaaagcaucauuuauugaagugaaaaguugucauuggcccaaaagucacacuuuauggucuaauggaguacucgagagcgagaugauuauacccaaaaauuuugcggguccgguuucccaacauaauuauaggccaggguaucacacucagacagcaggaccauggcaucucggaaaauuagaaauggacuuugacuuuugugaaggaacaacaguuguggugacugaagauugcggaaauagaggcccauccuuaagaacgacaacagcguccggcaaguuaauaaccgagugguguuguagaucauguacccuaccaccguuacguuaucggggugaagauggaugcugguauggaauggaaauacgaccauuaaaggaaaaggaagagaacuuaguaaauuccuuaguaacagcuggacaugggcaaauagacaauuuuucgcugggggugcuaggaauggcauuauuccuugaagaaauguuacguacgagaguagguacaaagcacgcgauucuacuuguagcggugucuuuuguuacacucaucacugguaauaugaguuuccgcgaccuaggaagagucaugguaaugguaggagcgacgaugacagaugauauagguaugggagucacuuauuuagcguuauuggcagcauuuaaaguuagaccaacuuuugcggcuggacuauuauugagaaaacuaacauccaaagaacucaugaugacgaccauagggauaguccucuugucgcaaucaacgaucccugaaacuauacuagagcuuacggacgcacuagcccuuggaaugaugguucuaaaaauggugagaaaaauggaaaaauaucaacuagcuguuacgauaauggcuauuuuaugcguaccuaacgcugucauacuccaaaaugcauggaaagugagcugcacuauauuggcaguuguaucuguuucuccacuuuucuuaacaaguagucaacaaaaagcagauuggauaccgcuagcauuaaccauuaaaggucuuaauccaacugccauuuuccuuacgacuuuaagccgaacaaauaagaaaagaagcuggccacugaacgaagcaaucauggcgguuggaaugguuucgauccuagcuucaucauuguuaaagaaugacauuccaaugacugguccgcucguagcuggugggcuucuaaccguguguuauguacuaacaggacgcucagcagaucucgaacucgaaagagcagcggacgucaaaugggaagaucaagccgaaaucaguggaaguucuccaauucuuagcauaacaauauccgaagauggaagcaugucgauaaagaaugaagaagaagaacaaacgcuaacgauauuaauaagaacgggucuauuagucaucucugguuuguuuccaguaucgauaccaauuacagcagcagcuugguaucuaugggagguaaagaaacaacgcgcuggaguauuaugggacgucccgaguccuccaccaguggguaaagcagaacucgaagauggcgcuuaccguauuaagcagaaagguauacuaggauauucgcaaauuggcgcaggcguauauaaggaggguacauuccauaccauguggcacguaacgcggggugcuguuuuaaugcacaaggggaaaagaauugaaccgucaugggcugauguuaaaaaggaccuaauaaguuauggagggggcuggaaacuugaaggugaauggaaagagggggaagaaguucaaguuuuagcauuagaaccugguaaaaacccaagagcugugcaaacuaagcccggucuauuuaagacaaacgcuggaacaauuggcgcgguaucucuugauuuuucgccuggcacuucaggaucgccuauaauugauaggaaaggaaaaguagucggccuuuacggcaacgguguagucacgagaaguggagcguaugucucagcgauagcacaaacugagaaaaguauagaggauaacccagaaauugaagaugauaucuucagaaaacguaaacuuaccaucauggaccuacacccaggagcggguaagacuaaacgauaccuacccgcuaucguaagggaagcaauaaaaagggguuuaagaacccucauauuagcaccuacaagaguaguugcagcugagauggaagaggcccuaagggguuugccgauaagauaucagacgccugcgauaagagccgagcacacuggucgagaaauaguggauuugaugugccaugcuacuuuuaccaugcgacuauuaaguccaguaaggguacccaauuacaaucuaauuauaauggaugaagcacauuucacugauccagcgagcauagcagcacguggauauauuucgaccagaguugaaaugggagaggcugcuggaauauucaugaccgccacgccgccaggaagcagagaucccuucccacaauccaaugcuccuauuauggaugaagagagggaaauuccagagagauccugguccaguggacaugagugggucacagauuucaaaggaaagacuguuugguucguuccgucgauaagggcagguaacgauaucgcagccuguuugcguaaaaacggcaagaaaguuauacagcuaagccguaagaccuuugacucugaauaugucaaaacucgaacaaaugacugggauuucguaguaacaacugauauaagugaaaugggagccaacuuuaaggcugaaagaguuaucgacccucgucgaugcaugaaaccuguuauacuuacugacggagaggaacgcguaauuuuagccggaccaaugccaguaacacacucaucugcagcacaacgcagaggucguauaggcaggaaccccaaaaaugaaaacgaucaauacauauacaugggcgagccauuagagaacgacgaagauugugcucauuggaaagaagcaaaaaugcuucuugacaauauuaauacgccugaaggaauaauuccuucaauguucgagccugaacgugaaaaaguagaugcgauugauggcgaguauagauugcgcggugaagcgagaaaaaccuucguugacuugaugcgcagaggagaucuuccaguauggcuggcuuaucggguagcggcggaaggaaucaauuacgccgacagaagaugguguuuugauggaaucaaaaauaaucaaaucuuggaagaaaacguagaagucgaaauuuggacaaaggagggggaaaggaagaaauuaaaaccuagauggcuggacgccagaaucuacagcgacccauuagcccugaaagaauuuaaagaauuugccgcaggacgcaagucucucacuuuaaaccugauaacagagauggguagauuaccaacguucaugacucaaaaggcacgagaugcacuggauaaucuagcaguacuacauacagcugaagcaggagggcgcgcuuacaaucacgcccuaagugaacucccugaaacacuagagacucuauugcuacucacgcuacuagccacagugacaggugggauauucuuauuuuuaaugucuggcagagguauugggaaaaugacguuggguauguguuguauaauaacugcuuccauauuacuuugguacgcucaaauccagccccacuggaucgcugcuucaaucauacuagaguucuuucuaauuguacuacuaauaccagaaccagaaaagcagagaacaccucaagacaaccagcucacuuauguuguaauugcuauuuuaacuguaguagcagcaacuauggcaaaugaaaugggguuccuugagaaaaccaagaaagacuuaggauuaggauccaucacuacacaacagccagagaguaauauuuuggacaucgaccuuaggccggccagcgccuggacacuguacgccguugccacaacguuugugacaccaaugcuuagacauucuauugagaauagcagcguaaacguaucuuuaaccgccauugcuaaccaagccacaguauuaaugggguuaggaaaaggauggccgcuaaguaaaauggauauaggaguaccucuuuuggccauaggguguuauagccaaguaaacccaaucacucuaaccgcagcucucuuccugcuaguggcacauuacgcaauaauugggccgggccuacaggcaaaagcuacuagggaggcucagaaaagggcggcagcagguaucaugaaaaacccaacuguugauggaauaacaguuauugaucuugaccccauuccauaugacccgaaauucgaaaaacagcuaggccaagugaugcuucuaguauuaugcguaacccaaguguuaaugaugaggacaacgugggcgcucugcgaggcgcuaacauuagcuacuggcccuauaucuacauugugggagggcaacccaggacgauuuuggaauaccacuaucgcagucucuauggcaaauaucuuuagagguagcuauuuagcgggugcaggucuauuauucucaauaaugaaaaacacgacuaauacacgucgagggacgggaaauauaggcgagacccugggugagaaauggaaaagucgccugaacgcacuaggaaaaagugaguuccaaauauauaagaaaagugguauacaggaaguugauagaacauuagcgaaggaaggaaucaaaagaggggaaacagaucaccacgcaguuuccagggguagcgcuaaacuucgcugguuuguugagaggaauauggucacaccagaaggaaaagucguagaucuagggugcggaaggggaggcugguccuacuacugugggggucucaaaaauguuagagaagucaagggccuuacaaaaggaggacccggacaugaggaaccaauaccaaugagcaccuacggauggaaucucgugcgcuugcaaaguggaguggacguauuuuucacaccaccugaaaaaugcgauacauuauugugugauauuggagaaucuucaccaaauccuaccguggaagcaggacgaaccuuacgcguucugaaccucgucgagaauuggcuuaauaauaacacucaauuuuguaucaagguauugaaucccuauaugccaucagucaucgagaaaauggaggcgcuucagcgcaaguacgggggagcauugguaagaaauccguuaucuagaaauucuacucaugaaauguauuggguaagcaacgcgucugguaauaucguaagcaguguaaauaugauaucgagaaugcuuauuaacagguuuacaaugcgacauaaaaaggcuacguaugaaccagacguagaucugggaucaggaacaaggaauauaggaaucgaaucagaaaucccgaaccuagacaucaucgguaagagaaucgaaaagauaaaacaagaauacgaaacaaguuggcacuacgaccaggaucacccauauaaaacaugggcauaccaugggaguuacgaaacgaagcagacuggaagugcuaguaguaugguuaaugggguaguccguuuauuaacuaaaccaugggacguaguucccauggugacgcaaauggcaaugacugauacaacccccuuugggcagcagaggguauucaaggagaaagucgauacgcgaacacaggaaccaaaggaaggaaccaagaaauuaaugaaaauaacggcugaaugguuauggaaagaauugggcaaaaagaaaacgccaagaaugugcacaagagaagaauuuaccagaaaaguaaggagcaaugccgcccuaggggcgauuuuuacugacgagaauaaauggaagucggcacgcgaagcaguugaagauucacgauucugggagcuaguagauaaagaacguaaucuacauuuggaagguaaaugcgaaacuuguguuuauaauaugauggggaagagagagaagaaacuuggagaauuuggaaaagcaaaaggguccagagccaucugguacauguggcuaggagcccgauuucuggaauuugaagcucuaggguuccuuaaugaagaccauugguucagucgagagaacucucuaucaggugucgaaggugagggucuacauaaacuaggguauauauugcgggaugucagcaagaaagaaggcggagcuauguacgcagacgauacggccggcugggauacacgcauuacacuagaggaucuaaagaaugaagaaauggucacaaaccauauggaaggugaacauaagaaauuggcugaggcuauauuuaaguugacguaucagaacaaaguaguaagaguccaacgaccaacuccuaggggaacaguaauggauauaaucaguaggagagaucagcgagguucaggccagguaggaacuuauggauugaauacauucacaaauauggaagcucaauuaaucagacagauggaaggcgaaggagucuucaaaaacauacaacacuuaacuguaacugaagaaauagcaguccaaaacugguuagcacgaguugggagagagcggcuuagccgcauggcaauaaguggagaugacuguguaguaaaaccacucgacgauagauucgcgucggcacuaacugcguuaaaugauauggggaaagucagaaaggauauacaacaaugggagccuaguagaggcuggaacgauuggacgcaaguaccauuuugcucccaccacuuccacgaacucauuaugaaagacggaaggguccuaguaguaccuugucgaaaccaagaugaguugauagggagagcaagaauuucucaaggcgcgggauggagccugcgggaaacugcgugcuuagggaagucauaugcacaaauguggaguuuaauguauuuccauagaagggauuuaagacuagcagcuaaugccaucuguucagcuguacccagccacuggguuccuacauccagaacuaccuggagcauccaugcaaagcacgaguggaugacaacagaagauaugcugacaguauggaauagaguauggauacaagaaaaucccuggauggaagauaaaacaccaguugaaucuugggaggaaauuccuuauuuaggaaagagagaggaucaaugguguggcucgcuaauuggccugacaucaagagcuacgugggcaaagaacauacaaacugcuauaaaucaaguacgaucgcuaauagguaacgaagaguauacagauuacaugccauccaugaaaagauuuaggagagaggaagaggaagccgguguauuaugguaa

SEQ ID NO: 22203 - RNA, 9876 nt, Artificial Sequence
  derived and/or modified CDS sequence (opt6) from DENV-2__KF704354__SS-prME
acugcugguaugauaauaauguugauaccgacuguuauggcauuucaucucaccacucgaaauggugaaccgcauaugauuguaucgcggcaggaaaaaggaaaaagucuacucuucaaaacggaagauggcguaaauauguguacguuaauggcuauggacuuaggggaauuaugugaagauacuauaacguauaaauguccuuucuugcgacagaaugaaccagaagacauugacuguuggugcaacucaaccuccacauggguaacuuaugggacuugcacaacgacuggggaacaucgaagagaaaaacggucgguagcauugguaccacauguaggcauggggcuagaaacucgcaccgaaacauggaugucuuccgaaggagcguggaaacaugcacagaggauagagacuuggauacuuaggcauccagguuuuacaaucauggcagcaauuuuagcauacacaaucggaaccacacauuuccagagagcgcuuauauuuaucuugcuaacagcaguggcaccaucaaugacaaugagguguauaggaauuaguaaucgagacuucguagaagggguaagugguggaaguuggguagauauaguucuagaacaugggucaugcguaacuacaauggccaaaaauaaaccaacucuagacuucgaacuaauaaaaacggaagcaaaacaaccagcuacucuacgcaaauacugcauugaggcaaaacuuacaaacacaacuacagagucaagguguccuacacaaggcgaaccuagccuaaaugaggaacaggauaaaagauucguauguaaacacucgaugguagauagaggauggggaaauggcuguggcuuguuuggaaaaggagguauagugacaugcgcaauguuuacuugcaagaaaauuaugaaaggaaaaguggugcaaccugaaaaucuagaguacacgaucguaauaacaccucacucuggcgaagaacacgcaguaggaaaugacaccggaaaacacggcaaagaaauaaaaauaacgccacaaucuaguauaacagaagcagagcugacuggauaugguacagugacaauggaguguucuccgaggacaggcuuagacuuuaaugaaaugguacuuuuacaaauggaaaauaaagcauggcucguucacagacaaugguuuuuagaucuaccauuacccugguuaccaggcgccgacacacaaggaaguaacuggauucaaaaagaaacgcugguuacuuuuaaaaauccucacgcuaagaaacaagacgugguagugcuuggaucacaagagggcgcuaugcacacggccuugaccggagcuacagagauacaaaugaguagugggaacguguuguuuacaggucaucuuaaaugcagacucaggauggacaaacuacaacucaaaggaaugaguuacucuaugugcacggguaaauuuaaaguggucaaagaaauagcugagacgcaacacgguaccauuguaauacggguucaauaugagggagaugguucaccuuguaaaauucccuucgaaauaauggaucuagagaaaaggcacguauuaggacgcuuaauaacgguaaauccaauuguaacggguaaagauuccccaguuaauauugaagcagaaccaccauuuggagauagcuauauaauaauaggcguugaaccagggcaauuaaaauuaaacugguucaagaaaggcaguucaauuggacaaauguucgccacaacaaugagaggagcaaagagaauggcuauccuaggagauacugccugggacuucgguucauuaggaggcguauuuacaucuaucgguaaagcccuccaccaaguguuuggagcaaucuauggagccgcauuuagcggcgucuccuggacaaugaagauacuaaucggggucauaauaacauggauuggaaugaacucucgaagcacaagucucucuguaagucuagucuuagucggaguaguaacacuuuaucuggguguuaugguacaagccgauaguggaugcguugucucauggaagaauaaagaauugaaaugcggcagugggauauuuauuacagauaacguacauacauggacugaacaguauaaauuccaaccagaaucgcccuccaagcuagcaucagcgauacaaaaagcacaugaagaaggcauaugugguauuaggucugugacaaggcuagagaaucucauguggaagcaaauaacucccgaacuaaaccauauccucucugaaaaugagguuaaacucacaauuaugacaggugauaucaaaggcauuaugcaagcagggaagaggagcuuacgaccacagcccaccgaacuaaaauauucauggaaaacauggggaaaggcuaaaauguuaucgaccgaaucacacaaccaaacguuucugaucgauggaccagaaacagccgaaugccccaacacuaacagggcauggaauagucuugagguggaagauuauggguucgguguauuuacaaccaauauuuggcuaaaacuuagagaagaacaagaugucuuuugcgauucaaaacuaaugucagcggccauuaaggauaauagggcaguacaugcagacaugggauacuggauugagagugcucucaacgacacauggaaaauagaaaaggccagcuuuauagaagucaagucuugccauuggccgaaaagucacacauuauggaguaauggagucuuggaaagugaaaugaucauaccaaagaauuucgccgguccaguaagucagcacaauuauagacccggauaccauacacaaacugcaggaccguggcacuuagggaaguuagaaauggauuuugacuuuugugaaggaacuacuguuguuguaaccgaggacuguggaaaucgcggaccaucauugcgaacgacuacagcaaguggcaaacuaauaacagaaugguguuguagaucaugcacucuaccaccuuugcguuaccguggggaagauggauguugguaugguauggagauucggccacugaaagaaaaagaggagaaucuaguuaauucucuagugaccgccggacauggucagauugacaauuuuagucuaggaguguuagguauggcacuauuucuugaagaaaugcuuagaacuaggguaggcacaaaacacgcgaucuugcucguagcuguuucuuuuguaacacugauaacuggaaacaugucauucagggauuuggggagaguaaugguuaugguaggagcaacuaugacagacgauauaggcaugggaguaacauauuuagcauugcuugcggcuuucaaaguacgaccaacauucgcagcuggucuauuauugcgcaaacuuacuucgaaagaauuaaugaugacaacaauagggauagugcucuuaucccaaaguaccauaccggaaacaaucuuggaguugacagaugcgcuagcauuagggaugaugguauuaaaaaugguucgaaaaauggaaaaauaccaguuggcaguaaccauuauggcaauacuguguguuccuaacgcaguuauuuuacaaaauacauggaaaguaagcuguacaauacuagcugugguuuccguuaguccacuauucuuaacaucgucacaacaaaaggcagacuggauuccacuggcucuaacuaucaaaggacuuaauccuacugcaauuuuucugacuacucuaucuagaacgaauaagaaacgauccuggccucuuaaugaagcaauuauggcagugggcauggugagcauauuagcuucuagccuccugaaaaacgauauuccaaugacaggcccucuaguugcggguggacuacuuacaguaugcuauguucuuacagggagaagugcagauuuagaacucgagagggcggcagauguuaaaugggaggaccaggcagaaauaaguggaagcucacccaucuuaucaauuacaauuucagaagacggaucuaugagcaucaaaaaugaagaagaagaacaaacccuaacaauauugauuaggacgggauugcucgugauuucuggacuuuuuccaguuaguauaccuauaacugcugcagccugguauuuaugggaagucaagaaacagagggccgguguuuuaugggauguccccagcccaccgcccguuggcaaagccgaguuagaagauggagcuuauagaauuaaacaaaaggggauuuuaggauauagucaaauaggagccgguguauauaaggagggaaccuuccauaccauguggcauguaacucgaggcgcuguauuaaugcauaaagggaagagaauagaaccuucaugggcggaugucaagaaagauuugauaucguauggagggggauggcgacucgagggugaauggaaagaaggggaagagguucaaguucuugcccuugaaccaggcaaaaacccccgugcaguccagacaaaaccuggccuauuuaaaaccaacgccggcacaauaggagcagucagcuuagauuucucuccagguacaucgggcaguccaauaauagauaagaaggggaaagucguaggucuauacggaaacgggguaguaacccgaucaggagcguauguaucagcuauagcacaaacagaaaagucgauugaagacaauccggaaauagaagacgauauuuuuagaaaaagaaagcugacaauaauggaccuccauccaggugccggaaaaacuaaacguuacuuaccggccauuguacgggaggcuauaaagagaggguuacgaacucuaauccuggcaccuaccagagucgucgcggcugaaauggaagaagcacuccgggguuuaccgauaagguaccaaacaccggcaauaagagcggagcauaccgguagagaaauuguagauuugaugugccaugcaacuuuuacaaugagacuuuuguccccugugcgcgugccgaauuacaaccuaaucauaauggaugaagcacacuuuacugacccagcgucaaucgcagcuagaggauauauaucgacacgagucgagaugggcgaagcagcuggcauauuuaugacugcaacgccacccggaucacgcgacccauuuccacaaucgaaugcaccgauaauggacgaagaaagggagaucccagagcgaucguggucaucaggacaugaaugggugacugacuucaaaggcaagacugugugguuuguuccuaguauaaaagcagguaaugauauagcugcuugucuuagaaagaauggcaagaaaguaauccaauuaagucguaaaaccuucgacagugaauauguaaaaacuagaacaaaugacugggacuuugugguaaccacugacaucucggaaaugggugcuaacuuuaaagcugaaagagugauagauccgcguagaugcaugaaaccaguaauccuaacagauggagaagaacggguaauauuggcuggcccgaugcccguuacacauagcucagcagcgcaacgacgugguagaauaggucgaaacccuaaaaacgaaaacgaccaauauaucuacaugggcgaaccucuagaaaacgaugaagacugugcucauuggaaggaagcuaaaaugcucuuagauaacauaaacacaccugagggaauaaucccgaguauguuugaaccugagagggaaaaaguugaugcaauugacggugaauacagacuuagaggcgaagcaagaaaaacauucguagaucugaugcgacgaggugauuuacccguauggcucgcuuaccgugucgcugcugaagggaucaauuacgccgaccgucgaugguguuuugacggaauuaagaacaaucaaauucuagaagaaaauguggaaguggagauuuggacaaaagagggugagcggaagaaacuaaagccaagauggcuagacgcacguaucuauucagacccauuagcgcuuaaggaauuuaaagaguuugcagccgggagaaagagcuuaacacuuaacuuaaucacagaaaugggucgcuugccaacauucaugacacaaaaggcaagagaugcguuagacaauuuagccguacugcauaccgccgaggcagggggucgugcauacaaucaugcauugucagaacucccugagacuuuagaaaccuuacuacuccucacacuauuggcuacuguuacuggagguauauuucucuucuugaugagcggaagagguauaggcaagaugacacuagggaugugcuguauaaucacugcaagcauccuuuuaugguacgcacaaauacagccgcacuggauagcagcaucaauaauucuugaguucuuccuaauaguucuauugauaccugagccggaaaaacaaaggacgccucaagacaaccaauugaccuauguugugauugcuauauuaacugucgucgcggcuacaauggcuaaugaaaugggcuuucuagagaaaaccaagaaagaucuaggcuggggaucaaucacaacgcaacagccagaauccaacauacuugacauugauuuacguccggcaagcgcuuggacacuguacgccguggcgacgacuuuuguaaccccgauguuaagacacucgauagaaaacucgucagugaacgugucucuuacagcaaucgcuaaccaagcuacuguuuuaauggguuugggaaaaggauggccauuaagcaaaauggauauagguguccccuuacucgcgauugguugcuacucacaggucaauccaauaacacuaacggcagcacucuuucuauuaguagcacauuacgcuauaauugggcccggccugcaagccaaagccaccagggaagcgcagaaaagggcugcagcaggaaucaugaaaaauccgacagucgauggaaucaccguaaucgaccuugacccaauuccuuaugauccuaaauuugaaaaacaguuaggacaaguaauguuauuaguauugugcguaacgcaagucuuaaugaugaggacaacgugggccuuaugcgaagcucuaacgcuggcaacggguccaauuagcacucugugggaaggaaacccgggcagauucuggaauacaacuaucgccguguccauggccaauaucuuucgggguaguuaccuugcuggagccggcuuauuauuuagcauaaugaaaaauacuacgaauacaagaaggggcacuggcaacaugggagaaacguuaggugaaaaguggaaaucuagacuaaaugccuuaggaaaaagcgaguuccagaucuauaaaaagaguggcauucaagagguugaucgcacuuuggccaaggaaggaauuaagcgaggagaaacugaucaucacgcagucaguaggggcagcgcaaaauuacggugguucguagaaagaaauaugguaacgccugaaggaaaaguaguagauuugggauguggucgcggaggcuggucuuauuacugugggggacugaaaaauguaagagaaguaaagggucucaccaaaggugguccaggucacgaagaaccgauuccuaugucuacguacggauggaauuuagugcggcuccaaagugggguagacguuuucuuuaccccacccgaaaaaugugauacgcuacuuugugauauaggugaaucuaguccuaacccaacuguagaggcugguagaacucuacgcguacuaaaccuagucgaaaauugguugaacaauaauacacaguuuuguaucaaaguuuuaaacccauauaugccaagugugauagagaaaauggaagcacugcaaagaaaauauggcggugccuuaguccgaaauccauuaagccgcaacagcacacacgaaauguauuggguauccaaugcaucaggaaauauaguuucaucaguuaauaugauaucuagaaugcucauuaauagauuuacaaugagacauaagaaagcgacguucgagcccgauguagaucuggguucagguacaagaaauauagguauugaaagcgagaucccuaaucuagauauaauugguaaaagaauagagaaaaucaagcaagaauaugaaacaaguuggcacuaugaucaagaucacccauacaaaaccugggccuaucacgggagcuaugaaacaaaacagacaggaucagcuagcaguaugguuaacggaguuguucgguuguuaacuaaaccuugggauguaguuccaaugguuacacaaauggcuaugacagacacaaccccuuucggacaacaaagaguauucaaggaaaaaguagauacacgcacccaagaacccaaggaaggaacuaagaaauugaugaaaauuacagcugaauggcuauggaaagaacuugguaaaaagaaaacaccucgaauguguacuagagaagaguucacgagaaaaguacgaucaaaugccgcccuuggugcaaucuucacggaugaaaacaaguggaaaagcgcacgagaagcgguagaagauucgagauucugggaauuagucgauaaggaacgaaaucugcauuuagaaggaaaaugcgagacgugcguuuacaauaugaugggaaagagagagaaaaagcuaggcgaauuugguaaagcaaagggaaguagagcaauaugguacauguggcucggcgcuagguuucuagaguuugaagcacuuggauuuuugaacgaagaucauugguucagcagggaaaauucucucagcggugucgaaggugagggucuccauaaacuagguuauauacucagggaugugagcaagaaagaaggcggagcaauguaugcagaugacacugcuggcugggauacaaggauaacccuggaagauuuaaagaaugaagagauggugacaaaccauauggagggggaacacaagaaauuagcagaagcaauuuuuaaguuaacauaccagaauaaaguagucagaguucaacgaccgaccccaagaggaacagugauggauauaauaucuaggcgagaccaacgcggaagcggccaaguagguacuuacgguuugaauaccuuuaccaauauggaggcucaauugauaagacaaauggaaggugagggagucuucaaaaauauacaacauuugacaguaaccgaggaaauagccguacaaaacuggcuugccaggguagguagggaacgcuuaucucgaauggccauaagcggagaugacuguguugugaaaccuuuagaugaccgguuugcgucagcgcuaacggcacuuaaugacaugggaaaaguucgcaaagacauacaacagugggaaccgucucgagguuggaacgauuggacacaaguaccguuuugcucacaccauuuucacgaacugauuaugaaagauggcagaguauuaguggugcccuguagaaaucaagaugaauuaauaggucgagcacgcaucucccaaggugcaggauggagucuaagggaaacugcaugccuaggaaagaguuaugcucaaauguggagcuuaauguauuuucacagacgugaucuccgauuagcagcaaacgcaauauguagugcaguuccaagccacugggucccgacgagccguacgacauggagcauucacgccaaacaugaauggaugacgacugaagacauguuaacgguuuggaauaggguuuggauccaagaaaauccguggauggaggauaaaacaccaguagagagcugggaagaaauaccuuaucuuggaaaacgggaggaucaauggugcgggucccuuauagggcuaacaagucgagcgaccugggccaaaaauauacaaacagcaauaaaucagguaagaaguuugauaggaaaugaagaauauacagauuauaugccuaguaugaaaagauuucgaagggaagaagaggaagccgguguucuaugguaa

SEQ ID NO: 22204 - RNA, 9876 nt, Artificial Sequence
  derived and/or modified CDS sequence (opt6) from DENV-2__KF704357__SS-prME
acugcagggaugauaauaauguuaauaccaacgguuauggcauuucauuuaacgacccgaaacggcgaaccucacaugauagugucaaggcaagaaaaagggaaaucacuacucuuuaaaacaggagauggaguuaauaugugcacacuuauggcuauggauuuaggagaacuaugugaagacacaauaacauacaaaugcccguugcuaagacagaacgaaccagaagauauagauuguugguguaacagcacaucaaccuggguaacauacggaacuugcacuacaacuggagaacaccgucgggaaaaacguucaguugcucuuguuccucauguugguaugggacuggaaacacgcacagaaaccuggaugucaagcgaaggugcauggaaacaugcacaaagaauugaaacauggauccucagacacccuggcuucacgaucauggcagcaauacuagcuuacacaaucggcacaacgcacuuucaaagagcauuaauuuucauucuauuaacugcaguagcucccaguaugacaaugcgauguauagguauaucuaacagggacuuuguagaagguguaagcgguggcuccuggguugauauaguucuagaacaugguuccuguguaacuaccauggcuaaaaauaaaccgacuuuagauuuagaacucaucaaaacagaagcgaaacaaccggcaacacugcguaaauacugcauugaagcuaaacuaacaaauacaacgacugaaucccgauguccgacucagggggaaccaucucuaaacgaagaacaagauaaaagguuuguuugcaaacacucaaugguugacagaggauggggaaauggguguggauuauuugguaaagggagcauugucacaugcgcaauguuuacguguaagaaaauuaugaaagguaaagucguacaaccugaaaauuuagaauauacaaucguuaucacaccccauaguggugaagaacaugcuguagggaaugacaccggcaaacauggaaaagaaauaaaaauuacuccacaaucgaguauuacugaagcagaacucacuggauacggaacaguuacgauggaguguucuccacguacuggauuggacuuuaacgaaaugguauuacuacaaauggaagacaaagcauggcuagugcauagacagugguuucuagauuuaccauuaccaugguugccuggagcagacacucagggaagcaauuggauacaaaaagaaacauuaguaacauucaaaaauccucaugccaagaaacaggaugugguuguacugggaucacaggaaggugcgaugcacacugcguuaacaggugcaacugaaauucaaaugagcuccggaaacguucuauuuacaggucaucuuaaauguagacuccguauggacaaacugcaauuaaaaggaaugucguacagcaugugcacagggaaauuuaaaguaguaaaagaaauagcagaaacccaacacggcacuaucgucauucgugugcaauaugaaggugauggaaguccuuguaaaaucccguuugaaauuauggauuuagagaaaaggcauguccuagggcggcuuauuacagucaacccuauagucacuggcaaagacuccccagucaauauugaagcggagccuccauuuggagauucuuauaucaucauugguguagaaccuggccaguuaaaauuaaacugguucaagaaagggucaucaauugggcagauguuugccaccacaaugagaggugcgaaaagaauggccauccucggggacaccgccugggacuucggcuccuuaggggguguuuuuacuucaaucgguaaagcacugcaucaagucuucggagcaauauauggagccgcuuuuucaggugugucguggacgaugaaaauucuaauagggguuauaauaacauggauaggcaugaacagccgcuccacuucacuaucuguaagccuuguucuagucggagugguuaccuuauaucuaggugugaugguccaagcagauucuggguguguaguuucauggaaaaauaaagaauuaaaaugcgggagugggauuuucauuacagauaauguacauacuuggaccgagcaauacaaguuucagccugaaucaccuagcaaacuugcaagcgccauccaaaaagcucacgaggaaggaauaugcgggauccgaucagucacuaggcuagaaaaucuuauguggaaacaaaucacaccagagcuuaaccacauccuaucugaaaaugaaguaaaacuaacaauaaugacuggugauauaaaagguauuaugcaggcgggaaaaagaagucuuaggccacaaccaacugaacucaaauauucauggaaaacuuggggaaaggcuaaaaugcuuucuaccgaaucccacaaccaaacuuucuuaaucgaugguccagaaaccgcagaauguccaaauacuaauagagcauggaacucuuuagaaguugaagacuaugguuuuggaguauucacgacgaauauuuggcugaaacuaagagaagaacaggacguauucugugacucgaaauuaaugucagcagcaauuaaggacaaucgugcuguacaugcugauaugggcuacuggauugaaagugcucucaaugauacauggaaaauugaaaaagcgaguuuuaucgaaguaaaaaguugccacuggccuaagucucauacacuuuggucaaauggaguccucgaauccgaaaugauuauucccaaaaauuucgccggucccguaucucaacauaacuauagacccggcuaccauacacaaacagcaggacccuggcaucuuggaaaacucgaaauggacuucgacuucugugaaggcaccaccgucguggucacggaagauuguggaaacagaggacccucccuucgcacuacuacagcaucuggaaaacugauaacagaauggugcugucgaaguugcacauuaccgccguuaagauauagaggagaagacggaugcugguaugggauggaaauaagaccccuuaaagagaaggaagagaaucuagucaauagccuaguaacagcaggacacggucaaaucgauaacuucuccuuaggaguucucggaauggcacuauuucuagaagaaaugcuacggacgagggugggaacaaagcaugcaauacuuuuagucgcagugagcuucgugacuuugauaacuggaaauaugaguuuucgggaccucggaaggguaaugguaauggucggggcuacuaugacggaugauaucgguaugggaguuacauauuuagcuuuacuggcagcguuuaaggucaggccaacuuucgcagcgggacuuuuacuaagaaaauugacauccaaagaguuaaugaugacaacuauaggaauagucuuacuuucucagaguacaauacccgaaacaauacucgaacucacagacgcgcuagcucuugggaugaugguacuaaagauggugaggaagauggagaaguaucaauuagcaguaacaauaauggcaauucuaugcguaccuaaugcagugauacuacaaaauacauggaaaguuucauguacuauucuugcaguaguaucugugagcccacucuuuuuaacaagcagucagcagaaagcagacuggauucccuuggcccugacuauaaaaggucuaaauccgacggccauauuccuuacuacacucucucgaacaaauaagaaacgaagcuggccucugaaugaggcaaucauggcaguuggcaugguaucgauucuagcaagcagucuucuaaagaaugauauaccuaugacuggaccauuagucgcaggaggauuguuaaccguaugcuauguccugacugggaggagcgcugacuuagaacuagaaagggcagcagauguuaaaugggaagaccaagcagagauaagcggaagcuccccaauauuaucaauuacaauaagugaagaugguucuaugaguaucaaaaaugaggaggaagaacagacuuugaccaucuuaauuagaaccggauuacugguaauaucgggacuuuuuccugucucaauaccaauaaccgccgcagcgugguacuuaugggagguuaagaaacagcgagcaggcgucuuaugggaugucccgucgccacccccugucggaaaagcagaacuugaagacggggcuuauaggauuaaacaaaaaggaauauuaggauacucgcagauuggagcaggcgucuauaaagaggguacguuucauacaauguggcacguaacacguggggcagucuuaaugcacaaaggcaaacguaucgagcccagcugggcggacguaaagaaggacuuaauaagcuacgggggagguuggaaauuagagggagaauggaaagaaggagaagaaguacaaguuuuagcucuagaaccaggcaaaaaucccagagcuguacaaacuaagccagguuuguuuaagacaaaugccgguaccauuggggcaguuaguuuggauuucaguccugguaccagcggauccccuauuauagacagaaaagguaaggucguaggucuauauggaaacggugucgucacgagaucuggggcuuaugugagcgcuauagcucaaacagaaaaaucuauagaagauaacccagaaauagaggaugacauauuuagaaaaagaaaacugacuauuauggaucugcauccaggagcaggaaagacaaagcgauaccuuccugcaauagugcgggaagcgauuaaacgaggauuacgaacccucauccuagcgccuacacgaguaguagcggcugaaauggaagaagcucugcgaggacugccgauacgauaucaaacgcccgcaauccgagcggaacauacagguagggaaauaguagauuuaaugugccacgcaacguuuacuaugcgacugcuaagcccggugcgaguuccaaauuacaacuuaauaauaauggaugaagcacacuuuaccgacccagcuucuauugcugcgcguggcuauauaagcacacgcguugagaugggugaggcugcaggcauauucaugacugcuacaccacccggaaguagagauccguucccccagucuaacgcucccauuauggaugaggaaagagaaauaccugaacguuccuggaguaguggucaugagugggugacagauuucaagggaaaaacuguaugguuuguuccaucgauccgugcagguaaugacauugcagccuguuuaaggaaaaacggcaagaaaguuauccaauugaguagaaaaacauucgauucagaauaugugaaaacgagaacuaaugauugggacuuugucguaacaaccgacauaagcgagaugggcgcaaauuuuaaggcagaacgcgucauagauccacguaggugcaugaagccagucauauugacugacggagaagagagaguuauacuagcaggaccuaugcccguaacucauucaucggcggcacaacgcaggggacguauagggagaaauccuaaaaacgagaacgaucaauauaucuauaugggggaaccacuagaaaaugacgaagauugugcucauuggaaagaagcuaaaauguugcuagacaauaucaacacaccugaaggcauaauaccgagcauguucgaaccagagcgugaaaaaguggacgccauugacggagaauauagauuaaggggcgaagcacgcaaaacauuuguagaucugaugcgccgaggggaccucccuguaugguuagcauauagaguagcagccgagggaauaaauuaugcggaucguaggugguguuuugaugguauuaagaauaaucaaauauuagaagaaaauguggaaguagaaaucuggacaaaagagggugaaagaaagaaacugaagccaagguggcuggaugcucguaucuauagcgacccauuggcuuuaaaagaauuuaaggaauuugcggcugggaggaaaucgcucacacuaaauuuaaucacugaaauggguagauuaccaacauuuaugacacaaaaggcaagagacgcuuuagauaacuuggcuguucuacauacugcagaagccgguggucgagcuuauaaucacgccuugucagaguuaccagaaacacuagaaacucuccuguuacuaacauugcuagcaacuguuaccggagggaucuuucuuuucuugaugucaggcagggguauuggaaaaaugacccugggcauguguugcaucauaacagcuaguauauugcuuugguacgcacaaauacaaccacacuggaucgcggcuagcauuauucucgaguucuucuuaauaguacuguuaauaccggaaccagagaaacagcgcacgccucaagacaaucagcuaacauauguagugaucgccauucuuacgguaguugccgcuaccauggcuaaugaaaugggguuccuugagaaaacuaagaaagaccugggucuuggguccauuacuacucagcagccggaaucuaauauauuggacauagaucuucgcccagcaucagcguggacucuauacgccguagcuacuacauuuguaaccccaauguugcgacauaguauugaaaacagcaguguuaacguaucucuaacagcuauugcgaaccaagcuacuguucuaaugggauuaggaaaagguuggccacuaucaaaaauggauauaggcguacccuugcuagcgauaggaugcuauucucaggugaauccgauuacauuaacagcagcuuuauuccugcuuguggcacacuacgcaauuaucgggcccggcuuacaagccaaggcuacccgagaagcgcaaaaacgggcagccgcugggauaaugaaaaacccgacaguagaugguauuaccguuauugacuuagaucccauaccauaugacccgaaauucgaaaaacaauuaggccaaguaaugcugcuaguacucugcguaacacaaguccuaaugaugagaacuacaugggcccuaugcgaagcucucacccuggcgaccggacccauaucuacauuaugggaaggaaaccccggaagauuuuggaauacaacaauagccguaucuauggcaaacauauuuaggggcucguauuuagcaggagccggauuacuuuucucuauuaugaaaaauaccacgaacacgcgacgaggaacaggaaauaugggagaaacacugggggaaaaauggaaaagccgauuaaacgcucuaggcaaaucagaguuucaaaucuauaagaaaucagggauacaagaaguagaucggacuuuagcaaaagaaggaauuaaaagaggggaaaccgaucaucaugcuguaagucgagguucugcuaaacuacguugguuuguugaaagaaacaugguaacaccagaaggaaaaguaguagaccuugggugugguagagggggcuggaguuauuauuguggaggacucaaaaauguaagagaaguuaagggucuuacuaaaggaggccccgggcaugaagaaccgaucccgauguccacuuauggguggaaucuaguacguuuacaaagcggcgucgauguauucuuuacacccccagaaaaaugcgauacuuuacucugugacaucggggaaucaucaccuaauccgacuguagaagcaggcaggacauugagaguacuaaaccuuguugaaaauuggcuaaauaauaauacgcaauucugcauaaagguuuuaaaucccuauaugccgucuguaaucgagaaaauggaggcuuuacaacgaaaauacggaggggcccucguccguaaucccuuaucaagaaacucaacucacgaaauguacuggguuucuaaugccucagguaacauaguaucaagcgugaauaugaucucaaggaugcuuauaaaccguuuuaccaugagacauaagaaggcaacuuucgaaccagaugucgaucuugggucuggaacaagaaauauuggaauagaaucugaaauaccuaacuuggacauaauaggaaagagaauagaaaagauuaaacaggaauacgaaacgagcuggcacuaugaucaagaccauccauauaaaacuugggcauaccaugguaguuaugaaacuaaacaaacggggucagccagcucgauggugaauggcguagugcgauuacuuaccaaaccaugggacguagucccuaugguaacgcaaauggcuaugacugacacaacaccauucgggcaacaacgaguuuucaaagagaaaguagacaccagaacacaggaaccaaaggaaggaaccaagaaauuaaugaagauaaccgcggaaugguuauggaaagaacuugggaagaagaaaaccccgagaauguguacucgggaagaauuuacgcggaagguaagaucuaaugccgcguuaggcgcaauuuuuacagaugaaaacaaguggaaaagcgccagagaggcaguagaagauucaagauuuugggaauuaguugacaaagagagaaauuuacaccuugaaggaaaaugugaaacguguguuuauaauaugaugggaaaaagggagaagaaacuaggcgaauuuggaaaggcgaagggcucgcgugccauaugguacauguggcuuggugcgcgauuuuuggaguucgaggcuuuggguuuucuaaacgaggaccacugguucuccagagaaaauagucuuaguggaguugaaggagaaggccuacauaaacuaggauacaucuuacgggaugugagcaagaaagaaggaggagccauguaugcggacgacaccgcagguugggauacaagaauaacucuagaagaccuuaaaaaugaagagauggugaccaaucacauggaaggagaacauaaaaagcuagcugaagcaaucuuuaaacuaacauaccaaaacaagguugucaggguacaaaggcccacaccaaggggaaccguuauggacauaauaagccgccgagaccaacggggcagcggacaaguagggacauauggacuaaauaccuuuacuaacauggaagcgcaacuuauccgacaaauggaaggcgaaggagucuucaaaaauauacaacaucuuacuguaacagaagaaauagcgguacagaacugguuggcgagagucggacgugaaagacuuuccaggauggcgauuuccggugaugacugcguaguuaaaccuuuggaugaucgauuugcaucggcccuaacugcccuuaaugauaugggaaaaguaagaaaagauauucagcaaugggaaccuucgaggggauggaacgauuggacucaagucccguuuuguagucaucacuuccaugaauuaaucaugaaagaugguagaguacuuguaguuccaugccggaaucaggaugaauugauuggcagagccagaauuucucagggugcaggauggagcuuaagggaaacggcauguuuaggcaaaaguuacgcccaaauguggucauugauguauuuccauagacgagaccuaagauuagcagcuaacgcaauuugcagugcaguaccaucacauuggguuccaacaucccguacaacauggucaauacacgcaaaacacgaauggaugacgacggaagacauguugacuguuuggaaucguguauggauacaagaaaaucccuggauggaagacaagacuccagucgaaucaugggaagagauaccguaucuggguaaacgagaagaucaauggugcggauccuuaaucggcuuaacuuccagggcgacaugggcaaagaacauccaaacagccaucaaccaagugagaagccugauuggaaaugaagaguauacugacuauaugccuagcaugaagcguuucagaagagaagaagaagaagcugguguauuaugguaa

SEQ ID NO: 22205 - RNA, 9876 nt, Artificial Sequence
  derived and/or modified CDS sequence (opt6) from DENV-2__KF704358__SS-prME
accgcagguaugauaauaaugcugauaccuacggugauggcauuucaucucacuacgaggaauggagaaccgcacaugauaguuucgcgucaagaaaaagguaaaucacuacuauucaauaccggagacggaguucauauguguacacuuauggcgaugcacuuaggagaauuaugcgaggacaccauuacauauaaauguccguuauuaagacaaaaugagccagaagacauugauugcuggugcaacucgacgucaacuuggguuacuuacgggacaugcacuacgaccggggaacauagaagagagaaacggucaguugcucucguuccgcacguugguaugggucuagaaacgaggaccgagacuuggaugucaucugaaggagcauggaaacaugcgcaaagaauagaaacuuggauccuaagacauccaggcuuuacgauaauggcugcuauacuugcuuauacaauaggaacaacgcacuuccaaagggcguuaauauuuauauugcuuacagcuguggcuccaagcaugacaaugagaugcauuggcaucucaaauagagauuuuguugaaggggugucaggugguaguuggguugacauaguacuugagcauggaucaugcguuacgacaauggccaaaaacaaaccaacucuggaucuugaauugauaaaaacagaggcgaaacagccggcgacauugcgcaaauauugcauagaagcgaaacucaccaauacaacaacggaaucucguugucccacucaaggugagccaaguuugaaugaggagcaagauaaacgguucguauguaaacauagcaugguagaucguggauggggcaauggaugcgggcuuuuuggaaaaggauccauagucacuugcgcaauguucacuuguaagaaaauaaugaaaggaaaagugguucaaccggaaaaccuggaauacacgauaguaauaacaccacauucaggggaagaacaugccguuggaaacgauacuggcaaacacgguaaagagauuaaaauaacuccucaaucuaguauuaccgaagcggaacucacggguuacggaacggugacgauggaguguaguccgagaacaggauuagacuuuaacgaaaugguguuacuacagauggaagacaaagcauggcuagugcacaggcaaugguuucuugaucuaccacuaccgugguuaccaggagcagacacacaaggaagcaauuggauucaaaaagaaacguugguaacauuuaaaaauccacaugcuaagaaacaggacguuguaguucuagggucacaagagggcgcaaugcauacugccuuaaccggcgccaccgaaauucaaaugucuucgggcaauguauuguuuacuggacaccugaaaugcagacuacguauggauaaauuacaauuaaaaggcaugucuuauucaauguguacaggaaaauuuaagguaguuaaagagauagccgaaacucagcacgggaccauuguaauaagaguacaguacgagggugauggcagcccguguaagauuccauuugagauaauggauuuggagaaacgacauguucuuggccgacucauaacaguaaacccaaucguuacaggaaaagauucacccguuaauauugaagcagaaccaccauuuggagauucauauauuauaauuggaguagaacccggccaacuaaaacuaaauugguucaagaaagguucuucgauaggacagauguucgccacaaccaugagaggagcgaaaaggauggcgauauuaggagauacagcgugggauuuuggcucgcugggagguguauucacuucaauugguaaggcguugcaccagguauucggagcuauauauggcgccgcguuuagcgggguuucauggaccaugaaaauauuaacuggaguaauaauuaccuggauagguaugaacaguaggaguacaucguuauccguaucguuaguacucguuggagugguaacacuauaucugggagugaugguacaggccgauagcggcuguguuguaucauggaaaaacaaagaauugaaauguggcucuggcauuuuuauaacugauaaugugcacacuuggacggagcaauacaaauuccaaccagaaucuccuucaaaguuggcuucagcaauccaaaaagcgcacgaagaagguauaugugguauucguucagucacaagauuggaaaacuuaauguggaagcagauaacaccagaacucaaccacauacugucagaaaacgaagucaaacuaacaauuaugacaggagauauaaaaggaaucaugcaagcggguaaaagaucacuacgaccacaaccaaccgagcuuaaauauagcuggaaaaccuggggaaaagccaaaauguuaaguacggaaucgcacaaucagacauuuuuaauugacggcccagagacagccgaauguccaaacacuaacagggcauggaacucauuagagguagaagacuauggcuuuggggucuucacgacaaauauaugguuaaaguuaagagagaaacaggacguauucugugacaguaaacuuaugagcgcggcgaucaaagacaacagagcuguacacgcagauaugggguacuggauagaaagugcauuaaaugacacauggaaaauagagaaagccucauucauugaaguaaaaagcugucauuggccaaaaucccauacucucuggucgaacgggguauuagaaagcgaaaugauaauaccuaaaaauuuugcaggaccugugagucagcauaacuaucggccuggauaucauacgcagacagcagguccguggcacuuagguaaauuagaaauggacuuugacuucugcgaagguacgaccgugguggugacagaggauugcggaaaucggggacccucacucagaacaacuacagcaucaggaaaguuaauaacagaauggugcuguagaucuuguacccuuccgccucuaagguacagaggagaggauggcugcugguauggaauggaaauucgcccccugaaggaaaaagaggaaaaucuugucaacuccuuaguaaccgcaggucauggucaaauagauaacuuuucacuuggagugcuaggaauggcguuauuuuuggaagagauguuaaggacacgagugggaacuaaacaugcaauacuucuaguagcggugagcuuuguaacacuuauaacuggaaauaugucuuuuagagaucuuggucgugugaugguaauggugggggcuacgaugacagaugacauagguaugggggugacauauuuggcguuacuagcagccuuuaagguuaggcccacuuuugccgcgggacuucuauuacgaaaacucacaaguaaggaacuuaugaugacuacgauaggaauuguacuauuaagucaaucaacgaucccggagacgauauuggaguuaacugaugcguuagcucuugguaugaugguuuugaaaaugguucgcaagauggaaaaauaucaacucgccguaaccauuauggcaauucuuugcguuccgaacgccgucauucuucagaacaccuggaaagugagcuguacuauauuagcuguuguaagcgucaguccauuguuucuaacaaguucgcaacaaaaagcagauuggaucccuuuggcacuaacgauuaagggauuaaauccaacagcaauauuucucacgaccuuaucucgcaccaacaagaaaagaucauggccuuugaacgaagcuauaauggcuguagguaugguaaguauuuuagcaaguucguuacuaaagaacgacauaccuaugacugguccguuggucgcuggcggguugcucacaguuuguuacguuuuaacgggcagaucugcagacuuagaauuagaaagagccgcggauguuaaaugggaagaccaagcggagauaaguggaucuucgccaauacugucaauuacuauauccgaggauggaucuaugucuaucaaaaaugaagaagaggagcaaacacucaccauauugauaaggacuggauuacuuguaauaaguggguuauuucccguuagcauacccaucaccgcugcagccugguaccucugggaagucaagaaacaaagagcggguguauuaugggacgugccgucaccaccaccaguagguaaagcggaacucgaagauggagcauaccguaucaagcagaaagggauauuagguuacucccaaauaggugcuggaguuuauaaagaaggaacauuucacacaauguggcacgucacccguggcgccgugcuaaugcacaagggaaaaagaauagaacccagcugggcagauguaaagaaagaucuaauaaguuacggagguggcuggaaacuagagggcgaauggaaagaaggcgaagaaguacaaguauuagcucuggaaccaggcaaaaauccuagggcaguacaaacaaagccagguuuauuuaaaacaaacgcuggaacaauaggggcaguuagucuagauuuuagcccuggcacaagcggaucaccaauaauagauaagaaggguaaaguaguaggauuauauggcaauggcgucgugacgaggucgggggcguauguuucagcgauagcgcaaacagagaaaucaaucgaagacaaccccgaaauagaagacgauauauuucguaagcgcaaauuaaccauaauggacuuacaucccggggcugguaagacaaaaagauacuuaccggccauaguacgugaagcaauuaaacguggucugcggaccuuaauauuagcgccgacccgaguaguggcagcugagauggaggaagcucuuaggggccuuccaauaagauaucaaaccccagcuauaagagcugagcacaccgguagggaaauuguagaucuaaugugccaugcgacauuuacgaugcgcuuacuaagucccgucaggguaccgaauuauaauuuaauaaucauggaugaagcccauuucaccgaccccgccucuauagcagcuagaggauacauaaguacaaggguagaaaugggagaagcugcagguauuuuuaugacagcuacgccaccaggcucgagggauccuuuuccgcaaucuaacgccccuauaauggacgaagaaagggaaaucccagaacgcucauggagcaguggccaugaauggguaacggacuuuaaaggcaaaacaguaugguuuguaccgucgauacgcgccggaaaugauauugcugcaugccuaagaaagaacggaaagaaagucauacaauuaagccguaaaacguuugauuccgaauacguaaaaacucgaacaaaugauugggauuuugucguaacaacugacauaagugaaaugggagccaacuuuaaagcggaacggguaaucgauccuagacguuguaugaagcccguaauuuuaaccgauggugaggaacguguuauauuggccggaccuaugccaguaacacacaguucagccgcacaacggcggggacguaucggaaggaauccuaaaaaugaaaacgaucaauauauauauaugggggaaccgcucgagaaugaugaagauugugcucauuggaaagaggcgaagauguuacucgauaacauaaacacacccgaagguauaauaccaucuauguucgaaccugaacgggaaaaaguggacgcgauugauggugaauaucgccuuagaggggaagcgagaaagacuuuuguagacuuaaugagaagaggagauuuaccuguuuggcuagcuuauaggguagcagcugaagggauaaacuacgccgauaggcgcugguguuuugauggaauuaaaaacaaccaaauauuagaagaaaacgucgaaguagaaauauggacuaaagaaggugaacggaagaaauuaaagcccagaugguuggaugcuagaauauauagcgacccuuuagcguuaaaagaguuuaaagaauuugcggcagguagaaagucauuaacauugaauuugauuacagaaaugggucgacuucccacuuuuaugacccagaaagccagagaugcacuagauaaucuagcugucuuacacacugccgaagccgguggcagagcuuacaaucaugccuugucugaacuaccagaaacuuuggagacauuacuccuccuaacauuguuagcaacgguuaccgguggaauauucuuguucuugauguccgggaggggaauaggaaaaaugacacucgguauguguugcauaauuacagcgagcauacuauuaugguacgcccagauacaaccccauuggaucgcugcaucaauuauuuuagaauuuuuccuaauagugcuauuaauuccagaaccugaaaaacaacgaacaccccaggauaaucagcugacauacguggucauugccauacucacgguuguugcagcaaccauggcaaacgaaaugggauuuuuagagaaaacuaagaaggauuugggcuuaggcucaauaacaacacagcaaccggaaucuaauauucuggauauagauuuaagaccagcuuccgcuuggacacucuaugcagucgcaacaacguucguuacuccaauguugaggcauucaauugaaaacagcucagugaacguaucauuaacugccauagcaaaccaagcuaccgugcugaugggacucggaaaaggauggccauuaucaaaaauggacaucggcguaccgcuuuuagcaauaggauguuauagucaaguaaauccgauuaccuuaacggcggcuuuauuccugcucgucgcccacuaugccauuaucggacccggucuacaagcaaaagcaacacgugaagcucagaaacgagcugcggcagguauaaugaaaaauccaacaguugauggaauuaccguuaucgacuuagaucccauaccuuacgauccaaaauuugaaaaacagcuagggcaagucaugcuauuaguucuaugugucacacagguacuaaugaugaggacuacgugggcacuaugcgaggcguuaacucuugcaacggguccaauauccacauuaugggaaggaaauccuggcagguuuuggaacacgacgaucgcgguauccauggcaaauaucuuucgaggaucguacuuagcuggagccggucuacuguuuuccauaaugaaaaauaccacaaacacgcguagagggacagguaauaugggagagacacuuggugagaaguggaaaucacgccuaaaugcauuagggaagagugaguuccaaauauacaagaaaucgggaauacaggagguugaccgaacccuagcaaaagaggguauuaaaaggggugaaacagaccaucaugcagucagccgagguagcgcaaaacuaaggugguucguagaaaggaauauggucacgccagaaggaaaagugguagauuuaggcuguggucgaggaggcuggucguauuacuguggaggacuaaagaauguacgugaggugaaaggacucacaaagggaggaccaggacaugaagaacccaucccuaugucaacuuacggauggaaucuagucagacuccagucgggcgucgauguauucuuuacaccuccggaaaagugugauacucugcugugugauauaggagaaucauccccgaaucccacugucgaagcggggagaacauuaagaguucucaauuuagucgaaaauuggcuuaauaauaauacucaauuuugcauuaaaguauuaaacccauauaugccaagcgugauagagaaaauggaggcuuuacaaaggaaauacggcggagcauugguacguaaccccuuaucgagaaacagcacgcacgagauguauugggugucgaaugcaagugguaauauuguaucuuccgugaacaugauuucuagaaugcugauuaaucgauuuacgaugaggcacaagaaagcaaccuucgaacccgaugucgauuuagguagcggaacaagaaauauuggcauagagucugagauaccgaauuuagacauuauugguaagagaauagagaaaauaaaacaagaauacgaaaccaguuggcauuaugaccaagaccaucccuacaaaacuugggcauaccacgguuccuaugagacaaaacaaacugguagcgccaguaguaugguaaauggcguaguaaggcuauuaacaaaaccgugggauguagucccaaugguuacacaaauggcaaugacggacacgacgccguuuggccaacaacggguauucaaggaaaaaguagauacucgaacgcaagaacccaaagaggggacgaagaaacuuaugaaaauaacggcggaauggcuguggaaagaauuagguaaaaagaaaaccccaaggauguguacccgugaggaguuuacaaggaaaguuaggucuaaugccgcuuuaggugcuaucuucacugaugaaaauaaguggaaaucugcaagagaggcugucgaagauucacgauuuugggaauugguagauaaagagcgcaauuugcaucuagaaggaaaaugcgagacauguguuuauaauaugaugggcaaaagagagaagaaacuaggagaauuuggaaaagcaaaggggucccgcgcgauaugguauauguggcuaggcgcuagauuuuuggaauuugaggcacuuggauuuuugaacgaagaccauugguuuaguagagagaauagucuaucugguguugaaggagaaggguuacacaaacuaggguauaucuuacgagauguaagcaagaaagagggaggagcuauguacgccgacgacacagcagguugggauacucguauuacauuggaggaucuuaaaaaugaagaaaugguuacuaaucauauggaaggugaacauaagaaauuagccgaagcaaucuucaaauuaacuuaccagaacaaagucguccgcgugcagagacccacgccaagaggcacgguaauggauauaauuaguaggcgggaccagcgugguaguggucaaguaggcaccuauggguuaaauacauucacgaacauggaagcacaacuaauaagacaaauggaaggugaaggaguuuucaaaaauauacagcauuuaacaguuacugaggaaauugcuguacaaaauugguuagcgcgugugggacgggagcgacugucacguauggcuauuagcggagaugauugugucguuaagccucuagacgacagauuugcaagugcacucacugcucuaaaugauauggguaagguuagaaaagacauacaacaaugggaaccaucaagaggcuggaacgacuggacacaagugccauucugcucacaccacuuucacgagcuaauaaugaaggacggaagaguauuagucgugccguguagaaaccaagacgaacuaauaggacgugcaagaauaagccaaggugcggguuggucacuacgggaaacugccugccuaggaaagucuuaugcacagauguggucgcucauguacuuucauagacgagauuuacgacuagcugcaaacgcaauaugcucagcagugccaucacacuggguuccaacgagcagaaccacguggucgauacaugcgaaacaugaauggaugaccacagaagauaugcuaacagucuggaaucgcguauggauacaagaaaauccguggauggaggauaaaacuccagucgaaucaugggaagaaauccccuacuuagguaaacgcgaagaucaauggugugguaguuugaucggacuuacaaguagggcgacaugggccaaaaauauacaaacugcgauaaaucaagugagaucuuuaaucggcaaugaagaauauacugacuauaugcccucaaugaagcgcuuuaggcgagaagaagaagaagcaggaguacucugguag

SEQ ID NO: 22206 - RNA, 9876 nt, Artificial Sequence
  derived and/or modified CDS sequence (opt6) from DENV-2__KF041232__SS-prME
acagcuggugugauaauuaugcucaucccuacggcaauggcauuucacuuaacaacgcgcaauggagaaccgcauaugaucguaucaaaacaagaaaaagggaaaagucuucuuuucaaaacugaagauggggucaauauguguacacugauggcaauggaucuuggggaauuaugugaagacacaauaacauauaauuguccauuacuucgacaaaacgaaccagaagauauagauuguugguguaaugcaacuagcaccuggguaaccuaugggacauguaccgcaaccggagaacaucgacgagagaaaagauccguagcauuagucccacacguaggaaugggucuugaaacgagaacagaaacuuggaugagcagcgaaggggcauggaaacacgcacagagaauagaaacauggauauugcgacaccccggguuuacuauaauggcggcuauucucgcuuauacaauuggaacuacguacuuucaacggguacuaauuuucauccuacuuaccgcuguggcaccgaguaugaccaugcgguguauaggaauuagcaaucgagauuuugucgagggggugaguggagguucgugggucgacauuguauuagaacacggaagcuguguuaccacgauggccaaaaauaaaccaacccucgacuuugaauuaauuaaaacggaagccaaacagccagccacccuucgcaaauauugcaucgaagccaaacuuaccaauacaacgacagcgaguaggugcccaacucagggggaaccaagccuuaaugaggagcaagauaaacguuuugucuguaaacauagcauggucgaucgaggaugggggaacggauguggacuauuugguaaagggggaauagucacuugugcaauguuuacaugcaagaaaaacauggaaggaaaaauaguacaaccagaaaaccuagaauacaccauaguagugacgccacacucaggggaagaaaaugcugucgggaaugacacaggaaaacacggaaaggaaauaaaaguuacgccccaauccucaauaacugaagcugagcuaacggguuaugguacuguaacuauggaaugcagcccacggacaggauuggauuucaaugaaaugguacugcugcaaauggagaacaaagcgugguuaguacacagacaaugguuuuuagaccuacccuuacccuggcuacccggagcagacauacaaggcaguaacuggauucaaaaagaaacucuaguaacauucaaaaauccucacgccaagaaacaagauguaguaguccuaggaucucaagaaggagcaaugcauacagcucuuacgggggcgacugaaauacaaaugucaucaggaaaccuucuuuucacuggccauuuaaaaugucgacuuagaauggacaagcugcaauuaaaagggaugucuuauucaauguguacugguaaguucaagguagugaaagaaauugcggagacccaacaugggacaauaguggucagaguacaauacgaaggugauggauccccuuguaaaauaccuuuugagauaauggauuuagagaaacgccacguguuaggucgacuaauaaccgucaauccuaucguaacugaaaaagacucgcccguuaauauugaggccgaaccaccguuuggugauaguuauauuauuauagggguugaaccugggcaacugaaacuuuccugguuuaagaaaggaucgagcaucgggcaaauguuugaaaccacuaugaggggcgcaaaacgcauggcuaucuuaggagacaccgcaugggacuucggcagccuaggagggguauuuaccucaauaggcaaagcacuucaccagguuuucggugccaucuacggagcugccuuuucugggguuucauggacaaugaaaauccucauuggcguagucaucacauggaucggaaugaacucuagauccaccucguuauccguuagucucgugcugguuggagucgucacuuuauaucugggagcaaugguccaagcagauucuggauguguuguaucauggaaaaauaaagaacucaagugcgggucagggauauucauaacagacaauguccauacauggacugagcaauacaaauuucaaccugagucuccgaguaagcuagcaucagcaauucaaaaagcacaugaagaggggauauguggaauuagaagcguaacuagauuagagaauuuaauguggaaacagauaacuccugagcuuaaucacauauuguccgaaaaugaaguaaagcuaucaauuaugacuggugauauaaaaggcauuaugcaagcagguaaacgaucuuuaaggccgcaaccaacagaauuaaaauacucuuggaagacguggggaaaagcaaaaaugcucuccacggaaccgcacaaucaaacauuccuaauugacgggccagaaacggcugaaugcccaaauaccaauagagcuuggaacucgcuugaaguagaagauuacggguuugggguauucacuacuaauauaugguugaaguuaaaggaaagacaagauguauuuugugauaguaaguuaauguccgcugcuaucaaagauaaccgggcaguccaugcugacaugggauauuggauagaauccgcucuuaacgauacauggaaaauugaaaaggcuucguucauugaagucaagucaugccauuggccaaagagucauacuuuauggagcaacgguguucuggaaucagagaugauuauuccuaaaaauuuugcggguccaguuagccaacauaauuaccguccgggauaucacacacagacagcugggccauggcauuuaggaaaacuggagauggacuuugauuuuugugaagggacuacaguugugguaacugaagauugcgguaacagggggccuucuuugcggacgacuacagccucaggaaaacuuauaacggaauggugcugccguagcuguacauuaccaccucucagauaucguggugaagaugguugcugguacgguauggagauaaggccauugaaagaaaaagaagaaaauuuagugaauagccuuguaacagcgggacauggacaaauagauaauuuuagccuugguguuuuagggauggcgcuauuuuuagaggaaaugcuacguacucggguaggaacgaaacaugcaguauuauugguugcaguuagcuuuaugacgcucauaacuggcaacaugucauuucgggauuugggacgggucaugguaaugguaggggcagcuaugacugaugacauagguaugggggugacguaccuggcucuguuagcagcauuuaaaguacgaccuacauuugcagcaggguuacuuuuaagaaaacuuacgaguaaggaacuuaugaugacuaccauagggaucguauuacuuagccaauccacaacuccggagacaauacuggaacuaacugacgccuuagcucuagggaugaugauacugaaaauuguuagaaauauggaaaaauaccagcucgcaguaacaauaauggcuauacugugcguuccaaaugcugugauccuacaaaaugcuuggaagguaagcuguacuauuuuggcagcagugaguguaucaccucuauuacuuaccucaucucaacaaaaagcagauuggauuccgcuugcguuaacaaucaaagguuuaaaucccaccgccaucuucuuaacaacauuaagucguacaaacaagaaaagauccuggccacucaaugaggcuauaauggcaguuggaaugguaucaauauuagcaucaaguuuauuaaagaaugauauacccaugacaggaccuuuaguagcaggaggguuacuaacagucuguuauguucuaacuggacgcuccgcagauuuagaauuagaaagagcagcggacguacgcugggaagaucaggcagaaaucagugggucgucaccgauccuuagcauuacgauaagcgaggaugguagcaugucuaucaaaaaugaggaagaagaacagacuuugacaauacuaauacgaacgggucuacuuguaauaucaggccuuuuuccaguuuccaucccgauaacagccgcggcaugguacuugugggagguuaaaaagcaacgggcuggaguucuaugggacgucccaaguccacccccgguagggaaagcugagcucgaagacggugcauaucggauuaaacaaaaaggaauacugggauacucacaaauuggagcaggaguauauaaagagggcacguuucacacuauguggcauguaacacgaggagccguauuaaugcacaaaggaaaaagaauagaaccguccugggcugacguucgaaaagauuuaauuuccuaugggggcgguuggaaauuagaaggcgaauggaaagagggcgaggaagugcagguucuagcucuugaaccuggcaaaaauccuagagcuguucaaacaaagcccggguuguuuaaaacaaacacaggaacgaucggcgcugugagcuuagacuucaguccaggaacaaguggaagucccauuguagacaagaaaggaaaaguaguaggucuauaugggaaugggguagugacaagaucggguacuuauguaucugccauagcacaaacagagaaaagcaucgaagauaauccugaaauagaagaugauauuuuucgaaagaaacggcucacaauaauggaucuacacccaggagccggaaaaaccaaacguuaccugccugcuauugugagagaggcgauaaaaagaggucucagaacucuaauccucgcaccaacgagaguaguagcugcugaaauggaagaagcucuuagaggacucccaauaagauaccagacuccggccauccgcgcugagcauaccggacgugaaauaguagaccugaugugccacgcaacauuuacaaugagacuacuaucaccaguuagaguaccuaacuauaauuuaauuauaauggaugaagcacauuuuacugacccugcgucuauagcggcuagaggcuauauuucgacacgaguggaaaugggagaagcugcugguauauucaugacggcaacaccgcccggcaguagggauccauuuccacaauccaaugcaccaauaauggaugaggaaagggagauccccgaacguuccuggaacucuggacaugaaugggucacugacuuuaaagguaaaacuguaugguucguaccuucuauaaaggcuggaaaugauauugcagcgugucugaggaaaaauggaaagaaaguaauacaacugagccggaaaacauucgacuccgaauauauaaaaacgaggacaaaugauugggacuucguuguaacaacagauauuagugaaaugggggcuaauuuuaaagcagaaagaguuauugauccacgaagaugcaugaaaccugugauucuaacagauggagaagaaagggucauuuuagcaggaccgaugccagucacccacuccucagccgcucaacgacguggaagaaucggacguaacccuaaaaaugaaaaugaucaguacauuuauaugggagaaccacuagaaaaugacgaagauugugcucauuggaaggaagccaaaauguuauuagacaacaucaauaccccagaaggcauuaucccaucuauguuugaaccagaaagggagaaaguggacgcaauagauggagaauaccgauugcguggugaggcucggaaaacguucguagacuugaugaggagaggggaucucccgguuugguuagcuuauagaguugcggcagaaggcauuaacuacgcugacagaaggugguguuuugauggaaucaaaaacaaucaaauacuugaagaaaauguagagguagagauauggacuaaggagggggaacguaagaaacuaaaaccgcguugguuggaugcgagaauuuauucagauccuuuagcauuaaaggaauuuaaagaguuugcugccggaagaaagagcuugacguuaaaucuaaucacggaaaugggcagauuacccaccuuuaugacucagaaagcucgaaaugcacucgauaaccuugcgguacugcacacggccgaagcugguggcagagcuuauaaccacgcuuuaagcgaauugccggaaacuuuagaaacccucuuacuucuaacacuuuuagcuaccgugacugguggaauuuuucucuuucuaaugucuggcaaaggaauaggcaagaugacuuuagggaugugcuguaucaucacggccucaauauuacugugguacgcacaaauacaaccacacuggauagccgcaaguauuauacuugaguucuuccucaucguccuacucauaccagaaccagaaaaacagagaacaccucaagacaaccagcuaacuuacguagucauagcaaucuuaaccguaguagcggccaccauggcgaaugagaugggguucuuagagaaaacuaagaaagacuucggcuuaggcucuauagccacacaacagcccgaaaguaacauacucgacauagacuuaaggccagcgucagcauggacacuuuacgcuguagcaacaacauuuauuacuccuaugcuacggcauucgauagaaaacucaaguguuaacgucagcuuaacagccauagcgaaccaagcaaccguauuaauggguuuaggcaagggguggccguuguccaaaauggauauuggcguuccauugcuagcgauaggcuguuauucacaagugaauccuaucacauuaacggcagcgcuguugcucuuaguagcgcauuaugcaauuauugguccuggucuacaagcuaaagcaacgcgagaagcgcaaaaacgugcggcagcuggaauaaugaaaaauccaacaguagaugguauuacagugauagauuuggauccaauaccuuaugacccaaaauucgaaaagcaauugggucaaguuaugcuauuaguuuuguguguaacccaaguccucaugaugcguacgaccugggcacuaugcgaagcgcuuacccucgcgacaggucccauaucaacccuuugggaaggcaacccaggucgguuuuggaacacaacuauugcaguuagcauggcaaauauauuccgcgggucguaucuugccggagccggccuucuauucucgauaaugaagaacaccacaaacacuagacgagguacgggaaacacuggcgaaacucuuggagaaaaguggaaaaauagguuaaauaguuuagguaagucagaauuucaaaucuacaaaaggaguggcauucaagagguagaccguacgcuagccaaagagggcauaaaaagaggagaaacugaccaucaugcagugaguagaggaucugcgaaauuacgcugguuuguugaacgaaauuuaguuaccccagaagggaaaguuguagacuuaggcuguggaagagguggauggucuuauuacuguggggguuuaaagaauguaagggaaguaaaaggauugacuaagggugggccaggacaugaagaaccaauaccaaugucuacguauggauggaaccuaguaagauugcaaucaggugucgauguauucuuuacaccaccagagaaaugugacaccuugcugugugacauaggagaaagcuccccuaaccccacuguagaagcuggaagaacgcuaagaguauuaaauuuaguagaaaauugguugaauaauaacacgcaguuuugcauaaagguuuugaauccauacaugccaucaguuauagaaaagauggagacacuacaaagaaaauauggaggagcguugguaagaaauccauuaagcagaaacagcacacaugagauguacuggguuagcaacgccaguggcaacauaguaucuagcgucaacaugauaucgcguauguuaauaaauagauuuacaaugagacauaagaaagcaaccuacgaacccgauguggaucuugguagugguacucgaaacaucggaauagaaucggaaacuccaaaccucgacauuauaggaaaaagaauagagaaaauaaaacaagaacaugaaacaagcuggcauuaugaccaagaccauccauauaagacaugggcuuaucauggcagcuacgaaacaaaacaaacaggcagugcgaguagcauggucaaugggguuguaagacuuuugacaaagcccugggacguuaucccaauggucacucaaauggcgaugaccgauaccacgcccuuugggcagcaaagaguuuuuaaggaaaagguggacacaagaacucaagaaccuaaagaaggcacgaagaaauuaaugaaaauaacugcagaauggcuuuggaaagaacuugggaagaagaaaacaccgagaauguguaccagagaagaauuugcgcgaaaaguccgaucaaacgcugcccugggagcaauauuuaccgaugagaauaaauggaaguccgcaagggaagcaguagaggauucuagauuuugggagcuaguugauaaggagagaaacuugcacuuggaggguaagugcgaaacguguguuuauaauaugaugggaaagagagagaagaaaauaggagaauuugggaaagcaaaaggaagcagagcgauaugguacauguggcuaggggccagguuccucgaguucgaggcauuagguuucuuaaaugaagaccauugguuuucaagagagaacagcuuaagugguguugaaggugaaggucuacacaaacuaggauacaucuugagagaagucuccaagaaagaagguggagcgauguaugcagacgauacggcaggaugggauacaaggaucacauuagaagaccucaaaaaugaagaaaugguuacuaaucauauggaaggagaacacaagaaauuagcagaagcaaucuucaaacuaacauaccaaaacaaaguuguaagggugcaacguccgacaccccguggaacaguaauggauauaauaucaagacgcgaccagcgagguucuggacagguugguacauacggguugaacacauucacgaauaugggcgcacaauuaauacgacaaauggaaggugaagguguguucaaggguauacagcaccugaccgcgaccgaagaagucgcagugcaagauuggcuugcuaggguagggagggaaagacuuucaagaauggcgauaaguggagaugauugcguaguaaaacccuuagacgaccgauuugcuaacgcuuugacugcccuuaaugacaugggaaaagucagaaaagauauacaacaaugggaacccucgagaggauggaaugauuggacacaaguuccuuucugcucacaccauuuucacgaacuuauaaugaaagaugggcguguuuuaguuguaccuugucgcaaucaagacgaacuuauugggcgcgcuaggauaagccaaggggcaggcuggagucuuagggaaacugcauguuuggguaaaucuuacgcacagauguggucacuaauguauuuccaucgacgagaucucagacuggcggcaaaugcuauuugcucugcaguuccaucucauuggguuccuacgucgaggacuacauggucaauacaugcuagacaugaguggaugacuacggaagauauguugacuguuuggaauagaguguggauacaagaaaauccauggauggaagacaaaacucccgucgaaaguugggaagaaauuccauaccuuggaaaaagagaagaucaaugguguggaucuuuaauuggccugacuagcagagcaacaugggcgcgaaacauucaaacugcaaucaaucaaguacggucauugauaggaagugaagaauacacagacuauaugccguccaugaagcgauuccgaagagaagaagaggaggcaggcguucuaugguaa

SEQ ID NO: 22207 - RNA, 9876 nt, Artificial Sequence
  derived and/or modified CDS sequence (opt6) from DENV-2__KF041233__SS-prME
accgcaggaguuauaauuauguugauaccaaccgcuauggcauuucaccucaccaccagaaacggagagccucacaugaucguaucaaaacaagagaaaggaaaaucccuccucuucaagaccgaagauggugucaacauguguacacucauggcgauggaccucggcgaacuaugcgaagauacaauaacuuauaacuguccuuuauuacgacaaaaugaaccugaagauauugauuguugguguaacuccaccaguacaugggugacguaugggacuuguaccgccacgggagagcaucgaagagagaagagguccguagcauuagugccccauguugguaugggauuagaaacaagaacagaaacauggaugaguucagagggggcauggaaacacgcacagagaaucgaaacauggauauuaagacacccagguuucacgauaauggcugccauauuagccuauacuaucggaacaacauauuuucaaagaguauuaauauucauacuauuaacagccguggcaccaaguaugaccaugcgauguauugguauuuccaacagggacuucguggaagggguuagcggagggucauggguagacauuguuuuagagcacggaucauguguuacuacaauggcuaagaauaaaccgacgcuagauuuugaacuaauuaaaacggaagccaaacagccugcaacacuccguaaauauugcauagaagcaaaauuaacaaauacaacaaccgcaaguaggugcccuacucaaggugaaccgagucuuaaugaagaacaagauaagagauucguauguaaacacuccaugguugaucggggauggggcaauggauguggcuuauuugggaaaggggguauugucacuugugcuauguuuacuuguaagaaaaauauggagggaaaaauaguacaaccagagaaucuagaauauacuauuguggugacaccucacaguggagaagaaaaugcagucgggaacgauacaggcaaacacggcaaggaaaucaaggucacgccccaaucgucaauuaccgaggcggaacucacaggauaugggacuguuacuauggaauguuccccccgcacagggcuagauuucaacgaaaugguacucuuacaaauggaaaauaaggcguggcuaguucacagacaaugguuucuagaucuaccacuaccaugguugccuggugcagacauucaagguucaaauuggauacaaaaagagacgcuaguaaccuucaaaaauccgcacgcaaaaaagcaggaugucguaguauuaggaucucaagagggagcuaugcauacagcauuaacaggagcgacagagauucaaaugagcuccgguaauuuacuguuuacaggccaccuuaaaugucgacuacgaauggauaaauuacaacugaaagguaugucauacagcauguguacaggcaaauuuaaagucguaaaagaaauugcagaaacacagcauggaacaaucgucguucggguacaauacgaaggcgacgguucaccaugcaaaauaccauuugaaauuauggaucuagaaaaaaggcauguguugggacgauuaauaacggucaaccccauaguaacagagaaagacuccccaguaaauauagaagcugaaccaccguuuggggacuccuauauaauaauuggaguagaaccuggacaacuaaaacucucaugguuuaagaagggauccucaauuggucaaauguucgagaccacuaugaggggcgcaaaacggauggcgauauuaggcgauacagcaugggauuucggaagucuagguggaguauucaccagcaucgggaaggcccugcaccaaguuuuuggggcgauuuauggcgcggcuuuuaguggaguuagcuggaccaugaagauucuaauaggcguuguaauaacauggauaggaaugaauucaagguccacuaguuugaguguaagcuuaguauuaguaggaguaguuacacuauaucuuggagucaugguucaggcagauucgggcugcgucgugucauggaagaacaaagaauuaaaaugcgguucugggauuuucaucacagacaacguacacaccuggacggaacaauauaaauuucagccagagucaccaucaaagcuugcugcugcaauccaaaaagcacaugaagaaggaauaugcggcauaagauccguaacuagacucgaaaauuuaauguggaaacaaauaaccccagaauugaaccacaucuuaagcgaaaacgagguuaagcucagcauuaugaccggggacauuaaaggaauaaugcaagcgggcaaaaggagucuucgaccacaaccaacugaauugaaauauuccuggaaaacuuggggaaaagcuaaaauguuaucuacagaaccccacaaccaaaccuuccuaauagacgguccggagacggccgaaugucccaauacaaaccgagcuuggaauucauuagaaguugaagacuacggauucggcguuuuuacuacuaauauaugguuaaaauuaaaagaaaggcaggacgucuucugcgacaguaaacucaugucagccgcuauaaaagacaauagggcaguucaugcagauauggguuauuggauagagagugcauuaaaugacacauggaaaauagaaaaggcaagcuucaucgagguaaaauccugucauuggccaaagagucauacacuuuggucaaauggaguccuugagagugagaugauaauuccaaagaacuuugccggcccagucucgcaacauaacuaucgaccuggauaucauacccaaaccgccgguccuuggcaucuugguaaacuugaaauggacuuugacuuuugugaaggcacuacggugguaguuacugaagacugugguaaccguggaccaaguuuaagaaccacuacugcaagcgggaagcuaauaacagagugguguugucguucaugcacccucccaccccuucgauaccgaggagaagauggauguugguaugguauggaaauaaggccacuaaaagaaaaagaagagaauuuagugaacagucucguaacagcaggacacggacaaauagacaauuucagucuaggugucuuagguauggcauuauuccuugaagaaaugcugagaacuagaguaggaacuaaacaugcaguuuuguuaaucgcuguauccuuuaugacucuuauaacuggaaacaugucuuuuagagauuuaggacggguaauggucaugguaggagccgcgaugacugaugauauaggaaugggugucacauaucuagcauuauuagcagcguuuaagguaagacccaccuuugcugcuggauuauuacuaaggaagcugacuucaaaagaacuaaugaugacuacuauuggcauaguccuauuaucucaaucaacuacaccugaaacaauuuuagagcucacugacgcucuggcacuugggaugaugauucucaaaauagucagaaacauggaaaaauaucaacuagcaguuacaauaauggcaauucuauguguaccaaacgcagugauuuuacaaaacgcuuggaaaguaagcuguacaaucuuagcugcagucucaguuuccccuuuauuauuaacuuccagucaacaaaaagcggacuggauuccccuagcguuaacaaucaagggcuuaaauccuacugcaaucuuucugacuacauuaucacguacuaacaagaagcgcaguuggccacucaaugaggcuauaauggcagucggcauggucaguauacuggccagcucucuauuaaaaaacgauauuccuaugacaggcccccuaguugcgggaggccuuuuaacaguaugcuaugucuugacaggcagaagcgcagauuuagaacucgaaagagcagcagauguccgcugggaagaccaagccgaaauuagugguucgucaccaauuuuaucaauuacgauuagcgaagacggaucaaugucuauuaaaaaugaggaagaagaacaaacacuaacaauuuuaauucgaacggguuuacuagugauaaguggcuuauuuccagugucaaucccuauaacagcggcagcaugguacuuaugggaaguaaaaaaacaaagagcuggaguuuugugggacguacccaguccuccaccugugggaaaagcagaguuagaggacggagcuuaccgaauaaaacagaaagguauacuugguuauucgcaaauuggggcggguguguacaaagaagguacuuuucacacgauguggcacguuacacggggagcaguacuaaugcacaagggcaaaagaauagaaccaucuugggcggauguaagaaaagaccuuauuucuuauggugguggauggaaguuagaaggugaguggaaggaaggugaagagguacaaguacucgcacuggagccagguaaaaaucccagagccguacagacuaaaccggggcuuuucaagacuaauacgggaaccaucggcgcuguauccuuagauuucagcccagguacaagugggaguccaauugucgacaaaaaagguaaaguagucggauuauacggcaaugggguaguuacaagaucuggcaccuaugucucagcaauugcgcaaacugagaaaucuauugaagacaaucccgaaauugaggaugauauauuuaggaaaaaaaaacucacaauaauggauuuacauccuggcgcaggaaaaacgaagagauaucuuccugcuaucguaagagaagcuauuaagcgaggauugcguacucuuauauuagcaccaacuaggguaguggcagccgagauggaagaagccuuacgcgggcugccaaucagauaucaaaccccggccauaagggcagagcauacggggagagagauaguagaccucaugugucacgccacuuucaccaugagacuauuaucaccgguccguguaccuaacuauaaccuaaucauuauggacgaagcacacuucacggacccagcaaguauagcggcuagaggauauauuucuacaagaguugaaaugggcgaagcagcagggauuuuuaugacagcgaccccuccuggcucaagagauccguucccccaaagcaacgcaccaauaauggaugaggagcgcgaaauaccagaacguucuuggaauaguggccaugaauggguaacugauuuuaaagguaaaacaguaugguucgugcccucgauaaaagcagguaacgauauagccgccugucuccgaaagaauggaaaaaagguaauucaguuaagucgaaaaacauucgacagcgaguacaucaaaacuagaaccaaugauugggacuucgugguaacaacagacauuagugagaugggugcaaacuuuaaagcagaaagaguaauugauccccguagauguaugaaacccguaaucuuaaccgauggugaagaaagagucauauuggcugguccgaugccuguaacgcacaguagugcggcacaacgccgagguagaauagguagaaauccaaaaaacgagaacgaucaguauauauacaugggcgagccgcuugaaaaugaugaagacugcgcacacuggaaggaggcuaaaauguugcuagauaacauaaauacgccagaaggaauaauaccgagcauguucgaaccugagagagaaaaaguagacgcaauagauggugaauauagguugagaggcgaagcucgcaaaaccuuuguagaucucaugagacguggugauuuaccuguauggcuagcauauagggucgcugcagagggcauaaacuaugcagaucgacggugguguuucgaugguauaaagaauaaccaaauuuuggaagagaacguugagguugagaucuggaccaaagaaggcgaaaggaagaaguuaaaaccacgcuggcuagacgcaaggauauacuccgacccucuugcucuaaaagaauuuaaagaguuugcagcagggcgaaaaucacugacuuugaauuuaauaacagaaaugggcagauuaccgacauuuaugacacaaaaagccagaaaugcucuugacaaucuagcgguacuacacacagcagaggccgggggaagagcuuacaaucaugcguugucagaacuaccagaaacucuggagacccuucuacuguuaacacuucuagcuacaguaaccggggggauauuuuuauuucuuaugaguggaaaagguaucggaaaaaugacccugggcauguguugcauaauaaccgccaguauucuacucugguaugcacaaauacaaccucacuggauagccgcaagcauaauccuagaauuuuuucuaauaguucuucuuauacccgaaccggaaaaacaacggacaccucaagauaaucaacuaacauacgugguaauugcaauuuuaacaguagucgcagcuacgauggccaacgaaaugggauuccuagaaaagacuaagaaagauuuuggauuagggucaauagcaacacaacaacccgaaucaaacauuuuagacaucgaccuccguccggcaucagcuuggacauuauaugcuguagcaacuacauuuauaacgccuaugcuacgacauagcaucgaaaacucaaguguaaauguuucguugacagcaauugccaaccaagccaccguacugaugggauugggaaaaggcuggccauuaagcaaaauggauauaggaguuccccuuuuagcaauugguuguuacagucaaguuaauccaaucacucuuacagcagcccuacuacuccuggucgcacauuaugccauuauaggaccaggucugcaggcaaaagcaacucgcgaggcccagaaaagagcagcugcggguaucaugaaaaauccgacuguagauggcauuacagugauagauuuggacccaauaccuuacgauccuaaauuugagaaacaauuaggucaggugauguuauugguacuaugugucacacaaguucuaaugaugagaaccacaugggcuuuaugcgaagcgcuaacccuagcuacgggacccauuucgacgcucugggaaggaaauccagggagauuuuggaauacaacuauugcagugucuauggcaaauauauuuagaggaaguuaucuagcaggcgcaggacuauuauuuucaaucaugaaaaacacaacaaauacgagacgaggaaccggaaauacaggcgaaacgcuuggggaaaaauggaagaauagauuaaacagccucggaaaaucggaauuucaaaucuauaagcgcucugggauacaagaaguagaucguacucuggcaaaagaaggaauaaagaggggcgagaccgaucaucaugcgguaucgcgaggcucggcuaaauugcgaugguuuguagagcgaaauuuagucacuccagaaggaaaagucguagaccucggauguggaagaggcggguggaguuauuacuguggaggucuaaaaaacguacgagagguaaaaggccuuaccaaaggcgggccaggucaugaagagccgauacccaugagcacuuaugguuggaacuuaguaagauugcaaucaggggucgauguauuuuuuacucccccugaaaagugugacacauuauuaugugauauaggagagucaaguccuaaucccaccguagaggcaggucgcacucugagaguacuuaaucugguugaaaauugguugaauaacaauacacaauuuuguauaaagguauuaaauccauauaugccaaguguuauagaaaaaauggaaacucuacagcgaaaauacggaggugcacugguaagaaauccguugucacguaacucuacacacgaaauguauuggguuucaaacgcuucuggaaacauaguaagcagugucaacaugauaagucggaugcucauaaaccguuucacaaugcggcacaaaaaggcgacauaugaaccugacguggacuuagguagcgguacgagaaauaucggcaucgaaagcgagacaccuaaccuagacaucaucggcaagcgcauagaaaagauaaaacaagagcacgaaacgaguuggcauuaugaucaagaucauccauauaagaccugggcauaucacgggagcuaugaaacaaagcagacugguagcgcaucauccaugguaaaugguguuguacgacuuuuaaccaaaccaugggaugucaucccgaugguaacucagauggcuaugacagacacuacacccuucggucagcaaagaguauucaaggaaaaaguagacacuaggacucaggaaccaaaagaagguacaaaaaagcucaugaagauuaccgccgaauggcuuuggaaagaauuggguaaaaagaaaacgccgagaauguguacacgcgaagaauucgcucgaaaaguacguaguaaugcagcauuaggagcaauuuucaccgaugaaaauaaauggaaaucugcgagagaggccguagaggacucaagauuuugggaauuaguugauaaagagcgcaacuuacauuuagaaggaaaaugugaaacaugugucuacaacaugaugggaaagagagaaaaaaaaauaggagaguuuggaaaagcaaaagguaguagagccaucugguauaugugguugggagcccguuuucuagaauuugaagcauuaggauucuuaaaugaagaucauugguuuucaagagaaaacucauugagugguguggaaggcgaaggucuccacaagcuaggauacauauuacgggaggugaguaagaaagaaggaggagcuauguacgcagacgauaccgcgggaugggacacacgcauaacucuagaagaccucaaaaacgaggaaaugguaaccaaccauauggaaggagaacacaaaaaguuagcggaagcgauuuucaaacuuacauaccaaaauaaaguaguaagaguccaacgaccaacaccaagagguacugucauggauaucauaucacgucgugaccagaggggauccggacaaguaggaacguacggauugaauacauuuacuaacaugggcgcucaacucauacgacaaauggaaggcgaaggaguuuucaaaggcauacaacauuuaacugcaacugaagaaguggcgguucaggauuggcuagcucgaguuggaagggaacgacuaucaagaauggcuauaagcggugacgacugugugguaaaacccuuggaugauagauuugcaagugcauuaacagcguuaaacgacaugggaaaagugagaaaagacauucaacagugggaaccuucacgagguuggaacgacuggacacaaguaccguuuuguucacaccauuuucaugaacuaauuaugaaagacggaagaguauuaguaguuccauguagaaaucaagacgaguuaauaggaagggcacgaaucucccagggcgcugguuggaguuuacgugagacagcguguuuaggaaaaaguuaugcucaaauguggucguuaauguacuuucaccgaagggauuuaagacucgcagccaacgcaauuuguucggcaguuccuucucacuggguucccaccucgagaacgacauggaguauccaugcccggcacgaauggaugaccacugaggacauguuaacugucuggaauagaguauggauucaagaaaauccguggauggaggauaaaacauugguagaaucaugggaagaaauucccuaccugggaaagcgggaagaccaauggugcgguucgcuaauugggcuaaccucacgcgccacuugggcaaggaauauacaaacugcaauaaaucaaguccggagccuaauagguuccgaagaauauacugacuauaugcccucaaugaaaagguuuagaagagaagaggaagaagcggguguucucugguag

SEQ ID NO: 22208 - RNA, 9876 nt, Artificial Sequence
  derived and/or modified CDS sequence (opt6) from DENV-2__KF041234__SS-prME
acugcaggaguaauuauaaugcugauuccaacagcaauggcauuucaccucacaacacguaacggggaaccccauaugauugugucuaaacaagaaaaaggaaaaucauuauuauuuaaaacagaagacggaguaaacaugugcacgcucauggcgauggacuuaggagaacuuugugaagauacaauaaccuauaacuguccuuuguuaagacagaacgagccagaagacauugauuguuggugcaaugcaacgucuacauggguaacauaugguacgugcacggcaacaggugaacauagaagggagaaaagaucaguggcccuaguaccacacguagggaugggauuagagacuagaaccgaaacuuggaugucuucugagggggcauggaaacaugcacagcggauugagacauggauuuuacgucacccaggauuuacaauaauggcugcaauccuagccuauaccauugguacuacuuauuuucaaaggguuuugaucuuuauccuucuaacugcgguagcgccuucaaugaccaugcguuguauaggaauuaguaaucgagauuuuguagagggaguaaguggugggagcuggguagauauaguauuagagcauggcucuugcguaacgacgauggccaaaaauaaaccaacacuugacuucgaacuaauuaaaacggaagcaaaacagccagcuacauuaagaaaauauuguauugaggcuaaauuaacgaacacaacgacagcuucaagauguccuacucagggggaaccuagccuuaacgaagaacaggauaaaagauucguuuguaaacauucuaugguugaccggggauggggcaauggauguggacuauuuggcaaagggggaauaguuacgugugcgauguucacauguaagaaaaauauggaaggaaaaaucguucagccagaaaauuuggaauauaccauuguugugacaccucauucuggugaagaaaacgccguagggaacgacacugguaaacacggaaaagagauuaaaguaacaccgcaaucgaguaucacagaggcugaacuuaccgguuauggcacaguuacaauggaauguaguccuaggaccggucuagacuuuaacgaaaugguccuucuucaaauggaaaauaaagcguggcuaguacacagacagugguucuuagaccuuccguugcccugguuaccgggagcagauauucagggaaguaauuggauacaaaaagagacauuaguaacuuuuaaaaacccacacgcuaagaaacaagauguugucguacuaggcagccaagaaggagcaaugcauacugcacucacaggcgccacagagauacaaaugucgucagggaauuuguuauuuacgggucacuuaaaaugucgacucagaauggacaaauuacaacuaaaaggcaugaguuauucuaugugcacgggaaaauuuaaagugaucaaagaaauagcugaaacacagcacgggacaauaguggugagaguacaguaugaaggcgauggcucaccuuguaagauaccuuucgaaauaauggacuuagaaaaacgucauguauuaggaagauuaauuacagucaauccaauagugaccgaaaaggauagucccguaaacauugaagcagaacccccuuuuggugacucauauauuauaaucgguguugaaccuggccaguuaaaguuaucaugguuuaagaaagggucuucgaucggucaaauguuugaaacaacaaugcgcggugcaaaacguauggccauacugggcgauacggcuugggacuucgguucgcugggaggaguauucacaagcauagggaaagcguuacaucagguguuuggcgcaauauauggcgcugcauuuucuggaguaucuuggacgaugaaaauauuaauuggcgugguuauuacauggauaggcaugaacucucgaagcacaucuuuaucagugucguuggucuuaguagggguaguuacucuauauuugggcgucaugguccaagcagauaguggaugcguaguuaguuggaagaauaaagaacuaaaaugugguagcggaaucuucauaaccgauaaugugcacacuuggacggagcaauacaaauuucaacccgaaucacccagcaaacuagcaagcgcaauccaaaaagcgcacgaagaaggaaucuguggaauacgaaguguaacacgccuggaaaauuuaauguggaaacagauuacaccugaauuaaaccauauacuuagcgaaaaugaggugaaauugucuaucaugacgggugacauaaaaggaauaaugcaagcgggcaaacguucacuaagaccucagccaacagagcuaaaauacaguuggaaaacauggggcaaagcuaagauguuguccaccgagccucauaaucagacauuucuaauagaugguccagaaacagcagaauguccaaauacuaauagagcuuggaacaguuuagaaguugaagacuauggcuucggaguguucaccacaaauaucugguuaaaacuaaaagaacgccaggacguauucugcgauucaaagcucaugucggcagcaauaaaagacaaccgagcaguacaugcugauaugggauauuggauagaaucugcacugaacgauaccuggaaaauagaaaaggcauccuucauugagguaaaauccugucacuggccaaaaucccauacauuguggucaaaugguguccuagaaucugaaaugauaaucccgaaaaauuuugccggaccgguaucucagcauaauuaucgaccaggauaucacacucaaacugcuggucccuggcaccugggaaagcuggaaauggauuucgacuucugugaaggcacaacuguuguagugacagaagacuguggaaaucgaggcccuucccuaaggacuacgaccgcuucggggaaauuaauuaccgagugguguugucgaucguguacacugccuccgcuacgauaccguggugaggacggaugcugguacgguauggagauaagaccucuaaaggaaaaggaagagaauuuaguuaacaguuuagugacagcuggucacggccagaucgacaauuucucccuagggguauugggaauggcccucuucuuagaagagauguuaagaacgagaguaggcacuaaacacgcaguacuguuaguagcagucaguuuuaugacacuaauaacugggaauaugagcuuccgugaucuaggaagaguaaugguuaugguaggagcagcuaugacggaugacauaggaaugggaguuacauaccuagcacuauuagcugcguuuaaagugagaccgacauuugcagcaggacuuuuguuacgaaaauugacaucuaaagaacugaugaugacgacuauagguauuguucuuuugucgcaaucuacuacuccugaaacuauauuggaauuaacagaugcacuggcccugggaaugaugauucuuaaaauagugcgcaacauggaaaaauaucagcuagcaguaacgauuauggcgauccucuguguuccaaaugcaguaauucugcaaaaugcauggaaaguaucgugcaccauacuggcugcgguaucaguuucuccgcuccuacuaacaucgucacaacagaaggcugauuggauuccauuagcccuuacgauaaaaggacuaaaucccacagcaauauuucuaacaacucugagccgaacuaauaagaaaaggucguggccucucaacgaagcaaucauggcgguagggauggugucgauuuuggcuucaucauuguugaaaaaugacauaccuaugacggguccacuuguugcaggaggucuacuaaccguauguuauguauuaacuggucgguccgcggaucuagaacuagagagagcggccgacgugcgaugggaagaucaggcggagauuaguggcagcucaccgauacuauccaucacuauaucugaagacgggaguaugaguauaaagaaugaggaagaagaacagacauuaacgauucuaauucgaacgggacuacuuguaaucagcggauuauuucccgucucuauaccaauaaccgcagcagcgugguaucuuugggaaguaaagaaacagcgugccgguguucuuugggacguaccaucacccccgccuguagggaaagcagaauuggaagacggugcuuauagaauaaaacaaaaaggaauauugggcuauagucaaaucggugccggcgucuacaaggaaggcacauuucacacaauguggcauguuacaagaggggcggucuuaaugcacaagggaaaacgcauagagccauccugggcagauguuagaaaagaccucauaaguuacgggggcggauggaaacuugaaggagaauggaaagaaggagaggaaguucaaguauuagcccucgaacccgggaagaacccacgugccguccagacaaaaccgggacuauuuaagacaaauacuggaacuauuggcgcgguuagcuuagauuuuucgccaggaacuucggguagucccaucguugacaaaaaggguaagguaguuggucuauaugggaacggaguagugacgcgcucugguaccuauguaucagcgauagcacaaaccgagaaaaguaucgaagauaacccagaaauagaagaugacauauucaggaagaaacgacuaacaauaauggauuuacacccaggggcgggaaagacaaagagauaucucccggcuaucguaagggaggccauaaaaagggggcuucggacacugauccuagcacccacuagaguaguugcagcugagauggaagaagcgcuuagaggauuaccaauucgcuaucagacgccugccauaagggcagagcauacagguagggaaauuguagauuuaaugugccaugcuacguucaccaugagacuucuaaguccugucagaguaccuaauuacaaucuaauaaucauggaugaagcacauuuuacugauccugcaucuauagcagccagagguuauauauccacccggguagaaaugggggaagcagcaggaaucuuuaugacugcaaccccaccuggaucacgggauccuuuuccccagucuaaugcuccaauuauggaugaagagagagaaauaccagagcgaaguuggaauaguggucacgaauggguaacagauuucaaagggaagacaguuugguuuguaccaaguaucaaagcuggaaacgacauagcagcuugucuacgaaagaacggcaagaaaguaauucaacuaaguagaaaaacguucgacucagaguauauaaaaacucguaccaaugauugggacuuuguugucaccacagauaucuccgagaugggcgcaaauuuuaaagcggaacgugugauagacccaaggcgauguaugaagccagucauuuuaacugauggagaagaaagaguuauuuuagcagggccuaugccaguaacucauucgucugcagcccaaaggagaggaagaauugggagaaauccgaaaaacgaaaaugaucaauacaucuacaugggagaaccucuagaaaaugaugaggacugcgcccauuggaaagaagccaaaauguuauuagauaauauaaauacacccgaagguauaauaccaucaauguucgaaccagaacgggagaaaguagacgcaauagauggugaauauagacugcggggagaagcccgaaaaacguuugucgacuuaaugagaagaggcgacuugccugucuggcucgcauauagaguagcugcugaaggaauaaacuacgcggaucgaagguggugcuucgaugguaucaaaaacaaccagauacuugaagaaaacgucgaaguagaaauuuggacgaaagaaggagaacgaaagaaacuuaaaccacgguggcuagaugcuagaaucuacucggauccgcuggcauuaaaagaauuuaaagaauuugcagcgggaagaaaaucgcuaacguugaaccuuaucacagaaaugggaagacuacccacauuuaugacccaaaaagcgagaaacgcauuggauaaucuugccguucugcauaccgcagaagcuggcggcagagcuuauaaucacgcauuaucagaacuuccagaaacccuugaaacccuacuucuuuugacucuauuggcaacaguaacugggggaauuuuucuauuccuaaugucagguaaaggaauaggaaaaaugacauugggaauguguuguauaauaaccgcaagcauacuacuuugguacgcacagauucagccacauuggauugcagcgucaauaauuuuagaguucuuucugauaguacucuugauaccugaaccggaaaaacagaggacuccacaggauaaccaauuaacauacguaguuauagccauucuuaccguaguugcugcuaccauggcaaaugaaaugggcuuuuuagagaaaacaaagaaagauuuuggucuagguagcaucgcgacucaacaacccgaauccaauauacuagacauagaucuccgccccgcuuccgccuggaccuuauacgcaguagcaacgacauucauaaccccaauguuacgccacaguauugaaaacuccagugucaauguaucauuaacagcuauagccaaucaggccaccgugcucaugggucuaggaaaaggauggcccuuaaguaaaauggauauuggugugccccugcuugcaauagguuguuauagccaggugaauccuauuacauugacugcagcccuacuuuuauuaguugcccacuaugcaauaauuggaccaggauuacaagcaaaagcgacacgagaagcacagaagagagcagcagcugguauuaugaaaaauccaacugucgauggaauaacaguuauagauuuagaucccauaccauacgauccuaaguucgaaaaacaauugggacaaguaauguugcuaguccucuguguuacucaaguucuaaugaugcguacaacaugggcuuuaugugaagcgcuuacucuagcaacaggacccaucaguacacucugggaaggaaauccggggagauuuuggaacaccacgauagcagucucuauggcaaauauauucagaggaaguuaucuggcuggggccggcuuacuauuuucaauuaugaaaaauacgacgaacacgcggaggggaacagggaauacuggagaaacauuaggagaaaaguggaaaaaucgcuuaaauucuuuggggaaaagugaguuucagauuuacaagaggaguggaauacaagaaguagauagaacucuggcaaaagaagggauuaaaagaggggagacagaucaccaugcgguaagcagaggaucugcaaaacuaaggugguucguugaaagaaacuuagucacaccugaagguaaaguuguggaucuugguuguggcaggggaggcuggagcuacuauuguggagggcuaaagaacguacgagaaguaaaaggguuaaccaaagggggacccggccaugaagaaccgauaccuaugaguaccuacggguggaauuugguaagacuacaaaguggagucgacguauucuuuacaccaccagagaaaugcgauacguuacugugugauauuggcgaaucaucaccaaacccgacaguagaagccggucgaacauuaaggguucugaaccuuguggagaacugguuaaauaauaacacacaauucuguauuaaaguuuugaauccuuacaugccuucgguuauugagaaaauggaaacacugcaacgaaaauauggaggggcauuagugagaaacccgcuaaguagaaacaguacacacgaaauguacuggguuaguaaugcguccggaaacauuguaagcagcguaaacaugauuaguaggauguuaauuaacagauuuacgaugagacauaagaaagcuaccuaugagccugacguagacuugggcucuggaacucgcaauauugguauugaaucagaaaccccuaaucuggauauaauaggaaagagaauagagaaaauaaagcaggaacaugaaacuucauggcacuaugaccaggaucauccuuauaaaaccugggccuaccacgguaguuacgagaccaaacaaaccggaagugcaaguucaaugguaaaugguguagugagauuacuaacuaaaccaugggauguuauuccaaugguaacucaaauggccaugacagauacaacaccguuuggccaacaacguguauuuaaggaaaaaguagacacacgcacucaagaaccuaaagaagggacgaagaaacuaaugaagauuaccgcagaaugguuauggaaagaacuaggcaagaagaaaacgccucgcauguguacucgagaggaauuugcgcgaaagguuagaucuaaugccgcucucggcgcaaucuucaccgacgaaaauaaguggaaauccgcacgagaagccguugaagauucgagauuuugggaauuaguagauaaagaaagggaucuccacuuagaagguaaaugcgaaacaugcguauauaacaugaugggaaagagagaaaagaaaauaggagaauuugggaaagcaaaaggcaguagggccauaugguacauguggcuuggugcccgauuuuuggaauuugaggcacuaggauucuuaaaugaggaccauugguucucccgggaaaauaguuuaucaggaguagaaggugagggucuucacaaacuuggauauauacuucgugaaguaagcaagaaagaaggaggagcaauguacgccgacgacacugcaggaugggacacuagaauuacguuagaggaccuuaagaacgaagaaauggucacuaaccacauggaaggggaacacaagaaacuggcagaagcaauauucaaacuuaccuaucagaauaaaguaguuagaguacaacgcccuacuccaagagggacuguaauggacaucauaucacgaagagaucaacgagguagcggacagguaggcaccuacggucuaaauacuuuuacuaacaugggagcacaacuaauucgucagauggagggagagggaguuuuuaaagggauacaacaucuaacugcuacggaggagguugccgugcaagacuggcucgcacgcgucggacgagaacgucugagccgaauggcuauuagcggggaugauugcguuguaaaaccauuggaugaucgguuugcuaacgcacuuaccgcucuaaaugauauggguaaaguaaggaaagauauacaacaaugggaaccuucuagaggauggucagauuggacacaaguaccuuucugcucgcaucauuuucaugaguugauaaugaaagauggcagaguauuaguagucccgugcagaaaccaagaugaacugauaggccgagcuagaauuagucaaggggcuggcuggagcuuaagagaaacagcuugucuggguaaaucauaugcucagauguggagucuaauguacuuccacaggagggaccuccgauuagcagccaaugcgauaugcagugcuguuccaucucauugggugccaacaucaagaacgacauggaguauacaugcgcgacaugaauggaugacaacagaagacaugcucacaguguggaauaggguguggauucaggagaacccuuggauggaagauaaaacgcccguagagaguugggaagaaauuccauaucucggaaagcgugaggaccaguggugugguucuuuaaucggcuugaccagcagggcaacaugggcacgaaacauucaaacagccaucaaucaagucaggagcuuaaucggaucugaagaguauacugacuauaugccuagcaugaagagauuccguagagaagaagaggaggccggcguauuaugguga

SEQ ID NO: 22209 - RNA, 9876 nt, Artificial Sequence
  derived and/or modified CDS sequence (opt6) from DENV-2__KF041235__SS-prME
accgcugguguuauaauaaugcuaaucccaacugcuauggcauuucauuugacuacaaggaacggugaaccacacaugauagugaguaaacaagaaaaaggaaagagcuuacuuuucaaaacagaagacggagugaauaugugcacauuaauggcaauggaccuuggagaauuaugugaagauacgauaacauauaauugcccacuacugcgccaaaacgaacccgaagauauagauuguuggugcaacucaacaaguacaugggugacguaugggacaugcacugcaacgggagagcacaggagagagaaaaggucggucgcguugguaccucaugucggcaugggccuugaaacaaggaccgaaacuuggaugucaagcgaaggcgcauggaaacaugcacaacgaauagagaccuggauauuaaggcauccagguuuuacgauaauggcggcuauauuagcuuauacuauugguacaacauauuuucaacggguauuaaucuuuauuuuauugacggccguagcuccaagcaugacaaugcgcuguaucggcaucucaaacagagauuuuguggaaggcguaucaggugguagcuggguagacauuguucuugaacacgguucaugcgucacgacgauggccaaaaacaaaccaacacuugacuuugaacucauaaaaacagaggccaaacaaccugcuacacuacgaaaauauuguauagaagccaaacuaacgaauacaacaacagcguccagauguccuacacaaggagaaccaaguuuaaaugaagaacaggacaaacgauuugucuguaaacauucaaugguugaccgagguugggguaacgguugugguuuauuuggaaaagguggaauagucacgugcgccauguucacauguaagaagaauauggaaggcaaaaucguacaacccgaaaaccuggaauacaccauaguaguuaccccgcacucaggagaagaaaaugcuguaggaaacgacacugguaaacauggaaaagaaauuaaaguaacuccccaaaguaguauaacugaggcagaauugaccggguaugggacugucaccauggaauguucacccagaacgggucuagacuuuaaugaaaugguacuauugcagauggagaauaaggcuuggcucguucacagacaaugguuccuugaucuuccucuaccauggcuuccuggugcagauauucaaggaaguaacuggauacaaaaagaaacuuuagugacauuuaaaaacccacaugcuaagaaacaagacgucguggucuuaggcucgcaggaaggagcgaugcauacugcucuuacuggggcuacagaaauucaaaugaguucugguaaucuuuuauuuaccgggcacuugaaaugccgauugcgaauggacaaauugcaauugaaagggaugucauauaguauguguacuggaaaauuuaaggucguaaaagaaauagccgaaacccaacacggaacaauuguuguaaggguacaauaugaaggugacgggagucccuguaaaaucccauucgaaauuauggaccuugaaaaacggcacguuuuagggagacuaauaacuguaaauccaauagucaccgaaaaggauaguccaguaaauauagaagcggaaccuccauuuggggacucuuacauaauuaucggugucgaaccaggccaacuuaaacucucaugguuuaagaaaggguccucaauuggucaaauguuugaaacaacgaugagaggggcaaaaagaauggcuauccuaggggacacagcuugggauuucgguucucucggaggaguuuucacuucuauaggaaaagcucuccaccaaguuuuuggcgcuauauacggugcggcuuucucugggguaucauggacaaugaagaucuuaauagguguaguaaucacauggaucggaaugaauaguagaucuacgagccuuucaguaaguuugguacugguaggcguagucacucuauacuuaggcgucaugguucaagcugauucugggugcguaguuaguuggaaaaacaaggaauugaaauguggcagugguauuuuuauuacggauaacguacacaccuggacggaacaauauaaguuucaaccagagagcccuaguaaacucgcuucagcgauacagaaagcucaugaggaaggcauaugugguauaagaaguguaacucgauuagagaaucuaauguggaaacaaauaaccccggaacucaaucauauauuaagcgaaaaugaagucaaauugaguauaaugacuggagauaucaaagguauaaugcaggcuggcaaacggucuuuaaggccgcagccgacagaacuuaaauacagcuggaagacgugggguaaagcaaaaaugcuaaguaccgagccccauaaccaaacuuucuugauugauggcccagaaacagcugaauguccaaauacaaaccgcgccuggaacucacuggaaguagaggauuauggauucggagucuuuacaacaaauaucugguuaaaguuaaaagaaagacaggauguguuuugcgauucuaaacuuaugagugcagcuauaaaagauaauagagcugugcacgcagacaugggauacuggauugaaagcgcuuugaacgauacguggaaaauagaaaaggcuucauuuauagaaguuaaauccugccauuggccaaaaagucauaccuuauggaguaacggcguguuagaaagcgagaugauuauucccaaaaauuuugccgguccaguuagccaacacaacuaucgacccggcuaucauacccaaaccgcagguccauggcaccuuggcaaauuagaaauggacuuugauuuuugugaaggaacgaccguggugguaacggaagauugugguaauagaggcccaucauuacgaacuaccacagcaucugggaaacuaauaacggaaugguguuguagaaguuguacauuaccucccuuaagguaccgaggugaggaugggugcugguauggaauggaaauaagacccuuaaaagaaaaagaggaaaacuuaguaaauucacucguaacggcuggacacggucaaauagauaauuuuucacuaggggucuuaggaauggcucuuuucuuagaagagaugcuuagaacucgagucggaaccaaacaugcuguacuuuugguugcaguaucguucaugacauuaauaacaggaaauaugagcuucagagaucuaggacgaguuauggugaugguaggugccgcuaugacagacgacauaggaaugggagugaccuauuuagcacugcuagccgccuucaaagucagacccacauucgcggcaggacuauugcuaagaaaauuaacauccaaagagcucaugaugacaaccauagggauaguuuuacuuucccagaguacaacgccagaaaccauucuugaauuaacagacgcacuugcucuuggcaugaugauuuugaaaauuguacggaauauggaaaaauaucaauuggccgugaccauaauggcaauacucugcguuccaaacgccguuauuuuacaaaaugcauggaagguuucuuguaccauucuugcagcagucucaguaagucccuuauuguuaacaagcucucagcaaaaagccgauuggauaccccuagcuuuaaccauaaaagggcuuaacccaacggccauauuuuuaacuacuuuaagcaggacuaauaagaaacgauccuggccacucaaugaagcuauuauggcgguagggaugguaucaauacuggcuucgagucuacugaaaaacgacauaccaaugacaggucccuuaguagcgggaggauuguugacaguaugcuacguccugacagggagaucagcagaucuggaguuagaacgagcagcagauguaaggugggaggaucaggcugaaauuagugggucaaguccaauccugucgauuacaauuuccgaagacgggaguaugagcauuaaaaacgaggaagaagaacaaacacuuacgauucucauccgcacaggacuauugguuauaaguggucuauuuccaguuagcauucccauuacagcugcugcaugguacuuaugggaagucaaaaagcaacgagcaggaguacucugggacguaccaaguccaccucccguggggaaagcagaauuagaagauggagcuuauagaauuaagcaaaaaggaauccucggauauagucaaauuggagcugguguuuacaaagaaggcacuuuccacacaauguggcacguuacacgaggagcuguauugaugcacaaggguaaaagaauagaaccgaguugggcagacguacguaaagaucugaucucauacggcggaggcuggaaauuggagggagaauggaaagaaggagaggaggugcaaguucuggcguuagaaccgggcaaaaauccacgagcuguccaaaccaaaccaggucuuuucaaaacgaauacggguacaauuggggccgucucccuugacuuuaguccagguacaagcggaucaccuauuguggacaagaaaggaaaagugguuggacuuuauggaaaugguguagugacaagaucaggcacuuacguaagugcuauagcacaaaccgaaaagucaaucgaggauaauccagaaaucgaagaugacauuuuuagaaagaaacggcucacuauaauggauuuacauccaggagcagguaaaacaaaacgauaucucccagcgauuguucgggaagcuauuaaacgagguuuaagaacacuaauauuagcuccuacaagaguaguugccgccgaaauggaagaggcuuuacgagguuuacccauacguuaucaaacuccggcaauacgagccgaacacaccggccgugaaauaguagauuuaaugugccaugcuacguuuaccaugcgccuucuauccccagugagaguaccaaacuauaacuuaaucauaauggaugaagcucacuuuacugauccugcaaguauagcggcgagaggcuauauaagcaccagagucgaaaugggagaagcugcaggcauuuucaugacugcaacaccuccuggaagcagggacccauucccucaaaguaaugccccaauaauggaugaagagagagaaauuccagaaagaaguuggaacucugggcaugaauggguaacagauuucaaagguaaaacgguuugguucguuccaucuaucaaagccgggaacgauauagcggcaugccuacgcaaaaauggcaagaaagugauucagcugucuaggaaaaccuucgacucagaauauauaaaaacgaggacuaaugacugggauuuuguagucacaacugacauaucggaaaugggggccaacuuuaaggcugagcgugucauugauccacggagauguaugaagcccguaauccuaacggauggagaagaacgaguaauauuggcaggacccaugccaguaacacacucuucagcugcucagaggcggggaaggauagggcgaaaccccaaaaacgaaaacgaucaauauauauacaugggugaaccauuggaaaaugacgaagauugugcucacuggaaagaagcuaaaauguuacuagauaauaucaauacaccagaaggcauuauacccucaauguuugaaccagaaagagaaaaaguagaugcaaucgacggcgaauaucgacuaagaggagaagcacggaaaacuuucguugaccugaugagacgaggggaccucccaguaugguuagccuaucgaguagcagcagaaggcauuaauuacgccgacagaagauggugcuuugacggcauuaaaaacaaucagauccucgaggagaaugucgaaguagaaauauggacuaaggaaggugaaaggaaaaagcuaaaaccccgaugguuggaugcgagaauuuacuccgauccuuuagcccuuaaagaauuuaaagaguuugcggcuggaagaaagucccuaacauugaaucuuauaacggaaaugggaagacugccaaccuuuaugacucagaaggccagaaaugcacuagacaauuuggcgguuuuacauacggcggaagcagggggccgagcauauaaucaugcuuugucagaauuaccagaaacacuagaaacacuacuccuauugacccuauuggcuacggugacuggagguauauuucuauuuuugauguccggaaaaggaaucgguaaaaugacuuugggaaugugcuguauaauaacugccucaauccuucuaugguacgcacaaauccagccucacuggauagcagcaucgauuauucuagaauuuuuccuaaucgugcuauuaauccccgagccugaaaaacaaaggaccccacaagauaaucaacugacauacguagugauugcaauacuaaccguugucgcugcaaccauggcaaaugaaaugggauucuuggagaaaacuaagaaagauuuuggucuaggaaguauugcaacccaacagccugaaagcaauauucuagauaucgaucuacggccugcuucagcauggacuuuguaugcaguggcgacaacguucauaacuccuaugcuacggcacucaauagaaaauaguuccguaaaugucucguuaaccgcuauugcaaaccaagcuacaguacuuaugggacuagguaagggcuggccccuaucaaagauggauauaggaguaccguuguuggcgauuggauguuauagccaaguuaauccgauuacuuugaccgcagcuuuacuucuauuaguugcucauuaugcuaucauagggccuggacuccaagcaaaagccacacgcgaagcacagaaacgagcggcagcgggcauaaugaaaaauccaacaguugacggaauaacuguaauugaccucgacccuauucccuacgaccccaaguuugaaaaacaauuagggcaaguaaugcuccucguauuaugcgugacccaaguguuaaugaugagaacgacuugggcucuuugcgaagcccuuacacuugcgacaggacccauuaguacccuaugggaagggaacccgggaagauucuggaacacgacaauagcugucaguauggcuaauaucuuucgaggaagcuaucuagcgggugccggucuccucuuuucuauaaugaagaauacgacgaauacaagaagaggaacggguaacacaggcgaaacauuaggagaaaaauggaaaaacagacucaauucauuaggaaagucagaauuucagaucuacaagagauccggcauacaagaagucgauagaacuuuagcgaaagaaggcauuaaaagaggugaaacugaucaccaugcgguuucgagaggaucagccaaacucagaugguucgucgagagaaaccuuguuacaccagaaggaaaaguaguagacuuagguuguggucgcggagguuggaguuauuauuguggcggucuaaagaauguaagggagguaaagggguugacuaaaggcggaccgggccacgaagaaccaauucccaugucaacguacggauggaaccuaguaagacuacaauccggagucgacguguuuuucacaccgcccgaaaaaugugauacacuacuaugugacauaggggaaucuagucccaauccaacggucgaagccggucguacucuacguguguuaaaucuuguggagaacugguuaaauaauaacacacaauucuguauaaaaguuuuaaauccuuauaugccuuccgucauagagaaaauggaaacauuacaaagaaaauauggaggagcguuaguaagaaacccacugagccggaacuccacacacgagauguauugggugaguaaugcgucugggaacauagucucaucaguaaauaugauaucgcgaaugcugaucaaucguuuuacuaugagacauaagaaagcuacuuacgagcccgauguggaccuugguaguggaacuaggaauauaggaauagaaucugagacaccaaacuuagauauaauaggaaagcgcauugagaaaaucaaacaagaacaugaaacaaguuggcacuacgaucaagaucaucccuauaagacaugggcguaucauggaucauaugaaacaaaacagacaggaagugcuucaaguaugguuaaugguguaguacguuuguugacuaagccaugggaugugaucccgaugguuacacaaauggcaaugacagacaccacuccauuuggucaacaaaggguauucaaggaaaaaguagauacaagaacccaggaaccaaaagagggaacgaagaaauugaugaaaauaacugcugaauggcuguggaaggaacucgguaagaagaaaacuccaagaaugugcacaagagaggaguucgcgcgaaagguacguucaaaugccgcacuuggugcuaucuuuacagacgaaaauaaauggaaaagcgcuagagaagcaguugaagacucaagauuuugggaacuggucgauaaagaacggaauuugcauuuagaagguaagugugagacauguguauacaacaugauggguaaaagagaaaagaaaaucggggaauuugguaaagcaaaagguucucgugcuaucugguauauguggcugggcgcacgcuuucuagaauuugaggcacuaggcuuucugaacgaagaucacugguuuucgagagagaacagucuaaguggagucgaaggugagggucuucauaaauuaggcuauauccuucgagaggucaguaaaaaggaaggaggggcuauguaugcugacgacacugcggguugggauacacggauaacacuugaagauuuaaagaaugaggaaauggugacaaaccauauggaaggugaacacaagaaacuugcggaggcaauuuucaaacuuaccuaucaaaacaaagucguuaggguccaaagaccaacaccgagaggaaccguuauggauauaauaucaagaagagaccaaagaggaucaggucaagucggaacguacggguuaaacaccuucacaaauaugggugcucaacuaauucgacaaauggagggggaagguguauucaaagguauucaacauuuaaccgcaacagaagaggucgcgguacaagacugguuagcgcguguaggacgagaacgauuaucacgaauggcaauaucgggggaugacugcguggucaaaccuuuagaugaucguuuugcaagugccuuaacagcacuaaaugacaugggaaaaguccgaaaagauauacaacaaugggaaccgucaagagguuggaaugacuggacucagguaccauuuugcucucaccauuuucaugaauuaauaaugaaagauggacgaguccuuguugugccaugcagaaaucaagaugaacugauagggcgagcccgcauaucccaaggcgcgggguggucuuuaagagaaacagcuugccuaggaaaaagcuacgcacaaauguggucgcugauguacuuucaccgaagggaccuaagauuagcagcaaacgcaauaugcucagcugugccuucacacuggguaccaacaaguaggaccacaugguccauacacgcaaggcacgaauggaugacgacugaggacaugcuaacaguauggaaccgaguuuggauucaagagaaccccuggauggaggacaaaacgccaguagaaucaugggaagaaaucccauacuuaggaaaaagagaggaccaauggugcggcucacugauaggacuaaccagccgagcaacuugggcaagaaacauucaaacugcuauuaaccaaguccguagcuuaaucggaucagaggaguauacggauuauaugccaagcaugaaaagauuucgaagagaagaagaagaagcuggaguccugugguaa

SEQ ID NO: 22210 - RNA, 9876 nt, Artificial Sequence
  derived and/or modified CDS sequence (opt6) from DENV-2__KF041237__SS-prME
acugcuggaguuaucauuaugcuaauaccaacagcuauggcauuccaucuuacgacuagaaauggggaaccgcacaugauuguuucaaaacaagaaaaaggaaaaaguuuacuauucaaaacagaagacgguguaaauaugugcacacuaauggcuauggauuugggagaauuaugcgaagacacaaucacguauaauugcccauuguuaagacagaacgaaccagaagacaucgauugcugguguaauucuacaaguacuugggugacauacggaacauguacagcuacuggagaacaucgaagagagaaacgaucaguagcucuagugccacacgucgggaugggguuagaaacaagaacagaaacauggaugaguucagagggagcauggaaacacgcacaaagaauagagacauggaucuugagacacccuggauucaccauaauggcggcaauauuagcuuacaccauugggacaacuuacuuucagcgcguauuaauauuuauuuuauuaacugcuguugcaccuucaaugacuaugaggugcauaggaauaaguaauagggauuuuguagaagguguuagcggaggaaguuggguggacauugugcuagagcauggaagcuguguuacaacuauggcuaaaaauaaaccaacacuagacuucgaauugauaaaaacugaagcuaaacagccagcuaccuugaggaaauacugcauugaagcaaaauuaacuaauaccacaaccgcaagucgaugcccaacacagggagaaccuuccuugaacgaagaacaggacaaaagauucguauguaaacauucuauggucgacagaggaugggggaauggauguggacuauuugggaaaggugggauaguaacaugcgcuauguucacuuguaagaaaaauauggaaggaaaaauugugcagccggaaaaccuggaauacacgauaguaguuacuccacauucgggugaggaaaacgccgugggaaaugauacaggaaaacauggaaaagaaauaaaaguuacgccacaaagcucaaucaccgaagcagaacugacaggauaugguacaguaacaauggaauguucaccuagaacugguuuggacuuuaaugaaauggugcuacuacaaauggagaauaaagcaugguuaguucacagacaaugguuucuagauuuaccgcuuccauggcuuccaggugcggauauacaagguaguaauuggauucaaaaagaaacgcuuguaacauuuaaaaacccccacgccaagaaacaggacguaguaguacuaggcagucaggagggagcaaugcacacugccuugacaggcgcaacugaaauacagauguccagcgguaauuuacucuucaccggacauuuaaaaugucgacuaagaauggauaaauuacaacucaaaggaauguccuauucaauguguacagggaaauuuaaaguaguaaaagagauagcagaaacacagcauggcacaauaguggugagaguucaguaugagggagacggaagcccaugcaaaauacccuucgaaauuauggaccuugaaaagagacauguccucgguagacucauaaccgucaauccuaucguuacggaaaaagauucgccagucaacaucgaggcagaaccaccauuuggugauucguauauuaucauugguguugagcccggucagcuaaaauuaaguugguuuaaaaagggaaguucaaucggacaaauguuugaaacaaccaugaggggcgcaaagagaauggcuauauuaggggauacagcuugggacuuuggaucauuaggaggcgucuuuacgagcauagguaaagcccuacaccaaguuuuuggugcaauauauggcgcugccuucucugguguaucauggaccaugaaaauuuugauaggugucguuauaacauggaucggaaugaacucaagaaguacuagcuugaguguaagccugguucuugugggcgugguaacacucuauuuaggugugaugguacaagcugacucuggcuguguaguuucguggaaaaauaaagaguuaaaaugugguucgggaauauuuauuacggauaacguucauacguggaccgaacaauauaaauuccagcccgaaucuccuucaaagcuagcuagugcaauacaaaaggcucacgaggaaggaauaugugguauaagaucggugacaagacuagagaaccugauguggaaacagauaacaccagaacuaaaccacauuuuauccgaaaaugagguaaagcucaguaucaugaccggggacauaaaaggaauaaugcaggcaggaaagagaucacuacggccgcaaccuacagaauuaaaauacuccuggaaaacauggggaaaggcaaaaaugcucaguacagaaccgcauaaccaaacauuccuuauugauggaccagaaacugcagaaugccccaauacaaauagagcuuggaacucauuagaaguagaggauuauggguuuggaguguuuaccacuaacaucugguugaaacuaaaagaacgacaggaugucuuuugugauaguaaacuuaugucugccgcuauaaaagacaaccgcgcuguucaugcugacaugggauacuggaucgaaagugcauuaaaugauacauggaaaauagagaaagcaucauucaucgagguaaaaucgugucacuggcccaagucccauacacucuggucgaacgggguucuagaaagcgaaaugauaauaccgaaaaauuuugcuggcccagucucacaacacaauuaucguccuggauaccacacccaaaccgccgggccuuggcauuuagguaaguuagaaauggauuuugauuuuugcgaaggaacuacugucguaguuacagaagauuguggaaauagaggcccaucacuacgcaccacaacagcaucggggaaacugauaacagaaugguguugccgaucauguacacuuccgccacuaagauacaggggagaagacgggugcugguauggaauggaaauucguccucuaaaagaaaaggaagaaaaucuuguaaacagucuuguaacugcagggcacggacaaauagauaauuucagcuuaggcguauuggggauggcauuauuuuuagaagaaauguuacgcacgcgcguuggaacgaaacacgcggugcucuuagucgcaguaaguuuuaugacccucauaacgggcaauaugucauucagagaucuuggucgcgugauggucauggugggagcugcuaugaccgacgauauuggcaugggggucacuuaucuugcacuauuagcggcuuucaaagucaggcccaccuucgcagcgggauuacuacuccggaaauugacgaguaaagaacuuaugaugacaacuaucgguauaguacuucucucgcaaagcaccacaccggaaacgauccuagaacuaacagacgcacuagcuuugggaaugaugaucuugaaaaucguacguaauauggagaaauaccagcuugccguuacuaucauggcgauacuaugcgugccaaaugccgucauacuucaaaacgcguggaaagucucguguaccauauuggcugcaguaagugugaguccacuauuauuaacauccucccagcaaaaagcggacuggaucccacuugcucuaacaauaaaaggucuaaacccgacugccauuuuccuaacuacacuuucuaggacaaacaaaaagcguucauggccauuaaacgaagcgaucauggcaguuggcauggucucaauucuagcgucaaguuugcucaaaaaugauauacccaugaccggaccccuaguagcugguggacuucugaccgugugcuauguauugacgggaaggucagcagaucuugaacuugagcgggcagcagauguacgaugggaagaucaagcugaaauuagugggagcucaccuauucuuucuauuacaauaagugaggauggcucaaugucaaucaaaaaugaagaggaagaacaaacccucaccauucugauccgaacuggccuccuaguaauuagcgguuuauucccuguauccaucccuauuacagcagcggcuugguauuugugggaggucaagaaacaacgugcaggcguccugugggacguaccaucgccaccacccguuggcaaagcggaauuagaagauggcgccuacagaauaaagcaaaagggaauauuaggauacagucaaaucggggcaggaguauacaaagaaggaacuuuccauaccauguggcauguuacacgaggagcggugcucaugcacaaagguaaacgcauagaaccgucaugggcggauguaaggaaagauuuaauaagcuacggcggaggauggaaacuugaaggugaguggaaagaaggagaggaaguacaaguccucgcucuagaacccgguaaaaauccgagggcggugcaaacaaaaccugguuuauucaaaacuaacacagguaccauaggcgcgguaucauuggauuucaguccuggaacuucggguagcccuauuguagacaagaaaggaaaaguugucgguuuauacgguaauggaguaguaacuagaucugguacuuauguuucugcaauugcacagacagagaaaaguauagaagacaauccagaaaucgaggaugacaucuucaggaagaaacggcugacaaucauggauuuacauccaggcgccgggaaaaccaaacgauaucugccggcaauaguacgcgaagcaauuaaacgaggguuaagaacuuugaucuuggcuccaacccgagucguugcugcugaaauggaagaagcguuaagagggcuaccgauaagauaccaaacacccgcgauaagggcugaacacaccggacgagaaauuguggacuuaaugugccacgcaacauuuacuaugaggcuuuugucuccaguuagaguuccgaacuacaauuuaauaauaauggaugaagcacauuuuacagaccccgcaaguauagcagcuagaggauacauuucaacucgaguagagaugggugaagcugcagguauuuuuaugacggcgacgccgccugggucucgugacccauucccccaaucaaacgcaccaaucauggacgaagaacgugagauuccugaacgcucauggaauagugggcaugaguggguuacagacuuuaaaggaaaaacaguaugguuuguaccaucuauaaaggcggguaaugauaucgcugcaugucugcgcaaaaacgggaaaaagguuauucaacuaaguagaaaaacguuugauuccgaauauaucaaaacccggaccaaugauugggacuucguggucaccacagauaucucagagaugggagcaaacuuuaaggcugaaagaguuauugacccgcgccguugcaugaaaccugugauacucacagauggugaagaaagaguaauacucgcaggaccuaugccugugacucauagcucagcugcacaaagaagaggaagaauaggcagaaaccccaaaaaugaaaaugaucaguauauuuacaugggagagccacuggaaaaugacgaagauugcgcucauuggaaagaagcaaaaaugcuacuagauaauaucaacacacccgagggaauuauaccuucgauguucgaaccugaaagagaaaaagucgaugccaucgauggcgaauauagauugagaggugaagcucgaaaaaccuucguagauuugaugagaagaggggaccuaccaguauggcuggcauaucgagucgcagcugaagggauuaauuaugcagaccgcagauggugcuuugauggaauuaagaacaaucagauccucgaagagaauguugagguugagauuuggaccaaagaaggugaacggaagaaacuaaaaccccgauggcuagaugcccgaauauauagcgaccccuuagcauuaaaagaguucaaagaguucgcagcagggcgcaaaucucuaacccuuaaucuaauuaccgaaaugggaagacuuccgacauucaugacucaaaaagcaaggaaugcacucgacaauuuagcaguucuacauacugcugaggcaggagggcgagcuuauaaucaugcauugucggaauugccggaaaccuuagagacccuuuugcuacugacucuucucgcuacuguaaccggcggaauauuuuuauuccugaugucuggaaaagguauagguaaaaugacgcuugguauguguugcauaauuaccgcgucgauauuauugugguaugcacagauucaaccccacuggauugcagcuagcaucauauuagaguuuuuccuuaucguucuguuaaucccagaaccugaaaaacaaaggacaccacaagauaaccaacuaacauaugucgugauugccauucuaacggucguggcggccaccauggcaaacgaaaugggcuuccuugaaaagaccaagaaagauuuuggcuugggaucaauagcuacgcaacaacccgaaucgaauauauuagauauagaucuuagacccgcaucagccuggacacuauacgcgguugcgacuaccuucauuacgccuaugcugcgucauucgauagaaaauucaaguguuaacguaucucugaccgcaauagcaaaucaggcaacaguauuaaugggauuaggaaagggguggccccuuucaaagauggacaucggagucccauuacuagccauuggaugcuacagucagguaaauccaauaacccuaacugcagcucuccuacuacuggucgcacacuaugcuauaaucggucccgguuuacaagcuaaggcaacacgagaagcgcaaaagagagcagcagcaggaauuaugaaaaauccuacggucgacggaauaacgguaauugaucuggauccuauaccauaugauccaaaauucgaaaaacaauuaggucaaguuaugcuguugguacucugcguaacgcaaguguuaaugaugcguacuacuugggcucucugcgaggcuuuaacacuagccacgggaccaauuaguacacuaugggaagguaauccaggacgauucuggaauacaacuauugcgguaagcauggcaaacaucuucagaggaaguuauuuagcaggagcagggcuacucuuuucuaucaugaaaaacacaaccaauacgagacgagguacaggaaauacaggugaaacucuuggagaaaaauggaaaaaucgacuuaacucgcuugggaagucggaauuucaaauauauaaacggaguggcauucaagaggucgauagaacacuagcaaaagaaggaauuaagagaggugaaacggaucaccaugcaguaagucgagguagugcuaagcuccgaugguuuguagaacguaauuugguaacgccggaagguaaaguaguggaucuggggugcggacgaggaggauggaguuacuauuguggaggacucaaaaacgucagagaagucaagggguugacuaaaggaggaccaggacaugaagaaccgauaccaaugucaacuuacggcuggaaccugguucgauuacagucaggaguugauguuuucuucacgccaccagaaaaaugcgacacguuguugugugauauaggugaaucgucuccaaauccaacuguggaggcagguagaacauuacgagucuuaaauuuagucgaaaacugguuaaauaacaauacacaauucuguauaaaagugcucaacccuuauaugcccucuguaauugagaaaauggaaacacugcaacgaaaauauggaggcgcacucgugagaaauccauugucucgcaacucaacgcaugaaauguauuggguuaguaacgcuucugggaacauagucucgaguguaaauaugauaucuagaauguuaauuaaucgauuuaccaugaggcacaagaaagccaccuacgagccggauguagauuuggggaguggaacaagaaauauaggaauagaaucggaaacaccuaaccuagacauuauagguaagagaauagagaaaaucaaacaagaacacgaaaccagcuggcacuaugaucaagaucacccauacaaaacgugggcuuaucauggcucauaugagacaaaacagacaggaagugcuucaucaauggugaaugggguugucagauugcuaacaaaacccugggauguaauccccaugguaacacagauggcaaugacagacacaacaccauucggccaacaacgagucuuuaaggaaaaaguggacacgcggacucaagagccuaaggagggaaccaagaaauuaaugaaaauaacugcagaaugguuauggaaggaauuaggaaagaagaagacaccgaggauguguacgagagaagaauuugcaaggaaaguccgaaguaacgcagcauuaggggccauauuuacagaugaaaauaaguggaaaucagcgagagaagcggucgaagacagccgguuuugggaauuaguugauaaagaacgaaaucuacaucuugaagguaaaugcgagacaugcguauauaauaugaugggaaaacgggagaagaaaauaggagaguucgggaaagcaaaaggaucacgggcaauaugguauauguggcuuggugccagauuucucgaguucgaagcccuaggauuucuaaaugaagaccacugguuuucaagggaaaauagucuaagcgguguugaaggggaagggcuacacaaacuugguuauauuuugcgggaaguaucgaagaaagaagguggagcuauguacgcagacgauacagcaggcugggauaccaggauuacguuagaagaucugaaaaaugaagagaugguaacgaaccauauggaaggugaacauaagaaauuagccgaagccauauuuaaacuaacauaucagaacaaaguugugagaguacaaagaccuacuccucgagggaccgucauggacauuauaaguagaagagaucaaagaggaucgggacagguuggaaccuacggauuaaauacauuuacgaauaugggcgcacaacugauaagacagauggaaggagaaggcguauucaagggcauucagcauuuaacugccacugaagaaguagccguacaagacugguuagcgagagugggcagggaaagacuuucaagaauggcuauaaguggugaugauuguguaguaaaaccacuggaugauagguucgcaucggcccuaacagcauuaaaugacauggguaaagugcguaaagauauucaacaaugggagccuucuagaggauggaaugacuggacacaaguuccauucuguagccaccacuuucacgaacuuaucaugaaagacggcagagugcuuguugucccaugccgaaaccaagaugagcuaauuggccgagcacguauaagucaaggagcgggauggagucuucgugaaacagcuugcuuaggcaaguccuaugcacaaauguggucauugauguacuuucaucgaagagaucuccgguuagcugcgaaugcuauaugcucggcuguuccgucccauuggguaccuaccucaagaacaacauggucaauacacgcuggucaugaauggaugacgacagaggacauguuaacggucuggaacagaguauggauucaagagaacccauggauggaagauaaaacaccaguagaaaguugggaagagaucccauaccuuggaaagcgagaagaucaaugguguggaaguuuaaucggauuaacuucaagagccaccugggcgcgaaacauucaaacagcuauaaaccagguaagaucgcuaaucgguucggaagaguauacggauuacaugccgagcaugaaaagauuucgacgugaagaagaagaggcaggcguucuuugguga

SEQ ID NO: 22211 - RNA, 9876 nt, Artificial Sequence
  derived and/or modified CDS sequence (opt6) from DENV-2__KM217156__SS-prME
acagcuggugucauuauaauguuaauacccacggcaauggcguuucaucuuacaacaagaaacggugaaccucauaugauaguuucaaaacaagaaaaaggaaaaucuuugcuuuuuaaaacagaagauggagugaacaugugcacgcuaauggcaauggacuuaggggaacuaugcgaagacacaauaacguauaacuguccauuauugagacaaaacgaaccagaagauaucgauugcugguguaaugcaacaagcacuuggguuacauauggaacuuguacagccacaggagaacaucgucgugagaaaaggucaguggcuuuagugccacacguaggaaugggacuagaaacaagaacagaaacauggaugucaagugaaggagccuggaaacacgcccaaagaauagaaacguggauucuaaggcacccugguuuuacaauaauggcagcaauacuggcguauacuauaggaacaaccuacuuucagcgaguacuaauauucauauuauugacagcaguagcaccaucaaugacaaugcgaugcauugggauuucaaacagagacuuuguggagggugugagcggaggaagcuggguagacauaguacuagagcacgggagcugugucacaacaauggcuaaaaacaaaccaacacuagauuucgaacuuauaaaaacagaggcgaaacagccugcaacguuacggaaauacuguauagaagcaaaacucacuaacaccacaacagcuucccggugucccacccaaggugagccgucacuaaacgaagaacaagacaaaagauuuguauguaaacacagcaugguagaucgaggguggggaaauggaugcggacucuuuggaaaaggaggaaucgugacaugugcaauguuuacaugcaagaaaaauauggaagggaaaauaguucaaccagaaaaccuagaauacacaauaguaguaacuccccacaguggggaggaaaacgccguuggaaacgauacgggaaaacaugggaaagagaucaaaguaacgccccaaagcucaauaacggaggcugaacucacagguuacgguacugucacaauggaauguucaccuagaacaggacuagacuuuaacgaaauggugcuacuucaaauggaaaauaaagcauggcuaguacauagacaaugguuccuugaccuaccacugccuugguugccaggcgcagacauacagggcuccaauuggauccaaaaagagacauuaguuacauucaaaaauccccacgccaagaaacaggaugucguaguuuuaggcagucaagagggugcgaugcauacugcacuuacaggagcgacagaaauucaaaugagcucgggaaauccauuguuuacaggacauuuaaaaugucgacuaagaauggauaaauuacaacuaaaagggaugagcuauaguauguguacuggaaaauucaaaguagugaaagagauugcggaaacccaacaugggacuauaguaguuagaauccaguaugaaggugauggaucucccugcaaaauccccuuugaaaucauggaucuugaaaaacggcacguucuagguagguuaauaacuguaaauccaauaguuacugaaaaagauucuccaguaaacauugaagcugagcccccauucggcgacaguuauauaauuauuggaguagagccuggucaacuaaaacuaucgugguuuaagaaaggcucuaguauagggcaaauguuugaaacaacuaugagaggugccaaaagaauggcuauucuaggugauacugcgugggacuuugguucacucggcggaguauucacaaguauuggcaaagcacuacaccaggucuuuggcgccaucuacggcgcggcuuuuagcggugugaguuggacaaugaaaauacuuauugguguaguuaucacuuggauagggaugaacucccgaucaacaucucuuuccgugucgcuaguauuaguugguguuguaacauuauaccuaggcgucauggugcaggcagacucaggaugcguuguuagcuggaaaaacaaagagcuaaaaugcgguucuggaaucuuuuucacagacaacguacacacuuggacggaacaguauaaauuucagccagagucgccuuccaaauuagcaucagcaauacaaaaagcucacgaagagggaauaugcgggauacgcuccaucacgcgucuugacaaccuuauguggaaacagauuacuccggaguuaaaccauauacuaucagaaaaugaagugaaacucaguauaaugacaggugauauaaaagguauaaugcaagcuggaaaaagaagccucagaccacaaccaacagaguuaaaauauaguuggaaaaccuggggaaaagcuaaaauguuaagcacugagccgcacaaucaaacauuucuuaucgauggaccagaaacugcacaauguccaaauacuaacagggccuggaacuccuuggaaguagaggauuauggauucgggguauuuacaacuaauauuuggcuaaaacugaaagaacgacaagauguuuucugugauaguaagcuaaugagcgcugcaauaaaagacaauagagccguacaugcagauauggguuauuggauugaaagcgcauuaaaugauaccuggaagaucgaaaaggcuagcuuuaucgaaguaaagucgugucauuggcccaaaucucacacacuguggagcaacgguguacuagaaucggaaaugauuauaccuaaaaauuuugcggggcccguuagucaacauaauuaccgaccaggauaucacacgcaaaccgcaggaccguggcaucuggggaagcuagagauggacuucgauuuuugugaagguacaacgguuguuguaacggaggauugugggaaccgagggccuagcuuacgaaccacgaccgcuagcggaaaacuaaucacagaauggugcugccggagcuguacacuaccaccauuaagauaucgaggagaagacggaugcugguauggaauggaaauccgaccucuuaaggagaaagaagaaaauuuagucaauuccuuaguuacagcaggccacggccaaauagacaauuuuagccuaggagugcuuggaauggcgcuauuuuuagaagaaaugcuucgaacgagaguagggacaaaacacgcugucuuacugguugcaguuaguuucaugaccuugauaaccgggaacauguccuuucgggaccuggguagaguaaugguuaugguuggagcagccaugaccgacgauauuggaaugggugugacauaucuagcacuuuuagcugccuuuaaaguccguccaacuuuugcugcuggccuccuacucagaaaacugacaaguaaagagcuaaugaugacuaccaucgguauaguucuauuaucacaauccacaacccccgaaacuauucuugaauuaacggacgcacucgccuuaggaaugaugauacuaaaaauaguccgaaacauggaaaaauaucaauuggccguuacuauaauggcaauauugugcguaccuaaugcgguaauucuacagaacgcguggaaaguaucguguacaauccuggccgcggucuccgugaguccccuucucuuaacaaguagucaacaaaaagcggauuggauaccauuggcacugacuaucaagggacuuaaucccacugcaauauucuugacaacacuuucucgcacuaacaaaaagagaucauggccacucaacgaagcaaucauggccguuggaauggucaguauuuuagcuuccucuuuacuaaagaaugauaucccaaugacuggcccauuaguagccggaggguuacucacgguauguuauguacuaacagggcgaagcgcugauuuagaguuagaacgagcugcagacguaagaugggaagaccaggcagaaauuagcggaucaaguccaauccuaucuauaacaaucagcgaagacggguccaugaguaucaaaaacgaagaagaagaacaaacucuaacuauacuaauaagaacugggcucuuaguuaucagugguuuauuucccguaaguauaccaauaacagccgcagcaugguaccuaugggaggucaagaaacaaagagcugggguuuuaugggauguuccgucaccuccgccagugggaaaagcggaacuggaagauggugcguacagaauaaaacaaaagggcauucugggcuauucacaaauuggggccggugucuacaaagaaggaacauuucauacaauguggcaugucacgcguggagcaguacuaaugcacaaaggaaagagaaucgagcccaguugggcggauguuagaaaagaucuaauaaguuacgguggcgguuggaaauuagaaggugaauggaaagaaggcgaagaagugcagguacuagccuuagaaccaggaaagaacccuagagcaguucaaacuaaaccuggacuauuuaaaacgaauacaggaacaauuggggcaguuuccuuggauuuuucuccuggaacuucugguucaccaauagucgauaagaaggguaaagugguuggauuguauggaaauggcgugguaacuagaucaggcaccuacguuagcgcuauugcacaaacugaaaagucaauagaagacaauccugaaaucgaagaugacauuuuccguaagaaaaggcuaacaauaauggaucuacauccaggagcuggcaagaccaagcguuauuuacccgccauaguaagagaagcaaucaagagaggacuaagaacauuaauuuuggcaccaacuagaguuguagccgccgaaauggaagaagcacuucgaggacugccuauuagauaccaaacucccgcuauaagagcagaacauacaggccgggaaauaguggauuuaaugugccacgcuacguuuaccaugagauugcucucuccuguucgcguuccaaauuacaaccugauaauuauggaugaagcccacuucacagaccccgccaguauagcagcucgugguuauaucucaacgcgcguggagaugggagaggccgcuggaaucuucaugacagccaccccuccuggaagucgagacccauucccgcaaaguaaugcaccuauuauggacgaggaacgagagauuccugaaagaucuuggaauaguggacacgaaugggucacagauuucaaggggaaaaccguaugguuugucccgucuauaaaagcaggaaacgacaucgccgcaugcuuaaggaagaauggaaagaaaguaauccaacucucacguaagacuuuugacucggaauauaucaagacacguacaaaugauugggauuuuguagugacaacggauauaagugaaaugggggcgaauuuuaaagccgaaagaguaaucgacccgcgccgauguaugaagccuguaauacugacagauggugaagaacgaguaauucuggccggaccaaugccaguuacacacaguucugcagcucaaaggagggggagaaucggcagaaaccccaagaaugaaaacgaccaauacauauacaugggggaaccuuuagagaaugacgaagauugcgcgcacuggaaggaggcuaaaauguuguuggacaauaucaacacuccugaaggaauaaucccaaguauguuugaaccggaaagagagaaaguagaugcaauugauggagaguaccgauuacgaggugaagcacggaagacauuuguagauuugaugcgacgcggugaccuuccuguauggcuugcuuacagaguggcagcagaagguauaaauuaugcggaucggcguuggugcuucgacggcauuaaaaauaaccaaauauuagaagaaaacguugaagucgagauauggacuaaggaaggagagagaaagaaacucaaaccgcgaugguuggacgcgagaauuuacuccgacccccuugcacuaaaagaauuuaaagaauuugcugcugcacgaaaauccuuaacauuaaaccuuauaaccgagauggggagauuacccacauucaugacacaaaaagcaagaaacgcacuggacaauuuagcgguacuacauacagcugaggcagggggacgcgcauauaaccacgcacuuagcgagcuaccugagacguuagaaacgcuccuuuugcucacacuucuagccacugucaccggaggaauauuucuauucuuaaugagcgguaaaggaauagguaaaaugacacuuggaauguguuguaucaucacagcaagcauacugcuaugguaugcgcaaauacaaccacauuggauagccgcaucuaucauauuagaguuuuucuugauaguauuauugauaccugaacccgagaaacaaagaacaccacaagacaaucagcuaacauacgugguaauagccauccuaaccguaguagcugccacaauggccaacgagaugggauucuuagaaaagacgaagaaagauuuuggauuagguucgauugcaacacaacagccugaaaguaacauacucgauauugaccuccgcccggccucagccuggacacucuacgcaguugcaacuacauucauaaccccaaugcuaagacacaguaucgaaaauagcaguguuaacguuucuuuaacugccaucgcuaaccaagcaaccguauugauggguuuagguaaagguuggccucugaguaaaauggauaucggagugccacuacuggcgaucggguguuacucacaagugaacccaauuacuuuaacagcugcuuuauuauugcuuguagcacauuacgcaauuaucgggccuggacuucaagcaaaagcuagccgagaagcccaaaaacgcgcugcggcaggcaucaugaagaacccuacugucgacggaaucacaguaauagauuuagacccgaucccauaugauccaaaguuugaaaagcaacuaggacaaguaaugcuauugauacuuugcguaacucaaguucucaugaugcguaccacgugggcauuaugugaggcuuuaacucuagcaaccggcccaauaucaacacuaugggaaggaaacccgggaagguucuggaacacgaccauagcuguaucaauggcgaacaucuuccgugguaguuauuuagcaggagcgggacucuuauucucaauaaugaaaaauacaaccaauacuaggagggguacaggaaauacaggcgaaacauuaggagaaaaguggaaaaacagaguaucuuugcuagguaagucggaauuucaaauauauaagaggaguggcauccaggaagucgaucguacacuagcgaaagaggggauaaaaagaggcgaaacggaccaucacgcagugagucggggaucugccaaacuaaggugguuuguagaaagaaaucuaguuacuccagaaggaaagguaguugaccuggggugcggaagaggaggauggucuuauuacugcgguggacugaaaaacguucgugaaguaaaaggucuaacaaaggguggaccaggccacgaggaaccaauuccaaugagcacauauggcuggaaucugguuagauuacuuacgggggcugacguauucuuuacgccgccggaaaagugcgauacguuacugugugacauaggagagucaucuccaaaccccacugucgaagcaggucguaccuugaggguacuaaaucucguggaaaacugguuaaauaacaacacucaauucugcauaaaaguacugaacccuuacaugcccaguguuauagagaaaauggaaacuuuacaaagaaaguauggaggagcauuaguaagaaacccucuaucuagaaacucaacgcacgaaauguacugggugucgaaugcaaguggaaauaucguuucaucagugaacaugauaucgagaaugcuaauaaauagauuuacuaugcgccauaagaaagcaacguacgauccagaugucgaucuaggaagcggcacaagaaacaucggaauagaauccgaaacaccaaaucuagauauaauuggcaaacggauagagaaaauaaaacaagaacacgaaacaagccgacauuacgaucaggaccacccauacaagacaugggccuaucauggguccuacgaaacuaaacagacagguagugcgucaucaacgguaaauggggugguuagacuguuaacaaaacccugggacgucauaccgauggugacacaaauggcaaugaccgauacuaccccauucggacagcagcgaguauuuaaagaaaaaguagacacuagaacacaggaaccgaaggagggaaccaagaaacuaaugaaaauuacagcagaaugguuguggaaagaacucggcaagaagaaaacuccaagaauguguacgagggaagaauuugcuaggaaaguacgaagcaaugcggccuugggugcgauauucaccgacgaaaauaaauggaaaucagcaagagaagccguugaagauucuagauucugggagcuaguugauaaagaaagaaaucuccaccuggaagggaaaugcgaaacaugugucuacaauaugaugggaaaaagagagaagaaaauuggugaguucgggaaggcaaaaggcucaagggcaauaugguacaugugguuaggagcgcgauuccuagaauuugaagccuuaggauuccuuaacgaggaucauugguuuucaagggaaaauucucuuagugguguugagggugaaggcuuacacaaauugggauauauacuucgggaaguaagcaagaaagaaggcggugcuauguaugcugaugauacagcggggugggauacccgaauuacauuagaagaccucaaaaaugaggaaauggucacgaaucauauggagggggagcauaagaaacuagcagaagcuaucuucaaacuaacauaccaaaacaaagucgucagaguacaacguccaacuccucgaggaacuguaauggauauaauaucccgaagggaucagagggguuccguacaaguggguacauauggcuugggaacguucacuaauaugggcgcacaguuaauaagacaaauggaaggggagggaguauuuaaaggcauacaacaucuuacggcgacugaagaaguugcuguacaagauugguuagccagggugggucgugaacgauugucaagaauggccauauccggggacgauugcgucguuaaaccacuagacgaccguuucgcuucugcuuuaacugcccuuaacgacaugggcaaagucagaaaagacauacaacaaugggaaccaucucgggguuggaacgacuggacacaaguccccuucuguagucaucacuuucaugaacuaaucaugaaggauggucgcgucuuagucgucgccuguagaaaccaggacgaauugauaggcagagcaagaaucucucaaggggcgggcuggucccuuagagagacugccuguuuaggcaagaguuaugcucaaauguggucacugauguauuuccaccgaagagaucuacguuuggcugcgaacgcgauuuguucagcuguaccgagucacugggucccgaccucucgaacaacguggucaauucacgcagggcaugaauggaugaccaccgaagauaugcugacuguauggaaucgaguuuggauucaagagaauccauggauggaagacaaaacacccguagagucaugggaagaaauaccauaccuaggcaaaagagaagaucaauggugugguucacugauaggacuaacauccagagcgacuugggcacgaaauauccagaccgcaauaaaucaaguaagaucguuaauugguucagaagaauauaccgauuauaugccaaguaugaaaagauucggacgcgaggaggaagaagcaggcguauuaugguaa

SEQ ID NO: 22212 - RNA, 9876 nt, Artificial Sequence
  derived and/or modified CDS sequence (opt6) from DENV-2__KX380809__SS-prME
acugcuggaauuauaaucaugaugaucccaaccguaauggcauuucacuuaacaacucggaauggugaaccccauaugauuguuagcagacaggaaaaaggaaaaucauuacuuuucaaaacggaaaacggcguaaauauguguacgcugauggcaauggacuugggugaacucugugaagauacuauuacauauaauuguccuuuacuuagacaaaaugaacccgaagauauagacugcugguguaacucaacaaguaccuggguaacguacgggacuuguacugcaacuggugaacaucgacgggagaaaagaucgguagcacuuguaccucauguuggaaugggacuagaaacuagaacagaaacuuggaugaguucagaaggcgcauggaaacacgcacaacguaucgaaacaugggucuuaagacacccuggauuuacuguuauggcagcuauauuagcauacacaaucgguacaacuuacuuccaaagaguccucauauucauccuccuuacggcuguagcuccgucaaugacgaugcgauguauaggaauaucaaaucgugacuucgucgaagguguuaguggaggauccuggguggauauuguccucgaacauggaucauguguaacuacaauggccaaaaauaaaccaacauuagacuucgaauuaauaaaaacagaagcuaaacauccggcaacccugagaaaauacuguauugaagcuaaacuaaccaauacuacaacggcuucgagauguccgacacagggagaacccagccuaaaugaagaacaagacaaaagauucguguguaaacacucaaugguggaccgaggcuggggaaacggaugcggacuauuuggcaaaggggguauaguaacuugcgcuauguuuacuugcaagaaaaauauggaaggaaaaauuguacaaccagaaaaucucgaauauacgauaguaauaacuccucacuccggcgaagaaaaugcgguaggaaacgacacgggaaaacauggaaaagaaauaaaagugacaccgcaaucauccaucacugaggcagaauuaacaggauauggaacugcaacaauggaguguucgccucguacuggacuugacuucaacgaaaugguguuauuacaaauggagaacaaagcauggcucguccaccgacagugguuuuuagaccuuccccuuccauggcugccaggugcagacacccaagggaguaauuggauccaaaaagaaacgcucguaacauuuaaaaacccacaugccaagaaacaagacguaguggucuuggguucacaggaaggggcaaugcauacggcacuaacaggggcgacagaaauccaaauguccagugguaacuuacuuuuuacaggccauuuaaaaugccguuuaagaauggauaaauuacagcucaaaggcaugagcuacagcaugugcacagguaaauuuaaaguaguuaaagagauugcagagacacaacacgggaccauuguaauccgaguucaauaugagggcgacgguucaccauguaaaauaccauucgaaauuauggacuuagaaaagcgucauguccuagggagguuaauaacugugaacccaauaguaacugaaaaagacucuccaguaaauaucgaagcugaaccgccauuuggagauagcuacauaauaauuggcgucgaaccagggcagcuaaaauugaguugguuuaaaaagggaagcucuauuggacaaauguucgaaacaacaaugagaggagcgaagagaauggccauccuaggugauacugcuugggauuuuggaucauuaggaggaguuuuuacaaguauuggcaaagcacuccaccaaguauuuggagcaauauacggggcagcauuuucaggaguaucguggacuaugaagauucuuauugggguagucauaacguggauugggaugaacucacggaguacaucacuaagugugagccuuguccuuguaggcauuguaacacuguauuuaggaguuaugguacaagcugauucgggaugcgucguaucuuggaaaaauaaagaauuaaaguguggaucaggaauuuucauaacagacaauguacacaccuggacugaacaauacaaguuucaaccagagucuccgucuaaacuagcaucugcaauacaaaaagcacacgaggaaggaauaugcgggauaaggagcguaacccgacuagaaaaucucauguggaagcagauuacccccgaacuaaaucacauccuuagcgaaaaugaagugaaacucacaauaaugacaggggacauaaaagguaucaugcaggcaggaaaaaggagcuugcguccccaaccaacggaauuaaaguauaguuggaaggcauggggaaaggcaaagauguuaaguaccgaacuacauaaucacacauuuuugauagauggaccagaaacugcggaauguccuaauacaaauagagcuuggaacaguuuagaggucgaggauuauggguuugggguauuuacaaccaauauaugguuaaaacucaaagagcgacaagacguuuucugcgauagcaaauuaaugucggcagcaauaaaagacaauagggcaguacaugcagacaugggauacuggauagaaagugcauuaaaugacacauggaaaauagaaaaagcaucauuuauagaggugaaaaguugucacuggccgaagagucacacgcuauggagcaauggaguuuuagagucugaaaugauuauucccaaaaacuuugcgggaccagugucgcaacacaacuacagaccagguuaucauacacaaacagcgggaccuuggcaccugggaaggcuagaaauggacuucgacuucugugagggaacgacggugguaguuacagaagauuguggcaaucggggaccaaguuugcgaacuacgacugcuucaggaaaauuaaucacugaguggugcuguagaucguguacgcuuccaccucugcguuaucguggcgaagauggauguugguacggaauggaaauucggccauuaaaagagaaggaagaaaauuugguaaauucccuaguuacagcuggacacggacaaauagauaacuucagucuaggagucuuaggaauggcccuguuuuuagaggagauguugagaaccagaguagguacgaaacaugcaauacuguuaguugcugucuccuuuguaacacuaauaaccgggaacauguccuuccgggaucuuggaagagugaugguuaugguaggagcgacgaugaccgacgacauaggaaugggaguuacauaucuugcucucuuagcugccuucaaagugcggccuaccuuugccgcaggacuacuacuacgaaaguuaacaagcaaggaacucaugaugacgacaauagggaucguuuuacuaucgcaaucaacaauuccagaaaccauucuugaauuaacugaugcauuagcauugggcaugaugguuuugaagaucgucagaaauauggaaaaauaucaguuagccguaacuaucauggcuauacuuugcguccccaaugcggucauucuccaaaacgcguggaaagucaguugcaccauuuuagcgguaguaagcguuucaccacuauuacucaccucaucccaacagaaagcugauuggauaccgcuagcauuaaccaucaaagggcucaacccuacggcaauauuuuugacuacacuaucgcgcacuagcaagaaaagaucuuggccucuaaacgaagcaauaauggcggucggcaugguuucaaucuuagccaguucucugcucaaaaaugauauccccaugacagguccauuagucgcagggggucuauuaaccguuuguuacguauuaacagguagaucagcagacuuagaacuugagcgagcagcugacguuagaugggaagaacaagcagagaucucuggaucaucaccaauuuuaucaauaaccaucagugaagauggaucaaugucuauuaagaacgaggaggaagaacaaacguuaacuauucuaauaagaaccggacuucugguaauaagcggacuuuucccagugagcauuccaauaacagcagcggcgugguaucucugggaaguaaagaaacagcgugcaggaguacuuugggauguaccaucuccuccacccgugggcaaagcggaacuagaagacggagcauacagaaucaaacagaaagguauuuuagguuacucucaaauaggcgcaggaguguacaaagagggaacuuuucauacaauguggcaugucacaagaggcgcagucuuaaugcacaagggaaagcggauagaaccaucaugggcggacguaaagaaagauuuaaucucauauggcggagguuggaaauuagaaggagaauggaaagaaggcgaggaaguacaaguauuagcuuuagaacccgguaaaaauccgagggcuguacaaacuaagccagggcuauuuaaaacuaacacaggcaccauaggagccguauccuuagacuuuucacccggaacaucagguagcccgaucguagacaagaaaggcaaagugguaggauuauacgggaacggagucguaacaagaucugggacuuauguuagugcuauugcucaaaccgaaaaaucuauagaagacaauccagaaauagaagaugauauuuuuagaaagaaacgccucacaauaauggaucugcacccgggcgccggcaaaacgaaacguuacuuacccgcuauugugagggaagccauaaaaagaggacuacggacucugauacuagcaccaacacggguuguagccgcugaaauggaagaagcucuuagaggucuucccaucagauaucaaacuccugccaucagagcagagcauacaggccgugaaauuguugaccuaaugugucaugcaaccuuuacaaugcgguuacuaucucccauccggguaccaaacuauaauuuaauuauuauggacgaggcucacuuuacggauccggccagcauugcugcaagaggguauauuucuacucguguugaaaugggggaggcugcuggaauauuuaugacagccacaccgccgggaagucgugauccauuuccacaauccaaugcuccaauuauggaugaagaacgagaaauaccugagagguccuggaauagcggacacgaauggguaacagacuucaagggaaagacugugugguuuguuccauccauaaaagcagguaaugacauagccgcuugucugaggaaaaacggcaagaaagucauacaacugucacgaaaaacuuuugauucagaauauauuaagacacgaacgaacgacugggauuucguaguuacaacugacauaucagagaugggugcgaacuuuaaagcugaacguguaauagauccuagacgauguaugaagccuguaauucuaacagauggagaagaaagagucauucuagcaggaccuaugccugugacacacagcucugcagcacaacgcagggggagaguagggaggaacccuaaaaaugagaaugaccaguauauauauaugggcgaaccauuggaaaaugacgaagauugugcccacuggaaagaagcaaaaauguuauuggacaauaucaauaccccagaaggcauaauuccaucuauguuugaaccagaaagagaaaaagucgaugcaauagauggcgaauacagacuaaggggugaagccagaaaaaccuuuguugacuugaugaggcgcggagaucuaccaguguggcuagcuuacagaguugcagcugagggaauaaacuacgcagauagaagaugguguuuugacggagucaaaaauaaucaaaucuuggaagaaaauguugaaguugaaaucuggacaaaagaaggagaaagaaagaaauuaaaaccaagauggcuggacgcaaggauauacuccgacccucuagcuuugaaagaauuuaaagaguucgcagccggaagaaaaagucucacuuugaauuuaaucacagaaaugggcagauuaccaacauucaugacgcagaaagcaaggaaugcccucgacaaccuagcaguguuacacacagcagaagcaggaggucgagccuacaaucacgcauuaucugaacuaccugagaccuuagagacacuacuacuacuaacccuucuugcgacaguaaccggaggaauuuuucuguucuugaugucaggcaaaggcauaggcaaaaugacucuagggauguguugcaucauuacggcaaguauacuucuuugguacgcgcaaauacaaccccauuggauugcagcaucaauaauauuagaguucuuuuuaauuguuuuguuaauacccgagccugaaaaacagagaacaccccaggacaaccaacuaacauacguaguaauugcaauucuaacuguaguagcagccacuauggcgaacgaaaugggauuuuuggagaaaacuaagaaagauuuuggacuugggaguaucaccacgcaacaaccugacaguaauauacuagauauugacuuacggccggcaagugcauggacacuauaugcaguagccaccaccuuuauuacgccaaugcuacgucauagcauagaaaauagcagcguuaacguaucucuaaccgcaauugcaaaucaagcuacaguacugauggguuuaggaaagggauggccguuaucuaagauggacauaggagucccguugcucgcuauaggaugcuacagucaagugaauccaaucacguuaaccgcggcguuacuguuguuaguggcacacuaugcuauaauuggaccuggguugcaagcaaaagcaacucgagaggcucaaaaacgcgcugccgcggguauaaugaaaauaccaacaguagacggaauuaccguaauugacuuagacccgauaccauaugauccaaaauuugaaaagcaguuaggacaaguuauguuacuuguguuaugcguuacacagguacucaugaugcggacaacuugggccuuaugugaggcuuuaacuuuggcaacagguccuaucucgacgcuaugggaaggaaacccggggagguuuuggaauacgacaauugcuguaucuauggcaaacauuuuuagagggagcuauuuggcaggagcaggacuauuauucucuaucaugaaaaauacggcaaauacucgcagagguacuggaaauacaggugaaacauuaggagaaaaauggaaaaauagacucaacgcguuagguaaaagcgaauuucaaauauacaagaagucagggauacaggaaguagaccggacuuuggcaaaagaaggaauuaaacggggugaaacggaccaccacgcugucucaagggguucugcaaaauuacguugguucguggaacguaacuuaguuacuccagaaggaaaaguuguugaccuagguugcgguagaggcggaugguccuacuauuguggaggcuugaagaacguuaaagaaguuaaaggucuuacuaaaggugggccagggcaugaggaacccaucccgaugaguacauacgguuggaaucucguucgauuacagucugguguagacguguuuuucacaccgccagagaagugcgacacacuacucugcgauauaggagagucauccccuaacccuacaguagaggccggcagaacgcuaagagucuuaaaucuuguagaaaauuggcuaaacaauaacacacaauuuugcaucaagguauugaauccauacaugccaaguguuauugaaaagauggaagcccuacaaagaaaauauggaggugcauuaguucgaaacccacucagucgaaauaguacccacgagauguacuggguuucgaacgcauccgggaacauaguaucgucaguaaacaugaucucuagaaugcuaauaaaccgguucacaaugaaacauaaaaaggcaacguacgaaccagacguggaccuugggagcggaacaagaaacauaggaauugagucagagacaccuaaccuagacauaaucggaaaacggauagagaaaaucaaacaagagcaugaaacaucuuggcauuacgaccaggaucaccccuacaagacuugggcauaucacggaagcuacgaaacaaaacaaacaggcagugcgucaucuauggucaacgguguugugcguuugcugacaaaaccaugggauguuauuccgaugguaacacagauggcuaugacagauacaacaccauucggacaacaacgugucuuuaaagaaaaaguagacaccagaacucaggaaccaaaagaagguaccaaaaagcuaaugaagauaaccgcagaguggcuauggaaagaauuagguaaaaagaaaacaccccgcauguguacaagagaagaguucacucggaaagucaggucaaacgccgcacuaggagcaaucuuuacagaugagaauaaauggaaauccgcgagggaagcaguugaagacagcggcuucugggaacuuguggacaaagaacguaaucuacaucuggaagguaaaugugaaacaugcguauauaauaugaugggcaagcgggagaagaaauuaggugaguucggaaaagcgaaaggcuccagagccauaugguauauguggcucggggcuagguuccuagaguuugaagcauugggauuucucaaugaagaucauugguuuucaagggaaaauucccucucagguguagaaggggaaggauugcacaaguugggguacauccuacgugauguaucgaagaaagagggaggugcaauguaugccgaugauaccgcgggcugggauacgaggauaacccuagaagacuugaaaaaugaagaaaugguuacuaaccauauggaaggagaacaccggaaacuagcagaagcaauauucagguuaacauaucaaaauaaaguaguacguguucaaagaccaaccccgcgaggaacaguaauggauauaaucagcaggagagaucaacgcgguagcggacaaguuguuacuuauggacuuaauacauuuaccaauauggaagcacaauuaauucgucaaauggaaggggaaggaguguuuaaaucaauucaacaccugaccguaacggaagaaauagcgguuaaaaauuggcucgaaaggguuggcagagaacgguuaaguagaauggccauuaguggugaugauugugucgucaagccacuugacgacagauuugccagcgcgcuuacagcacuaaaugauauggguaaaguaaggaaagauauccaacaaugggagccaagcagaggauggaacgauuggacucaaguuccuuuuuguucccaucacuuccacgaacuuaucaugaaggauggaagaguauuaguaguaccaugcagaaaucaagacgaauuaauaggccgagcacgaauuagccaaggggcaggcuggagcuugagagagacagcgugcuuagggaaaagcuaugcacaaauguggucacucauguauuuucaucgacgagaccuuagacucgcagcaaaugcaaucuguuccgcaguaccaucacacuggguccccacuucaaggacaaccuggaguauucacgcaacacaugaguggaugacgaccgaggauaugcucaccgucuggaauagaguguggauccaagaaaacccguggauggaagacaaaaccccugucgaguccugggaagaaauaccguaucuugggaagcgugaggaccaauggugcggcaguuugaucggauuaacaaguagagcuacaugggccaaaaauauucaaacagcuaucaaccaaguuaggucguugauuggaaaugaagaauauacugacuauaugccaucaaugaaaagguucagacgcgaagaagaagaagccgguguacuaugguaa

SEQ ID NO: 22213 - RNA, 9876 nt, Artificial Sequence
  derived and/or modified CDS sequence (opt6) from DENV-2__KX380810__SS-prME
acugcuggaauuauaauaaugaugauaccaacaguaauggcauuucacuugacaacaagaaacggagaaccacacaugauaguaucgcggcaggaaaaaggcaaaucgcuauuguuuaaaacagaaaacggcgugaauauguguacccuuauggccauggaccuaggagaauuaugcgaagacacaauaacuuauaauuguccccugcugagacaaaaugaaccggaagauauagauugcugguguaauagcacaucaaccugggucacuuauggaacuugcacggcaaccggugaacacagaagagaaaaacgauccguugcucuagucccacaugucggaaugggucucgaaacacgaacggaaaccuggaugaguagcgaaggcgcauggaaacaugcccaaagaauugaaacaugggugcuccgccacccgggauuuaccguaauggcagcuauacuugcauauaccauagguaccacauauuuucaacgcgugcuuauuuucauauuguugacugcuguagccccuucaaugacuaugcgaugcauagguaucagcaacagagacuuuguugaagguguaaguggcgggaguuggguggacauugugcuagaacacggaucuugugugacaacgauggcuaaaaacaaaccgacacuagacuucgaacuaaucaaaaccgaagcgaaacaccccgcuacuuugcguaaauauuguauagaagcgaaacucacuaacacuacuacggccagucgauguccaacacaaggggaaccaucuuuaaacgaagaacaagauaaacgauuuguaugcaaacacaguaugguagaucguggauggggaaaugguuguggacuauuuggaaaaggaggaauaguaacaugcgccauguuuaccuguaagaaaaauauggaagggaaaauuguacaaccagaaaauuuggaauacacaauagugauuacaccacacucgggcgaggaaaaugccguaggaaacgauacuggaaaacaugguaaagaaauuaaagucaccccacaaucauccauaacggaagcggaauuaacgggauacgguaccgcaacgauggaauguucuccgcgaacagguuuggauuuuaaugaaaugguacuucugcaaauggaaaauaaagcaugguugguucaucgacaaugguuccuagauuuaccauuaccuuggcuuccuggagccgacacacaggguucgaacuggauacaaaaagaaacacuuguuacuuuuaaaaacccucacgcaaagaaacaagaugucguggucuuaggcagucaagaaggugcgaugcacacagcguugacaggagcaaccgagauucaaauguccucggggaaucucuuauuuacuggccauuuaaaaugucgauuaaggauggauaaguuacaacuaaagggaaugagcuauagcaugugcacagggaaguuuaaaguaguuaaagaaauugccgagacacaacacggaacaauaguaauaagaguucaauaugaaggggacggaagucccuguaaaaucccuuucgagauaauggacuuggagaaaagacaugugcuagguagauuaauuacaguuaacccaauaguuacgggaaaagauaguccgguuaacaucgaagcagaaccgccauuuggcgacucauauauuauaauuggcguagagccuggacaacuuaaacuuucgugguuuaagaaaggaucuucaauaggccaaauguuugagaccaccaugcgaggagcaaagaggauggcgaucuugggggauacugcgugggauuucgggucacugggaggaguuuuuacgucuauaggcaaggcuuuacaccaaguguuuggugcuauuuauggugcagccuucucuggcgucucuuggacgaugaaaaucuuaauaggaguagugauaacuuggauagguaugaacucuagaaguacaucguuauccguaagucugguacuuguagggauaguaacacuauauuuaggaguaaugguucaagcugauucuggaugugucguuucauggaaaaacaaggaacuaaaaugcgguagugggauauuuauaacggauaacguacauacguggacagaacaguauaaguuucaaccagaaucaccuucaaaauuggcuucugcuauacaaaaagcucacgaagaaggaauuugcggaauacguucugucaccagacuggagaaucugauguggaaacaaaucacaccugaauugaaccacauacucucagaaaaugaagugaaauugaccauaaugacaggugauaucaaagggauaaugcaagcuggaaaacgaucgcuacgaccucaaccgacugaacuuaaauacucauggaaagcauggggaaaagcaaaaauguuaucuacggaauuacauaaccacacauuuuugauagauggucccgagaccgccgaauguccgaacacgaaccgggcauggaauagccuggagguagaggauuacggauucgguguguucacaacuaacaucuggcuuaaacuuaaagaacggcaagauguauuuugugacucgaaguuaaugagcgcagcaauuaaggauaaucgagcuguacaugcugauaugggguauuggauugaauccgcguuaaacgacacauggaagauagaaaaagcuagcuucaucgaagucaaaaguugccacuggccuaaaucucacacucuguggaguaacggaguauuagaaucagaaaugaucauucccaagaauuucgcagggccgguaucucaacacaauuaucggcccggcuaucacacacaaaccgcagguccuuggcaucugggaaggcuagaaauggacuucgauuuuugugaagguacuacgguggugguaaccgaggacuguggaaauaggggaccaaguuuaagaacuacuacagcaucagguaaacuaaucacagaauggugcugcagaaguugcacguugccuccccuaagauauagaggugaggauggguguugguacgggauggagauaaggccgcuuaaagaaaaagaagaaaaccuuguaaauagucucgugacagcuggacauggucaaauugauaacuucagcuuaggaguuuuagggauggcuuuguuccuugaagaaauguugcgcacaagaguggggacaaaacaugcaauacugcuaguagcugugagcuuugugacuuuaauuacaggaaauaugucauuucgggaccugggaagaguaaugguaaugguaggagcgacuaugacugaugauauagguaugggaguaacauaccuggcauuacuagcagcauuuaaaguccggccaacauucgccgcagguuuauugcuaagaaaauuaacaagcaaggaacuaaugaugacaaccauuggaauaguauuauugagccaaaguacuauaccagaaacuauucuagaguuaacugacgcacucgcauuagguaugaugguauuaaaaauaguaagaaacauggagaaauaccaauuggcaguuacaauuauggcgauccucugcgucccaaacgcaguuauacuucaaaaugcauggaagguaucguguacaaucuuggcaguaguuucaguuagcccacuucuauuaaccucaucacaacagaaagcagauuggauuccacuagcucugacaauaaaaggccuaaauccaacagcaauauucuuaacuacgcuaucacgcacuagcaaaaagaggucuuggccauugaaugaagcaauaauggcuguagguaugguaaguauucuagccucaucccucuuaaagaaugauauuccuaugacaggaccauuaguagcuggcggguuacucacgguuuguuacguucuaacugggagaucggcugacuuagaauuggagagggcagcagacgugcgcugggaggaacaagcggagauaucagguaguaguccaauacuauccauuacgauaagcgaagauggguccaugagcaucaaaaacgaagaggaagaacagacacuaacgauauuaauaaggacuggacuauugguuauauccggccuuuuuccuguaagcauaccuaucacagcagcggcaugguaucuuugggaagucaagaaacaaagagcaggaguacucugggaugucccuucuccgccaccagugggaaaagcggagcuagaggacggggcauaccggauaaaacaaaaaggaauacuaggauauagucaaauaggugcuggaguuuacaaagaagggacguuucacaccauguggcacgugacacgaggagcaguucuuaugcauaaaggcaaaaggauagagccaaguugggcggaugucaagaaagaucugaucucguauggaggcggauggaaacucgaaggagaguggaaggaaggugaggaaguacaaguauuggcacuugaaccgggcaagaauccgagagcgguucaaacaaaaccuggguuauuuaaaaccaauaccggcacaaucggugccguaucucuagacuuuucuccgggaacuagcggaucgccuauaguggacaagaaaggaaaggugguaggauuauaugggaauggaguaguaacgcgauccgggacuuaugucagugcuauagcucaaacugagaagucaauagaagacaacccagaaauugaagaugacaucuuuaggaagaaaagauuaaccaucauggaccuacauccaggagcuggcaaaacuaaaagauaucuaccggcgauuguacgagaggccauuaaaagggguuuacgaacacuaauucuugcacccaccagaguuguugcagcagaaauggaagaagcacucagaggacuuccaauacgcuaccaaacuccggcgauacgugcggaacacaccggcagagaaauaguggaccuuaugugucaugcgacguuuaccaugcgguugcucuccccuauccgcgucccaaauuacaaucucauaauaauggaugaagcacacuuuacagauccugcgucuauugcagcgcggggguauauuucaacacgugucgaaaugggggaagcggcgggaauauucaugacugcaacaccaccagggucgcgggauccauucccgcaaagcaacgcgccaaucauggaugaagaaagggaaauaccagaacgaucauggaacucaggccacgaaugggucacagauuucaaaggaaaaaccguaugguuuguaccaucaauaaaagcuggaaacgauauagcagcauguuugaggaaaaauggcaagaaaguaauccaauuauccaggaaaaccuucgauucggaauauauaaaaacaagaacaaacgacugggauuucguuguuacaaccgacaucucagaaaugggugcuaauuucaaggcugagcguguuauugacccaagaaggugcaugaaacccguaauacuaacagacggagaggaaagggucaucuuagccggcccuaugccaguaacccauucuagugcagcucagcgaagagggcgaguaggucguaaucccaaaaacgaaaacgaucaguacauauauaugggugaaccauuagaaaaugaugaagauugcgcgcauuggaaagaggcaaaaauguuacuagauaauaucaauaccccggaagguauaauaccaucaauguucgaacccgaaagagaaaaggucgaugcgauagauggcgaguaucguuuaagaggagaagcgcgaaagacuuucguggaucuaaugcggaggggagaucucccgguuuggcuugcuuauagaguggcugccgaagguaucaauuacgcagaccgucggugguguuucgauggagugaaaaacaaucaaauacuagaagaaaauguugaaguagaaauauggaccaaagagggggagcgaaagaaacuaaaaccgcgaugguuagaugcacgaauauauucugauccacuagcgcuaaaagaauuuaaagaguucgcagcugguaggaaaaguuuaacacuaaaucuaauuacagaaauggggcgauuaccaacguuuaugacacaaaaggcaagaaaugcucuagacaaucuugccguuuugcauacagcggaagcuggugggagagcauauaaucaugccuuaagcgagcugcccgagacgcuagaaacauuacuauugcugaccuuacuagcuacaguaacgggaggaauuuuucuguuccuaaugagcgguaaggguauaggaaagaugacauuggguaugugcuguauaauaacagccucaaucuuauugugguaugcgcaaauacagccacacuggauagcagcaucaauaauacuagaauuuuuccugauaguauuacuuauaccggagcccgaaaaacaaaggacaccacaagauaaucaacuuacuuaugucguaauagcaauacugacuguagucgcagccacgauggccaaugagaugggauuucuugagaaaacaaagaaagacuuuggccuaggaucgaucacaacccaacaaccggauagcaauauccuagacauagaccugaggccggcaucggccuggacacucuacgcaguugcgacaacguucaucacaccgauguuaagacauucuauagaaaacaguucgguaaauguaucguuaacugccauagcgaaccaagcaacaguacuaaugggacuuggaaaaggauggccacuaaguaagauggauauaggaguaccccucuuagcgauuggaugcuacagucaagugaauccaauuaccuuaacugcugccuuacuauuauugguugcacauuacgccauaauaggcccaggauuacaagcuaaagcaacaagggaagcgcaaaagcgagcagcggcaggcauuaugaagauaccggcagcugauauuggaacgguuauagaccucgacccuauaccuuaugacccaaaguuugaaaaacaauugggacaaguaaugcuacugguauuauguuccacucaaguacuuaugaugaggacgacuugggcucuaugcgaagccuugacacuugcgacaggaccaaucagcacucuuugggaaggcaacccaggacgguucuggaauacuacuaucgcagucucuauggcuaauaucuuccguggcucauacuuagcgggagcuggguuacucuucucaaucaugaagaauacugccaacacacguaggggaacaggaaauacaggagagaccuuaggagaaaaauggaaaaaucggcuaaaugcgcuaggcaaauccgaauuucaaauuuacaagaaaagcggaauccaggaaguugauaggacgcuugcaaaagaaggcauuaaacguggugaaacggaccaucacgcaguaucucgagggucagcaaaacucaggugguucguagaaagaaaccuuguuacaccagaaggcaaaguaguagaucuagguugcggcagaggagguuggaguuauuauugcggugggcucaagaaugugaaggaagugaaagggcuaacuaaggguggaccugggcaugaggaaccaaucccgaugucuaccuaugguuggaauuugguaagauugcagucgggaguugauguauucuuuacacccccagagaaaugcgacacccuacugugugauauuggcgagucaucuccaaauccgacgguugaagcuggccgaacguuacgugucuuaaaccuaguagagaacugguuaaauaacaauacacaauuuugcauaaaagugcucaacccauauaugccgucuguuauagagaaaauggaggcguugcaacguaaauauggaggagcacucgucagaaaucccuuaucacgaaauucuacacaugaaauguauuggguaaguaaugcaucuggaaacauugucagcucaguaaauaugauaagucguaugcuuauuaaucgcuucacaaugaaacacaagaaagccacauaugaaccugauguugauuuaggcaguggcacgcgaaauaucggaauagaauccgaaacccccaauuuggacauuaucggcaaaagaauugagaaaauuaaacaagagcacgaaacgucguggcauuacgaucaggaucacccauauaaaacuugggcuuaucaugggagcuacgagacuaaacaaacgggcagugcgucaucuaugguuaauggaguagugcgacuuuugaccaaaccaugggaugugaucccgaugguuacgcaaauggcaaugacugauacaacgccguucggacaacagcgaguauucaaagaaaaagucgauacacgaacccaagagccaaaggaaggcacaaagaaauuaaugaaaauaacugccgaauggcuuuggaaagaacuagguaagaagaaaacaccaaggauguguacgagggaagaguucacacgaaagguccgcuccaaugcggcacuaggagcaauauuuacugacgagaacaaauggaaaucggcaagagaggccguagaggacuccggcuuuugggaauuagucgacaaggagagaaaccuucauuuggaaggaaaaugugaaacauguguuuauaacaugaugggaaaacgagagaagaaauugggggaguucggcaaagcgaaaggaaguagggccauaugguauauguggcuaggcgccagauuuuuggaguucgaagcacuaggcuuccuaaacgaggaccauugguuuucuagagaaaauucguugagugguguugaaggggaagggcuacauaaacucggguauauauuaagagacgugagcaaaaaggaaggaggugccauguacgcagacgauacggcuggaugggauacccgaaucacucuagaagaccucaaaaaugaagaaauggucacaaaucacauggaaggggaacacagaaaacuggcagaagccauauucagacuaaccuaccagaacaaaguaguuaggguccaacgaccuacuccucgaggaacaguaauggacauaauuucacgucgagaucaacguggaagugggcagguaguaacuuacgguuugaacacauucacuaacauggaagcgcaguuaauucgccaaauggaaggagaggguguauucaaaaguauacaacauuuaacaguuacggaagaaauugcggugaaaaauuggcuugaaagaguaggaagagaacggcuaagccggauggcaauaucaggugacgacuguguuguuaaaccgcuggacgaccgauucgcgagcgcacuuacagcauuaaaugauaugggaaaaguuagaaaagacauccagcaaugggaacccucgcgaggcuggaaugauuggacucaaguaccuuuuuguucacaccacuuucaugaauuaauaaugaaggauggcagaguccuuguuguaccuugucggaaccaagaugaauuaauaggcagagcuaggauuucgcaaggggccgguuggagcuuaagagagacagccugccucggaaaaucauaugcucaaauguggagucuaauguauuuucaucgaagagacuugaggcuagcagcaaaugccaucuguuccgcagucccaagucauuggguaccaaucagccggaccacuuggagcauccaugcaacucacgaauggaugaccacugaggacaugcugacaguguggaaccgugucuggauacaggaaaauccguggauggaagauaaaacucccguugaaaguugggaagaaauuccuuaucugggcaaaagagaagaucaaugguguggcagucuuauaggccuaacaagcagagcaacuugggccaaaaauauccagacggcgauaaaucaaguaaggagcuuaauagggaacgaagaauauacugauuacaugccaaguaugaagagauuucgacgcgaggaagaagaagcugguguucuaugguaa

SEQ ID NO: 22214 - RNA, 9876 nt, Artificial Sequence
  derived and/or modified CDS sequence (opt6) from DENV-2__KX380811__SS-prME
acagcggggauuauaauaaugaugauacccaccguuauggcauuucaucuaacuacaagaaacggagaaccucauaugauugugagcagacaagaaaaaggaaaaagccugcuauucaaaacugaaaauggugugaauauguguacauugauggcuauggaucuaggugaacuaugugaagauacaauuacauauaacuguccauuacuacgacaaaacgaacccgaagacauagauuguuggugcaauucuacuucuaccuggguaacauacggaaccuguacugcuacuggggaacaccguagagagaaacgaucugucgcuuuaguuccgcacgucgguaugggucuugaaacuagaacagaaaccuggaugagcagcgaaggagccuggaaacaugcccaaagaauagaaaccuggauuuugcgucaccccggguucacaauaauggcggcaauccuagcguauacaauaggaacuacauauuuccaacguguacuaaucuuuauuuuacuuacagcuguaacuccaucaauggccaugcgaugcauagggauaagcaauagagauuucguagaagggguaucagguggaucuuggguggacauuguacuugaacauggaucgugcguaacaacuauggcuaaaaacaaaccgacucuggauuuugaacugaucaaaacugaagcgaaacaucuagcuacacucagaaaauacugcguggaagcuaaauuaacgaacacaacuacggcaucgagaugucccacccaaggugaaccuagucuaaaugaagaacaagauaaaagauuugugugcaaacauucaaugguugaccggggcugggguaauggaugcgggcucuuugggaaagguggaauagugacgugugcuauguuuacauguaagaagaauauggaaggaaaggugguacaaccagagaaucucgaauauacgauaguaaucacaccucauuccggcgaagaaaaugcggucgguaaugauacaggaaaacauggcaaagaaaucaaaguaacuccgcaaucuucgaucacugaagcagaacuuacgggcuacggcacagucacuauggaauguaguccgcggacaggucuugauuuuaacgaaaugguauuauugcagauggaaaauaaagcaugguugguacauagacagugguuuuuagacuuaccuuugccguggcuaccaggggcagauacccaagggucgaacuggauccaaaaagaaacgcuaguaaccuuuaaaaacccucacgcaaagaaacaagacguaguaguauuagguucacaagagggagcgaugcauaccgcacuuaccggagcaaccgaaauccaaaugucaucugguaaccugcuauucaccggucacuuaaaaugucgucuaagaauggacaaauugcaacucaaaggaaugucuuacucgaugugcacggguaaauucaaagucguaaaagaaauagcggagacccaacacggaacgauuguuauccgagugcaauacgagggagaugggaguccauguaaaaucccauuugaaaucauggauuuggagaaaagacauguacuuggcagauuaauaaccguuaacccgauuguaacugaaaaagauaguccugugaauauagaagcugaaccuccauucggugacaguuauauaaucauaggcguggagccuggucaauuaaaacugaguugguucaagaaaggaucuucaauuggacaaauguuugagaccacuaugagaggagcgaaaagaauggcaauauuaggugauaccgcaugggacuucggcagcuugggaggaguauucacuucaauuggaaaggcuuuacaucaaguuuucggagcuauauauggggcagcguuuaguggcgucaguuggaccaugaaaauuuuaauagggguagucauaacguggauagguaugaacucaagaucaacuuccuuaucagucucucuagucuuagucggaguaguuacacuuuaucuuggcgugaugguacaggcugacagugguuguguugugucauggaaaaacaaagaacucaaaugcgguucaggaauauuuauaacagauaauguacacacauggacagaacaauacaaauuccaacccgaaucaccgucgaaauuagcaucggcgauacagaaagcucaugaagagggaaucuguggaauaagauccguuacuagacuugaaaaccuuauguggaaacagauaacgcccgaacuaaaucauauucucacagaaaacgagguuaaauugacgaucaugacuggagacauuaaagggauaaugcaggcaggaaaaaggucauugagaccgcaaccaacagaacuaaaauacucuuggaaagcauggggaaaagcaaaaauguuaucaacagaguuacauaaucauacauuucucauagauggacccgaaacugcugagugcccgaauacaaacagagcauggaacucauuagagguagaagacuauggauuuggagucuucacaacgaacauauggcuaaaacucaaggaaagacaggauguguucugcgauucgaaccuaaugagcgccgcuaucaaggacaauagggcuguacaugcagacaugggguauuggauagagagugcacuuaaugauacauggaaaauagagaaggcgucguuuauugagguaaaaucuugccauuggccgaaaucgcacacucuuuggaguaacgggguuuuagaaucagaaaugauuauaccaaagaauuucgcggguccgguaucacaacacaauuauagaccuggguaccauacacaaacagcgggacccuggcaccuugguagauuggagauggauuuugauuuuugugaaggaacgacaguagugguaacggaagauugcggaaauagaggaccuagccugagaacgacaacugcaucagguaaacucauuacagaauggugcuguaggagcugcacacuaccaccauugagauauagaggcgaagauggaugcugguacggcauggaaauacgaccgcuuaaagaaaaagaagaaaaucuaguaaacucuuuaguaaccgcuggucauggacaaauugauaacuuuagucucggcguacuagguauggcguuauuccuagaagaaaugcugagaacucgaguggguacuaagcacgcaauccuauugguggcaguaucauuuguaacauuaauaacagggaauaugucauuucgggauuuaggaaggguuaugguaauggugggagcgacaaugaccgaugauauaggaaugggaguaaccuauuuagcacuacuggcugccuuuaaaguaagaccuacuuucgcagcgggauuauugcugagaaagcugacuucgaaagaacuaaugaugaccacaauagggauaguucuacuaucacagaguacuaucccagagucuauucuagaacuaacagacgcacucgcuuugggcaugaugguguuaaaaauaguuaggaauauggagaaauaucaguuagcaguuacuauaauggcuauccucugcgugccaaaugcugucauucuccaaaacgcuuggaaaguaucauguacaacguuagcuguaguuucagugagcccacuccuacuaaccucaagucaacagaaggcagauuggauaccacuagccuuaacaauaaaaggauuaaacccaacggcuaucuuuuuaacaacccuuucaaggacgagcaagaaaagaaguuggccccugaacgaagcuauuauggcaguugguaugguaucaauauuagcaagcagccuucucaaaaaugauauaccaaugaccggaccacucgucgcaggaggucuguuaacagucuguuauguuuuaacuggacguucggcggauuuagaguuagaacgggccgcagacguaaggugggaagaacaagcagaaauauccggcaguucuccuauauuaaguauaacaauaucagaagaugguaguauguccaucaaaaaugaagaagaggagcaaacacugaccaucuuaauaagaacgggucuccuuguuauaaguggauuauuucccgugucuauuccgauaacggcggcugccugguacuuaugggaggugaagaaacaaagagcuggaguauugugggaugucccaagcccacccccaguaggaaaggcugaauuggaggacggcgccuaucgaauaaaacaaaaagguauauuaggauauucgcaaauaggagcaggcguauauaaagaagggacauuucauaccauguggcauguaaccaggggugcuguauuaaugcauaaaggaaaacgcauagagcccaguugggcagacguaaagaaagacuugaucucauauggcggaggauggaaacucgaaggagaauggaaagagggugaagaaguacagguacucgcauuggaaccagguaaaaauccacgcgcaguccaaacaaaaccgggacuauuuaaaacgaauaccggcacaauaggggccgugucguuggacuucucgcccgggacuucuggaucuccgauugucgacaagaaaggcaaaguaguaggauuauacgguaacgguguuguaacaagaagcggaacguaugugagugccauagcucagacggagaaaaguauugaagacaacccagaaauagaagaugacauauuuaggaagaaacgacugacaauaauggaucuucacccaggggcgggaaaaacuaaaagauaccuccccgcgauaguaagagaagcaaucaaacgagguuuaagaacauuaauauuagcuccuacaagagucgucgcagcugaaauggaagaagcucucaggggacuucccauucgauaccaaaccccagcaauacgagcagaacacaccgguagggaaaucgucgacuugaugugccacgcaacauuuaccaugcgucuuuuaaguccgauacgaguaccaaacuauaauuuaaucaucauggacgaagcucauuuuacugaucccgcgucaaucgccgcacgggguuacauuagcacacgcgucgaaaugggcgaagccgcagggauauuuaugacagcaacgcccccaggaucgcgggaucccuuuccccaaucaaacgcucccauuauggacgaggaaagagagauccccgagagaaguuggaacucgggacaugaaugggugaccgacuucaaaggcaaaacggucugguucguaccaaguauaaaagcgggcaaugauauugccgcauguuuacgaaagaauggaaagaaaguuauccaguugucgagaaaaacauucgauagugaauauauaaaaacaagaacaaaugauugggauuuugucguaacaacagacauaagcgagaugggggcuaauuuuaaggcagaacgugucauagacccucgaagaugcaugaaaccaguaauauuaaccgauggagaggagagaguuauccucgcagguccaaugccaguaacccacagcagugcagcgcaacguaggggaagaguggggagaaacccuaagaaugaaaaugaucaauauauauacaugggagagccuuuagaaaacgacgaagauugcgcacacuggaaagaagcaaaaaugcuguuggauaacauuaacacuccggaaggcaucauaccuagcauguuugaaccggagagagaaaaaguggacgccaucgacggugaauauaggcuucgcggagaggcucggaaaacuuucgucgaccucaugcggagaggggauuugcccguuugguuagcauauagaguugcugcagaaggaauuaauuacgccgacagaagauggugcuuugacggggucaaaaauaaucaaauauuagaggaaaauguggaaguagaaauauggacuaaagaaggagaaaggaagaaauugaaaccaagguggcuagacgcacgcauauauagugacccauuggcgcucaaagaguuuaaagaauuugcagccggacguaagucacucaccuugaaucucauaacagaaaugggacgucuccccacguuuaugacucaaaaagccaaaaacgcauuggauaauuuggcagucuuacauaccgcggaggcaggggguagagcuuacaaccaugcacuaagugaauugccagaaacguuagaaacuuuguuauuguugacucuauuagcgacgguuacuggcggaauauucuuauuccugaugaguggaaagggaauaggaaagaugaccuuaggaauguguugcauaaucacagccuccauucuguuaugguaugcgcaaauucaaccccacuggauagcugccucuauaauauuggaguucuucuugauagugcuauuaauaccugagccagaaaaacaacggacaccccaagacaaucaguugacauaugucgucaucgcuauauugaccgucguagcagcaacaauggccaacgagaugggauuuuuagagaaaacaaagaaggauuucggacuaggaagcauuaccacucaacaaccagaaucaaauauuuuagacauugaucuaaggccugcaucggcuuggacuuuauaugccguagcuacuacauucauaaccccaauguuaagacauaguauugaaaacagcucaguuaacguuagcuugacagcuauagccaaccaagcaacuguacuaauggguuuaggaaaaggauggcccuuaagcaagauggacauuggcgugccacuauuggcaauugguuguuacucccaaguuaacccgauaacauuaacugcagcguuacuacuacuggucgcccacuaugcgauaauagguccagggcuacaagccaaagcuacaagggaagcucagaaacgugcagcagccgguauaaugaaaauuccaacaguugacgguaugaccguuauagaccuugauccgauacccuaugauccuaaauucgaaaagcaacuaggccagguuauguuauuaguacugugcguaacucagguacucaugaugcguacaacaugggcccugugcgaagcacuaacccuagccacagggccaauaucaacccuaugggaaggcaauccuggacguuuuuggaauacaaccauagcaguaagcauggccaauauuuucagagguucuuaucuagcaggcgcuggacuacuauucuccauaaugaagaauacugccaauacaagaagaggaacagggaauacaggagagacucugggggaaaaauggaagaauagguuaaacgcgcuuggaaagucggaguuccaaauauauaagaaaucaggcauacaagagguugacaggacgcuggcaaaagaaggaauaaaaagaggagagacagaccaucaugccguuucacgagguucagcgaagcuaagaugguucguagagcggaaucuaguaacaccagaaggcaagguaguagauuuaggaugcggacggggaggcuggucauacuauugugggggauuaaagaauguaaaagaagugaagggcuuaacgaaaggcggccccggacaugaagaaccuauaccaaugucuacguauggauggaacuuaguaagauuacagagcggaguugauguauucuuuacacccccagagaaaugugauacucucuugugugauauuggggagucaucuccuaaucccacuguugaagcaggacgaacuuuaagaguccuaaauuuaguagagaacugguuaaacaauaauacacaauuuugcauaaaaguauuaaaccccuauaugccgucaguuaucgagaaaauggaagcccuucaacgcaaauacggaggagcucuaguaaggaacccucuuaguagaaacucaacacacgaaauguauugggugaguaacgccagcggaaauauaguaagcucaguaaacaugauaagucgaaugcucauaaauagauucacgaugagacauaagaaagcaacguaugagccagacgucgauuuaggaaguggaacgaggaauauagguauagagucagagacaccuaaccucgauauuauugggaagcguauagagaaaauuaaacaggaacacgaaaccagcuggcauuacgaucaagaccauccuuacaaaacgugggcauaucacggaagcuacgagacuaaacaaacagguucagccagcucaaugguaaacggaguaguaagacuacucacuaaaccaugggauguaauucccaugguaacucaaauggcuaugacggauaccacuccauucggucaacaaagaguuuucaaagagaaaguugacacacguacacaagagcccaaggaaggaacgaaaaaguugaugaaaauaaccgcggagugguuauggaaggagcucgguaagaagaaaacgccgcguaugugcacaagagaggaguuuacgagaaaagucagaucuaaugcagcguuaggagcuauuuuuaccgaugaaaacaaauggaaaucugccagagaagcaguagaagauucugguuucugggagcuaguggacaaagaacgaaaucugcacuuggaaggaaaaugcgaaacauguguguacaauaugaugggaaagcgagagaagaaauugggagaguuugggaaagcaaaagguagucgcgcaaucugguauauguggcuaggggccagauuucuagaauuugaggcacugggauuuuugaacgaggaccacugguucucuagggaaaauucauuaucuggaguugagggagaaggucuucauaaacugggauauauuuuacgcgacguuaguaagaaagaggguggagcuauguaugcagacgauacggccggcugggacacgagaaucaccuuagaggaccucaaaaaugaagagauggucacuaaccauauggagggagagcauaagaaauuggcggaagcgauauuuaaacuuaccuaucaaaacaaaguaguaagaguacagagaccaacgccccggggaacggucauggacauuaucucacgaagagaccaaagaggaagcggccaagucgugacauauggguuaaacaccuucacgaauauggaggcacaguuaaucaggcaaauggaaggagaagguguauucaagucaauacaacaacucacgguaaaagaagagauugcuguuaaaaacugguuaauaaggguaggaagagaaaggcuaucccgaauggcgauaucgggagacgacuguguagugaaaccucuagaugaccgauuugcauccgcguugacggcacuaaaugauaugggaaaaguaagaaaagacauucaacaaugggaacccucaagaggauggaacgauuggacacaagugccuuuuugcucucaucauuuucacgaacuuauaaugaaagauggacgaguucuuguaguaccgugucggaaucaagacgaauuaauuggacgcgcuaggauuagccaaggagcuggauggucauugagagagacagccugcuugggaaaguccuacgcacaaauguggaguuugauguacuuucaucggagggaucuaagacuagcagcaaaugcaaucugcucagcaguuccgagucauuggaucccgacaucaagaacaacauggaguauccacgcuacucacgaguggaugacgacagaagauauguuaacgguauggaacagagucuggauccaagagaauccauggauggaagacaagacuccaguagaaucuugggaagaaaucccauaccucggaaaaagagaggaccaauggugcggcuccuugaucggacuuacaucacgcgccacaugggcuaagaauauacagaccgcaauaaaucaaguaagaaguuuaaucggaaacgaggaauacacggauuacaugcccucaaugaagcgauuuagaagggaagaagaagaagcaggaguacugugguaa

SEQ ID NO: 22215 - RNA, 9876 nt, Artificial Sequence
  derived and/or modified CDS sequence (opt6) from DENV-2__KX380813__SS-prME
acugcugggauuauaauaaugaugauacccacaguaauggcauuccacuuaacuacuagaaacggugaaccacauaugauuguaucacgucaggagaaaggaaaaaguuugcuuuucaaaaccgaaaauggaguaaacauguguacucuuauggcaauggacuuaggggaauuaugugaagacacaauaaccuacaauugcccauuauugcggcaaaacgagccugaagauauugauuguugguguaacaguacgucaacuugggugacauacgggacauguacagcgacaggagaacaccgaagagagaaacguuccguagcuuuaguaccccacgugggaauggggcuugaaacgcgaaccgagacauggaugucaagugaaggagcuuggaaacaugcacaacgaauugaaacuuggauccuaagacacccaggauucaccauaauggcagcaauacuugcauauacuauuggaacgaccuacuuucagagagugcuaauauucauauuacucacugcuguaacgccaucgauggcaaugaggugcauaggaauuaguaaucgggauuuuguagaagguguguccgguggaucauggguagauaucguucuggagcauggaaguuguguuacaacgauggcuaaaaacaaaccuacuuuggauuuugaacuaauaaaaacagaagccaaacacuuagcaacuuuaagaaaauacugcguagaggcaaaauuaacaaauacaacaacagcaaguagauguccaacacaaggagagccgucucuuaaugaagaacaagacaaacgauuuguaugcaaacauaguauggucgaccgaggauggggaaacggauguggacuauucgggaaaggaggaauagugacaugugcaauguucacuuguaagaaaaauauggaagggaaaguagugcagccagaaaaucuugaauauaccauuguaaucaccccucauaguggggaagaaaaugcgguagguaaugauacugguaaacaugguaaagaaauuaaagucacaccccaauccuccauaacagaggccgagcuaacagguuaugguacuguuacaauggaauguagcccccguacuggacuugauuuuaaugaaaugguuuuacuucaaauggaaaacaaagcaugguuaguacauagacaaugguuccuagauuuaccguugccuugguugccgggagcugauacacagggaaguaauuggauucagaaagaaacucuaguuacauuuaaaaauccucacgccaagaaacaagauguaguagugcuaggaucucaagagggggcgaugcauaccgcccuuacgggggcaaccgagauacagaugucaagcgguaauuuauuauucacuggacauuuaaaauguagguuaagaauggauaaauuacaacuuaaaggaaugaguuacucuauguguacgggaaaauucaaaguuguaaaagaaucugccgagacgcaacauggaacuauuguaauuagaguucaauaugaaggcgacggcucgccaugcaaaaucccguuugaaaucauggaucuggagaaacgacacguuuugggaagauugauaacgguuaauccuaucgucaccgagaaagacucucccguaaacauagaggccgaaccuccguuuggugauucauacauuauuaucggcguagagccuggacaacuuaaacuaaguugguuuaagaaagguucaucaauaggccaaauguucgaaacaacuaugagaggugcaaaacggauggcaaucuuaggggauacugcaugggauuucggcagcuuaggaggaguauuuacuucaauagguaaggcuuuacaucagguguuuggagcgauauauggagcagcguucuccggaguuucauggacaaugaaaauuuuaauaggugugguuaucacauggauagguaugaacucuaggucgacaagccuauccgucaguuugguacuuguagggguagugacacuauauuuaggaguuaugguucaagccgacaguggcuguguaguaucguggaaaaauaaagaguuaaaauguggaagugguaucuuuauaaccgauaauguacacacuuggacggaacaguacaaauuucaaccugaaucgccaucgaaacuugcgucugccauacaaaaagcccaugaagaaggaauaugcggaauacgaagugugacaaggcuagagaacuuaauguggaaacagauaacucccgaacuaaaucacauauuaacggaaaaugaagucaaauugaccaucaugacuggugacauaaaaggaauaaugcaagcuggaaaacgaacauugagaccucaacccacggaauugaaauacaguuggaaggcuuggggaaaagccaaaauguuaucuacagagcugcacaaucacacguucuuaauagauggaccugagaccgcagaauguccuaauacgaaccgagcauggaauagucuggaaguugaagauuacggcuuuggaguuuuuaccacuaacauaugguuaaaacuaaaagaaaggcaagacguuuucugugauucaaaauuaaugagugcggcuauuaaagauaauagagcaguucacgccgauaugggauauuggaucgaaucagcauuaaacgacacguggaaaaucgaaaaagcuaguuuuauugagguuaaaucuugucacuggccaaaaagccauacucuauggagcaauggaguuuuagagucggaaaugauuaucccaaagaauuucgcuggacccguaagccaacacaacuauagaccaggauaccacacccagacugccggaccauggcaccuagggaggcuagaaauggauuuugauuucugugagggaacuacaguuguuguaacugaagacuguggcaauaggggcccgucgcugcgaacuacaacagcaucaggcaaacugauuaccgagugguguuguaggagcuguacucuaccacccuugcgauaucguggagaggauggcugcugguauggcauggaaauacgaccacuaaaagaaaaagaagaaaaucucguuaacucacugguaacugcaggccauggacaaauagacaauuucucucucggaguauuaggcauggcccuuuuccuggaggaaaugcuaaggacgcgggucggaacaaaacaugcaaucuuacuuguggccgucucauuuguaacacuaauaacagguaauaugagcuuccgggauuuaggacggguaaugguaaugguaggagccaccaugacagacgacaucggaaugggcguaaccuacuuggcucuacuagcugcuuucaaaauaagacccacuuucgcagcaggccuacuccuacgaaaacuuaccaguaaggagcuaaugaugaccacaauaggaauagucuugcuuagccaaagcacgauaccggaaagcauacuggaauuaacugacgcuuuagcccuagguaugaugguauuaaaaauaguaaggaacauggagaaguaucaauuagcaguaacaauaauggcaauauuguguguccccaaugccguaauauuacaaaacgcauggaaaguuucguguacuacacuugcuguaguuucuguuucaccgcuucuucuuacaaguagucaacaaaaagcagacuggauaccguuagcguugacaauuaaaggauugaaucccaccgccauuuuccuaacaacccuaucucgaacuucuaagaaacguucauggccacuuaacgaggccauaauggcaguggggauggucagcauccucgcaucuucauuauuaaagaaugacauaccaaugacuggaccucuuguugcugggggauuauuaacugucugcuauguucuaacuggaaggucagccgaucuggaacucgagagggcggccgauguucguugggaagaacaagcugaaauauccggaucaucaccuauuuugucaaucacaauuagugaagacgggucaauguccauuaaaaacgaagaagaagaacaaacucugacuauuuuaauacguacggguuuauuaguaauaaguggacucuucccgguaucuauaccaauaaccgcugcggcgugguacuugugggaggucaagaaacaaagggcaggcguguuaugggacguuccaagcccaccaccuguagguaaagcggaguuagaagacggugcguaccgaaucaaacaaaagggaauccuagguuacagccaaaucggggcgggaguauauaaagaaggaacguuucauacaauguggcauguuacuagaggggcgguccuaaugcacaagggaaaacggauugaaccaucuugggcugauguaaagaaagauuuaauaagcuauggaggaggcuggaaauuagaaggagaguggaaggaaggugaagaaguacagguacuagcacuggaaccaggcaaaaauccaagagcggugcagacuaaaccggguuuauuuaaaacgaacacaggaacgauaggggcuguaagccuugacuuuucuccuggaacaucugggucgccaaucguagacaaaaaggguaaaguuguugguuuauauggaaacggaguuguuacaagaucugguacguaugucuccgcaauagcacaaacagagaaaucuauagaggacaauccagagauugaagacgacauuuucaggaagaaaagguugacaauaauggaccuccauccaggggcaggaaaaacaaaaagauaucuuccugcaauuguaagagaagcaauaaaaagaggacugcguacucuaauacuagcgccuacccguguuguagcugcagaaauggaggaagcccuacgaggacuacccauaagguaccagacccccgccauucgagcagaacauacgggaagggaaauaguagaccuuaugugccaugcaacuuuuacaaugagacuuuugucacccauccguguaccgaauuauaaucugauuauaauggacgaggcccauuucacugauccagcgucuauugccgcacgaggguauaucaguacucgaguagaaaugggagaagcugcagguauauucaugacggcaacuccucccggcucaagggacccauuuccccaaaguaaugccccaauuauggacgaggaaaaagaaauaccggaaaggaguuggaacucaggacacgagugggugacugauuucaaaggaaagaccguuugguuuguucccaguauuaaagcuggaaaugauauugcugcuugcuuaagaaagaauggcaagaaagucauucagcucucccguaaaacauucgacagcgaauauauaaaaacaagaaccaaugauugggacuuuguaguaacuacugacauuucagaaaugggagcgaauuucaaagcagagagagugauagacccaagaaggugcaugaagccaguaauucucacagauggggaagaacgaguuauucuggcagggccgaugccaguaacacauucaucagccgcccaaagaagagguagaguaggccgaaauccuaagaaugaaaaugaccaguacauauacaugggugaacccuuggaaaacgacgaggauugugcacauuggaaagaagcgaagaugcucuuagauaauaucaacacaccugaaggaauuauucccaguauguuugaacccgaacgcgaaaaaguagaugcaauagauggugaauauagacugcguggagaagcgagaaaaacauuuguggacuuaaugcgcagaggagaucuaccgguaugguuggcuuaucgcguggcagccgaagguauaaacuacgccgauagacggugguguuuugauggugucaaaaacaaccaaauucuagaggagaauguagaaguagaaaucuggacuaaagaaggagaaagaaagaaauuaaaaccuagauggcuggaugcucgaauuuacagugauccccuugcauuaaaggaauuuaaagaguucgcagcuggacgaaagucacugacucuaaaucuuauuacugaaaugggacgauugccaacauuuaugacucaaaaagccaaaaacgcacuagauaaucuagcgguguugcauacagcagaagcugggggcagagcauacaaucaugcgcucuccgaacugccggagaccuuagagacuuuauuacuguuaacucugcuugccacagucacugguggaauuuuccuauuucugaugagugguaaagguauuggaaaaaugacgcuugguaugugcuguauaauaacagcaaguauacugcuaugguaugcucagauacaaccccauuggauagcugcaaguauuauccuagaguucuuucuaauagugcuuuuaauacccgaacccgaaaagcaacgaacuccucaggacaaucaguugacauauguaguuauagcgauacuaacagugguagcagccacaauggccaacgagaugggauuuuuggagaaaacuaagaaagacuuuggauuagguaguauaaccacucaacaaccugaaagcaacauauuggauaucgaucuaagaccugcaagcgcuuggacauuguacgccgucgcaacaacauuuaucacaccgaugcuaaggcauucaauagaaaauagcucgguaaaugucaguuuaacagcaauagcuaaccaagcaacuguauuaaugggauuggguaaaggcuggccuuuaucuaaaauggacauugguguuccguugcuugccauuggguguuauucucaaguuaauccuauuacauuaacagcugcacugcuauuacuggucgcucauuacgcuauuauuggcccaggccuacaggcuaaagcgaccagagaagcacaaaaacgagcggccgcuggaauaaugaaaaauccaacaguugacggaaugacagugauagauuuagauccaauccccuacgaucccaaauucgaaaaacagcuagggcaggucauguuauuaguacuaugugugacucaaguccuaaugaugcgcaccacaugggcacucugugaagcacuaacgcuagccacagguccuauaucgacauuaugggaaggaaacccaggacgcuucuggaauacaacaauagcggugagcauggccaauaucuuucgaggaaguuaucuagccggugcuggucucuuguucucaauaaugaaaaacacagcaaauacacgaagagguacggguaauacuggagaaacuuugggagaaaaauggaaaaacagauuaaaugcgcucgguaaaucggaauuucaaauauauaagaaaucaggaauacaggaaguagauagaacucuugcgaaagaagguauaaagaggggagaaacagaucaucaugcaguaaguaggggauccgccaaguuacgcugguuuguagaaagaaaccuugucacgccggaagguaaaguuguugaccuaggauguggaagaggaggcuggaguuauuacugcggagggcuaaagaaugugaaagaagucaaaggauuaacuaaaggggguccuggacacgaagaaccaauuccaaugucaacauacggauggaauuuaguaaggcuacaaucaggaguggacgucuucuuuacuucgccggagaaaugcgauacuuuauuaugugauauuggagaaaguucaccaaauccaacaguagaggcuggucgaaccuugcgaguccuaaaccugguagagaauuggcucaauaauaacacacaauuuugcauuaaaguauugaauccuuauaugccaucuguaauagagaaaauggaagcccuacaaaggaaauacggaggagcacugguucggaacccgcuuucacguaauagcacacaugaaauguauuggguaucgaaugcaucuggcaauaucgucagcagugucaauaugauaucucggaugcuuauaaauagauucacaaugaggcauaagaaagcuacauaugaacccgacguagacuugggaucugguacuagaaacauaggcauagagagcgagacaccaaauuuagauauuauagggaaaaggaucgagaaaauaaaacaagagcacgaaacaaguuggcauuaugaucaagaccauccauauaaaacgugggccuaucaugguucauacgaaacgaaacaaacaggaucugcgucuagcaugguaaacggagucguuagauuacugacaaaaccaugggauguaauaccgauggugacucaaauggcuaugacugauacuacaccguucggacaacaacguguuuucaaggagaaaguugauaccagaacucaagagccuaaggaaggaaccaagaaacugaugaaaaucaccgcggaguggcuauggaaagaauugggcaaaaagaaaacucccagaauguguacaagggaagaauuuacacgcaaaguaagaaguaaugcagcacuaggugcuauauucacagaugaaaauaaauggaaaucggcuagagaggccguggaagauucagguuucugggaauuaguggacaaagagaggaaccuucauuuagaagggaaaugugaaacguguguauacaacaugaugggaaaaagagagaagaaacugggggaauuuggcaaggcaaaggguucaagggcaauaugguacaugugguugggugcucgcuuccuggaauuugaagcucuaggauucuuaaaugaagaccauugguuuucacgggagaauagccuaucugguguagaaggggaaggauugcauaaguuagguuauauacuuagggacguuagcaagaaagaaggcggagccauguaugccgaugacacggcuggcugggacacgcgaauuacauuggaggaccuuaaaaaugaagaaaugguaacgaaccauauggaaggcgaacacaagaaacuagcagaggcaaucuucaaacuuacguaccaaaauaaaguagucaggguacagagaccuacaccucggggaaccguaauggacaucauaagccguagggaucagagaggauccggacagguaguuacuuauggccuaaauacauuuacgaacauggaggcucaacucauuagacagauggagggagaaggaguuuuuaaauccauacaacaguuaacugugaaagaagagaucgcgguuaaaaacuggcucauucgaguuggucgagagaggcucucgcgaauggcgauaagcggagacgacugcguugucaaaccacuagaugacagauuugcaucagcacuaacggcuuuaaaugauaugggaaaaguccguaaagacauccagcaaugggagccgucuagaggauggaaugacuggacacaaguacccuuuugcucgcaucauuuucacgaguuaauuaugaaagauggcaggguucuagucgugccgugucgcaaucaagaugaauuaauagguagggcacgaaucagccaaggagccgguuggucuuuaagagaaacggcauguuuaggcaagucauacgcacaaauguggucacuuauguauuuucacagaagagauuuaagacuagcugcaaacgcaaucuguucugccgucccaucgcacuggauuccaacuuccagaacuaccuggucgauacaugcaacgcacgaauggaugacuacagaagauauguuaacaguauggaauagagucuggauacaagagaacccuuggauggaagauaaaacaccuguugaaucaugggaggaaauaccguauuuaggaaagcgcgaagaucaaugguguggaucccuaauuggucuuaccucgagagccacgugggcuaaaaacauucagacagcgauaaaucaagucaggucgcugauugguaacgaggaauauacagacuauaugccuagcaugaaacgauuucggagggaagaggaagaagcuggaguuuuaugguag

SEQ ID NO: 22216 - RNA, 9876 nt, Artificial Sequence
  derived and/or modified CDS sequence (opt6) from DENV-2__KX380814__SS-prME
acugcaggaauaauuauuaugaugaucccgacaguaauggcguuucacuuaacuacaaggaauggagaaccccacaugauuguaucaaggcaggaaaaagguaaaucucuacuuuuuaaaacugaaaaugguguaaacauguguacucuuauggcuauggaccugggagaacuuugcgaagacacaauaacauauaauugcccguuacuaaggcaaaacgaaccagaagauauagacugcugguguaacucaacaucuacuuggguaacauauggaacuuguacagcgacaggcgaacauagaagggagaaaagaagcguggcauugguaccucauguugguaugggccuagaaacccggacagaaaccuggaugaguucugaaggagcuuggaaacaugcgcaaagaauagaaacauggauacuaaggcacccaggcuuuacaauaauggcagcaauccucgcuuauaccauagggacaacauauuuucagagaguacucauauucauucuucucacggccgugacacccaguauggcuaugagauguauaggaaucagcaacagagacuuugucgaaggugugucugguggauccugggucgauauaguccuagaacaugguagcugcguaacgacuauggcuaaaaauaaacccacucuugacuuugaauugauaaaaacagaagcaaaacaucucgccacacugcgaaaauacugcguggaagcaaaacucacuaacaccacaacugcuagccguuguccaacacaaggagaaccaucuuuaaaugaagaacaagauaaacgauucguguguaaacauaguaugguugaucguggcuggggaaauggaugugggcucuuugguaaaggugggauaguuacuugugccauguucacuuguaagaaaaauauggagggaaaagucguacagccagaaaauuuagaauauaccauagucauaacaccucacucuggggaggaaaaugcaguaggaaaugauacuggcaaacaugggaaagaaauuaaaguaacgccccaaucaucaauaacagaggcggaacuuacaggcuacggaacaguaacaauggaauguagcccuaggacgggacucgauuuuaaugaaaugguuuuacuucaaauggaaaacaaagcaugguuaguccacagacaaugguuucuugaucuaccgcuaccaugguuaccaggagcugauacacaagguagcaacuggauacaaaaagaaacguuagucacauuuaaaaauccucaugcaaagaaacaggacguaguuguguuagguucacaagaaggagccaugcauacggcauuaacaggggcaacugaaauacaaaugaguagcggcaaccuacuauuuaccggccaucuuaaaugcaggcuuaggauggauaaauuacaacuuaaagguaugucauauaguaugugcacugggaaauucaaaguaguaaaagaaauugcagaaacucaacauggcacaauuguaauacgagugcaguacgaaggugacgguagcccaugcaaaaucccauucgaaaucauggaccuagagaaaagacacguauugggacgucuaauaacaguuaacccaauuguaacagaaaaagacucaccuguuaauauagaagcagaaccucccuuuggagacucauacauaaucaucgggguagaaccagggcaacuuaaacuuucaugguuuaagaaagguuccucuauaggacaaauguuugaaacgaccaugcgaggagcuaaacguauggcaaucuugggugacacugcaugggauuucggaucauugggagggguuuucaccucuauuggcaaggcguuacaccaaguauuuggagcaauuuauggagcugcauucucuggagugagcuggacuaugaaaaucuuaaucgguguagugauaacuuggauuggaaugaacucgagaucaacuucccucagcguaagucugguucuagucggagucguaacucuuuaccugggaguaaugguccaagcugacagcggaugcguaguguccuggaaaaauaaagaacuaaaaugcggaucgggaauuuuuaucacagacaauguacauacuuggaccgagcaauacaaguuucagccagaaucgcccucaaaacuugcaagugcaauccaaaaggcacaugaagaaggaauuugcggaauaagaaguguaacuagacuagaaaaccucauguggaagcaaauaacuccagaauuaaaccauauacucacggagaacgaagucaagcugacuauuaugacgggugauaucaaaggaauaaugcaagcagggaaacgaacacugcgaccucaaccuaccgaacugaaauauagcuggaaagcgugggggaaagcgaaaaugcuuagcaccgaacuacacaaucauacauuuuugauagauggcccagaaaccgccgaauguccgaacacuaaucgugcauggaacucccuagaaguggaagacuaugguuuuggaguguuuacgacaaacauuuggcugaaguuaaaggaaagacaagacguauucugcgauagcaaauuaaugagugcggcaauaaaggacaacagagcagugcaugcggacaugggauauuggaucgaaagugcauuaaacgacacuuggaaaauagaaaaagcguccuucaucgagguaaaaucuugucauuggccgaagagucauacuuuauggaguaacggagugcuugaaucagaaaugauaauaccaaagaacuucgcaggaccuguaucucagcacaacuaucgaccugguuaucauacgcaaacagccggaccguggcaccugggccgacuugaaauggauuuugauuuuugugaagguaccaccgugguuguuacugaagacugcgguaacagaggaccuucucuccguacaacaacugcuucgggaaaguuaauuacagaauggugcugcaggucuuguacuuuaccgccccugagauauagaggagaggacgggugcugguauggaauggaaauacggccucucaaagaaaaagaagaaaauuuaguaaauagcuuagucacggcgggacauggacaaauagauaacuuuuccuuaggaguuuugggaauggcuuuguucuuagaggaaauguugcgcacaagagucgguaccaaacacgcaauccuccuaguugcaguaucuuuuguaacacuaauaacaggaaacauguccuuccgagauuugggaagggucaugguuaugguaggggcuacuaugacggaugacauaggaauggggguaacauaccuagcgcuccuagcggcuuuuaaaauucgacccaccuuugccgccggucugcuauuacgaaaacucacaucaaaagaacuaaugaugaccacuauagguauaguacucuuaucacaaucaacaauacccgaaucgauauuggaauuaacugaugcauuagcuuuggggaugaugguacugaaaauuguuagaaacauggaaaaauaccaacucgcuguuacaauuauggcgauuuuaugugugccgaaugcuguaauuuuacaaaaugcauggaaaguaucauguacuaccuuggcuguaguaucaguaucaccgcuguuguuaacaucaucucaacaaaaagcagauuggaucccuuuagcccuaacgauaaaaggacuuaauccaacagcuauauucuuaacaacucuaagcagaacaaguaagaaaagaaguuggccgcuuaacgaagcuauaauggcgguaggaaugguuucaauauuggcuucuucccugcugaaaaaugauauacccaugacggguccacuggucgcugggggauuacuaacgguuuguuauguacuuaccggaaggucugcagaucuagaacuugaacgugcugccgauguuagaugggaagaacaagcagaaauaagcggaucaucaccgauauugaguaucacaauaucggaagauggaaguaugucaaucaaaaacgaagaggaagaacagacucugacuauauugauucgaacaggauuacucgugauaaguggacucuuucccguuaguauaccgauuacugcagccgcuugguacuugugggaagucaagaaacagagagcaggaguucuaugggacguuccgaguccaccgcccguugguaaagcggagcuagaggauggcgcauacaggauuaaacaaaaaggaauauuaggauacagucaaauaggugcagggguuuauaaggaagggacauuucauaccauguggcaugugaccagaggagcagugcuaaugcauaagggaaaacgaauagaaccuaguugggcugacgucaagaaagacuuaauaucauacggagggggcuggaaacuagaaggugaauggaaagaaggggaagaaguacaaguccuugccuuagaaccaggaaagaauccaagggcagugcaaaccaaaccagggcuguucaaaacaaauacagggacaaucggggcuguuucucuggauuucagcccggguacaaguggaucacccauaguggacaagaaaggaaaagucgugggauuauacgguaauggugugguaacucgaucaggaacauacguauccgccauugcucagacagaaaagucgaucgaggauaacccagaaauagaagaugauauuuucaggaagaaacggcugacaauuauggauuuacaucccggggcggggaaaacaaagcguuaccugccagcuauaguaagggaagcgauuaaacgaggauuacgcacccuaauuuuggcuccaacccgaguaguugccgcugagauggaagaggcacugaggggccuaccgauaagauaucaaacaccggcuauacgugcagagcauacgggaagggagauuguugauuugaugugucaugcuaccuuuacuaugagacugcuuucaccaauacgagucccgaauuacaaucuaauaauaauggaugaagcacauuuuacagacccagcaagcauagcggccagaggcuauaucucaaccaggguagaaaugggagaagcggcaggaauauuuaugacggcuacaccgccaggaagucgcgaccccuuuccacaaucuaaugcucccauuauggacgaagagaaagagauuccugagcgaucauggaacucaggacaugaauggguaacugacuuuaaaggaaaaacagucugguuuguuccaaguauuaaagcaggaaaugauauugcagcaugucuacguaagaacggcaagaaagucauucaacuauccagaaaaaccuuugacagugaauauauaaaaacgcgcacaaacgauugggacuuuguagugacaacugauauaucagaaaugggagcaaacuuuaaagcugagagagugauugaucccaggagauguaugaaaccagugauauuaacagacggugaagaacgaguaauauuggcaggaccaaugccagucacucauucaucagcggcucaaaggagaggaaggguuggcaggaauccuaaaaaugaaaacgaucaauauauuuauaugggggaaccgcuugaaaaugaugaagacugugcacauuggaaagaagcaaaaaugcucuuggacaauauaaacacuccugaagggauaauccccucuauguuugaaccagaacgagaaaaaguugaugcaauagauggagaauaucgucugcgaggagaagccagaaaaaccuucgucgacuuaaugagacguggagauuuaccuguauggcuugcuuauagaguagcggcggaaggaauaaauuaugcugaucguagaugguguuuugacgguguuaaaaauaaccaaauacuagaagagaacguagaaguugagauuuggacaaaggaaggagaaagaaagaaauuaaagccacgaugguuagaugcgcgcauauacagugauccacuugcucuuaaggaauuuaaggaguucgcagcggggagaaagagucuaacgcugaaucucauuacagaaauggguagguugccgacguucaugacgcaaaaggccaaaaaugcccuagauaaucuagcgguucuacauacagcggaagcugguggcagagccuauaaucaugcucuaagugaacuucccgaaacguuagagacuuuacuguuauugaccuuacuugcaacagugaccggagguauuuucuuauucuuaaugaguggcaaaggcaucggaaaaaugacguuaggaauguguugcaucauuaccgcaucgaucuugcugugguaugcucaaauacagccucacuggauagcagcaucuauaauauuggaguucuuucuaauaguacuuuuaauaccggaaccagaaaaacaaagaacaccacaggauaaccaauuaacuuacguaguaauagcgauauuaaccgugguagcagcaaccauggcaaacgaaaugggauuucuagagaaaaccaaaaaggauuucggacucgggucuauaacgacccaacaaccggaaaguaacauauuagacauagauuuaaggccagcaucggcauggacuuuauaugcgguugcaacaacauucauuacaccgaugcuuagacauaguauugaaaauucuucgguuaacguuagcuuaacagccauagcgaaccaagccacaguacuuauggggcucgguaaaggauggccgcuaucgaagauggacauaggagucccucuauuagcaauaggaugcuacucccaagucaacccaauuacccuaacugcugcacuacugcucuuaguggcucauuaugcuauaauaggaccgggacuucaggcaaaggcuacaagagaagcacagaaaagagcugcggcaggaauaaugaaaaacccgaccgucgacgggaugacaguaauugaccuugacccgauaccuuacgacccuaaauucgagaaacaauugggacaaguaauguuauuaguauugugcgugacucaagucuuaaugaugagaacaacuugggcauuaugugaagcauuaacuuuggcgacggguccaaucaguacguuaugggaagggaauccagguagauucuggaauacaacaauugcgguaaguauggcgaacauuuuuagagguuccuaucuagcaggagcgggcuuguuguuuagcauaaugaaaaauacugcaaacacacgacguggcacgggcaacacgggcgaaacauugggugaaaaauggaaaaauaggcuaaacgcccuugguaaaucagaauuucaaauauacaagaaaucugguauucaagagguggauagaacacuggccaaggaagggaucaaaagaggggaaacugaccaccacgcagucaguaggggaucagcuaagcuaaggugguucguagaaagaaaucuggucacaccagaagguaagguaguggaucuugggugcggucgcggcgguuggaguuauuauuguggaggucuuaaaaauguaaaagaagucaaaggacuaacgaaaggugggccaggucaugaagaaccuauuccgaugaguacauaugguuggaauuuagugcguuugcagaguggaguagaugucuuuuucaccagcccagaaaaaugugauacacuauuaugugacauaggggaaucuucaccgaaccccacuguagaagccggacggacuuuaagaguauuaaacuuaguagaaaauuggcuuaacaauaacacacaauuuuguauaaaaguccuaaauccauacaugccaucgguaauagagaaaauggaggcacuucaaagaaaauauggaggggcguuagucagaaauccgcuaucccgaaacuccacacaugaaauguacuggguaucaaacgccagugguaauaucgugucauccguuaacaugaucucccggaugcucaucaacagguuuaccaugcgacauaagaaagcgacauacgaaccugauguagauuugggcagcggaacccguaauauuggaaucgaaucugaaacuccgaaccuggacaucauagggaaacguauugagaaaaucaagcaagaacaugaaacuuccuggcacuacgaucaagaccauccauacaaaaccugggccuaccauggaagcuaugagaccaaacaaaccggaucagcaucuaguauggugaacggaguugucagauuauuaacaaaacccugggaugugauuccaaugguaacucaaauggcaaugacagauacaacacccuucggucaacaacgcgucuucaaagagaaaguugauacccgaacacaagaaccaaaagagggaaccaagaaauuaaugaaaaucacagccgaguggcuauggaaagaauuaggaaagaagaaaaccccaagaaugugcacucgagaagaauuuacaaggaaaguacgaucgaaugcugcauugggagcaaucuucacagaugagaauaaguggaagagugcgagagaagcgguagaggauucaggauucugggaauuaguugacaaagagcggaaucuacacuuagaggguaaaugcgaaacauguguguacaacaugauggggaaaagagaaaagaaauuaggugaauuuggcaaggcaaaaggcucgagggcuaucugguacaugugguuaggcgcacgauuucuugaguucgaagcacuagguuuccuuaaugaagaccacugguucucgagagagaauagccuuucuggagucgagggagaaggauugcauaagcuaggcuauauacugcgugaugugaguaagaaagaagguggagcuauguacgccgaugauacagccgggugggauacacgaauaacucuggaagaucuuaaaaacgaggaaaugguaaccaaucacauggaaggagaacauaagaaacuugccgaagccauauuuaaauuaacauaucaaaacaaaguuguaagaguacaaaggcccacaccuaggggcacagucauggacauuauaucgagaagggaccaaagggguucagggcaagucguaacauacgguuuaaacacauuuacgaacauggaagcccaacuuauaagacaaauggaaggcgagggaguauucaagucuauacaacaacuaaccguuaaagaggaaaucgcugugaaaaacuggcucauacgaguaggacgagaaaggcuaucuagaauggcuaucucaggggaugauugcguuguuaagccccuugacgacagguucgcaucagcccuaacggcauuaaaugacauggguaaaguaagaaaagacauccaacagugggaaccaucacggggcuggaacgauuggacucaggucccuuuuuguagucaccauuuccaugaauuaauaaugaaagauggaagaguacuggugguaccuugcagaaaucaggaugaauuaaucggcagagcgaggaucucgcaaggagcgggcuggaguuugcgagaaacugcguguuuagguaaaaguuacgcacaaauguggucauuaauguauuuucauagacgagaccuaaggcuagcagcuaacgcuauaugcagugccguaccuucucauuggauucccaccucgcggacgacguggucgauacacgcuacgcaugaguggaugacgacggaagacauguugacgguauggaaucgaguauggauucaggaaaacccauggauggaggauaaaacgccaguagagucgugggaagagauaccuuaccuagguaaacgggaagaccaguggugcgggagucucauuggauugacuucacgggcaacaugggccaaaaauauucagacagcuauaaaucaaguuaggucauuaaucggaaaugaagaauauacagacuacaugccaaguaugaaacgauucaggcgagaagaggaggaggccgggguauuaugguaa

SEQ ID NO: 22217 - RNA, 9876 nt, Artificial Sequence
  derived and/or modified CDS sequence (opt6) from DENV-2__KX380807__SS-prME
acagcaggaauuauuaucaugaugauuccaacaguuauggcuuuucaccuaacaacccgaaacggagaaccacauaugauaguaagccgccaagaaaaaggaaaaagucuauuguuuaaaacagaaaauggagugaacaugugcacuuuaauggcuauggacuuaggagaacuuugugaagacacaauaaccuauaauuguccauuguuaaggcaaaaugaaccagaagacaucgauugcugguguaacagcacaaguacauggguaacauaugguacauguacagcaacuggcgagcaccgaagagagaaaaggaguguagcguuagcaccccauguagguauggguuuagaaacuaggacagaaacguggaugaguucagaaggugcauggaaacaugcacaacgaauugaaauuuggguauuaagacauccaggcuuuacuauaauggcagcgaucuuagcguauacaaucggaacaacguauuuucaaagaguacuaauauuuauuuuacuaacagcgguagcaccaagcaugacuaugcgguguaucgggauaagcaauagagauuucguugaagggguuucagggggaagcuggguggauauaguguuggagcacggcagcuguguaacuacgauggcuaaaaauaaaccaacguuagacuucgaauuaauaaaaaccgaagccaaacaccccgcaacucuaagaaaauauugcauagaagcuaaauuaacaaauacaacaaccgcauccaggugcccaacacaaggcgaaccaagccuaaacgaggaacaagauaaaagauuuguauguaaacacagcaugguugaucgcggauggggcaauggguguggucuuuuuggaaaaggaggaauuguaacgugcgcgauguuuacauguaaaaagaauauggaaggaaaaaucgugcagccugaaaacuuagaauauaccauuguaauuacgccucauucaggagaagagaacgcgguagguaaugauacgggaaaacacggcaaagaaauaaaaguaaccccacaaaguagcauuaccgaggccgaauugacaggauauggcaccguaacaauggaauguucaccuagaacaggguuggauuuuaacgagaugguacuucuacaaauggaaaauaaagccugguuaguucauagacaaugguuccuugaucugccucuaccuugguuaccgggagcagacacgcaagguagcaauuggauacagaaagagacguuaguaaccuuuaaaaauccucaugcuaagaaacaagauguaguaguacucggaucucaagaaggagcaaugcauacggcucucacaggagcaacugaaauacagaugucaucaggcaaucuuuuguucaccggucauuuaaaauguagacuacgaauggauaaacugcaguuaaaagguaugucauacucaauguguacaggaaaauuuaaagugguuaaagaaaucgcugaaacucagcauggcaccauuguaauuaggguucaguaugaaggugaugggagcccuugcaagauuccguuugagauaauggauuuagaaaagaggcacguacuagggaggcuaaucacgguaaaccccauugucaccgaaaaggacucuccaguaaacauugaggcugagccaccuuuuggugauucauauauuauaauugguguugaaccaggccaauuaaaauugagcugguuuaagaaggguucaagcauaggacaaauguuugaaacuacaaugagaggggccaaaaggauggcaauacugggagacacagcaugggacuuuggcagcuuaggaggggucuucaccaguauaggcaaggcacuacaucagguauucggagcaauauauggggcugcauuuuccggagugucauggaccaugaagauccuaauaggagugguuauuacauggauagguaugaauagcagaucaaccagucuaucagucucguuaguuuuaguuggaguuguaacguuguaccuuggaguuaugguacaagcugauucgggaugcguagucucuuggaaaaacaaagaacuaaaaugugggaguggcauauuuauuaccgacaauguacauacuuggacggaacaauacaaauuucaacccgagucgcccucaaaauuagcgucagccauacaaaaagcacaugaagaaggaauuuguggaauacggucggugacaaggcuugagaaucuuauguggaagcaaauaacaccagaauuaaaccauaucuugucagagaaugagguuaaacuaacaaucaugaccggagauauaaaagggauaaugcaagccgggaagcgcagcuugcguccacagccaacagaguuaaaguacucauggaaggcgugggggaaagcaaaaaugcuaaguacagaguuacauaaucauacauucuugauagacggaccagagacagccgaguguccaaauacaaauagggcuuggaacuccuuagaagucgaagauuauggauuuggcguauuuacaacgaacauaugguuaaaacuaaaagagaggcaagaugucuuuugugauucuaaacuaaugagugcugcaauuaaagauaauagagcuguccaugcggacaugggauauuggauagagucggcguuaaaugauacauggaaaauagaaaaggcuucguucauugagguuaaaaguugucauuggccaaaaucacauacuuuauggaguaacgguguucucgaaucagaaaugauaauucccaaaaauuuugcuggcccuguuagucaacacaacuauagaccuggauaucacacccaaacugcagguccauggcaccuaggaagacuugagauggauuuugauuuuugugagggcacaacaguaguagugacugaagauugcggcaacagagggccaucguugagaacaacuacugcaagcgguaaacuuauuacugaaugguguugucgaucuugcaccuuaccgcccuugagguauagaggugaagauggaugcugguauggaauggagauuagaccccuaaaggaaaaggaagaaaacuuaguuaacagcuuaguaaccgcuggacauggacaaaucgauaauuuuaguuuagguguccuaggaauggcacucuuccuggaggagaugcuaagaacuaggguaggaaccaaacaugcaauccuguugguagcagucaguuuuguuacccuaauaacagguaacaugucuuuucgagauuuagguaggguuauggucaugguaggugccacuaugacagauaauauugggaugggaguuaccuauuuagcucuguuagcggcauuuaaaguuagaccuaccuucgcugcaggauuauuguuacgaaaacuaacuagcaaagaacugaugaugacgacgauuggaauuguauuauuaagccagucuacuauaccagaaacgauuuuggaauuaacagaugcucuggcguuagggaugaugguauuaaagaucguaagaaauauggaaaaauaucaguuggcuguaacgaucauggccauauuaugugucccaaaugcaguaauuuuacaaaaugcuuggaaaguuuccugcacuauucuagcaguuguuaguguaucuccuuugcuuuuaaccaguucacaacaaaaagcggauuggauuccacuugcucugacuauaaaaggauugaacccaacugcaauauucuuaacuaccuuaucaagaacgaguaaaaagagaaguuggccacuuaaugaagcaauuauggcagucgguauggucucgauauuagcaucuucacuacucaaaaacgacauaccgaugacugggccuuuagucgcaggagggcucuugacgguauguuauguacuaacagggagauccgcugaccucgaauuagagagagcagcagacguucgaugggaagaacaagcagaaauaucgggcuccucaccaauccuauccauaaccauaagcgaagaugggaguaugucgauaaagaacgaagaagaagaacaaacucuuacaauauugauuagaaccggacuacuggucauaaguggcuuguucccgguaucaauaccaaucacugccgcagcgugguaccuaugggaggucaagaaacagagggcagggguuuugugggauguaccaagcccuccacccguaggcaaggccgaauuagaagauggagcuuaccguaucaagcaaaaaggaauuuuagguuauagccagauaggagcgggggucuauaaagaaggcacauuccauacuauguggcacguaaccagaggggcuguacugaugcauaaagguaaacgaaucgaaccaaguugggcugacgucaagaaagaucuaauaucauacggagggggcuggaagcucgagggugaauggaaagaaggagaagagguucagguauuggcacuagaaccagguaaaaauccuagagcuguacaaaccaagccggguuuauucaaaaccaacacgggaaccauaggggccguaucacucgacuuuagucccgguacaucugggucccccaucguggauaagaaagguaaagugguaggccuguacggaaauggaguuguaacaagguccggcaccuacguaucugcgauagcucaaaccgagaaaucuauugaagauaaccccgaaauugaggacgauauauucagaaagaaacguuugacaauaauggacuuacacccaggugccggaaagacaaaaagauaccuaccagcaauaguacgagaggcaauaaaaagagggcuaaggacguugauccucgcucccacuaggguagucgcagccgagauggaggaagcacugcggggacucccuauacgcuaccaaacuccagcaauaagggccgaacacacagggagggaaaucguugacuuaaugugucaugcaacauuuacaaugagacuuuuaucaccuauuagaguacccaauuauaauuuaaucauaauggacgaagcucauuuuaccgauccagcaucgauagcagcacgaggauacauuaguacaagaguggaaaugggcgaagcugccggcauuuuuaugaccgcgacgccgcccgggucuagagacccguuuccacaaaguaacgccccaauaauggacgaagaacgcgaaauccccgagaggucauggaacucaggucaugaaugggugaccgacuucaaaggaaagacggucugguuuguacccucuauuaaggccggaaaugauaucgcggcauguuuacgcaagaacggaaagaaaguuauacaguuaaguagaaaaacuuuugauagcgaauauaucaaaacuaggacaaacgauugggacuuuguagugacaacagauauaagcgagaugggagccaauuuuaaagcagaaagaguaauugaccccagaagguguaugaaaccgguuauccuaacugacggcgaagaaaggguaauccuagccgguccgaugccaguaacucacuccagugcagcacaaaggcgagguagaguaggacgcaauccuaaaaaugagaaugaucaauacaucuauaugggcgaaccacuugaaaacgacgaagauugcgcacauuggaaggaagcaaaaaugcuacuagacaauauuaauacuccugagggcauaaucccuagcauguuugaaccggaacgcgaaaaaguagaugcagucgacggagaguaccgauuacggggagaagcucguaaaacauuugucgacuuaaugaggcgaggagacuuaccggucugguuggcauacaaaguagcugcagagggaauaaacuacgccgaucggagaugguguuucgacggagucaaaaauaaccaaauucuagaagaaaacguugaaguugaaauauggacuaaggaaggugaacgaaagaaguugaaaccacgaugguuagaugcccgaaucuauucagauccauuagcucuaaaagaauuuaaagaguucgcagcaggaagaaaaagucuaacucucaaccuuaucacagaaaugggucgacuaccaacuuucaugacacaaaaagcaagaaaugcuuuagauaaucucgcagucuuacacacagcagaagcugggggacgugcauauaaucacgcucuaagugaguugccggaaaccuuagagacucucuuguuacucacuuuacucgcuacuguaaccgguggaauauuucuuuuucuaaugucgggcaaaggcaucggcaaaaugacuuuagggaugugcugcauuauaacggccagcauauuacugugguacgcacaaauucaaccucauuggaucgcagcuagcauuauucuagaauuuuuccuuaucguucuacuuauaccugagccugaaaaacagcgaacaccccaggacaaucaauuaacauacguagucauagcaaucuugacgguuguggcagcuacuauggcgaaugagaugggguuuuuagagaagacuaagaaagauuuugguuuagggaguaucacaacacaacaaccugagucaaauauacucgauauagaucuucgcccagcgucggccuggacuuuauaugccguugcaacgaccuuuauaaccccaauguuaagacacucuauagaaaacaguucuguuaacguaaguuuaacggcgauugcuaaucaagcaacuguccuuauggggcuagguaagggguggccuuuaucaaaaauggacauuggcgugccauuauuagccaucgggugcuauucacaggucaauccaauaaccuuaaccgcggcgcuuuuguuguuaguagcgcacuaugcuauaauagguccgggacuucaggcuaaagcuacucgugaagcucaaaaacguacagccgccggaauaaugaaaauuccugcggcacucauaguuacgguuauagauuuggaccccauaccauaugauccgaaauucgaaaaacaacucggacaagucaugcuguuggucuuguguaguacgcaaguucucaugaugagaacaacgugggcucucugugaagcccuuacacucgcaacagggccuaucucuacacuuugggaaggaaacccaggaagauuuuggaauacuacaauagcagucuccauggcaaauauuuuucgagggucauaucucgccggggcuggucuacuauuuucaauuaugaaaaacacagcaaacacuagaagggggaccggaaauaccggagaaaccuuaggcgagaaauggaagaauaggcuaaacgcucuagggaaaucagaauuucaaauauauaaaaagaguggaauacaggaaguugauaggacacuggcuaaagaagggauaaaaagaggagaaacagaucaccacgcgguaaguaggggaucggcuaaguuacguugguuuguagaacguaaccuaguaacgccggaagggaaagugguggaccucggaugcggacgagggggcugguccuacuacugcgggggacucaaaaacguaaaagaaguaaagggauugacgaaaggcggaccaggccaugaagaacccaucccuaugucaacuuaugguuggaacuuaguuagauuacaaucagguguagaugucuucuuuacaccgcccgagaaaugugacacacucuuaugugauauaggugaaagcaguccuaacccaaccguagaagcaggccgcacauuaagaguacuaacgcuaguugagaauugguugaauaauaauacacaguuuugcauaaagguauugaauccauacaugccauccguuaucgagaaaauggaggcacuccagaggaaauacggaggagcauuggucagaaauccccuuucuagaaauucgacccaugaaauguauuggguaagcaacgcaucaggaaacauaguuuccagcgugaacaugauuucacgaauguuaaucaaucguuuuacaaugagacauaagaaagcuacuuaugaaccagauguugaucuaggaucugggacgcgaaauauaggcaucgaguccgaaacaccaaauuuagauauaaucggcaaacgaauagaaaagauaaagcaagaacaugaaacaagcuggcauuaugaucaggaucacccguacaagacuugggcuuaucacgguaguuaugagaccaaacaaaccggcuccgcuucuucgaugguaaacggaguaguaaggcuacugacaaagccaugggacguaauuccaauggugacacaaauggcgaugacugauacaacuccguucggacaacaacgagucuuuaaagaaaaaguugacacgagaacacaggaaccuaaagaaggcaccaaaaagcuaaugaaaauuacagcggaauggcuuuggaaagaauuagggaagaagaaaacaccaagaauguguaccagagaagaguucacgagaaaagucaggucaaaugcggcguuaggagcaauauucaccgaugaaaauaaguggaaaagcgcaagagaagcaguagaggacaguggauuuugggagcuaguggauaaggagaggaaucuacaucuggaagggaagugugaaacauguguauauaauaugaugggaaaacgagaaaagaaauuaggcgaauuugggaaagcaaaagguaguagagcgauaugguacauguggcuuggugcgagauuccucgaguuugaggcuuuaggauuucuaaaugaagaccacugguucucgcgugaaaauagccucucaggaguggaaggugaagggcuucacaaauuggguuauauacuucgcgauguaucaaagaaagaagguggggcuauguacgcagaugauaccgcaggaugggacacuaggauaacucucgaggaucugaaaaaugaggagaugguaacgaaccacauggagggagaacacaagaaauuagcagaggcaauauuuaaauugacauaccaaaauaagguuguaagaguucagcgcccaaccccuaggggaacuguuauggauauuauuucacgacgcgaucagaggggaagcggacaaguggucacguauggauugaauacuuucacgaacauggaagcacaguuaauacggcaaauggagggcgaaggcguguucaaaaguauucaacaacugacugcaacagaggaaaucgcagugaaaaauugguuaguacgaguuggaagagaaagacugucaaggauggcaauuagcggugaugacugugucguaaagccccuagacgauagguucgcuucggccuuaacggcucuaaaugacaugggaaaggugcguaaagauauucagcagugggaacccucgcgagguuggaaugacuggacucaaguacccuuuugcagucaucacuuucacgaauuaauuaugaaggacggucgaguucuugugguaccaugcagaaaucaggacgaacuaauugguagagcucgcaucucccaaggagcagguuggagucuccgagagaccgccugccuaggcaaaaguuaugcacaaauguggagcuuaauguauuuucacagacgagaucuacgauuagcagccaacgcuaucugcucagcggucccaucgcacugggucccaacaucuagaaccaccuggucaauacaugccacacaugaauggaugacgaccgaagauauguuaaccguuuggaaucguguuuggauacaagaaaauccauggauggaggacaagacacccguagaaagcugggaggaaauaccguaccucggaaaaagggaggaucaauggugcggaucccucauugggcucaccucaagagcuacaugggccaaaaauauccagacagcgauaaaucaaguuagaagucuaauaggaaacgaagaauauacugacuauaugccauccaugaagcgguuucgacgagaagaagaagaagcggguguccucugguag

SEQ ID NO: 22218 - RNA, 9876 nt, Artificial Sequence
  derived and/or modified CDS sequence (opt6) from DENV-2__KX380815__SS-prME
acagcaggaauaauuaucaugaugauuccgacaguuauggcuuuucaucuaacuacgagaaacggagaaccgcacaugaucguaaguagacaagaaaaaggaaaaagucuauuauucaaaaccgaaaauggaguaaacauguguacauuaauggcaauggacuuaggagaacuaugugaagauacuauaacauauaauugcccgcuuuugagacaaaaugaaccggaagacaucgauugcugguguaauucaacaucaacaugggucaccuacgggacaugcacggcuaccggugaacaccgacgagaaaaacguagcguagcgcuugucccacacgucggaaugggacuugaaacuagaacggaaacguggaugaguagugaaggagcuuggaaacaugcgcagagaauagaaaccuggguauuacgccauccuggauuuacaauuauggcggcgauauuagcuuacacaauaggaacgacauauuuccaacguguacugauuuuuauauuauugacggcuguagcacccagcaugacaaugagauguauagggauaucaaacagggauuuuguagaaggaguuaguggaggauccugggucgacaucguacuagaacaugguucauguguaaccacaauggccaaaaauaaacccacccuugauuuugaacuaauaaaaacagaagcuaaacauccagcgacacuuagaaaauauuguaucgaagcaaaacugacgaauacaacuacggcgucacgcugcccaacccagggugaaccaucauuaaacgaagaacaagacaaacguuucguauguaaacacagcaugguugaucgaggauggggaaauggauguggucuuuuugguaaaggugguauaguuacuugugccauguuuaccuguaagaaaaacauggaaggcaaaauaguacagccagaaaacuuagaauauacaauuguaaucacaccccacaguggugaagaaaaugcugugggcaacgauacuggcaaacacgguaaagaaauaaaaguuacaccacaauccagcauaacugaagcagaacuuacuggauacgguacuguuacaauggaauguucuccaagaacaggcuuagauuuuaaugaaaugguauuacugcaaauggaaaauaaagccugguugguccaccgccaaugguuucuagaucuaccgcuaccaugguuaccuggggccgauacucaaggaagcaauuggauacaaaaagaaaccuugguaaccuuuaaaaauccgcaugcgaagaaacaagacguuguaguuuuagguucacaagagggagccaugcauacugcacugacaggugcaacugagauucagauguccagugguaacuuacuauuuaccggacaucuuaaaugucgccugcgaauggauaaacuacagcuuaaaggaauguccuacucgauguguaccggaaaauuuaaaguggugaaagaaauugccgaaacccaacauggcacgauugucauacggguucaauaugaaggagacgggucucccugcaaaauaccguuugaaauuauggaucuugaaaaacgccacguuuuaggcagacuaauuacuguuaacccuauuguaacugaaaaagacaguccgguaaauauagaagcggaaccuccuuuuggcgauaguuauauaauaauuggaguugaacccggacaacuuaaacuaagcugguuuaagaaagguucaucgauuggccaaauguucgagacaacaaugaggggagcgaaaagaauggcuaucuuaggagacaccgcgugggacuucgggucucuaggagggguauuuacaaguauagggaaagcauuacaucaggucuuuggagcuauauauggagcagcuuucagcggaguaaguuggacuaugaaaaucuuaauaggggucguaauaacguggauaggaaugaauagucgaucuacgucacuaucaguaucgcucguccuaguaggaguugucaccuuauauuuagguguuaugguacaagcggacagugguuguguuguaucguggaaaaacaaagagcucaaauguggcucuggcauauucaucacggauaauguucacacauggacagaacaguacaaauuucaaccggaaucaccgucaaaacuugcgagugcgauucaaaaagcccacgaagaagggauaugugguaucagauccgugacuagauuagaaaacuuaauguggaaacagauaacaccggaguuaaaccacauacuaacggaaaaugagguaaaacuaacaaucaugacaggggacauaaaagguauaaugcaagccgggaaaaggucccuucgaccucagccaacagaauuaaaauauucauggaaggcuuggggcaaagccaaaauguugagcacagaacuccauaaccacacuuucuuaauugaugggccggaaacggcagaauguccuaacacuaaucgugcauggaacuccuuagaagucgaagacuacgguuucgguguuuucacuacaaauauuuggcucaaacucaaagaaagacaggauguuuccugugauucaaaacuaaugucggcagcaauuaaagauaaucgcgcaguccacgcggauaugggguauuggauagaaucagcguuaaacgacacauggaaaauugaaaaagcaucauuuaucgaagucaaaucaugucacuggccgaaaagucauacacucuggaguaauggggucuuagagagugagaugaucauaccuaaaaauuuugcaggaccaguaagucaacacaacuaucgacccggguaccacacgcagacugcaggaccauggcauuuagggcgacucgaaauggacuuugauuuuugugaaggaacuacagucgugguaacugaagacugcggaaaucgugggccaucuuugagaacaacaaccgcaucagggaaacugauaaccgaaugguguugucgcaguuguacccugccaccccuuagauacaggggagaggacggaugcugguaugguauggagauuagacccuuaaaagagaaagaagaaaaucuagucaacagccuugucacagccggacacggacaaauugacaauuucagucugggaguauugggcauggcguuauuuuuggaagagaugcuuaggacaagaguuggaacaaagcacgccauucugcuuguggccgucucuuucguuacacucauaacugguaauaugaguuuucgugacuuaggacgaguuauggugauggugggagcgacuaugacugacgauauagguaugggagugacuuaccuugcccuacuagcugcauuuaaaguacgaccuaccuucgcagcuggacugcuacuccguaagcuaacuucuaaagaguuaaugaugacaaccauuggaauaguguuauuaucgcaaucaacaauuccagagacuauccuagaacuuacagaugcauuggcuuuagggaugaugguguuaaaaauuguaagaaacauggaaaaguaccaauuagcagucacaaucauggcuauauuauguguuccuaaugccgucauauugcaaaacgcauggaagguuucuuguacaacuuuagcaguaguaagcguuuccccacuauuacuuacauccucacaacagaaaacggacuggauuccgcuggcguugacuauaaagggccucaaccccaccgcaauauucuuaacuacucuauccagaacuucgaagaaaagaucguggccacugaaugaggcuauuauggcagugggaaugguuagcauuuuagcgucuucauuuuugaagaacgacauaccaaugacaggucccuuaguggcgggaggacuacuuaccguauguuacguucuaacagggagguccgcagaccuagaacuggaacgggcugcugacauaagaugggaagaacaggcugaaauaaguggaucaucccccauacucucuauaacaauaucugaggaugggucaaugaguaucaaaaaugaagaagaagaacaaacucugacaauacuuauuagaacggggcuccuggugauaucgggccuauucccgguaucuauucccauaacggcggcggccugguauuuaugggaaguaaagaaacaaagggcuggaguuuuaugggacgucccaagucccccaccaguggguaaagcagaguuagaggauggggcguauaggaucaaacaaaaaggcauacucggauauagccaaauaggagcaggcgucuauaaggaaggcacuuuccauacgauguggcacgucacucguggggcuguucuuaugcauaaggguaagcgcauagagccuucaugggcugacguuaagaaagacuuaauauccuauggggguggcuggaaauuagaaggugaauggaaagaaggagaagagguccaaguacuugcacuagaacccggcaaaaacccaagggcgguucaaacuaaaccuggauuguuuaaaacuaauacaggcacaauuggcgcuguaucgcuggauuucaguccuggcacaaguggcaguccaauuguugauaagaagggaaaaguaguuggcuuauacgguaaugggguagucacaagaucuggaacguacguauccgcaaucgcucaaacggagaaaaauaucgaagauaauccggaaauugaagacgacauuuucaggaagaaacgacuaacaauaauggaucugcacccgggcgcggguaaaaccaagagauaucuucccgcuaucguuagagaggccauaaaacgugguuugagaacauuaauacuugcaccaacacgugugguugcagcagaaauggaagaggcuuugcgugggcuuccuauucguuaccaaaccccugcgauaagggcugaacacacaggacgagaaauaguagaccucaugugccaugcaacauuuaccaugcgacuucuaagcccaauaagaguuccgaauuacaaucuuauaauuauggacgaagcucauuucacagauccagcuaguauugcagcacgagguuacauuucaacacgaguagaaaugggagaggcagcggguauuuuuaugacagcaaccccaccaggaucgcgggacccauuuccucaaucuaacgccccaaucauggacgaagaacgggagauaccugagagaucauggaacaguggacaugaauggguuacagauuucaaaggaaaaacuguuugguuugucccgucaauaaaggcagguaacgacaucgcugcaugucuaaggaaaaauggcaagaaaguaauacaacugucuagaaaaacauuugacucagaauacguaaaaacacgaacaaacgauugggacuuuguagugacaacugacaucucagagaugggagcaaauuuuaaagccgaacguguaauagacccaagaagauguaugaaaccgguaauccuuacagauggggaagaacgugucauauuagcaggcccuaugccagugacgcauucaagugcggcucaacgacgagguaggguaggcagaaacccuaaaaacgaaaaugaucaguauauauauaugggagaaccacucgaaaacgaugaagacugugcucacuggaaagaagcaaaaaugcuucuagauaauauuaacacgcccgaagggauaauuccaucaauguuugaacccgaaagggaaaaaguugaugcaauagauggcgaguauagacuucguggcgaagcacgcaaaacauuuguagaccucaugcguagaggugaucuacccgugugguuggcauauaggguugccgcagaagggauaaauuaugcugacagaagauggugcuuugauggugucaagaacaaccaaaucuuagaagaaaacguagaagucgagaucuggacgaaagaaggugaaaggaagaaacuaaaaccgcgcugguuagacgcacgaauauauucggauccucuugccuugaaagaauuuaaagaguucgcugccggcaggaaaucauugacuuuaaacuugauuacugaaaugggacggcugcccacauuuaugacccagaaagcgcguaaugcuuuggauaauuuagcgguuuugcauaccgcagaagccggcggucgcgcuuacaaucaugcucuuagcgaauugccggaaacacuagaaacucuccuacuauuaacucuauuagcgacgguuacugguggaaucuuccuauuucugaugucagguaaggguauaggaaagaugacacuuggcauguguugcauaguaacugcaaguauauuacuaugguaugcacaaauacagccccacuggauagcagcaaguaucauucuggaguucuuucucaucguauuauugaucccugaacccgaaaagcaaagaacaccccaagacaaccaauuaacauauguagucauagcaauucuuacuguaguagcagcuacgauggcaaaugaaaugggauucuuggagaaaaccaagaaagauuuuggccugggcucgauuacaacucagcaacccgaaucaaauauacuugauauagauuuaaggccugccagugcauggacgcuauacgcuguugcuaccacauuuauuaccccgauguugaggcacucaauugaaaauaguaguguuaauguaucauuaacagcaauagcgaaccaggcgacaguacuaaugggguuggguaagggauggccccuuucgaaaauggacauuggaguaccauuguuggccauagguugcuauucgcaaguaaauccaaucacucuaacggcugcauuacuucuauugguugcacauuaugccauaauaggccccggguuacaagcaaaagcaacaagagaggcacagaaaagagcagccgcaggcauaaugaaaauacccgcugcucuaauaaugacgguuauagauuuagauccaaucccauaugauccaaaauucgaaaaacaguugggacaaguaaugcuuuugguucuauguaguacacaagucuuaaugaugagaacaacgugggcucuaugcgaggcacuaacacuagcaacugggcccauaucaacacucugggagggaaaccccggaagguuuuggaauacaacuauagcggucucuauggcgaacauuuucagagguucuuacuuagcaggggcuggguuacuauuuuccauuaugaaaaauacugcaaacacacgcagaggaacagguaacacaggagaaacgcuaggggaaaaauggaaaaaucagcucaaugcacuaggcaagucagaguuccaaauuuauaagaagucugguauccaagagguagacaggacuuuagcuaaagaagguauuaagagaggugagacugaucaucaugcgguaucuaggggaucagcaaagcuccgaugguucguagaaaggaauuuggugacaccagagggcaaaguugucgaucugggaugugguagaggaggauggagcuauuacugcggcggauugaaaaaugugaaagaggugaaaggccuaacaaaaggagguccaggucaugaagaaccaauaccuaugucaaccuacggguggaacuuagugagauuacaaucuggaguggauguuuucuuuacuccuccggaaaaaugugacacccuacuaugugauaucggugaguccucacccaaccccacuguggaggcggggcgcacguuacggguccuuaauuuaguggaaaauuggcucaacaauaauacucaauuuuguauaaagguccuaaauccguauaugccuagugucaucgagaaaauggaagcauuacaacgaaaauauggaggugcauuaguuagaaauccuuugucaagaaacaguacucaugaaauguauuggguuucaaaugccucugggaauauugugucaagugugaauaugauaucuagaaugcucauaaaucgauuuacaaugaggcacaagaaagcaacguaugaacccgacguggaccuuggaagcggaacaagaaauauaggaauugaaucagaaguaccuaauuuagacaucauagguaaaaggauugagaaaauaaaacaagaacaugaaacaucauggcauuaugaccaagaccacccuuacaaaacaugggcuuaucacgggaguuaugaaacuaaacaaacgggcucagcgaguaguauggugaacgggguuguacgacuacuaaccaagccgugggauguaauuccaaugguaacacaaauggcgaugacagauacuacaccuuucggccaacagcgaguauucaaggaaaaagucgacacaaggacccaagaaccuaaagaaggaaccaagaaacuuaugaagauuacggcagaauggcuauggaaagaauuagguaagaagaaaacaccgaggaugugcacgagagaagaauuuaccaggaaagucagaucaaaugcugcucuaggagcuauauuuacggaugaaaacaaauggaaaucagcuagagaagcuguagaggacucaggauuuugggaauuaguugauaaggaacgcaacuuacauuuagaagggaaaugugaaaccugcgucuacaauaugauggggaaaagagagaagaaacucggcgaguucgguaaggcaaagggcucgagagcaaucugguauauguggcuaggugccagauucuuagaguucgaagcauugggcuuucuaaaugaagaccauugguuuucaagagaaaacagccuuucagggguggaaggagaaggauuacauaaauuagguuacauuuuaagagaugugagcaagaaagaggguggcgcuauguaugcugacgacacugcgggaugggauacuagaauaacguuggaagaucucaaaaacgaagaaaugguaaccaaucacauggaaggcgaacauaaaaagcuagcugaggcaaucuucagacucaccuaucagaauaagguaguacgcguacaaagaccaacgccuaggggaacugugauggacauaauaucaaggcgagaccaaagaggcagcggucaaguaguuaccuacgguuugaauacuuuuacaaauauggaagcucaauugauaagacaaauggaaggggaaggagucuucaaaucaauccaacaucuuacagcuacggaagaaauagcugucaaaaauuggcuaguucgcgugggcagggaaagacuuaguagaauggcuaucaguggugaugauugugugguuaaaccacuagaugauagauucgccaaugcacuaaccgcauuaaaugacauggguaaaguucgaaaagauauucaacagugggaaccuucgagagguuggaaugacuggacucaagucccuuuuuguagccaccauuuccaugaauugauaaugaaagacgggcgcguguuggucguccccugcagaaaucaagaugaauuaauagguagggcacgaauaucgcaaggcgcagguuggagucuccgagaaacagcuuguuuaggaaaauccuaugcgcaaauguggucacuaauguauuuucaccggagggaucuuagguuagcagcaaacgcuaucugcucagcaguuccgagccacugggucccgacaucgagaacaacauggucuauacaugcuacucacgaauggaugacaacugaagauauguugacgguauggaauagaguguggauacaggagaaccccuggauggaagauaaaacaccaguggagagcugggaggaaauaccuuacuuaggaaaacgugaagaucaauggugcggaucuuuaauaggauugacaucacgggcaacaugggccaaaaauauacaaacagcgauaaaucaaguaagaucauugauagguaaugaggaauacacagacuacaugccaaguaugaaacguuucaggcgugaagaagaagaagcggggguguugugguga

SEQ ID NO: 22219 - RNA, 9876 nt, Artificial Sequence
  derived and/or modified CDS sequence (opt6) from DENV-2__KX380816__SS-prME
acagcaggaauaauaauuaugaugauucccacgguuauggcguuucaucugacuacuagaaacggugaaccucauaugauaguaaguagacaagaaaaagguaaaagucugcuguuuaaaacagaaaacgggguaaauaugugcacauuaauggcaauggacuuaggagaauuaugugaagauacaauuacauacaacugcccccucuuacggcaaaacgaaccagaagauauagauugcugguguaacucuaccucaacguggguaaccuacggaacauguacagccacgggggaacaucgucgagagaaaaggucaguagcccuuguaccccauguugggaugggccuugaaacuagaacggaaacguggaugucuucggaaggagcuuggaaacacgcccaaaggauugaaacauggauuuugcgacaccccggguuuacuaucauggcagcaauauuggcuuacacaauagggacaacuuauuuccaaagaguauuaauauucauucugcuaacagccgucaccccaaguauggcgaugagguguauugguauaucuaaccgugauuucguggaaggaguaagcgguggaaguuggguugauauuguucuugaacacggcucgugcguaacuacgauggccaaaaauaaaccaacccuggauuucgaauuaauaaaaacugaagcaaaacaccuugcaacuuuacgaaaauauuguguggaggcuaaacuuacaaacacaacuaccgccucucggugccccacgcaaggugaaccgagucuaaacgaggaacaggauaaaagauuuguauguaaacauucaauggucgacagagguugggguaacggaugugggcuauucgguaaaggagguauaguuacaugugcuauguuuacauguaaaaagaacauggagggaaaaguaguucagcccgaaaaccucgaguauacuauagucauuacuccucauagcggugaagagaacgcaguagggaacgauacuggaaaacaugggaaagagauaaaaguuacaccucagaguaguauaacagaggcagagcuuaccggcuauggcacaguuacaauggaaugcucaccucgaacaggucuagauuucaaugaaaugguuuuauuacaaauggaaaauaaggcguggcucguucacagacaaugguucuuagacuugccguuaccuuggcuaccgggggcugauacccagggaucaaauuggauucaaaaagaaacccuaguuacauucaaaaauccccaugccaaaaagcaagacguaguagucuuaggaagucaagaaggugcaaugcauacagcucuaacgggagcaacugaaauucaaaugucuucagguaaucuucuguucacaggacacuuaaaaugcaggcucagaauggauaagcuacagcuuaaaggaaugaguuacucuauguguacagggaaauuuaagguugugaaagaaauagccgaaacccagcauggaacaaucgucaucagaguccaauaugagggcgauggaucucccuguaaaaucccauucgagauaauggacuuagaaaagcgacacguucugggcagguuaauaacggucaauccgauaguaaccgaaaaagauucuccuguaaacaucgaggcagaaccgcccuuuggagauucauacauuaucauaggaguugaaccuggacaauuaaaauuguccugguucaagaaaggaagcagcauaggacagauguucgagaccacaaugagaggagcuaagagaauggcaauacuuggugacacugcuugggauuuugggaguuuaggaggagucuucacaucgauuggaaaagcguuacaucaaguauuuggagcaaucuauggagcggcauuuagcggagucucguggacaaugaaaauacuuauagggguugucauuacauggauuggaaugaacagcagaucaacaucuuuauccguaucacuuguauugguagggguagugacacuuuaucucggagucauggugcaagcggacucggguuguguaguguccuggaagaacaaagaauuaaaauguggcaguggaauuuuuauuacagauaauguacauaccuggacggaacaauacaaguuucaaccagaaaguccaaguaagcuagcuagugcuauccaaaaagcacaugaagaagggauauguggcauuagaucagucacuaggcuugaaaaucuaauguggaaacaaauaacgccagaauuaaaccacaucuugaccgagaaugaagucaaacuaaccauuaugacuggagauauaaaggggauaaugcaagcggggaaacgcacgcuuagaccucaaccaacagaauuaaaauauagcuggaaagcauggggaaaggcgaaaauguuaucaacagaacuucacaaucauaccuuucucauagauggaccagaaacggcggaaugucccaauacaaauagggcguggaacucauuagagguggaggacuacggauuugguguauuuacuacaaauaucugguuaaaacucaaagagagacaggacguguucugugacuccaaauuaauguccgcagccauuaaagacaaucgcgcaguacaugcggacaugggauacuggauagagucagcacuaaacgacaccuggaagauugaaaaagccucuuucauagaagucaagaguugucauuggccuaaaagccauaccuuguggucaaauggaguauuggaaucagaaaugauaauaccuaaaaauuuugccgguccugucucacaacauaacuaucgaccaggauaccauacucagacggcugguccguggcaccuuggaagguuagagauggacuuugauuucugcgaaggaaccaccguggucguaaccgaagauugcgguaaccguggaccaaguuuacgcacgacaacagcuagugguaaacugauaacagaauggugcuguaggucuuguacacugcccccacuccgcuauagaggcgaagacggauguugguacgggauggagauccggccguugaaagaaaaagaagagaaucuagucaacagccuuguuacagcgggacauggucaaaucgacaauuucucguugggagugcuaggcauggccuuauucuuagaggaaaugcuaaggacccgagugggaacaaaacaugcaauucuucucguggcaguuucguuuguaacguuaauuacugggaauaugucauuucgugauuugggacguguaauggugaugguaggagcgacuaugacugaugauauagguaugggagucacauaucuggcccuauuagccgcuuucaaaauaagaccaacuuuugcagccggucuguuguugcgaaaguuaacuucuaaggaacuuaugaugacuaccauaggaauuguucuuuuaucgcaaaguacuaucccugagagcauucuagagcucacggaugcacucgcccuuggaaugaugguucugaaaauaguucgaaauauggagaaauaucaacuugcaguaacuaucauggcaauacuguguguaccuaaugccguaauauuacaaaaugccuggaaagugagcugcacaacgcuggcaguaguuucuguaucaccccuccuccuuacauccucacagcagaaagcagacuggauuccccuagcauuaacaauuaagggacuaaauccaacagcaauauuccugacaacgcuaucacggacgaguaagaaacgauccuggccauugaacgaggcuauaauggccguaggaaugguauccauucucgcaucaucucuuuugaaaaaugauauuccaaugacagggccauuaguggcaggaggauuguuaacagucuguuauguauuaacaggcaggagugcagaccuagaauuagaacgcgccgcggauguucgaugggaagaacaagcagagauuucgggaaguaguccaauccuuaguauaacuauaagugaagauggcagcaugucaauuaagaacgaagaagaggaacaaacauuaacgauauuaauaagaaccggccucuugguaauuagcgggcuauucccugucuccauaccaauaacagccgcagcuugguaccuuugggaaguaaagaagcaaagggcaggaguuuuaugggacgucccaucaccuccaccggugggaaaagcagaauuagaagacggagcuuacagaauaaaacaaaaaggcauccuaggguauagucaaaucggggcaggaguuuauaaggaaggaacauuucauacaauguggcauguaacccgaggcgcaguccugaugcacaaaggcaagcgaauagaaccaucaugggcagauguaaagaaagaucuaaucucguauggaggggguuggaaguuggaaggagaauggaaagagggugaagaaguucaaguuuuagcuuuagaaccuggcaaaaacccuagagcaguccaaacuaagcccgggcuuuuuaagacaaauacugggacaauaggugcagugagccuagauuuuucccccggaacaaguggcaguccuaucgucgacaaaaaggguaaagucguaggacuguacgguaacggagucgugacuagaagugggaccuauguuagcgcgauagcccaaacggagaaaagcaucgaagauaaucccgagauugaagacgauauauuuaggaagaaaagacugacaaucauggaucuacauccuggugccggaaaaacaaagagauaucucccugcgauuguacgcgaagcaauaaagagaggccucagaacucucauccuagccccgacaaggguaguagcggcagaaauggaagaagcacugagaggcuugcccauaagauaucagaccccagcgaucagagcugaacauacuggccgcgaaauuguggaucucaugugccaugcaacauuuacgaugcgcuuauuaucaccaauuagagugccgaauuauaauuugauaaucauggacgaggcucauuuuacggacccugcuagcauagcagccagaggauauaucucaacgagaguagaaaugggcgaagccgccggcauauuuaugacagcuacuccucccgggaguagggaucccuuuccucagagcaacgcaccuauuauggaugaagaaaaagagauaccggaacggucguggaacagcggacaugagugggugaccgacuuuaaaggcaagacuguuugguuuguaccgucuauaaaagcugguaaugauaucgccgcaugucucagaaagaacgguaaaaagguuauacaacuguccagaaagacguuugacagcgaauauaucaaaacgagaacgaaugacugggauuuugucguuacaacagacauaucagaaaugggcgcgaacuuuaaagcagaacgaguaauagauccacggcgaugcaugaaaccgguuauacuaacagacggggaagagagggugauacuagcaggucccaugccuguuacccacagcuccgcagcucaaaggagaggaagaguuggccguaauccuaaaaaugaaaacgaucaguacauauauaugggcgaaccacucgaaaacgaugaagauugugcacauuggaaagaggcaaagaugcuauuggacaauauuaauacaccugaaggaauuauaccgucgauguucgaaccggagagggaaaaaguggaugcuauagacggagaguacaggcucagaggcgaagcccguaaaacauuugucgauuuaaugcguagaggggauuugccugucuggcuggcauauaggguagccgcugagggaauaaauuaugccgaccggaggugguguuucgauggagucaaaaauaaccaaauacucgaagaaaacguugaaguugaaauauggacaaaagagggugaaaggaagaaauuaaaaccacgauggcuugaugcuagaauauauagcgaucccuuagcuuugaaagaguuuaaagaguucgcugcaggaagaaaaucacuaacguuaaauuuaauaacagaaaugggacgacuuccaacguucaugacacagaaagcgaaaaacgcccucgacaauuuggcgguacuacacacagcagaagcaggaggaagggcauauaaccaugcuuuaucugaacuaccagagaccuuagagacguuauuacuacuaaccuuacucgcaaccguaaccggaggaaucuuuuuauuuuugaugucuggaaaaggaauaggaaaaaugacacuugguauguguugcauaauaacagcaucaauauuacuuuggcacgcgcagauccagccucauuggaucgcggccucgaucauauuggaguucuuccuaauaguguuacuuauaccugagccggaaaagcaaagaacaccucaagauaaucaguugacuuaugucguuauagcaauucuaacuguuguagcggcuacgauggccaaugaaauggguuuucuagagaaaaccaagaaagauuucggucuggggagcaucacgacacaacaacccgaaagcaauauucucgacaucgaccuuagaccagcaucggcguggacgcuauacgcaguugcuacuacauuuaucacaccgauguuaagacauucaauugaaaauucaucagucaauguaucucucacagcaauugcuaaccaagcaacagugcuaaugggccugggaaaagguuggccacuaagcaaaauggauaucggcguucccuuacuugcuauagguuguuacagccaaguaaauccuauuacauugacggccgccuuacuucuucuuguagcgcauuacgcuauuaucggaccagggcugcaagcuaaagccacacgagaggcucagaaaagagcugcugcagguauaaugaagaauccaacaguagauggaaugacagugauugaccuagacccuauaccguacgauccgaaguuugaaaaacaauuaggacaaguaauguuauuaguccuguguguuacccaggugcuaaugaugaggacuacaugggcccuaugugaagcauugacccuagcaacugggccaauauccacuuuaugggaaggaaaccccggacguuuuuggaauacuacuaucgcaguuucuauggcuaauaucuuucguggauccuaccuagcaggcgcugguuuguuauucagcauuaugaaaaauacugcaaacacucgaagaggcacuggcaacaccggggaaacucuuggagaaaaguggaaaaaccgacuaaaugcauuagggaaaagugaauuucagaucuacaagaaaucagguauacaagaaguagaccgaacccucgcaaaagaaggcauaaagaggggugaaacugaucaccaugcaguaucacgaggcucugcuaaauuaagaugguuugucgaacgaaaccucgugaccccagaagggaagguaguugauuuagguugcgggcgaggcgguugguccuauuauuguggaggacuuaaaaacguaaaagaagugaaaggucuaaccaaggguggccccggucacgaagaaccgauuccaaugucaacauacggcuggaacuuggugaggcuacaaucaggaguagauguauucuucacaucaccagaaaaaugcgacacacuccuuugcgauaucggugaguccucaccaaacccaacgguugaagccgguagaacuuuacggguucuuaaccucguagaaaauugguuaaauaauaauacacaguucuguauaaaagugcuaaauccauacaugcccaguguaauugagaaaauggaagcucuacagagaaaauacgguggugcacuuguucguaacccucuaucaagaaauucaacccaugaaauguauugggucaguaaugcgagcggaaacauugucaguaguguaaauaugauaucacggauguugauaaacagauucacgaugcgucauaagaaagcuaccuaugaaccagacguagaucuaggaagugggaccagaaauauuggaauagaaagugaaaccccuaacuuagauaucauaggaaaaaggauagagaaaauuaaacaagaacaugaaaccucguggcauuaugaccaagaccauccauauaaaaccugggcauaucauggcucauaugaaacaaaacaaacgggcucugccuccaguaugguaaauggugucguuaggcuauuaacaaagccuugggacguaauuccgauggucacucaaauggcuaugacugauaccacuccuuucggacagcaaagaguauuuaaggagaaaguggacacgagaacgcaggaaccuaaagagggaacgaagaaacuaaugaagauuacugcugaaugguuguggaaagaguuggggaaaaagaaaacgccuagaaugugcacaagagaagaauuuacaaggaaaguaagaucaaacgcagcacuuggagccaucuuuacagaugaaaacaaauggaaaagugcacgagaagcuguugaagacaguggauuuugggaguuaguugauaaagaaagaaaccuacaccucgaggguaagugcgaaacauguguauauaacaugauggguaaaagagagaagaaacuuggggaguucggaaaagcaaaaggcucgagagcgauaugguacaugugguuaggggcgagguuuuuagaguucgaggcacuuggauuucuuaaugaagaccauugguuuucacgagaaaauucuuugucugggguugaaggagaaggauugcauaaacuaggauauauuuugagagauguuucuaagaaagaagguggcgcaauguaugcggacgacacugcugguugggacacacgaauuacuuuagaggauuuaaagaaugaggaaaugguaacuaaucacauggaaggagagcacaagaaacuagccgaggccauauucaagcuaacauaucaaaauaaggucguccgggugcagcgaccgacaccaagagguacaguuauggacauaauuucacgucgagaucaacgaggcucuggacaagucguuacuuaugggcucaauacauuuaccaauauggaggcgcaauuaauaagacaaauggaaggugaaggggucuuuaaaagcauacaacaacucacuguuaaagaagagauagcaguuaaaaauuggcugauaagaguuggaagagagagguuaagccggauggccauaucaggcgaugauugugugguaaagccauuagaugaccguuucgcuucagcuuugacagcacuaaacgauaugggaaaaguuaggaaagacauacaacaaugggagccaaguagaggguggaaugacuggacccaagucccauuuuguagccaucauuuccaugaacucauaaugaaagauggcagaguucuagucguccccugucggaaccaagaugaacuaauugguagagcaaggauaagccaaggagcaggguggucuuugcgugaaacggcuugcuuagggaaaaguuacgcccaaauguggucacuaauguauuuccaucgucgcgauuuacggcuagccgcaaacgccauuugcucggcagugccaagucauuggauaccgacaucgaggaccacuuggaguauacacgcuacacaugaauggaugacuacagaggauauguuaacgguauggaaucgagucuggauacaagaaaauccauggauggaagauaaaacuccaguugaaucuugggaagaaauaccauauuuagggaagagagaggaccaaugguguggaagucuuauuggcuugacaagucgugcaacaugggccaaaaauauccaaacagccaucaaucagguccgcucacuaaucggcaaugaggaauauacagauuauaugccuucaaugaaaagauucaggagagaagaagaggaagcaggcgugcuuugguaa

SEQ ID NO: 22220 - RNA, 9876 nt, Artificial Sequence
  derived and/or modified CDS sequence (opt6) from DENV-2__KX380817__SS-prME
acggccggaauuauuauaaugaugauuccgacagugauggcuuuucacuuaacuacuaggaacggagaaccacauaugaucgucucucgccaagaaaaagguaaaaguuuacuguuuaagaccgaaaacgguguuaauauguguacacucauggcuauggaucuaggagaacuaugcgaggauaccauaacuuacaacugcccacuccuacgucagaacgaaccugaagacaucgacugcugguguaauucaacaucuacuuggguuacauacggaacaugcacugcaacuggggaacauagacgcgaaaagcgcucuguugcauugguuccacacguggggaugggacucgaaacuaggaccgaaaccuggaugagcucggaaggggcauggaaacacgcacagcguaucgaaaccuggaucuuaagacauccuggauucacaauuauggcugcaauucuggcguauaccauuggaaccacuuacuuccaaaggguucuaauauucauuuugcuuacagcggugacuccaucaauggccaugaggugcauaggcaucaguaaucgagauuuuguugaaggggucucugguggcaguugggucgacauugucuuagagcacggcagcuguguaacgacaauggcuaaaaauaaacccacauuagauuuugaauugauuaaaacagaagcaaaacaccuugcgacacuuagaaaauauuguguagaggcgaagcucacuaauaccacaacagccaguagauguccuacucaaggggagccgagucuaaacgaggaacaagacaagagguuugucuguaagcacaguauggucgacagaggaugggguaacggaugcggguuauuuggaaaaggaggaauagucacuugugcaauguucacauguaaaaaaaauauggagggaaaaguggugcaaccagagaaccuugaauacacgauuguuauaacuccgcauagcggugaagaaaaugccgugggaaaugauaccggaaaacacggaaaagagaucaagauaacuccucaaaguuccauaacagaagcagaauuaacgggauaugggacuguaacaauggaaugcuccccuaggaccggacuggauuuuaacgaaauggugcuucuacaaauggagaauaaagcauggcuuguacacaggcaaugguuuuuagaccugcccuugccauggcuaccaggugcugauacccagggaucgaauuggauccaaaaggaaacuuugguuacguuuaaaaacccacaugcaaagaagcaggacgucguuguucuugguucccaggaaggagcaaugcauacugcguuaaccggugcaacagagauacagaugucuagcggaaaccuacucuucacaggacacuuaaaauguagacuacgaauggacaaacugcaauuaaaaggcaugucauauucuauguguacaggaaaauuuaaagucguuaaagaaauugcagaaacucagcauggcacaauaguuauuagaguacaauaugaaggagacgggaguccuuguaaaauaccauuugaaauaauggaccuugaaaaaagacacguccucggccguuugaucaccguaaacccgauugucacagagaaagauuccccaguaaacauagaggcagaacccccuuuuggagauucuuauauaaucaucgggguagaacccggacaacuaaaacugagcugguuuaaaaaaggaucaucgaucggacaaauguuugaaacaacaaugagaggugcgaaaagaauggcaauccuaggugauacagccugggacuuugguucguuaggcgguguauucacuagcauugguaaagcgcuucaucaaguauucggugcaauauacggggcagcguucucagguguuucuuggaccaugaaaauauuaauugggguaguuauuaccuggauuggaaugaacucgcgcucaaccucauuaucggugaguuugguacugguaggagugguaacccucuacuugggcguaauggugcaagcugauucaggauguguaguuucuuggaaaaacaaggaauuaaagugugguucagguauauuuauuacugacaauguccauacauggacagaacaauauaaauuucaaccagaaaguccuuccaaauuagccagugcuauccagaaggcacacgaggaagggaucugugguauucgaucaguaaccagacuugaaaaccuuauguggaaacagaucacucccgaauugaaucacauucugacagaaaaugaagucaagcuaacgauaaugacaggcgauauaaaagguaucaugcaggcgggaaaacguucuuuaaggccccaaccuacugaacucaaauauagcuggaaggccugggguaaagccaaaaugcuaagcacagaacuccacaaccacacguuccuuauagaugggcccgagacagcagaaugcccuaacacaaaucgagcuuggaauaguuuagaagucgaagacuacgguuucggcguuuuuacaacuaacauuuggcucaaacuaaaggaaagacaagauguguuuugugacucuaaauuaaugucggccgcaauaaaagacaauagggccguccaugcggacaugggauauuggauagaaucugcacuaaaugacacauggaagauagagaaagccaguuuuauugaaguaaagagcugccacuggccaaaaucucacacucuauggaguaauggcguauuggaaucagaaaugaucauacccaaaaauuuugcaggaccaguuucucagcauaacuaccggccaggauaccauacacagacugcugggcccuggcauuuggggagauuagagauggauuucgauuuuugugaaggcacaacaguaguaguaacugaagauugugguaaccgaggaccaucacuacguacaacgacagcgagcgguaaauuaauaaccgaaugguguugucguagcugcaccuuaccaccucuccgauacagaggagaggacggauguugguacgggauggaaauacgcccuuuaaaagaaaaagaggaaaauuugguuaauucacuagucaccgcgggccauggacagauugauaauuuuagucugggugucuuaggaauggcauuguuccuagaagagaugcuucgaacaagagucggaacuaagcacgcaauccuacuaguugcuguuucauuuguaacucuuauaacagguaauaugucuuuccgagacuugggaagaguuaugguuauggucggggccacaaugacggaugauauuggcaugggcgucacauaucuugcauuguuagcggcauuuaaaguacgaccaacauucgcugcuggauuauuguuacgaaaguuaacgaguaaagaauugaugaugacuacaauaggaaucguauuacugagccagagcacuauaccggaaucaauacucgaacuaacagaugccuuagcacuugguaugaugguacuaaaaauagugcggaacauggaaaaguaucaguuagcaguaacaauuauggcuauaucauguguuccgaaugcggugauucuacaaaaugcguggaaagugucauguacaacauuagcgguaguaucgguaucaccccuacuguugaccagcucucaacagaaagcugauuggauuccccuugcuuugacaauaaaagggcuuaauccuaccgccauauuucuaacaacgcugaguagaaccagcaaaaagcggucauggccuuuaaaugaagcaauaauggcaguaggcaugguaucaauauuagcauccucacuguuaaaaaaugauauaccgaugaccggcccuuuaguagcaggaggguuacucacugucuguuauguacuuacaggaaggucggcugaccucgagcuagagagggcagcagauguacgaugggaagagcaagcugagauaucuggcagcucaccaauauugucgauaaccauaagcgaagacggaaguaugagcauuaaaaacgaagaagaagaacagacucuaacgauucucauacgaaccggacuccuaguaaucagcggauuauuuccgguuucgauuccaauaacagcagcugcaugguauuuaugggaaguuaaaaaacagagagcuggaguucugugggaugucccaucaccaccaccaguagggaaagcagaacuugaagacggugccuaucguauaaaacagaagggcauauuaggauauucucaaauaggugcuggaguauacaaagaagggaccuuccauacgauguggcacguuacaagaggggcuguauuaaugcauaaaggaaaacguauagaaccaucaugggcagauguaaaaaaagauuuaauuaguuacggcggaggauggaaacuagaaggggaauggaaggaaggcgaagagguccaaguauuagcauuagaaccuggaaaaaauccccgugccgugcaaacaaaaccagggcuauucaaaacaaauaccgguacaaucggcgcaguaucgcuugauuuuaguccaggaaccagugguucuccaauagucgauaaaaagggaaagguaguuggacucuaugggaacgggguaguaacgagaagugguacguaugucucagcuauagcccaaacugaaaaaagcauugaagauaacccagaaauagaagacgauauauuucguaaaaaaagauuaacgauaauggaccuacauccuggggcuggaaaaacaaagcgauaccucccugcaauagucagagaagcaaucaaacgaggucugagaacccuuauacuggcuccgacgagagugguagcagcugagauggaggaggcacuacgaggucuuccaauucgcuaccaaacucccgcgauaagagcagagcacacgggccgggaaaucguagacuugaugugccaugcuacuuuuacuaugagacucuugucaccaauacgagugccaaacuauaaucuuauaauaauggacgaagcucauuucacagacccggcaaguaucgcagccagaggcuacauuucuacuagaguggagaugggugaagcugcaggcauauuuaugacggcaaccccaccugguagucgugacccauuuccucaaaguaacgcgcccauaauggaugaggaacgugaaauaccugaaagaucauggaauaguggccacgaguggguuacugacuuuaaggguaaaacaguaugguuuguuccuucuauaaaagcuggcaaugacauagccgcuugucuccgaaaaaacgggaagaaagucauacaacucucuagaaaaacguucgauucugaguauauaaagacaaggacaaaugauugggacuuugucguaacuacagacauaucagaaaugggagcuaauuuuaaggcagaaagaguaauugauccaagaagauguaugaagccuguaauucuuacggauggagaagaaaggguuauauuagcgggaccgaugccaguaacacacucaucggcugcucaaagaagagggagagugggcaggaauccgaaaaaugaaaacgaccaauauauauauaugggcgaacccuuagaaaacgacgaggauugcgcacacuggaaagaggcaaaaauguuacucgauaacauuaacacgccggaggggauaauuccuucgauguucgaacccgagagggagaagguagacgccauagacggugaauauagacugaggggugaggcuagaaaaacauuuguagacuuaaugcgucgcggugauuugccaguauggcuugccuaucgagucgccgcugaagguauaaacuaugcagaucgucggugguguuucgacggaguuaaaaacaaucaaaucuuggaagagaacguggaaguugaaaucuggacaaaagagggagagagaaaaaaauuaaaaccacgaugguuagacgcaaggauuuacucugauccuuuagcacucaaagaauuuaaagaguuugcggcgggaagaaaaagccuaacuuuaaauuuaauaacugagaugggccgucuuccuacuuuuaugacacagaaagccaaaaacgcccucgauaauuuggcgguauuacacacggccgaagcuggugggagggcauacaaucacgcucucagugaacucccugaaacucuagaaacgcuccuucuauuaacccuucuugccacgguaaccgggggaauauucuuguuucucaugucuggaaagggaaucggaaaaaugacauuaggcaugugcugcauaauaaccgcaucaauucuccuuugguaugcucaaauacagccccauuggauagcggcuaguauaaucuuagaauuuuuccuaauaguccuucuaauuccagaaccugagaaacaacgaacuccacaagauaaucaacuaacauaugucguuauugcaauuuuaaccguaguagccgcaaccauggcaaaugagaugggcuuucuggagaaaacaaaaaaagacuuuggauuaggaagcauaacaacacagcaaccugagagcaauauccucgacaucgaccugagaccagcuagcgcauggacguuauacgcaguagcaacuacuuuuauaacaccuauguuaagacacucgauagaaaacucaaguguuaauguaagucugacagcaauagcuaaccaagcuacaguucugauggggcuagggaagggcuggccgcucucaaaaauggauauuggggucccuuuguuagcaauaggauguuacagucaagugaacccaaucacacuuacagcggcacuacuccuccuuguagcacauuaugccauuaucggcccaggguuacaagcaaaagcgacaagagaggcacaaaagcgagcugccgcugggaucaugaaaaauccaacaguagauggaaugacaguuauugaucuggauccuauaccauacgauccuaaauucgagaaacaguuaggucaagugaugcuauuaguacugugcgugacacagguauuaaugaugagaacaacaugggcacuaugcgaagcuuuaaccuuggcaacgggaccuaucucaacucuaugggaaggaaauccaggucgauucuggaauacuacgauagccgucaguauggcaaauauauucagagggaguuauuuggccggggcaggccuucuauucucaauuaugaaaaacacagcaaauacucggcguggaacaggaaacacaggagagacauugggagaaaaauggaaaaauagauuaaacgcauuagguaagucggaguuccaaauauacaaaaagagcggaauccaggaaguugaccgcacauuagcgaaagaaggaaucaaacguggagaaacagaucaucacgcggugucacgagggagugccaaacuuagaugguucguugagcgcaauuugguuacccccgaagggaaggugguugacuuaggaugugggagggguggcugguccuauuacugugggggauuaaaaaacguuaaagaaguuaagggccuaacaaaggguggaccaggacaugaagaaccaauaccaaugucaaccuauggcuggaaccuaguacgucuacaaagcggaguagacgucuucuuuacuccgccggagaagugugauacacuguuaugugacauuggugaaaguuccccuaauccgaccgucgaagcgggcagaacucuaagagucuugaaccuaguagagaauuggcuuaacaauaacacccaauuuuguauaaagguauugaacccuuacaugccaucuguaauugaaaagauggaagcuuuacagagaaaauacgggggugcauuaguccguaauccuuuaucacgaaacagcacucacgaaauguauugggugagcaaugcaucugggaauaucguaucuaguguuaacaugauaagucgaaugcuaauaaacagguuuaccaugaggcauaaaaaagcuacauacgaaccagacguggacuuagggucagguacuaggaauauaggaaucgaaucugaaacaccgaacuuagauauuauagggaaaagaauagaaaaaaucaaacaagaacacgaaaccucauggcauuaugaucaagaccaucccuauaaaacuugggcuuaucauggaucguaugaaacuaaacaaacagguucggcuaguucuaugguaaauggaguaguuagacugcucacgaagccuugggauguaauaccuaugguuacacaaauggcgaugacagauacaacaccguucggacaacagagaguuuucaaggaaaaaguagauacccguacccaagaaccuaaagaggguacuaagaaacuuaugaaaaucaccgcagaguggcucuggaaagaauuaggaaaaaaaaagaccccaagaaugugcacuagagaggaauucacgaggaaaguaagaucgaacgcggcauugggugcaauuuuuacggacgaaaauaaauggaagucggcaagagaagcgguagaggacaguggauucugggaacuuguagaucgagaacguaauuugcacuuagaaggaaaaugugaaacgugcguauacaacaugaugggcaaaagagagaagaaacuuggggaguuuggaaaagcuaaagguagcagagccauaugguauauguggcuuggagcacgauucuuagaguuugaagcacuuggguuuuuaaaugaagaucauugguucucccgagagaauaguuugaguggcguggaaggagaaggguuacauaaauuaggguauauucugcgagaugugucgaaaaaagagggaggcgcgauguacgcggaugauaccgcaggaugggauacccgaauuacgcuagaagaccuaaaaaaugaagaaaugguuaccaaucacauggaaggcgagcacaaaaaacuagcagaggcaauauucaaauuaacauaucaaaauaaaguagucaggguacaacgaccuacaccaagaggaacaguuauggauauaauaagcaggagagaucaacgaggcucaggacaaguaguaacauauggacuaaauacuuuuacgaauauggaagcccaauugauucgacagauggaaggggaaggcgucuuuaaaaguauacaacaacugaccguuaaagaggaaauagcaguaaaaaauuggcucauuaggguaggaagagaacgucuaagccguauggcaauaaguggugacgauuguguaguuaaaccauuagaugauagauucgcaucagcuuuaacagcgcuuaacgauaugggaaaaguccguaaggauauccaacaaugggaaccuucaagagguuggaaugauuggacacaaguucccuucuguagucaccacuuucacgaacuaaucaugaaagaugggaggguacucguagucccuugucgaaaucaagaugaacugauuggccgugcucguaucucucaaggggcaggauggucucuccgggaaacagcaugucuaggcaaaucguaugcccaaauguggucucuaauguauuuucacaggagagauuuaagacucgcugcgaaugcuauaugcucugccgugccgucucauuggauccccacaucccgaacaacuuggaguauucacgcaacucacgaauggaugacaacagaagacaugcuuacgguauggaauaggguauggauucaagaaaauccuuggauggaagauaaaacaccuguugaaucaugggaagagauaccuuacuugggcaaaagagaagaucaauggugcggcaguuugauaggucucacuucaagggcuacaugggcuaaaaauauccaaacggcaauaaaucagguccgaucauugaucgguaacgaggaguacacugacuacaugccaucgaugaaaagauuccgacgcgaggaggaagaagccggaguccuuugguaa

SEQ ID NO: 22221 - RNA, 9876 nt, Artificial Sequence
  derived and/or modified CDS sequence (opt6) from DENV-2__KX380818__SS-prME
acggccggaauaauuaucaugaugauaccaaccgucauggcuuuucauuuaaccacccggaacggagagccacauaugauugucucaagacaggaaaaggggaaaucacuauuguuuaaaacugaaaacggugucaacauguguacauuaauggcuauggauuuaggagaauuaugugaagauaccauaacguacaauuguccacuuuuacgacaaaaugagcccgaagacauugacugcugguguaacucaaccuccacguggguuacauacgguacaugcacugcuacgggugaacauagacgagaaaaacgaucugucgcgcuaguuccacacguugguaugggguuggagacccgcacagaaacauggaugucuagcgagggagcuuggaagcaugcccaacgcauagagacaugggucuugcgucacccuggauuuacuauaauggcagcgauacuugcauacacgauagggacaaccuacuuucaaagaguucugauauuuauacuucucacugcagucgcuccuucgaugacaaugagguguauaggaauaucaaauagagauuuuguugaagguguaagcgguggcagcuggguugacaucguauuagaacacgggaguugcgugaccacaauggcaaaaaauaagccaacuuuggauuuugaacugauaaaaacagaggcgaaacauccggcuacauuacgcaaauauugcauagaagcaaaguuaacgaauacuacaacggcaucaagaugcccaacacaaggagaaccaagccugaacgaagaacaagauaaacgauucguauguaaacauucuaugguggaucgaggaugggguaacggcugcgguuuauucgggaaaggcgguaucguaacaugugcuauguuuacgugcaagaagaacauggaagguaaaauaguacaaccugaaaauuuagaauauacuauaguuauaaccccucauagcggagaagaaaaugcaguaggcaaugauacuggcaaacauggaaaagagaucaaaguuacaccacagaguagcauuacagaagcagaauugaccggguaugguacaguuacaauggaauguucuccuagaacgggccuagauuucaacgaaaugguauuacuacaaauggaaaacaaagcuuggcucguucaucgucaaugguucuuagacuuaccuuuaccauggcuacccggugcggauacacagggaucuaauuggauucaaaaagaaacacuagucacuuuuaaaaauccacacgccaagaagcaagacgucguagugcuaggaagccaagaaggugccaugcauacagcauuaacaggugcaacugaaauacaaaugaguaguggaaauuuauuauuuacagggcauuugaaaugcagacuacgaauggauaaauugcaauuaaaaggaaugucuuacucgauguguacaggaaaauucaaaguagugaaagaaauugcggaaacgcaacacggcacaauaguaauuagaguccaauacgaaggcgauggcucuccgugcaagauccccuuugaaauuauggaccuggaaaagaggcacguguuaggacgucuaauaacuguaaacccaauuguaacagaaaaagauucuccgguuaauaucgaagcagagccaccauucggugauucauacauuauaauagggguagaaccaggacaauuaaaauuaucgugguuuaaaaaaggcucaucaauaggucaaauguucgaaacaaccaugcggggugcaaagcguauggccauauugggggauacggcuugggauuucggaucgcuggguggcguuuuuacuagcauuggaaaagcauuacaucaaguuuuuggagcaauauacggagcagcauucucgggaguaaguuggacaaugaaaaucuuaauagggguggugauuacauggauagggaugaauagucguaguacgucguuaucaguaucauuaguacugguuggcgucguaaccuuauaccuagguguuauggugcaggcugacucagguugcguagugaguuggaagaacaaagaguugaaguguggcagcggaaucuuuauaacagauaauguucauacauggacagaacaguauaaauuucagccagaaucuccgucaaaauuggcuagcgcaauacaaaaagcucaugaagaggguauaugcggaauaaggaguguaacaagguuagaaaaucuuauguggaaacaaauuaccccagaauuaaaccacauauuaaccgaaaacgaagucaaauugacgauuaugacuggugacauuaaagguauaaugcaagcugguaagaggucucuaagaccacaaccaacagagcuaaaguauaguuggaaagcuuggggaaaggcaaagaugcuaaguacagaauugcauaaucauacuuuucugauagacgguccagagacggcagaaugcccaaacaccaacagagcuuggaauucuuuagaaguagaagauuacggcuuugguguguucaccacaaauauaugguugaaacuaaaagaaaggcaagaugugaguugcgauagcaagcuaaugagugcagcuauuaaagacaaucgggcuguccaugcugacaugggauauuggaucgaaagcgcccucaaugacaccuggaaaauagaaaaagcuagcuuuauagaagucaaaucuugucauuggccaaaaucucacacacuauggucaaacggcgugcuggagucugagaugauaauucccaaaaacuucgcgggacccgucucgcaacacaauuacagaccuggcuaucauacacaaacagcaggcccauggcaccuuggucgacuagaaauggacuuugauuuuugcgaagguacuaccguaguaguuaccgaagacuguggaaauagaggccccagucuucguacuacgaccgccucagggaaacuaauaacagaauggugcugucggaguugcacacucccaccucuacguuacagaggagaggaugguugcugguaugguauggaaauccgaccgcuaaaggaaaaagaagaaaaccucguaaauucgcuaguaacagcaggacauggucaaauagacaauuucucauuggguguucuugggauggcuuuauuucuugaagaaauguugaggacacgaguaggaacuaaacaugcaauauuauugguagcugucucauucgucacauuaauaacaggcaauaugagcuuuagagacuugggucguguaaugguaauggucggagcgacaaugacagacgacaucgggauggguguaacuuauuuagcacuucuugcagcauuuaaaguacgaccgacauucgcagcuggacuucuauugaggaaauuaacgucuaaagaauugaugaugaccacaaucgguauaguguuacugucgcagaguacaauaccagaaacaauuuuggagcuaacagaugcauuagcguugggaaugauggugcucaaaauugugagaaacauggaaaaauaccaacuagcagucacuauuauggccauucuauguguaccaaaugcagugauauuacagaaugcuuggaaaguaucauguacaacuuuagcaguugugucaguuucacccuuauuauugacaagcagccaacaaaaaacggauuggauaccauuagcccuaacaaucaaggguuuaaauccgacagcuauauucuuaaccacccuaucaagaacaucaaagaaacggaguuggccccugaacgaagcuauaauggcgguaggcaugguaagcauucuagccucaaguuuccuaaaaaacgacaucccaaugaccggaccauugguagcuggcggacuacucacuguuuguuaugugcucacgggacguucggcggaccucgaacuagaacgagccgcagauaucagaugggaagaacaagccgagauaucugggucaucgccaauucuuagcauaacuauuucagaagacggaucuaugucuaucaaaaacgaagaggaggaacaaacauuaaccauccuaauaagaacuggacuacuggucauaucaggccuauuuccagugucuauaccaauaacagcggcugcaugguaucugugggaagucaaaaagcaacgagcugguguauuaugggaugugcccucuccgccaccggucggaaaagcggaauuagaagauggagccuauaggaucaaacagaagggaauucuaggauacucacagauaggcgccggugucuauaaagaaggaacauuucauacgauguggcacguaacacgaggagccguucuaaugcauaaagggaaacgaauugaaccaucaugggcugaugucaaaaaagauuugauuaguuacgguggcggguggaagcuugaaggagaauggaaggaaggggaggaggugcaaguccuagccuuagaaccuggcaaaaaucccagagcgguacaaacgaaacccgguuuauucaaaacaaacacagguacuauaggcgcugugagucuagacuucucgccaggaaccaguggcaguccaauagucgacaaaaaaggaaaaguaguuggacucuacgguaauggagucguaacacgaagcggcacauaugucucugcuauagcacaaaccgaaaaaaauauagaagauaauccugagaucgaagaugacaucuuucguaaaaagagacuuacaauaauggaccuucauccaggagcagguaaaacaaagagguaccuuccggcgauaguaagagaagcgauaaagcguggguugcguacacuuauucuagcaccgacccgugugguagcagcggaaauggaagaggcguuaagaggguuaccaauuagauaucaaacgccggcaauacgugcagaacacacaggaagagaaauaguugauuuaaugugccacgcuacauuuacaaugagacuucuaucuccaauacgcgugcccaauuauaacuugauuauaauggacgaagcacauuucacagauccagccaguaucgcugcacgcggauacauuucuacaaggguagagaugggagaagcagcaggcaucuuuaugacugcuacaccaccagggucaagagacccauucccgcaaagcaaugcaccuauuauggacgaggaaagagaaauuccugaacgaaguuggaacagcgggcacgaauggguaacugauuucaaaggcaagaccguaugguucgucccuaguauuaaagcuggaaacgacauugcugcauguuuaagaaaaaacggaaagaaaguaauacagcuaucaaggaaaacauuugauuccgaguacguuaaaacgcgcacuaaugauugggauuuuguaguaacaacagauauaucagaaaugggagcgaacuuuaaagcugagagaguaauugauccacgucgaugcaugaaaccagucauucuaaccgauggcgaggaacgaguaauacuagccggacccaugccgguuacacauaguucugcugcgcaacgaaggggaagagucggaagaaauccaaagaaugagaaugaucaauauauuuauaugggagagccauuagaaaacgaugaagauugugcccauuggaaagaagcuaaaaugcuacuagauaacauuaauaccccugaagggauaauuccauccauguuugagcccgaaagagaaaaaguugaugcuauagauggugaguauagauugcgaggagaggccagaaagacauuuguagacuugaugaggcgcggagaccugccuguguggcuugcuuaucgaguagcagcagaaggaaucaauuaugcagaucgacgaugguguuuugacggagucaagaacaaucagauacuugaagaaaaugucgaaguagagaucuggacaaaagaaggggagagaaagaaauugaaaccacgcugguuagacgcucgaauuuacagugacccauuagcucuuaaagaguuuaaagaguucgcugccggacgaaagagucuuacgcuaaaucugauaacugaaauggguagacuccccaccuuuaugacucaaaaagcgcgaaaugccuuagauaaccuggcagugcuucauacagcagaagcgggaggaagggcauacaaucaugcguuaucagaguuaccugaaaccuuggaaacacuccuacuacucacccuacuagcuacagugaccggagguaucuucuuguuccucaugaguggaaaaggaauuggaaagaugacacuagguauguguuguauaguaacugcaaguauauuauugugguaugcacagauacaaccacacuggauugcagcguccauuauauuagaguuuuuuuuaaucguacuacuuaucccggaaccagagaaacaaaggacuccucaagacaaccaacuaacuuaugucguuauagcaauauugacagugguagcggcuacaauggcaaaugaaaugggcuuucuggaaaaaacaaaaaaagauuuuggacucggaucaauuaccacacaacaaccugaaucaaacauacuagauauagaccuacgcccggcuagcgccuggacauuauacgcaguagcuacuacauuuauaacucccaugcuccgucauucuauugaaaacucaaguguuaacguuucauuaacagcaaucgcuaaccaagccacaguguuaauggggcucggaaaaggguggccucuuucuaaaauggauauaggaguuccauuacuagcaaucggauguuauagucaagugaacccaauuaccuuaacagcugcgcuuuuacugcuaguggcucauuacgccaucauuggaccugggcuacaggccaaagcuacgcgggaggcucaaaaaagagcagcugccggcauuaugaaaauacccgcagcagacauugggcgugucauugaccuggauccuauacccuaugaccccaaauucgaaaaacaguuaggccagguaauguugcuggucuuaugugucacucagguucuuaugaugagaacuaccugggcauuaugugaggcuuuaacacuugcaacuggaccaaucagcacacugugggaggguaauccugggagauucuggaauacuacaauagcuguuucuauggcaaauauauuccguggaaguuacuuagcuggcgcggggcuccuguucuccauaaugaaaaauacggcaaauacuagacgcgggaccgguaauacuggugaaacacuaggcgagaaauggaagaaccaguuaaacgcccuaggaaaaagugaauuucaaauuuauaagaaauccggaauucaagaaguagaucguacuuuagccaaagagggaauuaagagaggggagacugaucaucaugcaguaucgaggggaagugcgaaauugcguugguuuguggaaagaaauuuaguaacaccugaagggaaggugguggaccuagguugcggaagagguggauggaguuacuacuguggcggacuuaaaaauguuaaagaaguaaagggauugaccaaaggagggccagggcaugaagaacccauuccaaugucuaccuacggcuggaaccugguacgauuacaaucgggaguagaugucuuuuucacacccccugaaaagugugauacacuucuaugcgacauuggugaaagcucaccgaauccaaccguugaagccggaagaacgcucagggucuuaaaccuaguggaaaauugguuaaauaacaacacucaauuuugcaucaagguucuuaauccguauaugccgucuguuauagaaaagauggaagcgcuucaaagaaaauacggaggagcauuaguacguaacccgcuaagcaggaauaguacccaugaaauguauugggucucaaaugcgaguggcaacauugugucaucgguuaauaugauuagcaggaugcuaauaaaccgguuuaccaugagacauaaaaaagccacauacgagccagacgucgaucuggggucaggcacuagaaacauaggcauugagagcgaaguaccaaauuuggacaucauugguaagagaauagaaaagauaaagcaagaacaugaaacaucauggcauuaugaccaagaccacccguacaaaaccugggcuuaucacggcaguuaugaaacuaaacaaacggguagcgcaucuucaaugguuaauggggucguacgacucuugaccaaaccgugggacgucauucccaugguuacacagauggcuaugacagauacuacgccuuuuggccaacagcgaguuuuuaaagagaaaguggauaccagaacucaagaaccuaaggaagguacaaaaaaacuaaugaaaauuacagcagaaugguuauggaaagagcuuggaaagaaaaagacuccaagaaugugcacacgagaagaguuuacaaggaaaguacgauccaacgcagcauugggagcgauauucacagacgaaaauaaauggaagucagcuagagaagcuguugaggauucaggauucugggaacugguagacaaagaacgaaaccuccacuuagaaggaaagugcgagacuuguguuuauaacaugaugggaaagagagaaaagaaguugggagaguuuggaaaggcuaaaggaucccgcgcaauuugguacauguggcuuggagcgagguuucuagaguuugaggcacuuggcuuccuuaaugaggaucacugguuuucgagagagaacuccuuaagcggagucgaaggagaagguuuacauaaauuggguuacaucuugagggauguuaguaaaaaagaaggaggugcuauguaugcugaugauacugcuggaugggauacgcgcaucacguuagaagauuuaaaaaacgaagaaauggugacaaaucacauggaaggcgagcauaaaaaauuagcggaggcaaucuucagacugacauaucaaaacaaaguaguuagaguucaaagaccaacaccaagaggaacgguaauggauauaaucaguaggagagaucaaagaggcagcggacaaguagucacauauggguugaauacuuuuacgaauauggaagcacaacugaucagacagauggagggagaaggaguauuuaagucaauacaacauuuaaccgcaaccgaggagaucgcugucaagaacuggcucguacgagucgggcgagaaagacucucacgaauggcaauauccggcgacgacugugucgucaaaccauuagaugaucguuucgcuaaugcuuuaacggcucuaaaugauauggguaaaguaagaaaggacauacaacaaugggagccuucacgaggguggaaugacuggacucaaguuccauuuuguagucaucauuuccacgagcuaauaaugaaagauggaagggucuugguaguaccaugcaggaaucaagacgagcuuauagggagagcacguauuucacagggggcaggauggagccucagagaaacagcuuguuuagguaaaucauaugcucagauguggagccuaauguauuuucaucgaagggauuuaagacuugcagcgaacgcuaucuguucugcugugccuucacauuggguuccaacauccagaacaacauggucgauacacgcaacacaugaauggaugacaacagaggauaugcuuacugucuggaaucguguuuggauacaagaaaauccuuggauggaggacaaaacaccagucgaaucuugggaggaaauaccguauuuagguaagagagaagaccaguggugcgguucuuuaauaggucucacaagucgggcuaccugggcaaagaauauacaaacggcgauaaaccaggugagaucacuaauuggcaaugaagaauacacagauuauaugccuagcaugaagcgauuccgacgcgaggaggaagaagcuggcguacugugguag

SEQ ID NO: 22222 - RNA, 9876 nt, Artificial Sequence
  derived and/or modified CDS sequence (opt6) from DENV-2__KX380819__SS-prME
acugcagguauuauuaucaugaugauaccuaccgucauggcauuucacuuaacaacuaggaacggagaaccgcauaugauagugagucgccaagaaaaaggaaaaucauuauuguucaaaacugaaaauggaguaaacaugugcacucuuauggcaauggacuuaggggaauuaugugaagauacuaucacauauaacuguccacugcugagacaaaaugaaccagaagacauagacuguugguguaauucaacaucuacaugggugacuuacggaaccugcacagcuacaggagaacauagaagagaaaaacguaguguugcauuaguaccacacguagguaugggucuggaaacgaggacugagaccuggaugagcagugaaggggcauggaaacacgcacagagaauugaaaccuggguucuucgacauccagguuuuaccgugauggcagcaauucuugcuuacacaauaggcacaacguacuuccaacgcgucuuaauuuucauauuauuaacggcuguugcuccuuccaugacaaugcguugcaucgguauaucgaauagggauuucguagaaggcauauccggaggaaguuggguagauauagucuuagaacacggaucaugcguaaccacuauggcuaaaaacaaacccacucucgauuucgaacugauuaaaacugaagcuaaacauccggcaacuuuaagaaaauauuguauagaagcgaagcucaccaauacuacaacagccaguagauguccaacccaaggggaaccuaguuuaaacgaagaacaagacaaaagauuuguaugcaaacacuccaugguagaucgcggguggggaaacggauguggucuauuuggaaaaggaggaauuguaacaugcgccauguucacuugcaagaaaaacauggaagguaaaaucguacaacccgaaaauuuggaauauacaauuguaauaacuccgcacucaggagaggaaaacgcgguagguaaugacacaggaaaacacgguaaagaaauaaaagucacgccucaaaguaguauaacagaagcggaacuuaccggguacggaaccgcuacgauggaauguuccccaagaacuggauuggauuuuaaugaaaugguacuacuacaaauggagaacaaagcaugguuaguacaucgucaaugguuccuugaucuuccuuuaccgugguuaccuggagccgauacgcaaggaagcaauuggauccaaaaagaaacgcuuguuaccuuuaaaaauccgcacgccaagaaacaagauguaguaguauuaggaagccaagaaggugccaugcauacugccuuaacaggagcgacagaaauacaaaugucaucgggaaacuuauuauucacugggcacuugaaaugucgacuccgaauggauaaacuacaauugaaaggaaugagcuauaguaugugcacagguaaauucaagguuguaaaagaaauugccgaaacucaacacggcacgauuguaauaagaguucaauaugaaggagacggaagcccaugcaaaauaccguucgaaauuauggaucuggagaaaagacauguccuggguagacuaauaacggucaaucccauagugacagagaaggacuccccuguaaauauagaagcagaaccuccauucggcgacagcuauauaauaaucggagucgaaccaggacaauugaaauuaucuugguucaagaaaggaucgucuauaggacaaauguucgaaacaacaaugagaggugcgaaaagaauggcaauauuaggggauacugccugggauuuuggaagccuaggaggagucuuuacaaguauaggaaaagcacuccaccagguuuucggugccauuuauggagcggcguuuaguggaguuagcuggacaaugaaaauuuuaauuggaguagucauaacuuggauuggaaugaauaguagaucuacuucacuuagugugagccuaguauuggucggaauuguaacuuuauaccuagguguuauggugcaggcagauagugguugugucguaaguuggaagaauaaggaacuaaaaugcggcagcgguauuuucaucacugacaauguucacacauggacagaacaauauaaauuucaaccagaaucuccaaguaaauuagccagcgccauucaaaaagcacaugaagagggaauauguggaaucagaucagucacuaggcuugaaaauuuaauguggaaacaaauaaccccugagcucaaucacauuuuaagugaaaaugagguuaaacucacaauaaugacgggugauauaaagggaaucaugcaagcagggaaaaggucuuugagaccccaacccacugaacugaaauauuccuggaaagcaugggguaaggcuaaaauguuaagcacugaauugcacaaucauacuuuucuaauagacgguccggaaacagcugaaugccccaauacaaauagagccuggaauagccuugaaguugaggacuauggguucggcguauucacaacaaauauaugguugaaacuuaaagaaagacaagauguauuuugcgauagcaagcucaugucagcagcuaucaaagacaauagagcaguacaugcggauaugggcuacuggauagaaagcgcauuaaaugauaccuggaaaaucgaaaaagcuaguuuuauagaagugaaaaguugccauuggccuaaaucucauacuuuauggucaaauggagugcucgagucugaaaugauuauacccaaaaacuuugcagggcccguaucucagcacaacuaucggccaggcuaucauacgcaaaccgcaggaccauggcauuuaggacgauuggagauggauuucgauuuuugcgagggaacaacaguaguugucacagaggacugugguaaucguggcccuaguuuaagaacaacaaccgcauccgguaaacuaaucacagaaugguguuguaggucaugcacgcuuccgcccuuaagauaucgaggugaagacggauguugguacggcauggaaauaagaccacuaaaggaaaaggaagagaaccugguaaacucccucguuacggccggacacggucaaauagauaauuucucguuaggaguguuaggaauggcuuuauucuuggaggagaugcuaagaacuagggucggaacaaaacaugcuauccugcuagucgcagucagcuuuguaacauuaauuacuggaaauaugagcuucagggacuuaggucggguaaugguaaugguuggcgcuacaaugacagaugacauaggcaugggggucacuuauuuagcacuauuggcugcguuuaaaguaagaccaacauuugcagcuggccucuugcugagaaagcucacaucuaaagaauuaaugaugaccacaauugguauaguuuuacuuucacaaaguacaauuccggagaccauuuuagagcugacagacgcauuagcucuugguaugaugguuuuaaaaauuguccgaaacauggaaaaauaccaguuagcugucacuauaauggcuauucuuugcguuccuaacgcugugauacuccaaaaugcauggaaaguaucuuguacaauacucgcugugguuucgguaaguccauugcucuuaacaaguucucagcaaaaagcugacuggauacccuuagcgcuaacgaucaaagguuuaaacccaacggcaauauuuuugacuacacuaucccgcacaucaaagaaacguucguggccucucaaugaagcuauaauggcagugggaaugguuucuauacuagcauccaguuuguuaaagaaugacauccccaugaccggaccucuaguagcuggaggcuuauuaacaguguguuauguucuaacggguaggucagcugacuuggaguuagagcgugcugcugauguaagaugggaagaacaagcggaaauaucagguucuaguccgauauuaaguauaacuauaagugaagacggcucuaugucuauuaaaaaugaagaagaagaacaaacacugacgauacuuauacggacaggccuguuaguaauaaguggacucuuuccgguaucuauaccgaucacggccgcagcaugguacuugugggaagugaagaaacagagggcgggagucuuaugggaugucccgagcccgccuccuguaggaaaagcggaauuagaggauggagccuauaggauaaaacaaaaagggauucuaggguauucgcaaauaggcgcugguguauauaaagagggcacuuuccacacgauguggcauguaaccagaggagcggugcuaaugcacaaaggcaaaagaauugaaccaaguugggcggauguaaagaaagacuuaauaagcuacgggggaggcuggaaacuugaaggugaauggaaagaaggcgaagagguacaaguauuggcacuagaaccugguaaaaauccgcgggcaguacaaacgaaaccaggauuauucaaaacgaauacugggacaauaggggcuguuaguuuagacuuuucaccgggcaccucgggaaguccgaucgucgauaagaaaggcaaagucguuggccucuaugguaauggaguggucacgcgguccggcacuuacguaucagcuauagcacagacagagaaaucaauagaggauaauccugaaauagaagacgauauauucaggaagaaaagacuuaccaucauggacuugcauccaggagcaggcaaaacaaaaagguaccuuccugcaauuguaagggaggcuauaaaaaggggauugagaacacuaauccuggcaccaacucgaguaguugccgcagagauggaagaagcacuucgaggauuaccaauuagauaucaaacaccagcaauaagagcagagcauacagggagagaaaucguagacuugaugugccacgcaacguucacaaugcgucuacugucaccuauuagaguaccaaauuacaaucugauuauaauggacgaagcacacuuuacggauccggcaucaauugcugccagaggauauaucagcacgaggguggaaaugggcgaggcagcagguaucuuuaugacggcgacacccccgggauccagagauccuuucccccagaguaacgcuccgaucauggaugaggaacgugaaauaccagaaagauccuggaacucugggcaugaauggguuacggacuucaaagggaaaaccguuugguuugucccgaguauaaaagcgggaaacgacaucgccgcaugcuugaggaaaaauggcaagaaagucauccaacuaaguaggaaaacguucgauucggaauauauuaaaacaaggacuaacgacugggauuucguaguaacaacagauauuucagaaaugggugcaaauuucaaagcugaaaggguuauugauccuagaaggugcaugaaaccagucaucuuaaccgauggugaagaacgcguuauuuuagcuggacccaugcccguaacucacucuagugcggcucaaagaagagguagaguugggagaaaucccaaaaacgaaaaugaccaguacauuuauaugggggaaccauuagaaaacgaugaggacugugcccauuggaaagaggcaaaaaugcuacuagauaauauuaauaccccagaaggcauaauaccuaguauguuugagccagaaagagagaaaguagacgccauugacggagaguauagacuccgcggcgaagcgcgcaaaaccuucguggauuuaaugcgaaggggugaccugccaguuuggcucgcuuaucgaguagccgcagaagguauaaauuacgccgaucgacgaugguguuuugacggaguaaagaauaaucaaaucuuagaggaaaacgucgaaguugaaauuuggacaaaggaaggagaaaggaagaagcuaaagccuagguggcucgacgcuaggaucuauagugauccacuagcucuaaaggaauuuaaggaauuugcggcaggccguaagucgcugacacuaaaucuuauaaccgaaaugggaaggcuaccaacauuuaugacccaaaaagcucgcaaugcuuuagauaaucucgcaguucuacauacagcagaagcaggaggcagggcauacaaucaugcauuaucagaacucccagaaacauuggaaaccuuauuacugcucacuuuacuugccacugucacugguggcauauuuuuauuccugaugucuggaaaaggaaucggaaaaaugacacuagguauguguuguauuauaaccgcgucgauauuacuaugguacgcacagauacaaccacauuggauagcggccucaauaauacuagaguucuuucucauaguucucuugauuccggagccugaaaaacaaaggaccccgcaagacaaccaacucacguauguaguaauugcaauauuaacaguaguugcagccacaauggcuaaugaaaugggauuucuagagaaaaccaagaaagauuucggauuagguaguauaaccacccagcaacccgauuccaauauuuuagacauugauuugaggccagcaucugcuuggacacuauaugcugucgcaaccacauuuauuacaccuaugcuacgucauagcauagaaaauucgagcguuaaugucagucuaacagcuauugccaaccaagcaaccguguugaugggguuagggaaagguuggccauuaaguaaaauggacauagguguaccauuacuugcaauaggcuguuacagucaggugaauccaauaaccuuaaccgcagcguugcuguuauugguagcucauuaugcaauuauugggccaggucuucaggcaaaagcaacgcgugaagcccaaaaacgugcggcugcggggauaaugaaaauaccugcagcacuaauugguaggguuaucgaucuugauccuaucccauaugauccaaaauucgagaagcagcucggacaagucaugcuauugguauuaugcguuacacaaguacuuaugaugaggacaacaugggcguuaugugaagcacuaaccuuagcaacaggccccauuucuacauuaugggaagggaauccuggacgauuuuggaacacaacuaucgcagucaguauggcaaauauuuuuagggguaguuacuuagcaggagcagguuuauuguuuucuauuaugaagaauacugcaaauacaagacggggaacagggaauacuggcgaaacauugggagaaaaguggaagaauaggcuuaacgcacuaggaaagagcgaauuucaaauauauaagaaaagcgggauucaagaaguagauagaacacuagcgaaagaagggaucaaacgcggagaaacagaccaucacgcagucucgcgcgggucugcuaaauuacgaugguucguagaaaggaaccuaguaacuccugagggcaagguuguugaucuaggguguggaagaggaggauggaguuacuauugcggaggucuaaagaacguaaaggaagugaagggguugacuaaaggcggcccugggcaugaggaacccauaccgaugucuaccuacgguuggaauuuagugagauuacaaucuggaguagauguauucuucacaccuccagagaaaugcgauacuuuauuaugugacaucggagaaagcucgccaaaccccaccguugaagccggaagaacuuuaagaguauuaaauuugguugaaaauuggcuuaauaauaauacacaguuuuguauuaaaguucucaaucccuauaugccaagcguaauugagaaaauggaagccuuacaaagaaaauacgguggugcacucgugcguaauccuuugaguagaaauaguacacacgagauguacuggguuaguaacgcuucaggaaauauuguuuccagcguuaauaugauaucucggauguugauaaauagauucacaaugaaacauaagaaagcaaccuacgaaccagacguugaccuuggaucaggaaccagaaacauaggaaucgaauccgaaacaccuaaucuggacauaaucggcaagagaauagagaaaauaaaacaagaacacgaaacaucuuggcauuaugaccaagaccauccguacaaaacaugggcauaucauggcucuuaugagacaaagcagacgggaagugcuagcucaaugguaaauggaguaguaagacuacugacaaagcccugggacguaauaccaauggugacccaaauggcaaugaccgauacuacaccuuucggucaacaaaggguuuuuaaagaaaaaguugauacacgaacccaggaaccaaaagaggguaccaagaaacuaaugaagaucaccgcagaauggcuauggaaggagcugggcaagaagaaaacucccagaauguguacucgagaagaauuuacgcgcaagguacgcucaaaugcugcauuaggcgcuaucuucacagacgaaaauaaauggaaauccgcuagagaagcggucgaagacaguggguucugggaauuaguggauaaggaaagaaauuuacauuuagaagggaaaugcgaaacgugcguauauaauaugauggggaaaagagaaaagaagcuaggcgaguucgguaaagcaaaaggaaguagagcaauaugguauaugugguugggcgcaagguuccuagaauuugaggcauuaggauuucuaaaugaagaccacugguuuucuagagaaaacucccuuucagggguggaaggcgaaggucugcauaaacuggguuauaucuuacgagauguaucaaagaaagaaggaggggcuauguacgccgaugacacggcggggugggacacccgaauuacauuggaagaucuuaaaaacgaagagauggugacuaaccacauggaaggggaacacagaaaacuagccgaagcaaucuuuagauuaacguaucaaaauaaaguuguacgaguacaaagaccgaccccacgaggaacuguaauggauauaauuucccguagagaucaaagaggcucggggcaaguaguaacguauggacuuaauacauuuacaaauauggaggcucaauuaauaagacaaauggaaggugagggaguuuuuaaguccauccagcauuuaacggugacagaagagauagcagucaagaacugguuagagagaguaggacgagaacgguuaucacgcauggcaauaucgggagaugacuguguggucaaaccucuugaugaucgcuucgcauccgccuuaacugcauuaaacgauaugggaaaaguuaggaaagacauacaacagugggagccaaguagaggcuggaacgauuggacccaaguaccuuuuugcucacaucauuuucaugaacuuauaaugaaagacggcagaguccuugucgucccaugccgcaaucaggaugaacuaauaggacgggcaagaauuucccaaggagcggguuggucccuacgugagacagcuugucuuggaaaaucauaugcccaaauguggagucuaauguauuuucacagaagagaucuaagguuagcugccaaugcuaucuguagcgccgugccgucacauugggucccgauaucgagaacuacuuggagcauacacgcaacacaugaauggaugacaacagaagauaugcucaccgcauggaaucgaguauggauucaagaaaacccuuggauggaagacaaaacaccaguagagagcugggaagagauccccuaucuaggaaaaagagaagaucaauggugcggcucucuuaucggcuuaacgucacgagcaacuugggccaaaaauauacagacggccauaaaccaagucagaucgcucaucggaaaugaagaauauacagauuacaugccaucaaugaaaagauucaggagagaagaggaagaagcggggguuuuaugguaa

SEQ ID NO: 22223 - RNA, 9876 nt, Artificial Sequence
  derived and/or modified CDS sequence (opt6) from DENV-2__KX380821__SS-prME
acagcuggaauaauuaucaugaugaucccaacagucauggcauuucacuuaacgacccguaauggugaaccucauaugauugugagcagacaagaaaagggaaaaucacuuuuauuuaaaacagaaaauggcguaaacauguguacacuuauggcaauggaucuaggggaauuaugugaagauacuauuaccuauaacuguccucuccuacgacaaaaugagccugaggacauugauuguuggugcaauucaacgaguacaugggucacuuaugguacaugcaccgcuacuggagaacauagaagagaaaaaagguccguagcguugguaccacauguggguauggguuuagaaacgagaacagagaccuggauguccuccgagggagcauggaagcacgcacaacgaaucgaaaccuggguucuucgacacccuggauuuacgguaauggccgcaaucuuagcauauacaaucgguaccacuuauuuccaacggguauuaauuuucauccuuuugaccgcaguagcccccuccaugacaaugcgauguaucgguaucucuaaccgggauuuuguagaagggguaucgggaggaucauggguggacaucguccuugaacacgggagcuguguuacaacuauggcaaaaaacaaaccuacccuggauuuugaauuaauuaagacggaagcaaaacauccugcuacauugagaaaguacugcaucgaagcaaagcugacaaacacaacuacugcgagccguugcccuacacaaggagagccaagucuaaacgaagagcaagauaaaagauucguguguaaacauucuauggucgaccgagguuggggcaaugggugugggcuguuuggaaagggaggaauagucacgugugcaauguuuacuuguaaaaaaaacauggaagggaaaauuguucaaccagaaaauuuggaauauacaauaguuaucacaccccauucuggggaagagaaugcagucggaaaugauacgggaaaacauggaaaagaaauaaaagucacuccucaaagcucuaucacugaagcggaauuaacgggcuauggaacggcuaccauggaauguucaccucggacggguuuggacuuuaacgaaaugguauuguugcagauggaaaacaaagcauggcugguccacagacaaugguucuuagaccuuccuuugccuuggcuaccaggagcagauacccaagguucuaacuggauucaaaaagaaacucuuguuaccuuuaagaauccacacgcuaaaaaacaagauguagucgugcuugggucgcaagaaggugcaaugcauacagccuugacuggggcaacagagauucagaugucguccggcaacuuacuauucacaggacaucugaagugcaggcuccgcauggauaaacugcaauuaaaagguaugucguauagcauguguaccggaaaguucaaggucgucaaagagaucgccgaaacucagcauggcacuauuguuauaagaguacaauacgagggcgauggaucuccaugcaagauaccguuugaaauaauggacuuagaaaaacgccauguucugggacguuuaauaacuguuaauccgaucguuacggaaaaggacucgcccgucaauaucgaagcugaaccgcccuuuggagauucguacauuauuauagguguugaaccuggucaacuaaaacugaguugguucaaaaaaggcuccaguauuggucaaauguuugaaacaaccaugcgcggugcuaaacgaauggcgauucuaggcgauaccgcuugggauuuuggcucauuagguggcguuuuuaccuccauaggaaaggcuuuacaucaaguauucggugcaaucuacggugccgcguuuagugguguaaguuggacgaugaagauccuuauaggaguagucauaacauggauagguaugaauucacguucuacaucuuuaaguguuaguuuagucuuaguggguguaguaacgcuauaucuuggaguaaugguucaggccgauaguggaugcgucguuucuuggaaaaauaaagaauugaaaugcgguagcggcauuuuuauuacugauaauguacacacauggacagaacaauacaaauuccaaccggaaucacccagcaaacuagcgucagcaauacaaaaagcucacgaagaggguauaugcggaauuagaaguguaacuaggcuagaaaaccucauguggaaacaaauuaccccagagcuaaaucauaucuuaacagagaaugaaguuaaacuaacaaucaugaccggugacauaaaaggaauaaugcaagcuggcaagagaacauuacgcccgcaaccgaccgaauuaaaauauucauggaaagcuugggguaaagcaaaaauguuaucuacagaacuacacaaucacacauuccuuaucgacggaccugaaacagcagagugucccaauaccaauagagccuggaauucauuggaaguugaagauuacgguuuuggaguuuucacgaccaacauuuggcuuaaauuaaaagaacgccaggauguuuucugugauaguaaacugaugagugcugcuauuaaagacaauagagcaguacacgcagauaugggauauuggauagaaagcgcguuaaacgauacauggaaaaucgagaaagcuucuuuuaucgaaguuaagucgugccauuggcccaaaucccacacacuaugguccaaugguguacuugaaagcgaaaugauaauaccuaagaauuuugcugguccagucagucaacauaacuaucgacccggcuaccauacucaaaccgcuggaccguggcaccuagguagacuagaaauggacuucgacuucugugaaggaacgacuguaguaguuaccgaagacugugguaaccgugggccaucauuaagaaccacuacagcaagcggcaaacuaaucacagaaugguguugccguucgugcacacuacccccucugagguaccgaggugaagauggcugcugguauggaauggaaauucgccccuuaaaagaaaaagaggagaacuugguaaauucccuuguaaccgcgggccacggacaaauagacaauuuuucucuuggaguacuaggaauggcacuuuuccuugaagaaaugcuacguacgcgaguaggaaccaaacacgcgauacuccuuguggcaguuagcuuuguaacucugauuacaggaaauaugaguuuucgcgacuuaggacgaguaaugguaaugguuggagcaacuaugacagaugauauaggaaugggagugaccuacuuagcauuauuagcugccuucaagaucagaccuacauuugcugcaggccuucuauugaggaaguuaacaagcaaagaauuaaugaugacaacaauagguauaguuuugcuaucacaaagcaccaucccugaaaguauacuugagcugacugacgcgcuugcauugggaaugaugguauuaaaaauuguaaggaauauggaaaaauaccagcuagcggucacaauuauggcaauauuauguguaccaaacgcugucauucugcaaaaugcguggaaaguaucauguacaacacuggcugucgucagcgucucgccauuauuacuaaccucaagccaacaaaaagccgauuggaucccguuggcacuaacgauaaagggauuaaaucccacugcgauuuuccuaacuacccuaucacguaccucuaaaaaaaggagcuggccuuugaacgaagcuauaauggcuguuggcaugguaucaaucuuggcgucaucucuuuuaaaaaaugacauacccaugacugggccguuaguagcaggaggauuguuaacaguuuguuacgugcucacaggacgaagugcagauuuagagcuugagcgagccgcagauguacguugggaagaacaggcugaaauuaguggaagcaguccuauucuaucgaucacaauaagugaagacgguucuaugaguauuaaaaacgaagaagaagaacaaacacuaacaauucuuaucaggacgggacuacuugugauaagcggauuauuucccgugagcauuccgauaacagcagcggcaugguaccucugggaagugaaaaaacaacgugcaggaguauuaugggauguacccagcccaccuccuguggggaaagcagagcuugaagacggugccuauagaaucaaacaaaaggguauauuaggauauucgcaaauaggugcuggcguuuacaaagaggguacuuuucacacgauguggcacguaacaagaggggcaguuuuaaugcauaagggaaaacgcauugaaccaucuugggcggacguuaaaaaagaccuuauaucauaugggggaggguggaaacuugaaggagaguggaaagagggagaggaaguucaaguucuugcauuagagccaggaaaaaauccccgugcgguacaaacgaagccuggauuauuuaaaacaaauacagggacaauuggcgcugucagcuuagauuucaguccagggaccucagggucuccaauaguugauaaaaaaggaaaggucgucggauuauacggcaacggaguagucacacguucagguacauauguuucugccauagcgcaaacagaaaaaucaauagaagauaauccagaaauagaggaugacauauuucgaaaaaaaaggcuuacgaucauggaccugcauccuggugcaggaaagacaaaaagauaucuaccagcaaucgugagagaggccaucaagaggggauugaggacacuaauauuagccccuaccagggucguugcagcagaaauggaggaggcauuacgcgggcucccuaucagauaccaaacucccgcuauaagagccgagcauacgggaagggaaauuguagaccuaaugugucacgcaacguuuacaaugagacuuuuaucucccaucagaguuccuaauuacaauuuaauaauaauggaugaagcacacuucacagauccugcaaguaucgcugcucgcggauacauauccacacguguugaaaugggagaggcagcuggcauauucaugacugcaacuccaccagggucgagagauccauucccgcaauccaacgccccaaucauggaugaagaaaaggaaauaccagaacggucuuggaauagcggucaugaguggguuacagauuuuaaagggaaaaccgucugguucguaccaagcauuaaggcaggaaaugauauagcagcuugcuuacgaaagaacggaaaaaaaguaauccaauugucgagaaaaacuuucgauagcgaauacauaaaaacgcgaacaaaugacugggauuuugugguaacgacggauauuucagaaaugggugccaacuuuaaggcagaaagaguaauugacccaagaagauguaugaaaccagugauuuuaacagauggcgaggaaagagugauauuggcgggcccaaugccaguaacgcauuccucugccgcacaacgacgagguagaguaggaagaaacccaaagaaugagaaugaucaauacauauacaugggagagccguuagaaaacgaugaggauugugcacauuggaaagaggcuaaaaugcuacuagacaauaucaauacaccugaaggcauaauaccgagcauguuugagcccgaaagagaaaagguugacgcgauagauggcgaauauagacuccgaggagaggccagaaaaacauuuguggaccuuaugagacguggugaccugccagucuggcuugcuuauaggguagccgccgaaggaauuaacuacgcagauagaagaugguguuuugauggcgucaaaaauaaccaaauauuagaagagaauguagaaguagaaauauggacuaaggaaggagagagaaaaaaacuaaaaccaagauggcucgacgcucgaauuuacucagauccauuggcacuaaaggaauuuaaggaauucgcugcaggacgcaagucucuaacacuuaaccuuauuacugaaaugggacgacugccaacuuucaugacacagaaagcuaaaaaugcccuagauaacuuagcgguacuccacacagcagaggcuggggguagggcauacaaucacgcauuaucggaacuaccggaaacacuagaaacuuuauuacugcuaacucuauuagcuacugucacagguggcauuuucuuauuucugaugagugggaaggggauaggaaagaugacauuaggaauguguugcauaauaacggcuuccauccucuuaugguaugcacaaauucagccacacuggaucgcagcaucgaucauauuagaauuuuuucuuauuguucuauuaauaccugaaccagaaaagcaaagaaccccgcaagacaaccaguuaacguaugucguaauugcuauucugacaguuguugcagcaacuauggcuaaugaaaugggauuucuagaaaaaacuaaaaaagauuuuggucuggguucaauaacuacucaacaaccugaaucaaauauucuagacaucgauuuacgcccugccagugcguggacguuguaugcuguagcaacuaccuuuauaacuccgaugcuacgccauaguauagaaaacucuagcgugaacguuucguugaccgccauagcaaaucaagcaacaguucuuaugggucuagguaagggcuggccucuuaguaaaauggauaucggagugccacuguuagcuauagguuguuauagccaaguuaauccaaucacgcugacggcagcacuuuuauugcuuguagcacauuaugcgaucauugguccagguuuacaagcgaaagcuacacgcgaagcacaaaaaagggcagcagcagguauaaugaagaacccaacaguagauggcaugacagucauagauuuagacccuaucccauacgacccuaaguuugaaaaacaauugggucaaguaaugcuucuuguacuuugcguuacccagguacuaaugaugcgaacgaccugggcacuuugcgaagcguuaacucuagcgacuggaccuauaucuacacuaugggaaggaaaccccggaagauucuggaacacaaccauagccgucaguauggcaaacauauucagagggucauaccuagcaggagcaggcuuacuauucucaaucaugaaaaauacggcuaauacaagacgaggcacugguaacacaggagaaacacuaggcgagaaauggaagaauagguuaaacgcacuggguaagagugaguuccagauuuauaagaaaucaggcauccaggagguagaccgcacuuuggcgaaagaaggaaucaagaggggugaaacagaucaccaugcaguuuccagaggaucagccaagcuccggugguucguagaaaggaaccucguaacacccgaaggaaaaguuguagaucuagguuguggaagaggggguugguccuacuauugugguggacuaaagaauguaaaagaagugaaggguuugacaaaaggaggcccugggcaugaggaaccaauuccgaugagcacauacggauggaaucuagugagauugcaaagcgguguugaugucuuuuucacgccaccugaaaaaugugacacauuacucugugacauuggggaaucaucgccgaacccuaccguagaagcuggacgaacccuuagaguacuaaacuuaguugagaauuggcuaaauaacaacacucaauuuuguauuaaaguacuuaaucccuacaugccuucugucauagagaaaauggaagcucuccaacgcaaauauggaggcgcauugguacgaaacccacuaagcagaaauucgacacacgaaauguauuggguuucaaacgcgagcggcaacauagugaguagugucaacaugaucagccgaaugcugauaaaucguuuuacaaugcgucacaagaaagcaacauaugagccggauguggaucuagggucuggaacaaggaacaucggcauugaaucagaaacuccuaaucuugauaucaucggaaagagaaucgagaaaauaaaacaagaacaugaaaccucauggcauuacgaucaggaccaccccuacaaaacaugggcauaucauggaaguuacgaaacaaaacaaacaggaagugccucaucuaugguaaaugguguaguaagauuauuaacuaaaccaugggaugucauaccaauggugacucaaauggcuaugaccgacacgacuccauucggucaacaaagaguuuuuaaagaaaaaguugauaccagaacacaagagcccaaagaagguacaaagaaacuuaugaaaauaaccgccgaauggcuguggaaagaacuaggaaagaagaagacaccgaggauguguacucgagaggaauuuacuagaaagguacguucaaaugcagcauuaggcgcuauauucacggacgaaaacaaguggaagucugcacgcgaagcuguagaagauaguggauuuugggaacuaguggacaaagaacgaaauuugcacuuagaagguaaaugugaaacuugcguauacaauaugauggggaagcgagaaaaaaaacugggugaauucgggaaagcaaaaggaucaagagccauuugguauaugugguuaggcgcacgauucuuagaauucgaagcacuaggguuccuuaacgaggaccacugguucagcagggaaaauucacuaucuggaguagaaggagaaggcuuacauaagcugggcuauauuuuaagggauguaaguaaaaaagagggcggcgcuauguaugcagaugauacagcaggaugggacacaaggauaacauuagaagaucucaagaaugaagagaugguaacuaaucauauggagggcgagcacaagaaauuagccgaggcgauuuucaaauugacguaccagaacaaaguaguacgaguucagcguccuacaccgcggggaacgguaauggauaucauaucccgaagagaccaacgaggcuccggucagguaguuacuuacggacuaaacaccuucacuaauauggaagcgcaauuaauccgacagauggaaggagaaggaguguucaaaagcauacaacaauuaaccguaaaagaagaaaucgcagucaagaauugguuaauaagaguuggcagagaacgacuaagcagaauggcaaucuccggagaugacugcguagucaaaccauuagaugauagauucgcaucggcauuaacggccuuaaaugacaugggcaaaguuagaaaggauauacaacaaugggagccuagccgaggauggaacgacuggacacaagucccauuuugcagucaccacuuccacgaacuuauuaugaaagaugguaggguauugguuguucccugucgaaaucaagacgaacuaauuggacgugcccgcauaagccagggugcugguuggagucuacgagaaacggcaugucuagguaaaucuuacgcucaaauguggucauuaauguauuuccauagaagagaccuaagauuggcagccaaugcaauuuguucagcagucccuucucauuggauaccaacgucacgaacaacauggucaauacacgcuacacaugaauggaugacuacggaagacaugcuuacaguguggaacaggguauggauucaggagaauccauggauggaagauaaaacccccguugaaucaugggaagagauacccuaccugggaaaaagagaagaucaaugguguggaucacuaauuggcuugacuagccgugcaaccugggccaaaaauauacagacugcuauaaaucagguacguagucuaaucggaaacgaggaauacacggauuauaugccaucaaugaagagauuccgacgugaagaagaggaagccggaguacuaugguaa

SEQ ID NO: 22224 - RNA, 9876 nt, Artificial Sequence
  derived and/or modified CDS sequence (opt6) from DENV-2__KX380822__SS-prME
acagcagguauaauaaucaugaugaucccaaccgugauggcguuucauuugacaacuagaaauggagagccacauaugauuguaucuagacaagagaagggaaaaucacuauuauuuaagacagaaaauggcgugaauauguguacuuuaauggccauggaucuaggugaauuaugugaagacacaauuacuuauaauuguccauuacuacggcaaaaugaacccgaggauauagacugcuggugcaauucgacgucaacguggguuaccuaugggaccugcacagccacgggagaacauagacgggagaagagaucgguagcuuuaguuccacauguggggauggguuuagaaacccguacggaaaccuggaugucuagugagggagccuggaaacacgcacaaagaauagaaacauggguacuaaggcacccggguuucacaguaauggcugcgauuuuagccuauacaauagggaccacguacuuccaaagaguauugauauucaucuuacuaacagcaguugcgccuagcaugacuaugagaugcauaggaauaagcaacagagacuucgucgaaggcguauccggaggcucguggguugacauaguuuuggagcaugguucaugugugacaacuauggcaaaaaauaaacccacacuagauuuugaauuaauuaaaacggaagcaaaacacccugcgacuuuacggaaauauugcauagaagcaaagcuaacgaauacaacaacagcaucucggugucccacgcagggugaaccaaguuugaacgaagaacaagauaaacgauucguaugcaaacauucaaugguagauagaggaugggguaacggauguggacuuuucggaaaaggaggcauugugaccugugcuauguucacaugcaagaaaaacauggaaggcaaaauaguacaaccugaaaaucuagaguauacuauuguaauaaccccgcauucaggagaggagaacgcuguuggcaaugauacuggaaaacauggaaaagaaaucaaagugacaccccaaucgagcauaaccgaagccgaacuaacaggauaugguacagcaacuauggaaugcucaccccgcacgggguuagacuuuaaugaaaugguucugcugcaaauggagaacaaagcauggcuaguucaucgccaaugguuccuugaccuaccuuuaccuuggcugccaggagccgauacacaaggcucaaauuggauucaaaaagaaacacucguaacauuuaagaauccacaugcaaagaaacaagacgugguugugcuugggagccaggaaggcgccaugcauacagcguugacgggugcaacagaaauacaaaugaguuccgguaaucuucuauucaccgggcaucuuaaaugucggcuccgaauggacaaacuccagcuaaaagguauguccuauucuauguguacaggcaaguuuaaaguaguaaaagaaauagcagaaacucaacaugguacaaucgucauccgggugcaauacgaaggugacggcaguccauguaagauaccguucgaaauuauggaucucgaaaaaagacacguguuagggagacuuaucacagucaauccuauagucacagaaaaagauagcccgguaaauauugaagcugagccaccauuuggggacagcuauauaauuauaggagucgagcccggacaguuaaaauuaagcugguucaagaagggaagcucaauaggacaaauguuugaaaccacgaugcgaggugccaaaagaauggcgauuuuaggugacaccgccugggauuuuggaucucugggagguguauucacaagcauagguaaagcuuugcaucaaguauuuggagcaauuuauggcgcugccuucucaggggucagcuggaccaugaaaaucuuaaucggaguaguaauaaccuggaucgguaugaacagucggaguaccucccuuagcguaagucuggucuugguugguauuguaacacuuuaccuaggagucaugguacaagcagauagcgguuguguuguaaguuggaaaaacaaggagcuaaaauguggcucaggaauauucauaacugacaauguucauaccuggacggaacaguauaaauuccaacccgagaguccuaguaaauuagccucagccauacaaaaagcacacgaagaaggcaucuguggcauacggaguguuacaagauuagaaaaucuuauguggaaacaaauuacuccggaacuaaaucacauacuuagcgaaaaugaaguaaaauuaacuauaaugacgggugacauaaaggguauaaugcaagcuggaaaaaggucccugcgaccacaacccaccgaguugaaauacucauggaaggcauggggaaaggccaaaauguuaucaacagaauugcauaaccacacuuucuugauagaugguccagaaaccgcggaauguccuaauacaaacagggccuggaacucucuugaaguagaagauuauggauuuggaguguuuaccacuaauauuuggcuaaaauugaaggaacgucaggauguuuucugugauaguaaacuaaugucugcugcgauuaaagacaauagagcgguccacgcagacaugggcuauuggauagaaagugccuugaaugacacguggaagauagaaaaagccucguucauugaggucaaaucaugucauuggccgaaaagccauacacuuuggucaaauggaguccuagaaagcgagaugauaauucccaaaaauuuugcugguccagugucgcagcauaauuacagaccagguuaucacacucaaacugcugguccuuggcaucuaggaagacuagagauggauuucgauuuuugugaaggcacuacaguaguagucacugaagauugcggcaaccgcggccccagcuuacggacgaccacugccagcggcaagcuaauaacagaauggugcugucgaaguugcacauuaccaccauuacgauauaggggggaagaugguuguugguacggaauggaaauaagaccacuaaaggaaaaagaagaaaacuuaguaaauucuuuaguuacugccggacaugggcaaauagacaauuucuccuugggcguccuggggauggcacuauuccuagaggaaaugcuuaggacaagaguuggaacgaagcacgcaauucuguuggucgcaguuaguuucguuacauugauaaccgggaacaugucauuuagagacuuagggcguguuaugguaauggugggcgccaccaugacugacgauauaggaaugggaguaacuuaucuagcauuauuggcagcguuuaaaguaagacccacauuugccgcuggauuacuauuaagaaaacuuaccucuaaggaacuaaugaugaccacaaucggaaucguucucuuaucucaaucaacgauuccugagacaauacuagaacuaaccgaugcacuagcgcuuggcaugaugguccuuaaaaucguccgaaauauggagaaauaucaacuagcagucaccauuaugacgauacuaugcgugccaaaugcagucauacuacagaaugcguggaaaguuucuuguacaaucuuggcaguuguaucgguuucaccauuacuauuaacgagcucucaacaaaaagcagauuggauuccucucgcacuuacaauaaaagggcucaauccaacugcuauauuccuaacgacucucucacgaaccaguaaaaaacgaaguuggccacucaaugaggcgauaauggcaguagguaugguuaguauucuugcuaguucacuuuuaaaaaacgauauaccuaugacgggaccguuaguagcaggaggucuacucaccguuugcuauguacuaacaggacgcagcgcugacuuagagcuggaaagagccgcggaugugagaugggaggagcaggccgaaauaaguggaagcucaccaauuuuaaguauaaccauaucugaagaugguagcaugucaauaaaaaacgaagaggaagaacagacgcuaacaaucuuaauacgaacuggacuacuagucauauccggucuauucccaguuaguauaccuauaaccgcggccgcaugguacuugugggaaguaaaaaaacagagggccgguguacucugggacgucccaucucccccuccaguugguaaagcagaacuugaagacggagcauaucguaucaaacagaaaggaauucuaggauauagccaaauaggcgccggcguauacaaagaagguacauuucauaccauguggcaugugacucggggugccgucuugaugcacaaaggcaaacggauagaaccgagcugggcagacgugaaaaaagacuuaaucaguuauggugguggguggaaguuagaaggagaauggaaagaaggggaggaaguacaaguccuagcuuuggaaccugguaagaaccccagagcuguacaaacgaagccgggauuguuuaaaacuaacacaggaacaaucggagccguaagucuugauuucagcccagguacgucagguucgccaauuguagauaagaaggggaaaguuguuggucuauaugggaauggcgucguaacuaggagcggaaccuacgucucggcuaucgcacagacugaaaaaaguauugaggauaaucccgaaaucgaggacgacauuuuuagaaagaagcgacuaacgaucauggaccuccaucccggcgcaggaaagacaaaacguuaccugccagccaucguuagagaagcuauaaaaaggggucuacgcacauugauacuugcaccaacaagaguaguugccgcggaaauggaagaagcauuaagaggauuaccaaucagauaucagacaccugcuauacgagccgaacauaccggacgagaaauaguugaccuaaugugucaugccaccuuuaccaugagauuauuauccccuauaagagugccuaacuacaaccuaauuauuauggacgaagcucauuucaccgauccagcaagcauagcugcgagagguuauaucagcacuagaguggagaugggagaagcugcagguauauucaugacggcgacacccccagggucacgugauccguuuccucaguccaaugcgccaauaauggacgaggaacgagagauaccagagcgaaguuggaauaguggccaugaaugggucacugauuuuaaaggaaagacaguuugguuuguuccaaguauaaaagccggaaaugauauuacagcauguuugcgaaaaaaugggaaaaaagucauccaacuaagccgaaagacuuucgauucggaguacauuaagacccgcacuaacgacugggauuuuguugugacuacggauauuucugaaaugggugcaaauuucaaagcagagagggucaucgacccacgaagauguaugaagccagugauucuuacggauggggaagaacgugucauuuuggccggaccaaugccagucacacauucaagugcggcucaaagacgugggagaguuggcagaaaucccaagaacgaaaaugaucaauauauauacaugggcgaaccgcuggaaaaugaugaggauugugcucauuggaaagaagcaaagaugcuucuagacaacauaaauacaccugaagggauuauaccaaguauguuugaaccugagagagaaaaaguggaugcaauagauggggaguaccggcuaagaggugaagccagaaaaacauuuguagaucuuaugaggcgaggugauuuaccaguauggcucgcguauagagucgcugcagaaggaaucaacuacgcggaccgcagaugguguuuugacggcgugaaaaauaaucagauuuuagaagaaaacgucgaaguagaaauauggaccaaagaaggagaaagaaaaaaauuaaagccacgaugguuggaugcccguauauacagugaccccuuggccuuaaaagaauucaaagaauucgcugcagggagaaaaagccuaacucuaaaucucauaacagaaauggguagacuaccuacuuuuaugacucaaaaagcaagaaaugcuuuagauaaucuggcaguguuacauacagccgaagcgggagggcgugcauacaaccaugcauuaucugaauuaccagaaacauuagaaacacuuuuacuauuaacucuucuugcaacagugacagguggaauuuuuuuguuucuaaugucuggcaagggaauagggaaaaugacccuaggaauguguugcauuauaacagcuucgauacugcugugguaugcgcagauacaaccccauuggaucgcugcaucaaucauuuuagaauuuuucuuaauagucuugcuaauacccgaaccggagaaacaaagaacaccccaggauaaucagcuuacuuacgugguaauagccauuuuaaccgucguagcagcaacaauggccaacgagauggguuucuuggaaaagacaaagaaagacuucggacucggaucgauaacuacacaacaaccagacaguaauauuuuagacauagaccugcgaccagcgagugccuggacacuauacgcaguugcgacuacuuucaucacgccaauguugaggcacucaaucgagaacucuagugucaauguaucgcuuacagcaauagcuaaucaagcgacuguucuuaugggcuuagguaaaggauggccauugucaaaaauggauauuggaguaccccuacucgcgauuggguguuacagucaagugaaucccauaacacucacagcagcgcucuuauuguugguugcucacuacgcuauaauaggaccaggccuccaagcaaaagcaacacgggaagcccaaaagagagcagccgccgggauuaugaaaauaccagcagcagaugguaugacaguaauugauuuagacccaauaccguaugauccgaaauucgaaaagcaacuaggacaaguuaugcuucuaguauuauguguuacucagguuuugaugaugcgaacgacaugggcgcugugugaagcauugacuuuagcaacaggccccauuucaacgcuaugggaaggaaauccaggaagauuuuggaacacuacuauugcgguaaguauggcaaacauauuuagagguaguuacuuagccggugcaggcuuguuauuuucaauaaugaaaaacacugcaaauacucgccgaggcacaggaaauacaggagaaacacucggagaaaaauggaaaaaccggcucaaugcauuaggcaaaagcgaauuucaaauuuacaaaaagaguggaauacaagaaguagauagaacccuagccaaagaaggcaucaaaagaggagaaacagaccaucacgcuguuucuagggguucggcaaaacuuagaugguucguagaaagaaauuuaguaacccccgaaggaaagguggucgauuuagguuguggucgaggagguuggucguacuacugcgguggcuugaaaaacguaaaggaaguaaaggggcuuacuaaaggggggccuggacaugaagagccaauaccaaugagcacauauggauggaaucuaguaagacuacaaucagguguggacguuuucuucacacccccugaaaaaugugacacuuugcugugcgauauaggugaauccucgccaaauccuacgguagaggcuggacgcacacuuagaguucucaaucugguagaaaacuggcuuaacaacaauacacaauuuugcauaaaaguauuaaacccuuauaugcccagugucauagaaaaaauggaagcacuucaacggaaauacggcggagcgcuuguccgaaacccucuaagccgaaauuccacacacgagauguacuggguaucaaaugccagcggaaacaucgucagcuccgugaacaugauaagucggaugcuuauaaacagauucacgaugaaacauaaaaaggcaacauaugaaccugaugucgauuuggguucagguacuagaaauauagguauagaaucugaaacgccaaauuuagacauuauagguaagagaauagaaaaaauaaaacaagaacacgagacaucuuggcauuaugaccaagaucacccuuauaagacgugggccuaccauggaucauacgaaacuaagcagaccggaagugcgucuuccaugguaaacgggguggugagauuguuaacaaaaccuugggauguaaucccgaugguuacacaaauggcuaugacagauacgacuccguuuggacaacaaagagucuucaaggaaaaagucgauacucggacucaagaaccaaaggaaggaacgaagaaacugaugaaaauaacggccgaguggcuguggaaagaauuagggaaaaaaaaaaccccuagaauguguacuagggaagaguuuacgcggaaaguaagaucgaaugcagcauuaggcgcgaucuucacagaugaaaauaaauggaagagugcaagagaggccguggaagacagcgguuuuugggaauugguugauaaggaaagaaauuuacauuuagaagguaaaugcgagacauguguguacaacaugauggguaaaagggaaaaaaaauugggagaauucggaaaggcuaagggcagucgagcaauuugguauauguggcuuggagccagauucuuagaauuugaagcgcuaggauucuuaaacgaggaucacugguucucaagagaaaauagucuaaguggaguggaaggagaaggccuacacaaguugggguauauucuucgagaugugagcaaaaaagaaggaggcgcgauguacgcagacgacacagcggggugggauacaagaauaacguuagaagacuugaagaacgaggaaauggugacaaaucauauggaaggcgaacaucgaaaacuagcagaagcgaucuuuagauuaacuuaucaaaacaaaguugugagaguucagaggccgacaccccgaggaacggucauggauauaaucucucgcagagaucaaagggguaguggucaaguaguuacauacggguuaaauaccuuuaccaauauggaggcccaacuuauucgacaaauggaaggugaaggagucuuuaaaucuauucagcaccucacgguaacagaagaaauagcaguaaaaaacugguuagaacguguaggaagggaacgacuuaguagaauggcaauaaguggugaugacugcgucguuaaaccacuggaugacagauucgccucugcacuaacugcuuugaacgauauggguaaaguucgaaaggauauucaacaaugggaaccguccagggguuggaaugauuggacucaggucccuuuuugcucacaccacuuucaugagcuaauaaugaaagauggcagaguccuaguggucccaugcagaaaucaggaugaguugauuggacgcgccaggauaagccaaggcgcaggcuggaguuuaagagaaacagcuuguuuagggaaaaguuacgcccaaauguggagcuuaauguauuuucaccgccgagacuugcguuuagcggcaaacgccauauguucagcuguaccaucacauuggguuccgacgucaagaacgacauggucaauucaugcaacucaugaauggaugacgacugaagauauguugaccguguggaacagaguauggauacaagagaauccuuggauggaggauaaaacuccaguagaaaguugggaagaaaucccguacuuagguaaaagagaagaccaauggugugggagcuuaauaggccuaacuucaagggcgacgugggcaaaaaauauacagacugcaauaaaucaaguucgaucacuaauaggcaaugaagaauacacagauuauaugccuucgaugaagagauuccgcagagaagaggaagaagcgggcguacugugguaa

SEQ ID NO: 22225 - RNA, 9876 nt, Artificial Sequence
  derived and/or modified CDS sequence (opt6) from DENV-2__KX380828__SS-prME
acagcugguguaaucauaaugcuaauaccaaccgcuauggcguuccacuugacaacuaggaauggggaaccacauaugauagucucacgacaggaaaaaggaaaaucuuuacuauuuaaaacugaagauggagucaauaugugcacauuaauggcaauggacuuaggagaauugugugaagauacuauaacauacaacuguccauuacugagacaaaaugaaccugaagauauagacuguugguguaauaguacuucaacgugggugaccuauggaacguguacggcuacuggagaacauagaagggaaaaacggucuguggcucuugugccccacgucggaaugggacuagaaacgagaacagaaacauggaugucuagugaaggugcguggaaacacgcccaacguauagaaacuuggauacuacgacacccagguuuuacuauuauggcugcaauauuagccuacaccauaggaacaacguauuuccaaagaguucuaauauucauauuauugacagccgucgcgccaaguaugacaaugcgaugcaucggaaucaguaauagggauuuuguugaaggaguaagcgguggaucaugggucgauauaguucuagaacacggaucuugcguaacgacuauggcgaaaaauaaaccaacccuggauuuugaauuaaucaaaaccgaagcaaaacaaccggcgacauugcgcaaauauugcauagaggcgaaacuuaccaauacaacgaccgcuagccgcuguccuacgcaaggagagccaucacuaaaugaagaacaagauaaaagguucguguguaaacauaguaugguggauagagguuggggaaauggguguggauuauucgguaaaggaggaauaguuacaugugcuauguuuaccuguaagaaaaauauggaaggcaaaauuguacaaccugaaaaccuggaauauacaauaguugugacuccucauucaggagaagagaaugcggugggcaaugauacaggcaaacacgggaaagaaaucaaagucacuccacaaaguaguaucacagaggcugaacucacgggauacggaaccgucacaauggaguguucaccaagaaccggacuggauuuuaacgaaaugguauuacuccagauggaaaauaaagcaugguuagugcaucggcaaugguuuuuggacuuaccgcucccguggcuuccaggagcagauacacaaggaagcaacuggauacaaaaagaaauguuaguaaccuucaaaaauccucacgccaagaaacaagacguaguaguucucggaucacaagaaggagcaaugcauacagcucucaccggagcaacugagauacaaaugaguucugguaauuuacuauuuacuggacaucuaaaaugccgccuacguauggauaaacuccaauuaaaagggauguccuauucgaugugcaccgggaaauuuaaagugguuaaagagauagcagaaacacaacauggcacuauaguaguacgcguucaauaugaaggagaugguuccccuugcaaaauucccuuugaaauuauggacuuagagaaaaggcacguacuaggacgccuuauuacugucaauccaauaguaaccgaaaaggauucuccugucaacauagaggcagaacccccguucggggacagcuauaucauuauagguguagaaccgggucaacuaaaauuaucaugguuuaagaaagggucuucuauaggacaaauguuugaaacaacgaugaggggugcuaagagaauggcaauucucggagauacugccugggauuucggaucauuagguggaguauuuacaucuauaggaaaagcgcuccaucaaguguuuggcgcuauuuauggggccgcauuuagugguguauccuggacuaugaaaauucugaucggagucgugaucacauggauagguaugaacagucgaucaaccagucuaucuguaucauuaguucuggucggcgucguuacacuauacuuaggaguuaugguucaagcagauucaggaugugucguuucauggaaaaacaaagaacuaaagugcggaucgggaauauuuauuacagauaaugugcacacuuggaccgaacaauauaaauuccaaccugaaaguccguccaaacuggcuucugcuauacagaaagcacacgaagagggcauaugcgguauaagaaguguaacaaggcuugaaaaccuuauguggaaacagauuacgccagaauugaaucacauucuauccgaaaacgaagucaaacugacaauuaugacaggagauaucaaagguaucaugcaggcugguaaaagaucuuuacgaccucagccaacugaacuaaaguacagcuggaagacuugggguaaagcgaaaauguugagcacagaaccacauaaccagaccuuccuaauugauggaccggaaaccgcagaaugucccaauacuaaccgagcuuggaacucguuagaaguagaagauuacggguuugggguauuuacuacuaacauaugguuaaaacucaaagaaaggcaagauguguuuugcgacucaaaauuaaugagcgcagccauaaaggauaauagagcuguacacgcugauauggguuacuggauugagucggcgcuaaaugacacauggaaaauagaaaaagcaaguuuuauugaaguaaaaaguugccacuggccaaaaucucacacauuaugguccaauggugugcuugaaucagaaaugauaauaccaaagaacuuugcuggaccuguaagccagcacaauuaccgaccaggauaucacacucagaccgcuggacccuggcauuugggaaaacucgaaauggauuucgauuucugugaagguaccacagugguuguuacagaggauugcggcaauagaggucccucuuuacguacuacaacagcaucgggaaaacucauaacugaaugguguuguagaucgugcacguuaccaccgcuucgauauaaaggugaagacggaugcugguacggaauggagauacggccgcuaaaagagaaagaagaaaauuuagucaauaguuuaguaacugcgggucacggacaaauugacaacuuuucauuagguguacuaggcauggcacuuuuucuagaagaaaugcuacggacgaggguaggaacuaaacacgcuguccuacucguagcugucaguuuuaugacguuaauaacaggcaauaugaguuuccgagacuugggcagaguuaugguaaugguaggagcggcaaugacugacgacauaggcaugggagugaccuacuuagcucuauuagcugcauucaagguaagacccaccuuugcugcagggcuucuuuuacgaaaauuaacaucaaaagagcugaugaugaccaccauagguauuguauuauuaucacaaucgacgaucccugaaacaauacuagaauuaacugaugcacucgcucuugguaugaugauacuaaaaauuguaagaaacauggaaaaguaccagcuggcaguaacaauaauggcaaucuuaugcgccccuaaugcuguuauuuugcagaaugccuggaaaguuuccugcacgauacuugcagucgugucaguaucaccgcuauuauugacuucaagccagcagaaagcggauuggauaccccuggcguuaacuauaaaaggucuuaauccgacagcaauauuccucacuacccuaagccgaacaaauaagaaacgaaguuggccauugaaugaagcaauuauggcaguaggaaugguuaguauacuagccucaucguuauugaaaaaugacauacccaugacagguccgcuaguagcaggaggacucuugacaguaugcuauguacucacuggcagauccgcagaucuagaauuggaaagggcagcggauguacgaugggaagaucaagcugaaauaucggggucgucgccaauauugaguaucacuaucucagaagaugguucgaugaguauaaagaaugaggaagaagaacagacacuuacgaucuuaauccguacagggcuucuuguaauaagugggcuauucccgguaucaauaccuauuacagcggcagcaugguaccuuugggaggugaagaaacaaagggcaggcguauuaugggacguaccuagcccuccgccuguagguaaagcggaacuggaagacggggcauacagaauaaagcaaaagggcauacugggauauucucaaaucggagcugggguguauaaggaaggaacguuccauacaauguggcacgugacaagaggagcuguucuaaugcauaaaggaaaaagaaucgagccgucaugggcggauguucggaaggauuuaauuucuuauggugggggauggaaacuagaaggagaauggaaggagggagaagaaguacaaguauuggcacucgaacccggcaaaaauccaagagcgguacaaacgaaaccaggacuuuuuaaaacuaacaccggcaccauuggugcgguaaguuuggacuuuaguccugguacaagugggaguccaauaguugauaagaaaggaaagguggugggcuuguacggaaauggugugguaacgcggaguggaacauacgucagcgcuaucgcccagacagagaagucaauugaagauaacccugaaaucgaagacgauauauuucggaagaaacgacuaacgauuauggaucuacauccaggcgcaggcaagacuaaacgauaccuaccggcaauagugcgcgaagcaauaaagcguggauugagaacauugauacuagcaccgacaagaguaguagcugcagagauggaagaagcauuacgcggccuuccgauaagauaucaaacuccagcaauaagagccgaacauacaggaagagaaaucguggacuuaaugugccacgcaacauuuacaaugagauuauuaucuccagucagggucccaaauuauaauuuaauuauaauggaugaggcgcauuuuacggacccugcaucuaucgccgcgagaggauacauuucgacaaggguugaaaugggggaagcagccgggauauucaugacugcuaccccaccugguagucgagaucccuuuccccaauccaacgcgccuauaauggacgaagagagggagauaccagaaaggucguggaacucuggucaugaaugggucacagacuuuaaaggaaaaacaguaugguucgugccuucaauuaaagcggguaaugacauagcagcaugccuacguaaaaaugggaagaaaguaauucaacuaucacgaaaaacauucgauucagaguauaucaagacgaggacuaacgacugggacuuugugguaacgacagacauaucggagaugggagcuaauuuuaaagcagagagaguaauugacccuagacguuguaugaaaccaguaauacuuaccgacggggaggaaagaguuauauuagcuggaccgaugccgguaacgcauuccucagcagcucagaggagggguagaauaggccguaaucccaaaaaugagaaugaucaguauauauauaugggagaaccacuugaaaaugacgaggauugugcgcacuggaaagaagcaaaaaugcucuuagauaauauuaacacaccagaaggcauaauuccaucgauguucgaacccgagcgagaaaagguggaugcuaucgacggagaauaucgacuaaggggagaagcccguaaaacguucguagaacucaugaggcguggcgaccuaccagucuggcucgcuuaucggguagcagcagaggggauuaacuaugcggaucguagauggugcuuugauggaauuaaaaacaaucaaauacuagaagaaaacguagagguagaaauuuggacaaaggagggcgagaaaaagaaacuuaagccaagguggcuagacgcaaggauauauucagauccauuagcacuuaaagaguuuaaagaguuugcagccgguagaaaaaguuuaacaaugaaucuaauaaccgagaugggcagacuuccaacauuuaugacacaaaaagcccgaaacgcucuagacaaucuugcuguacuccacacagcggaggcaggcggacgagcauauaaucacgcguuaucagaacuaccagaaacacucgaaacucuucuuuuacucacauugcuugcgacuguaacugguggcauuuuccuauuucuaauguccgggaaaggaaucgguaaaaugacgcuaggaaugugcugcauaauaacugcauccauuuuacucugguaugcucaaauccagccacauuggauagcagcaucaauaauauuagaguucuucuuaaucguguuauuaauuccggaaccugaaaaacaaaggacaccacaagacaaucagcuaacuuauguaguuauagccauacuuacuguaguagcagcaaccauggcuaacgaaaugggguuucuagagaaaaccaagaaagauuuuggacugggaucaauuguagcacaacaaccugagucaaacauuuuggacauagauuuaagaccagcuuccgcuuggacguuauacgcaguggccacaaccuuuauaacuccaauguuacgacauucaauagaaaauucaucgguaaaugucagucuaacggcaauagccaaucaggcuaccgucuuaaugggauuaggaaaagguuggcccuugagcaaaauggacauagggguaccucuguuagccaucgguugcuacucucaagugaauccgauuacacucaccgccgcacuacuacuauuaguggcucacuaugcgauuauagggcccggauugcaagcaaaagcaacuagagaagcucaaaagagagcagcagcuggaauaaugaagauuccgacaguagacgguauaacaguaauugaccuagacccgauucccuaugacccuaaauuugaaaaacagcugggucaaguuaugcuauuaguacuaugcguaacucaggucuugaugaugagaacaacaugggcccuaugcgaagcacuaacguuagccacgggcccaauuagcacacucugggaggguaauccgggacgcuucuggaauacaaccauugcgguuucuauggcuaauauauucagaggaucguaccuugcaggggccggauuguuauucaguauaaugaaaaauacgacgaauacucgaagaggaaccgggaauaccggggaaacgcucggugaaaaguggaaaaauagacuuaauagucuaggaaaaagugaguuucaaaucuacaaaagaagcggcauucaagaaguggauagaacauuagcuaaggagggcauuaaacgaggagaaacagaccaccacgccguaucgcguggaucggcaaaacuaagaugguucguagaacgaaauuuaguaacaccggaaggaaaagugauggacuuaggauguggucgggguggguggucauacuacuguggcggccugaaaaauguuagagaaguuaaaggacuuacaaaaggagggccggggcacgaggaaccaaucccaaugucuacuuacggcuggaauuugguacgguuacaaucuggaguggauguuuucuuuacuccaccagaaaaaugugauacucucuuaugugauauaggggaaagcucuccuaauccaaccgucgaagcgggaagaacacugagaguacuaaaccuuguagaaaauugguugaacaacaauacccaauucuguauuaagguguuaaauccuuauaugccaucugugauugagaaaauggaaacucuacaacgcaaauaugguggagcucuaguccggaacccacuaucuaggaacuccacucacgaaauguauugggucucaaacgcaagcgguaauauaguuucuagcgugaauaugauuucuagaaugcuaauuaaucguuuuacuaugcgacauaagaaagcgacauacgaaccugauguagauuugggaucaggcacacgaaacauaggaauagaaagugaaaccccaaacuuagacauaaucgguaaacggauugagaaaauuaaacaggaacaugaaacgaguuggcauuacgaucaagaccacccuuauaaaacaugggcuuaccaugguaguuaugaaacuaaacaaaccggaucagcaucauccauggucaaugguguagucagacuucuuacaaaaccgugggauguaauuccaaugguaacgcagauggcgaugaccgauacgacgccauuuggacaacaaagggucuuuaaagagaaaguugauacaagaacccaagagcccaaagagggaacuaagaaauuaaugaaaauaacugcagagugguuauggaaagaguuaggcaaaaagaaaacuccacgaaugugcacgagggaagaauuuacaaggaaaguaaggucuaaugcagcacuuggggcaauauucacagaugagaauaaguggaaaucggcacgggaagcgguagaggauucaagguucugggagcugguagauaaggaaagaaauuugcauuuggaggguaaaugcgaaacuuguguauacaauaugaugggaaaaagagagaagaaaauaggagaauuugguagggcaaaaggaaguagagcgaucugguacauguggcuaggagcuagauuuuuagaguucgaagcgcucggauuccuuaacgaagaucacugguuuagcagagaaaauucucucagugguguugaaggugaaggacuacacaaguuaggguacauauuaagagaagugagcaagaaagaagguggagccauguacgcggaugacacagcagggugggacacaagaauuacacuagaggaucuaaagaacgaagaaaugguaacaaaucacauggagggugaacauaagaaauuagcagaagccauauuuaaauugaccuaucagaauaagguaguucgagugcaacgucccacuccccgcgggacagucauggauauuauauccagaagggaucagcgagggucuggacagguggguacuuauggacuaaacacguuuaccaauaugggggcccaacuaauucgucagauggagggggaaggaguauuuaaguccauacaacaucuaacuacuacggaagaaguagcaguacaagacugguuagcacgcguuggcagagaaagacuuucccgcauggcaauaaguggagacgauugcgucguaaagccccuugaugauagguucgcuucagcuuugacugcacuaaaugauauggguaaagugaggaaagacauacaacaaugggagccuucgaaaggguggaacgauuggacacagguaccauucuguagucaucacuuccaugaacuaauaaugaaagacgggagaguccuaguaguaccaugccgaaaucaagacgaacuaauuggcagagcuagaaucagucagggagccggauggagccugcgagagacagcuugcuugggaaagucguaugcacaaauguggaguuugauguauuuccauaggagggaccucaggcuagcugcuaaugcaauauguuccgcuguaccaucgcacugggugccaacaaguaggacgacauggucuauucaugcacgacaugaauggaugacuacagaagauauguuaacaguuuggaauagaguauggauacaagaaaauccauggauggaagacaaaacgccaguagaaucaugggaggaaauaccauaucuagggaaaagagaagaucaauggugcggaucucucauaggauuaacaagcagggccacgugggcuaaaaauauacaaacagcaauuaaccagguccgcucacuaauaggcagcgaagaguauacagauuauaugccaaguaugaaaagauuucggcgggaggaagaagaagcagggguauugugguaa

SEQ ID NO: 22226 - RNA, 9876 nt, Artificial Sequence
  derived and/or modified CDS sequence (opt6) from DENV-2__KX380829__SS-prME
acggcaggagugauuauuaugcuuauccccacagcuauggccuuccaucuaacuacacguaacggagaaccgcacaugauaguaucaagacaagaaaaaggaaaauccuuauuguucaaaacagaagauggaguuaacauguguacucuaauggcuauggacuuaggugaauuaugugaagauacaauuaccuauaauuguccucuacuucgacaaaaugaaccugaagauauagacuguuggugcaauagcacaaguacauggguaacauacgguacuugcacagcaacgggugaacaucggcgugagaaaagaagcguagcauuaguuccacacguagguauggggcuagaaacaaggacagaaacuuggauguccuccgagggggcauggaaacacgcccagagaauagaaacauggauccugcgucauccagguuucacuaucauggccgcgauacuggcuuauaccauaggaacaacauacuuucaaagaguccuuauauuuauucuacuaacagcgguagcaccgaguaugacaaugcgguguauagggauuucaaacagggauuucguagaaggaguuucaggaggaagcuggguugauauagugcuggagcaugggucuugcguaacuacuauggcuaaaaacaaaccuacguuagacuucgagcuuauuaaaaccgaagccaaacagccggcaacacugagaaaauauuguauagaagccaaacuuaccaauacaacuacugcaagucgauguccuacacagggugagccaucacuaaacgaagaacaagauaaacguuuugucugcaaacauucaauggucgacagaggauggggaaacggguguggacuuuuuggaaaaggaggaaucguaaccugcgccauguuuacauguaagaaaaauauggaaggaaaaaucguccaaccugaaaauuuagaauauacuauuguuguaacuccucauucaggagaggaaaaugcuguagggaacgacacuggaaaacaugguaaagaaauaaaaguaaccccacaaucaucaauuacugaagcagaacuaacuggauacggaacaguaacaauggaauguucaccacgcacaggccuugacuucaaugagaugguucuacuccaaauggaaaauaaagcaugguuaguccacagacagugguuucucgauuuaccacugccaugguuacccggggcagacacccaagggucgaauuggauccagaaagaaaugcuaguaacauuuaaaaauccccaugcuaagaaacaggacgucguuguacuaggaucucaagaaggcgcgaugcauacagcuuuaacaggugcaacagagauucaaaugaguucagggaaucuauuauuuaccggccaucuuaaaugucgacuucggauggauaaacuacagcuaaagggaaugucauacucaaugugcacuggcaaauuuaaagugguaaaagagauugcagaaacucagcacgguacuauuguggucagaguucaauaugaaggcgaugggucaccguguaaaauuccauuugaaauaauggacuuagaaaagcgucauguauugggcagguuaauaacuguaaacccaauaguaaccgaaaaagauaguccaguaaacaucgaggccgaaccacccuucggagauucauauauaauuauagggguugaaccaggucaacuaaaacucuccugguucaaaaagggaucauccaucggccaaauguucgaaaccacuaugagaggugcaaaacgcauggcaauauuaggcgauacagcgugggacuuuggaagucuaggcggaguuuucacgucaauaggaaaggcacuccaccagguuuucggagcaauauacggagcggcauuuagugguguaucuuggacaaugaaaauacuaauaggcguggugauuacauggauagguaugaacucccgaucaacaaguuugaguguuucgcuaguauugguaggcguaguuacauuauaucuugguguaaugguccaagcagacucaggaugugugguaucguggaaaaauaaagaacuuaaauguggaucagggauauucauaacugauaauguucauacauggacugaacaauacaaauuucagccugaaaguccaucuaaauuagcaucagcuauacaaaaggcacacgaagaaggaauuugcgguaucaggucuguuacaagacuugagaauuuaauguggaaacaaauaacacccgaacuaaaccacaucuuaucagagaaugaaguaaaacuaacuauuaugacaggagacauaaaggggauuaugcaggcgggaaaacgaucucuaagaccacaacccacagaacuuaaauauucauggaaaacguggggaaaagcgaaaauguuaucaacugaaccgcacaaucagacuuuucucauugaugguccagaaaccgccgaaugccccaauacaaauagagcguggaacucucuggaaguagaggauuacggauuuggcgucuucacaaccaacauuugguugaaauuaaaagaaagacaggacguauucugugacaguaaauuaaugagcgccgcuauaaaagauaacagagcaguacaugcagacaugggauacuggauugaaucugcauuaaaugauacuuggaagaucgaaaaggcuucauuuauugaaguaaaauccugucauuggccaaaaagccacacauuauggucuaauggaguauuggaaagugaaaugauuauuccuaaaaacuucgcuggucccgugucacaacacaacuaccggccggguuaccacacacagacggcaggaccuuggcaccuagggaaacuugaaauggacuucgauuuuugcgaagggaccaccguaguugugaccgaagauuguggaaauagaggaccaucauuaagaacaacaacagccucgggaaaacuaauuaccgaaugguguugccgaaguuguacauuaccuccacuucguuacaaaggugaagauggauguugguaugguauggagauccgaccccugaaagagaaagaagaaaaucuaguaaauagucuaguaacggcaggccauggacaaauugacaauuuuuccuuagguguauuaggaauggcauuauucuuagaagagaugcuacgaacuaggguagguacgaagcaugcgguccuauuaguugcuguuaguuuuaugacacuuauaacaggcaauaugucauuucgugaccuagguagaguuauggucaugguuggagcggcaaugacagacgacauagguauggguguaaccuaucuagcacuacuggcagcauuuaaaguacggccaacguuugcagcaggauugcucuugcgaaaauugacgucaaaagagcuuaugaugacuacaauuggaaucguucuucuuagucagucaacuauaccugagacaauauuagaauugaccgaugcgcuagcucuggggaugaugauccuaaaaauaguacgaaauauggaaaaauaccaauuggcugugaccaucauggcaauacuuugcgcuccaaacgcaguaauacuucaaaacgcuuggaaaguuaguugcacaauucuagcaguugugagcgugucccccuuauuauuaacaucaucucaacaaaaagcggacuggaucccacuagcacuuacaauaaaaggacucaauccaacugcaaucuuccuaaccacguuaagcagaacaaauaaaaagcgaagcuggccuuuaaacgaggcaauaauggcuguagguaugguaucaauacuagccuccucacugcuaaagaacgacauuccaaugaccggaccccuaguugcuggcgguuuacuuacgguuugcuacguauugacgggacgcagcgcugaucuagagcucgaaagagcagcagauguuaggugggaagaccaagcggaaauuucggguucuagucccauucugucaaucacaauuuccgaagaugguucaaugucuauuaaaaacgaagaggaggagcagacgcuaacaauucuaauacgaacagguuuguuaguaaucagugggcuauucccaguuuccauaccgauuacagcggcagcaugguaucuaugggaaguaaagaaacaacgcgcagggguacuaugggacguaccaucaccaccaccagucggaaaagcagaacucgaagacggugcauacagaauaaagcaaaaagggaucuuagguuauucacaaauaggugcuggaguauauaaagagggcacauuccauacgauguggcacgugacccguggggcaguacuaaugcauaaagguaaaagaauagaaccaagcugggccgaugucaggaaagacuuaauaucauacggugguggcuggaaacuagaaggugaguggaaggaaggagaagaaguacagguucucgcauuagaaccagggaaaaacccuagagcagugcaaacuaaaccggggcuuuuuaaaacgaacacugguacaaucggggcuguaucacucgacuuuucgccaggcaccuccgguagcccgauugucgauaagaaaggaaagguaguuggacuauauggcaacggagucguaacacggucaggaacguacguuagcgcgauagcccaaacagagaaaaguauagaagacaacccugaaauagaggaugauauuuuucgaaagaaaagauuaaccaucauggaucuacauccaggcgccgguaaaaccaagagauaccuaccugcuauaguucgagaagcaauuaaaagaggccuuagaacguuaauucuugcuccuaccagagucguagcagcagaaauggaagaagcccugaggggccucccuauacgcuaccaaaccccugccauaagagcagaacauacuggacgugaaauuguagaccuuaugugccaugcaacuuucaccaugagauuacuuagcccuguacguguaccaaacuauaaccugauaauaauggacgaggcacauuuuacggauccugccucuauagcugcuagaggcuauauaaguacgagaguagaaaugggagaggcugcgggaauauuuaugaccgcgacgccaccgggcaguagggaucccuucccacaaucaaaugcuccuauuauggaugaggaaagagagauuccagagaggaguuggaacucgggccacgaauggguuacggacuuuaaaggaaaaacggugugguuugugccaagcauuaaggcuggcaacgauauugcugccugucuacggaaaaaugguaagaaagucauucaauuguccaggaaaacauuugauucggaauauauaaaaacucgaacgaaugacugggacuucgucguaacuacagauaucucagaaaugggugcgaauuuuaaagcagaacguguaaucgauccuagacguugcaugaaaccagucaucuuaaccgauggggaagaacgugucauauuagcggggccaaugccuguuacgcacucgagugcugcacaaagacgaggucgcaucggucggaauccgaagaaugagaacgaccaauauauauacaugggggaacccuuggaaaacgacgaggauugugcucauuggaaagaggcgaaaauguuguuagauaacauaaacacgccagaagguaucauuccaaguauguucgaaccagaaagagaaaaagucgaugcaauagauggugaguaccgauuaagaggagaagcaagaaaaacauuuguugaacuuaugaggcgaggggacuuaccuguuuggcuagcuuacagagucgcugcagaagguauaaacuaugcagauagaagauggugcuuugaugguauaaagaauaaccaaauacuugaagaaaauguagaaguugaaauuuggacaaaggaaggugagaagaagaaacugaaaccucgcuggcucgaugcucguauuuacagugacccacucgcauugaaagaguuuaaagaauuugccgcggguaggaaaucucugaccaugaauuuaauuacugagaugggaagauuaccaacuuucaugacacagaaagcgcguaacgcucucgauaacuuagcaguguuacacaccgcggaagcugggggacgugcguacaaccaugcuuuaagugaauuacccgaaacccuugaaacccuucuuuuguuaacuuugcuugcaaccguaacgggagguauuuuccucuuccugaugucaggaaaggguauagguaagaugacacuaggaauguguuguauaaucacugcgucaauacuauuaugguaugcacaaauacaaccccacuggauugcagcuucuauuauacuugaguucuuuuuaauuguucuuuugauaccugaaccagaaaaacagaggacaccgcaagacaaccaauugacauauguaguaauagcaauauuaacggucguugcagcgaccauggcuaaugaaauggguuuucuagagaaaacaaagaaagauuuuggucuuggaagcaucguggcacaacagccagagucgaacauacuagacaucgauuuaagaccagccucagcauggacacucuaugcaguugcaaccacauucauaaccccaauguuacgacacucaauagaaaauaguuccgucaacgucucgcucacugcaauugcuaaucaagcaacuguauuaaugggcuuaggaaaaggauggcccuuaaguaaaauggauauaggcguaccgcucuuagcaaucgguugcuacucacaaguaaacccgauaacgcuuacugcagcacuucuacuucuaguugcucauuacgcgaucauagguccuggauuacaggcaaaagcaacaagagaagcucaaaagagagccgcagcaggaauaaugaaaaaucccacagucgacggaaugacaguuaucgauuuagauccaauuccauaugaucccaaauuugaaaaacaauuaggucaagugaugcuuuugguucuaugcguaacacagguacuaaugaugcguaccaccugggcacuuugcgaggcuuuaacacuggcuacuggacccaucucuacacuaugggaggggaaccccggccgauuuuggaacacaacaauagccguaucuauggcaaacauauucagagggaguuaucuugcuggggcaggauuauuauuuuccaucaugaagaauacgacaaauacacgucgaggaacaggaaauaccggugaaacgcuaggggagaaguggaaaaaucgacuuaacucacuggguaaaagugaguuucagauauauaaaaggucggguauacaagaaguggacaggacucuagccaaagaggguauaaagcgaggagagacugaucaucaugccguaagucgcggaucagcaaaguuacgaugguuuguggaacgaaacuuaguuacaccagaaggcaaaguuauggauuuaggauguggccgcggcgggugguccuacuacugcggcggacuaaagaaugugagagaaguaaagggucugacaaaaggagggccagggcaugaagaaccgauacccaugaguacauacgguuggaauuuaguacgacuucagucagguguagauguuuucuucaccccuccagaaaagugugacacauugcuuugugauauaggagaguccucaccgaauccaacuguagaagcuggaagaacuuuacgcguauuaaaucuuguugagaauugguugaauaauaacacacaauuuuguauaaaagucuugaauccuuauaugccaaguguaauugaaaagauggaaacucuacagagaaaguauggaggggcacucguccgcaacccguugucaagaaauucuacacaugaaauguauuggguaucgaacgcaucuggaaacauuguaaguagcguaaauaugaucucacgcauguuaaucaacagguuuacaaugagacacaagaaagccacuuaugaaccagauguagaccugggcucggggacaagaaauauuggcauagagucagagacaccaaaccuggauauaauugggaagcgaaucgagaaaaucaaacaagaacacgaaacguccuggcauuaugaccaagaucacccauacaaaacaugggcguaccacggaucauaugagaccaaacaaaccggcucagccucguccauggucaaugggguaguaagguuacuaacgaagccaugggacguaaucccuaugguuacgcaaauggcgaugaccgauacuaccccauuuggacaacaaagaguguuuaaagaaaaagucgacacuagaacacaagaaccaaaggaggggaccaagaaauugaugaagauuacagcggaauggcucuggaaagaauuaggcaagaagaaaacaccuagaaugugcacacgugaagaguuuacacgaaaaguacgauccaacgcugcucuuggugcaauauuuacagaugagaauaaauggaaaagugcccgugaagcuguugaagacagccgauuuugggaacucguugacaaagaacgaaauuuacaccuggaagguaaaugcgaaacauguguauacaauaugaugggaaaaagagagaagaaaauaggugaauuugggcgggcuaaaggaagccgagcaauuugguacauguggcuuggagcgagguuccuugaguucgaagcgcuaggauuuuuaaacgaggaucacugguucaguagagaaaacucguuaagugguguagaaggggaaggacuacauaaauuaggauacauauugcgggaaguuucaaagaaagaaggaggagccauguacgcagacgauacggcagguugggauacacgaauaacauuggaagaccuuaaaaacgaagaaaugguaacaaaccauauggaaggugaacauaagaaacuagcugaagcaauuuucaaguuaacguaucaaaacaaaguuguuaggguacagagaccaacaccaagagguacaguaauggauauuauuucacggagagaucaacgugggucaggucaaguggguacguacggacucaacacauuuacuaacaugggcgcucagcuuauaagacaaauggagggagaaggaguuuucaaaaguauucagcaucucacaacgacugaagaaguagcuguucaagauuggcuugcgcgggucggcagggaacgacuaagcagaauggcuauaaguggugacgacugcguaguaaaaccucuggaugaucgauuugcgucggcauuaacagcccuaaaugacaugggaaaaguacgaaaagauauacaacaaugggagccgucuaaaggcuggaacgacuggacacaaguaccauuuuguucacaccauuuccaugaacuuauuaugaaggacgguagaguguuaguagucccaugcaggaaccaagaugaguugauagggagagcaagaauaagucaaggagcaggauggaguuugagggaaacagcgugccuuggaaagagcuaugcucagauguggagucuaauguacuuucaucgaagggacuugcgacuagcagccaacgcuauaugcagugccgugccgucacauugggugccaacgaguagaacuaccuggucaauccacgcccggcaugaauggaugacaacggaagauaugcuaacuguguggaaccgcguguggauacaagaaaauccguggauggaagauaagaccccuguggaaaguugggaggaaauuccuuauuuggggaaacgcgaagaucaauggugcggcucucucauaggacuaaccucaagggccacuugggcuaaaaacauucaaacugcaauuaaccaaguacguagcuuaauagguagugaagaguacacugacuauaugccuuccaugaagagauuucgacgagaggaagaagaagcggggguguuaugguga

SEQ ID NO: 22227 - RNA, 9876 nt, Artificial Sequence
  derived and/or modified CDS sequence (opt6) from DENV-2__KX380830__SS-prME
acagcagguauaaucauaaugaugauaccaacgguaauggcauuccaucugaccacccggaauggagaaccgcauaugauaguuuccagacaagaaaaagggaaaagccuauuauucaaaacagaaaauggaguaaauaugugcacauugauggcaauggauuuaggagaauuaugcgaagacacgauaaccuauaauugcccuuuacuuagacaaaaugaaccugaagacauagauugcuggugcaacagcacaagcacuugggugacguacgggacuuguacagcgaccggugaacauaggagagaaaaacgaucaguggcucuugugccacacguuggaaugggauuagaaacccgaacagaaacguggaugaguucagaaggagcuuggaaacaugcacaaaggauugaaacuugggugcuaaggcaccccgguuuuacugugauggcagcgauucuggcauauacaauaggcacuaccuauuuucaaaggguauuaauauuuauauuguuaacagcaguagcgccaucuaugacuaugagaugcauugguauaucaaauagagauuucguagaagguguuuccggcggaagcuggguagacauagucuuagaacaugguuccugcgucacaacgauggccaaaaauaaaccaacacuugacuucgaacuuauaaaaacagaagcuaaacauccugcuacucuccgcaaauauugcauugaagcaaaacuaacaaauaccacgaccgcaagucgaugucccacgcaaggagaaccaucacucaacgaagaacaagauaaaagauuuguuuguaaacauuccaugguggaccguggauggggaaauggcugugguuuauucggaaaaggggguaucguuacgugcgcaauguucacauguaagaaaaauauggaaggcaaaauagugcaacccgaaaauuuggaauauacuauagugauaaccccucacagcggggaagaaaaugcgguagguaaugacacuggaaaacauggaaaagaaauuaaagucacuccucaauccucaaucacugaagccgaacuaacaggauauggcacugcaacgauggaauguucuccacgaacagggcuagauuucaaugaaaugguuuuacuccaaauggagaauaaagccuggcuuguccauagacaaugguuuuuagaucugccguuaccaugguuaccuggagcagauacucaaggcuccaauuggauacaaaaagagacauuaguaacauuuaaaaacccacaugccaagaaacaagauguaguaguacucgguucccaagaaggcgcaaugcauacagcauugacaggagcuacugagauucaaaugaguuccggaaauuuacuuuucaccggacaccuaaaaugccgauuaaggauggacaaacuacaacuuaaagguaugaguuauaguauguguacagggaaauucaaaguugugaaagaaauugcagagacccagcauggaacaauagucauucguguucaauaugagggagaugggaguccuuguaaaaucccguuugaaaucauggauuuagagaaaagacauguacuugguagauuaaucacaguaaaccccauaguaaccgaaaaagacagcccaguaaauauagaagcagagcccccauuuggugauuccuauauaauuauaggcguagaaccgggucaacuaaaacuuaguugguucaagaaaggcaguuccauuggucaaauguuugagacuaccaugagaggagcuaaacgcauggcgauccuaggugauacugcuugggauuuuggcagucuuggagggguauuuacauccauaggaaaagcauuacaucaaguguucggagcaauuuauggagcggcuuuuagcgguguuaguuggacuaugaaaauccuaauaggaguagucauuacguggaucgguaugaacucacgaucgaccaguuuaucuguuagucuuguauuaguagguauaguuaccuuguacuuaggcguuaugguacaagcggacucgggaugcguagucagcuggaaaaauaaggaacuuaagugcgggaguggcaucuucauaacugauaacguccauacauggacugaacaguacaaauuccagccggaaagcccaagcaaacuggcaucagcuauacagaaagcucaugaagaaggcauuugcgguauaaggucggucacacgcuuggaaaauuuaauguggaaacagauaacaccagaacucaaccacauccuaucagagaaugaggugaaacuaacuauaaugacgggggacaucaaggguaucaugcaagccgguaaaagaagccuuagaccucaaccaacagaacuuaaauacucguggaaagcauggggaaaggcaaaaauguuaucuacagaacugcauaaucauacauuuuuaauagauggaccagagacagcagaguguccaaauacgaaccgcgcauggaacucguuagagguugaagauuacggauuuggaguauuuacaacaaacauaugguuaaaacucaaagaaaggcaggacguauucugcgauaguaagcuaaugagugcggcuaucaaagauaaccgugcaguacaugcagauaugggauauuggauagagagugcguuaaaugauacguggaaaauagaaaaagccucauucauugaggugaagucuugccauuggccaaaaucucacacguuguggaguaacggugugcucgaaucagaaaugauuauacccaaaaauuucgcagguccuguaagccaacacaauuaucguccagguuaccauacacaaacagcaggaccuuggcaucugggccguuuagaaauggauuuugacuucugugaagggacaacaguuguugucacugaagauugcgguaaccgagggccgucuuuacguacaacgacagcaucagguaagcugauuacagagugguguuguagaucaugcacacuaccgccauugcgcuaucguggagaagauggcugcugguauggcauggaaauuagaccauugaaagaaaaagaagaaaauuuaguuaauagccugguaacagccgggcauggacaaauugacaauuuuucauuagggguucuagggauggcucuauuuuuggaagaaaugcuacguacacgcgucggcacaaaacacgcuauacuuuuaguagcggucucauuuguuacauuaauaacaggcaacauguccuuucgugauuugggacgcguaaugguaaugguaggagcgacuaugacggacgacauugguaugggagucacuuauuuggcgcuccuagcagcuuuuaaaguucguccaacuuuugccgcaggauuacuucuaaggaaacugacaagcaaggaacuuaugaugacaacaauaggaauaguauuauuaucucaaucgacaaucccagaaacuaucuuagagcucacggaugcgcuugcauuaggaaugaugguuuugaagauuguacguaauauggaaaaauaucaacucgcaguaacaauaauggcuauauuguguguaccuaacgcuguaauccuccaaaaugcguggaagguaucaugcacaauacuggcgguaguaucggugucgccccucuuacuaacuuccucacagcaaaaggccgauuggauaccccuugcccuaacaauuaaaggcuugaauccaacagcuauuuuucuaacaacacuuagcagaacaaguaagaaaagaucauggccccucaaugaagcuaucauggcuguagggaugguuucgauacuugcaagcagccuauugaaaaacgacaucccaaugacugguccauugguagcgggugguuuauuaacggucuguuauguucugacuggaaggucugcagacuuggaauuagaacgagcggcagacgugagaugggaagaacaagcugaaauaaguggcaguaguccaauucugucuaucacaauaagugaagacggaucaaugucgaucaaaaacgaagaagaagaacaaacucugaccauucucauuagaacuggucuauuaguaauaagcggacuuuuuccuguaaguauaccaauuacggcagccgcgugguauuuaugggaagucaaaaagcaaagagcagggguuuuaugggacguaccaucuccgccuccaguaggaaaagcagaacuagaagauggagccuaccguauaaaacagaaagguauacucggauauucacaaaucggcgcaggcguuuauaaagaaggaacuuuucacacaauguggcacguaacacgcggugcaguuuuaaugcauaaaggcaaacggauugagccuucuugggcagaugugaagaaagauuuaauaagcuauggagggggauggaaacucgaaggagaauggaaagaaggagaagagguacagguucuugccuuagagccagguaaaaacccaagagcgguucaaacgaagccuggacuguuuaagacaaacacggggacuaucggagcggugucucuagacuuuaguccuggcacauccggaaguccuauaguggacaagaaaggcaaaguaguuggacucuaugggaacgguguaguuacccguucuggaaccuacguaucagcgaucgcccaaacagagaaaaguauagaggauaacccagaaaucgaagacgauauauucaggaaaaagcgccuaacuauaauggauuugcauccgggagcggguaaaaccaaaagauaucuaccggcaauuguacgugaagcuauuaaacgcggauuaagaacacuuauucuagcgccaacgcgugucguagcagcagagauggaagaggcuuuaagaggauugccaauacgauaucaaacaccggcaaucagagcagaacacacuggacgcgaaauuguagaucucaugugucaugcuacuuuuacaaugcgcuuacuaagcccaauaagggugccuaacuauaaucuaaucauaauggacgaagcucauuucacagacccagcuucaauugcugccagaggguauaucucuacacguguagaaaugggugaagcggccggaauauucaugacagcuaccccaccaggcucacgagauccuuuuccucaaucaaaugcaccgauuauggacgaagaacgugaaauaccagagagaagcuggaacucaggucacgaauggguaacagauuucaaaggaaagacaguaugguuuguacccucuaucaaagcugguaaugauauagcagccugcuuacguaaaaaugguaagaaaguaauacaacuaagcagaaaaacauuugauagugaauacauaaaaacucgaacgaaugacugggacuucgugguaacgacggauauaucggaaaugggcgcaaacuucaaagccgagagaguaauagacccaagacgcuguaugaaaccugugauauuaacagauggugaagaaaggguaauucuagcugggccgaugccaguaacucacaguucggcagcacaacgaagaggucggguaggaagaaaucccaagaaugaaaaugaccaguauaucuacaugggugaaccauuagagaacgacgaagauugcgcccacuggaaagaggccaaaauguuguuagacaacauaaauaccccagaaggcauuauaccgucgauguucgagccagaaagagaaaagguggaugcuauagacggagaguaucgauuaaggggugaggcgcgcaaaacuuucgucgaccuuaugcgcaggggagacuuaccaguguggcuugcauauagagucgccgccgagggaauuaacuacgcagaucgacgauggugcuucgacggaguuaaaaauaaucaaauucuugaagaaaauguggaaguggagauauggacuaaggaaggagaaagaaagaagcuaaaaccucgauggcuugaugcacgcaucuauucugauccacuagcacucaaggaguucaaggaguuugcagcugggagaaaaucuuuaaccuuaaaucucauaacagagauggguagacuaccgacuuucaugacacagaaagcacgaaacgcacuggauaaccuugccguauuacauacugcggaagccggagguagagccuauaaucaugcucucuccgagcuaccagaaacauuagaaacucuucuuuugcuaacucugcucgccacagucacaggcggaauauuuuuauuucuaaugaguggaaaagguauaggaaagaugaccuuagggaugugcuguauuauaacugcaaguauacuauuaugguaugcccaaauacaaccucacuggauagcggccucaauuauuuuagaauuuuuccuuauuguuuugcucauacccgagccagaaaaacagagaaccccacaagauaaucagcugacauacguagucauagcuauuuugacugucguagcugcuaccauggccaaugaaaugggauuucucgaaaagaccaagaaagauuuuggccuagguucuauuacuacacagcaaccggacucuaacauauuagacauagacuugcguccagcaucggcuuggacuuuguaugcugucgccacaacuuuuaucacaccuauguugcgacacucaaucgaaaauaguagcguuaauguaucguuaacagcgauagcgaaucaagcgacaguucuaaugggucucggaaaggguuggccacuaucaaagauggauauaggaguaccguuguuagccauaggcugcuacagccagguaaauccaauuacucuaaccgcggcacuauuacuguugguagcacacuacgccauuauaggacccggacuccaggcaaaagcaacacgggaagcacagaaaagagccgcggcaggaauaaugaaaauaccugcagccgacggaaugacagugauagauuuagauccaauaccuuaugacccaaaguucgaaaaacaacuaggccaggucaugcuucuuguacuaugcgugacucaaguacuaaugaugaggacaacaugggcccuuugcgaagcauuaacccuagcaaccggaccaauaaguacucuaugggaagguaauccggggcguuuuuggaacacuacaauagcuguaucaauggccaacauauuuaggggaucauaucuagccggugcaggguugcuuuucucgauuaugaaaaauacggcuaauacuagacgcgguacgggaaauacaggagaaacuuugggcgaaaaauggaaaaauagacugaacgcuuuaggaaaaucugaguuucaaauauauaagaaaucgggaauacaagaggucgaccggacgcucgcuaaagaaggaauaaaaaggggcgaaacggaccaucacgcugucagccgagguucggcaaaacuuagaugguucgucgagcguaaucugguuacuccugaaggaaaggugguugaucuuggaugcggaagagguggguggucuuauuauuguggaggacugaaaaauguuaaagaagucaaaggacucacaaaagggggcccaggucacgaagaaccaauccccaugucaacuuauggauggaauuuaguaagacugcaaagcgguguagacguguuuuucacaccgccagaaaaaugcgauacccuacuaugugauauuggcgaaagcaguccaaaucccacugucgaagcaggacgaacccuucgagugcuuaaccuaguggaaaacuggcugaacaacaauacccaguuuugcauuaaggugcuuaaccccuacaugccaaguguaauugagaagauggaagcucugcaaaggaaguacggaggggcccuagugagaaauccuuugucaagaaacucaacacacgaaauguacuggguaucgaaugcaaguggcaauauaguuucuaguguaaacaugauuagcagaaugcuuauuaauagguucacuaugaaacauaagaaagccacuuacgaacccgauguagauuuaggaaguggcacccgaaacauaggaauugaaagugaaaccccaaaucuggacauaauuggaaaaaggauugagaaaauaaaacaagaacaugaaacgaguuggcacuaugaucaagaccaucccuauaaaacaugggccuaccaugggaguuacgagacuaaacaaacagguucagcuucaagcauggugaacgguguagugcgauuauuaacuaagccaugggacguuauaccaaugguaacucaaauggccaugacagacacaacuccuuucggucaacaacgggucuuuaaagagaaggucgauacuaggacacaagaacccaaggaggggaccaagaaauugaugaaaauuacagcugaaugguuauggaaagaacuugggaagaagaaaacaccaagaauguguacgcgagaagaauuuacgagaaaaguaaggucaaaugcugcgcuaggagcuauauuuacggacgaaaacaaguggaaaucggcacgugaggcggucgaagacucaggauucugggaguuaguagauaaagaaagaaaucuacaccuagaaggaaaaugcgagaccugcguauacaauaugauggguaaacgcgagaagaaauuaggggaguucggcaaagcaaaagguagcagggccauaugguauauguggcuuggugccagguuucuagaauuugaagccuuagguuuucugaaugaggaccauugguucagcagagaaaauucauuaucaggcguugaaggagaaggucuacauaaacuggguuauauucucagggacgugucgaaaaaggaaggaggggcuauguaugcugacgacacagcuggaugggauacacguauaacauuagaagaucuuaaaaacgaggaaaugguuacgaaccauauggagggggaacacagaaaauuggcagaggccauauuuagauuaaccuaccaaaauaaagucguaagggugcaaagaccgacucccagagggacuguaauggacauaauuucccgccgcgaccagagggguuccggccagguagucacauacggacuaaacacuuucacaaauauggaagcacagcuaauuaggcaaauggaaggggaaggugucuuuaaaucuauacagcaucuuacaguuacggaagagaucgcaguaaagaauuggcuugagagagucgguagggaaagacuguccaggauggcaauuagcggagaugacugcguaguaaaaccauuagaugaccgcuucgccagugcccuaacugcucuuaaugacaugggaaaaguaagaaaagauauacaacagugggaaccaucucgggguuggaacgacuggacccaaguacccuuuuguucccaucauuuucacgaacuaauuaugaaggacggacgcguucuuguaguaccuugccgcaaucaggaugaguuaauuggucgcgcaagaauaucacaaggagcgggguggucauuaagagagacugcuugccuuggaaaauccuaugcgcaaauguggaguuuaauguauuuccaucgucgagaucuuagauuggcugccaaugcaauaugcucagcgguaccaucccauuggguuccgauaucacgcacaacguggaguauucaugcgacacacgaauggaugacaacagaggauauguuaacuguguggaaccgagucuggauucaagaaaauccauggauggaagacaaaaccccaguggaauccugggaggaaauuccguauuuagguaagagggaagaucaaugguguggcucucugauugggcuaacaaguagagcaacuugggccaaaaauauccaaacggcaauuaaucaaguaagaucucuuaucgggaacgaagaguauacugauuacaugccaaguaugaagagguuuagaagggaagaagaagaagcaggaguacuaugguaa

SEQ ID NO: 22228 - RNA, 9876 nt, Artificial Sequence
  derived and/or modified CDS sequence (opt6) from DENV-2__KX380831__SS-prME
accgccggaaucauaaucaugaugaucccuaccguaauggcguuccacuuaacaacaagaaauggugaaccucauaugaucguuaguaggcaggaaaaaggcaaaucuuuauuauuuaagacagagaacggaguuaauaugugcacauuaauggcaauggauuuaggcgaauugugugaggacacaauuacauacaauuguccauuacugagacagaaugaaccugaagauauagauugcugguguaauagcacaaguacaugggugacauacggaacauguacggcaacgggagaacaucgaagagagaagagaaguguggccuuagucccccacguagggaugggauuggaaacgcguaccgagacauggaugucaagugaaggugcauggaaacacgcacaacggauagagacuuggauuuuacggcacccagguuucaccauuauggcggcaauccuagccuacacgauuggaacuacguauuuccaacgaguacuuauauuuauauuguuaacagcaguaaccccaucaauggcgaugcgauguauuggaaucagcaacagagauuuuguagaaggcguaucaggaggcucauggguugacaucguuuuagaacaugggucaugcguaacuacaauggcaaaaaauaaaccuacauuagauuucgaacuaauaaaaacugaggcaaaacaucuagccacuuuacgaaaauauuguguugaagccaaacugacuaacacgacuacagccucacgaugcccuacacagggagaaccauccuugaaugaagaacaagacaaacgauucgugugcaaacauucaaugguggauagaggaugggguaacgguuguggacuguucgguaaaggaggaauagugacaugugccauguuuacaugcaaaaaaaacauggaagguaagguugugcaacccgaaaaccuagaauauacaaucgugaucacuccucacuccggcgaggagaacgccguagguaacgacaccgguaaacauggaaaagagaucaaaguaacuccacaaucuucaauaaccgaggcugaguugacaggguacgggacuguuacuauggaauguucucccagaacuggcuuagacuuuaacgagaugguauuauuacaaauggaaaauaaagcauggcucguacauagacagugguuucuggaucucccuuuaccuugguugcccggcgcagauacacaggggucaaauuggauacaaaaggagacacuuguuacuuuuaaaaacccacaugcaaaaaaacaagacguuguuguauuaggcagccaagaaggugcgaugcacacagcauugaccggggccaccgagauucaaaugucgaguggcaaucuuuuauucacgggacaucugaaauguagacuucguauggauaagcuucaauuaaaagggaugaguuacucaauguguacaggcaaauuuaagguggucaaagaaauagcugaaacgcaacacggaaccauagucauccgaguccaguaugaaggggaugggucaccaugcaaaauaccguuugaaauuauggaccuugagaagagacauguccucggaagauuaaucacagucaacccaauaguuacagaaaaagauaguccaguuaauaucgaagcugaaccccccuucggcgacucuuauauuauuaucggcguagaaccuggacaacucaagcuuagcugguuuaagaaaggauccucaauaggacagauguuugaaacuacaaugcgaggagcaaaaagaauggcgauucuaggagauacggcuugggacuucggcucuuuagguggaguauuuacaaguauagggaaggcacuacaccaaguguuuggagcgaucuauggugcugccuuuaguggaguguccuggacaaugaaaauucucaucggggucguaauaacauggauaggcaugaauaguagaucuaccagccuaucaguuucauuaguauuagugggaguuguaacccuuuauuugggcguaaugguacaagcagacuccgguuguguugugucuuggaaaaauaaggaauugaaaugcggaucgggaauuuuuauaacagacaauguccacaccuggacugaacaauauaaauuccaaccagaauccccaucgaagcuagccucagcaauucaaaaagcucaugaagaaggcauuugugguauaagguccguaaccagauuggaaaaucuuauguggaaacaaaucacaccggaauuaaaucauauacuaacagaaaaugaaguaaagcucacuauaaugacuggagauaucaaaggaauaaugcaagcgggaaaaagaucccuaagaccgcaaccaacagaacuuaaauauucauggaaagccuggggaaaagccaaaaugcuaucgacagaacuacauaaucacacauuuuugauagauggacccgaaacagccgaaugcccaaacacaaauagggccuggaacucgcuagaggucgaagacuacggcuucggaguauucaccacaaacauauggcugaagcuuaaggaaagacaagaugucuucugugauaguaaucuaaugucagccgcuauuaaagauaacagggccgugcaugcagacaugggguacuggaucgagagugcuuuaaacgauacguggaaaauagaaaaggcaaguuucaucgaagucaaaucuugccauuggcccaagagucauacacucuggucuaacgguguauuagagagugaaaugauaauaccaaaaaauuucgcaggaccuguaucacagcacaauuaucgaccuggauaccacacacaaacagcgggaccauggcaucugggaaggcuagaaauggauuucgauuuuugcgaaggcacaacaguugugguuacugaggacuguggcaaucgagguccaucuuugagaacuacaacggccucaggaaaauugauaacagaguggugcugccgaaguugcacuuuaccgccauuacgguaucgaggagaagacgguugcugguauggcauggagauacggccacuuaaagaaaaggaagaaaaucucguuaacaguuugguuacugcgggacauggacaaauagauaacuuuaguuuaggcguacuagguauggcuuuauucuuggaagagauguugagaaccagggugggaacgaaacaugcgauauuauuagucgcaguaucuuuuguuacacucauaacaggaaauaugagcuuucgcgaccuaggacgcgucaugguaaugguaggugcuaccaugacagaugauauaggaaugggaguaacuuauuuggcauugcuagcagcauuuaaaguucgaccaacauuugccgccggauuguuauugagaaaacuuacuucuaaagaguuaaugaugacaacaauaggaauagugcuucugucucagucgacaauaccggagagcauuuuggaacuaacugacgccuuagcguugggcaugauggugcugaaaauaguaagaaauauggaaaaauaucaguuggcgguaacuauuauggccauucuuugcgugcccaacgcagugauccugcaaaaugccuggaaggucuccugcacgacacuugcaguuguuaguguuucuccuuugcuuuugacaucaucgcagcaaaaagcugauuggauuccacuggcacuaacaauuaaaggguuaaauccgacagcaaucuuccuaacuacacugucuaggacuucaaaaaaacgaaguuggccccuaaaugaagcaaucauggcgguagguauggugagcauuuuagcaucaucacuacuaaagaacgacauucccaugacuggaccccucguugcgggaggauuacugacaguauguuacguccucacaggaaggucugcggauuuagaacuugaaagagccgccgauguccggugggaggagcaggcagaaauuagcgguagcucuccaauauuaagcauaacuaucucugaagauggaucgaugucuauaaaaaacgaagaggaagaacagacacuaacaauccugauucgaaccggucuccugguuauauccggccuguucccgguaaguauaccaaucacugccgccgcaugguauuuaugggaaguaaaaaaacaacgugcggggguauuaugggacgugccaucucccccaccugucgggaaagcugaacuugaagauggcgccuauagaauaaaacaaaaaggcauucuuggcuacucccaaauaggugcaggcguauacaaagaagguacauuucauacaauguggcacgucacaagaggagcuguucugaugcauaaaggaaaaaggauagaaccuagcugggcugacguuaaaaaggacuuaaucagcuacggaggaggauggaagcuggaaggggaauggaaagagggugaagaaguacaaguuuuagcguuagaaccaggaaagaauccaagagcuguacaaacuaaacccggauuauuuaagacaaacaccggaacuauaggugccguaucucuugauuucagucccgggacauccgguuccccaauaguagauaaaaaagguaagguaguuggauuguacggaaauggaguaguaacgcgaucgggcaccuaugucagcgccauagcucaaacugaaaaaaguauugaagacaauccagaaauagaagaugacauauuuagaaaaaaaagguuaacuaucauggaucuccacccuggagcuggaaagacaaaacgcuaccuaccugccauagucagagaagcaauuaagcgaggacuuagaacacuuauacuugcccccacgagagucguugcagcggaaauggaagaagccuuacgaggacuaccuauacgauaucagacuccagcaauacgagcugaacauacagguagagaaaucguggaucuaaugugccacgcaacuuucacuaugaggcuacugaguccuauacgaguaccaaauuacaacuugauuauaauggaugaagcgcauuuuacagacccagcaucgauugcagcuagagguuauaucucaacucgaguggaaaugggagaagcugcuggaaucuucaugacagcaacucccccaggcucaagagacccuuucccucaaucuaaugcaccaauuauggaugaagagagggaaauaccagaaagaucuuggaauucaggacacgaaugggugacugauuuuaaagguaaaacuguuugguucguuccuucuauuaaagcaggaaaugauauugccgcaugccuacgaaaaaacggaaagaaagucauucaauuaucucgaaagaccuucgauagcgaauauaucaagacccguacaaaugauugggauuucgugguuaccacugauauuagcgagaugggagcaaacuuuaaagcagaacgaguuauagauccacgacgcuguaugaaaccagugaucuuaacugauggagaagaaagagugauucucgcagguccaaugccuguuacacacaguucagcagcacaacgaagaggcagaguagggcgaaacccaaagaaugaaaaugaccaauauaucuauaugggggaaccccuagagaaugaugaggauugcgcccacuggaaggaagcgaaaaugcuuuuagauaacaucaauacaccugaggguauuauucccaguauguuugaaccugaaagagaaaaagucgaugcaaucgacggagaauacagacuuaggggagaagcacguaaaacauuuguugacuugaugcguaggggcgaucugcccguuuggcuagcauacagggucgcagcagaaggaauaaauuaugcagacagacggugguguuuugacggagucaagaauaaucagauccuggaggaaaacguagaagucgaaauauggacuaaggaaggcgaacguaaaaaacuaaagccaaggugguuggaugcaagaauauacagcgaccccuuagcccuaaaagaauuuaaagaauucgcugcggggaggaaaucccucacgcucaaucuuaucacagaaaugggacgauuaccgacuuucaugacacaaaaagcaaagaaugcauuagauaaccuagcgguguuacauacugcggaagcuggcggaagggcauacaaucacgcauuaagugaauugccggaaacacuugagacauuacuccuauuaacauuacuagccaccgucaccgguggaauuuuccuuuuccuaaugaguggaaaagggauugggaaaaugacauuggguaugugcuguauaaucaccgcaucaaucuuauuaugguacgcgcaaauacaaccccauuggauagcagcaucuaucauauuggaauuuuuuuuaauagugcuucucauaccggaaccagaaaagcagagaacgccacaggauaaccaauuaaccuacgucgugauugccauccuuaccgucguggcggccacaauggccaaugaaaugggauuuuuagaaaaaacgaagaaggauuucggacuaggcucuauuacaacacagcagccagaaagcaacauauuggauauagauuuaagaccugcuagcgccuggacucucuaugccguugcaacaacuuuuaucacuccgaugcuaagacauuccaucgaaaauucaucgguaaauguuucuuuaacagcaaucgcaaaccaagccacgguguuaaugggauuggguaagggauggccccugucuaaaauggacaucggaguaccccucuuggcuauuggguguuauagucaaguaaacccuauaacacuaacugccgcuuuacuucuauugguggcccacuaugcaauaauuggaccuggauuacaggcaaaagcuaccagagaggcacaaaaaagagcagcagcuggcaucaugaaaaaccccacaguugauggaaugacaguuauugaucuagacccuauuccuuaugauccaaaauuugaaaaacagcuagggcagguaauguuacucgucuugugcguuacacaaguauuaaugaugcgaacgacuugggccuuaugugaggcacuaacuuuagcaaccgguccgauaaguacacuaugggaaggaaauccgggaagauucuggaauacaacuauagcaguaucaauggcgaacauauuuagaggcuccuaucuugcaggcgcagggcuucucuucuccauaaugaaaaauacggcaaacacgcguagaggaacuggcaauaccggcgagacccuuggugaaaaauggaaaaaucgguuaaaugcuuugggaaagagugaauuucaaaucuacaaaaaaucugguauacaggagguagauagaacccuagcaaaagaggguauaaaacgcggggaaacugaucaccaugcagucagucgagguuccgcaaaguuacggugguuuguugaaaggaaucuuguaaccccagagggcaaagucguggauuuaggcuguggcagggggggauggucguauuauugcgggggccuuaaaaauguaaaagaagugaaagggcucacaaaaggaggaccuggucacgaagagccaauaccaaugucuacauauggauggaaccuagugagauuacaaucagguguggacgucuucuucacaccuccugaaaagugugacacucucuuaugugacauuggcgaaucgucgccuaauccaaccguagaagcuggacgaacuuugagggucuuaaacuuaguagaaaacugguugaauaacaauacgcaguucugcauuaagguauuaaaucccuacaugccaagugugauagaaaagauggaagcacugcaaagaaaauauggaggcgcccuaguacguaaccccuugucacgcaauucuacccaugaaauguacuggguuucaaaugcaagcggcaauauugugucuucuguuaauacaauaagucgaaugcucauaaaccgauucaccaugagacauaaaaaagcaacuuaugaacccgacguugaccuagggagcgggacaagaaauauagggauugaaucugaaacgccuaauuuagauaucauagguaaaagaauagagaagaucaaacaagaacacgaaacaucuuggcauuacgaucaagaucauccguauaaaacaugggccuaccauggcucauacgaaacuaaacaaacaggaagugcauccuccaugguaaauggaguagucagauuauuaaccaaaccuugggauguaauaccgaugguaacacaaauggcgaugacugauacgacgccauuuggucaacaacgcgucuucaaggagaaaguggauacacgcacucaagagccgaaagaaggaaccaaaaaacucaugaaaaucacagcugaauggcucuggaaggaacuugguaagaagaaaacgccaagaauguguaccagagaagaauuuacucgaaaaguuagaaguaaugccgcucuaggagcgauauuuacggacgaaaauaaguggaaaucagcaagagaagccguagaggacaguggcuucugggaauuaguugacaaagaaagaaacuugcaucucgaagguaaaugcgaaaccugcguuuacaacaugaugggaaaaagagagaaaaagcugggugaauuuggaaaagccaaagggucuagggcuaucugguacauguggcucggagcuagguuuuuagaauuugaagcccuagguuucuuaaaugaagaucauugguucagcagagaaaauucauuaucaggagucgaaggagaaggccuacauaagcuaggguacaucuugagggauguaucaaaaaaggaaggcggagcuauguacgccgacgacaccgcagggugggacacacggauaacccuugaggauuuaaaaaaugaggaaauggugaccaaccacauggaaggcgagcacaagaaauuagcagaagcuaucuucaaacuaacauaccaaaauaaaguagugcgagugcaaagaccuacgccucguggaacaguaauggauaucauaucccguagagaucaacguggaagcggucaggucguuaccuauggacuuaauacuuuuaccaacauggaagcucagcugauccgucaaauggaaggugagggaguauuuaaauccauacaacaacuaaccguaaaagaagaaauugccguuaagaauuggcugauuaggguagggcgagaaagauuaagucguauggcuauaagcggagacgacuguguagucaaaccuuuggacgauagauucgcuagugccuugacugcauugaaugacauggguaaagugcguaaggauauacaacaaugggaaccgagccgugguuggaaugauuggacucaaguccccuucugcagucaucacuuucaugaauuaauaaugaaggacggaagaguuuuaguaguuccaugucgaaaccaagaugagcuuauagguagagcacgaaucucacaaggagcuggauggucacugcgagaaacggcuugucuuggcaaaucuuaugcccaaauguggucacuaauguauuuucauaggcgagaucuacgucuagcagcuaacgcaaucuguagugcugugccuagucauuggaucccuaccaguagaacaacuuggucuauccaugcuacccaugaauggaugacaacagaagacaugcuuacuguauggaaucgcguuuggauacaagaaaacccuuggauggaagacaagacaccuguagagucuugggaagaaaucccuuaucuuggaaaacgugaggaccaauggugcggaagucuaaucggauugacaucaagagcgacuugggcaaaaaacauacaaacagcgauaaaucaaguuagaucacuaauagggaaugaagaauauacagauuauaugccuagcaugaaaagguuucgaagggaagaagaagaagcugggguucuuugguaa

SEQ ID NO: 22229 - RNA, 9876 nt, Artificial Sequence
  derived and/or modified CDS sequence (opt6) from DENV-2__KX380808__SS-prME
acggcaggaauaauuauaaugaugauuccaacaguaauggcauuccaucuaaccacaagaaacggagaaccacauaugauaguaucccgucaagaaaaagguaaaagccuauuauucaaaacugaaaauggaguaaauaugugcacccucauggcuauggacuuaggggaauuaugugaagauaccaucacuuacaauuguccgcuccugaaacaaaacgaaccugaagauauagauugcuggugcaauucaacaaguaccuggguaacauacgguacauguacagcgacgggggaacaccgaagagagaaaagaucaguggcguuaguaccccacguaggaaugggauuagaaacucgaacugagaccuggaugucgagugaaggagcauggaaacacgcgcagagaauagagacauggguuuuacgacauccagguuuuaccauaauggcggcaauauuagcauauaccauaggaacuacuuauuuccaacguguuuugauuuucauauugcuaacugcuauugcucccucgaugacaaugagaugcauaggaauuagcaacagagauuuuguagaaggagugucagguggaagcuggguagauauagugcucgagcacggaaguuguguaaccacuauggcgaaaaauaaaccgacccuagauuuugaacuaauaaaaacagaagcuaaacauccagcuacacuucgaaaauauuguauagaggcuaaacuaacuaacacaacgaccgcaaguagauguccgacacaaggagaaccgucauuaaaugaagaacaagauaagagauuuguauguaagcacaguaugguagacagaggauggggaaacggaugcggauuguuuggaaaaggagguauaguaacgugugcuauguuuacaugcaaaaagaauauggaaggaaaaaucguacaaccagaaaaccuagaauacacaauaguuauaacgccacacucgggagaagaaaaugcaguaggcaaugauacgggaaaacaugguaaggaaauuaagguaacaccucagagcagcauuacagaggcggaauugacuggauacggcaccgugacuauggaaugcucaccacggacagguuuggauuucaaugaaaugguuuuauugcaaauggaaaacaaagcauggcugguucaucgacaaugguuccuugaccuacccuugccuuggcuaccaggggcugauacgcaaggaaguaauuggauacagaaagaaacucuuguuacauuuaaaaacccacaugcaaagaaacaggauguagucguauugggaucacaagaaggggccaugcacaccgcccugacgggagcuaccgaaauacagauguccucagguaaccuauuguucacuggucacuuaaaaugucgacuuagaauggauaaguuacaacuaaagggaaugucauauucuauguguacuggaaaauuuaagguuguaaaagaaauagcagaaacacaacauggaacuauuguuauaagaguucaauaugaaggggacggcucaccguguaaaauuccauuugaaauaauggauuuagaaaaacgacauguauugggacgucuuauaacgguaaacccgauaguuacagaaaaggacaguccaguaaauauugaagcagaaccucccuucggcgauaguuauauaauuauaggcguagaaccaggacaacuuaaacuaagcugguuuaaaaagggaagcucgaucggucaaauguucgagacaacaaugaggggugcaaagcguauggcaauacucggagacacagcaugggacuuuggcucacuagguggaguauucacaagcauaggaaaagcauuacaccaaguauuuggugcaauuuauggugcugcuuuuucagggguuucauggacuaugaagauacuuaucggugugguuauuacauggauagggaugaauaguaggaguacaucacuaagcguaucgcugguuuugguagggguaguaacacuguaucuaggaguaaugguucaggcugauaguggaugcgucgucagcuggaaaaauaaagagcuaaaauguggaucaggaauauuuaucacugacaauguucauacauggacggaacaauacaaguuccaaccggagucgccuuccaaacuugcguccgccauacagaaagcccacgaggaagggauauguggcauaagaagugucacuagacucgaaaaccuuauguggaaacagauaacaccugaauugaaccauauacuauccgaaaacgagguaaaacuuacaauaaugacuggagacaucaagggaaucaugcaagcagggaagcguuccuuacgaccucaaccaacugaacugaaguauucauggaaggccuggggaaaggcaaaaauguuaucaacagaauuacauaaucacacauuucuaauagauggcccugaaacugcugaguguccuaacacaaauagggcuuggaauaguuuagagguugaagauuaugguuuugguguguuuacaacaaacaucugguuaaaacugaaggaaaggcaggaugucuuuugugauaguaaguugaugucugccgcuauaaaggauaacagagcugugcaugcagacaugggcuacuggauagaaucugcgcucaacgacacuuggaagaucgaaaaagccucauucauagagauaaaaucaugccacuggccaaaaucucacacucuauggucaaauggcguguuagaaucugagaugauuauacccaaaaauuuugcagggccgguuucucaacauaauuacaggccaggauaccauacgcaaacugcuggaccauggcauuuaggcagacuugaaauggacuuugacuucugcgaagguacaaccgucgucgugacggaagauugcggaaaucgaggcccaagucuaagaacgacgaccgcaucuggaaaacuaauaacggaauggugcuguagaagcugcacacuaccgccauuacgcuaccgaggagaagaugguuguugguauggaauggagauacgaccguugaaagagaaagaggagaaccuggucaauagccuaguaacugcuggucacggucagauagauaauuucucucuaggagugcucggcauggcuuuguuccucgaagaaauguuaagaacucgcguagguacgaagcaugcgauucuccuaguagcaguaucauuugucacgcugauaacgggaaauaugucauuuagagaucucggaagggucaugguuaugguuggagccacuaugacugacgacauagguaugggaguaacauacuuggcacuauuagcggcuuuuaagguucgaccaaccuucgcugccggauugcuguuacgaaaauuaacguccaaagaauuaaugaugacuacaauuggaaucguacugcugucucaauccacuauaccagagacaauacuggaguugacugacgcccuagcauugggaaugaugguucuuaaaaucguacgcaacauggaaaaguaccaacuagccguaacaauuauggccauuuuauguguaccaaaugcagucauccuucagaacgccuggaagguuucaugcacuacuuuggcaguagucucugugagccccuuacuauugacaucaagccaacagaaagcagauuggauuccacuagcgcuuacaauaaaaggccuaaacccaacggcgauauucuuaacuacguuaucaagaacuucgaagaaaagaucguggccacuaaacgaagcaauaauggcuguggggaugguuaguauuuuagcaucaucuuuauugaaaaaugacauccccaugacaggcccauuaguagcaggaggucuauuaacugucugcuacgugcuaacaggaagaagcgcagauuuagagcuagaaagagcugcagauguuaggugggaggaacaagcagaaauuaguggaucaagcccaauauuaucaauaaccauuucugaagacgguaguaugucaaucaaaaaugaagaggaggagcaaacacuaacaauacugauaagaacuggccuccuugucaucaguggacuuuuucccguaaguauaccgauaacggcugcagcgugguaucuaugggaagugaagaaacaaagagcgggaguucuaugggauguuccuagcccucccccugugggaaaagcugaauuggaagacggagcauaucguauaaaacaaaaagggauucuaggauacucucaaauaggagcuggaguauauaaggaagguacauuucacacuauguggcacgugacucguggggcaguacucaugcacaaaggcaaaagaauugagccgucgugggccgaugucaagaaagaucuaauaagcuauggaggaggauggaaacuagaaggagaauggaaagagggugaagaagugcaaguguuggcauuagaaccaggaaagaauccaagagcuguccaaacuaaaccggguuuauuuaaaaccaauacagguacaauaggagcuguaagccucgauuuuuccccaggaacgucuggaucgccaaucguugauaagaaaggcaaaguuguagguuuauacgggaaugguguaguuacaagaagcggcacauacguuagugccauagcacaaacugagaaaucuaucgaagacaauccagaaauugaagacgauauuuuccguaagaaacgacucaccauuauggacuugcacccgggugcaggcaaaacaaaacguuacuuaccugccauuguuagagaagcaauuaaacguggauuacgaacucuaauccuggcaccaacgagaguaguugcggcagagauggaagaagcguuacgaggccugcccaucagauaucaaacucccgcuauuagggcagaacauacaggacgcgaaauagucgauuuaaugugucaugccacauuuaccaugagauuacuaucuccaauaagagucccuaauuauaaucugauaauuauggaugaagcacauuucacagauccggcgagcaucgccgcaagaggcuacaucucaacacguguagagaugggagaagcagcgggaauauucaugacagcgacucccccaggaucacgugacccuuucccucaaaguaacgccccuauuauggacgaggaacgugaaauaccagaaaggucauggaacucuggacacgaaugggucacagauuuuaaagggaagacaguaugguucguaccauccauuaaggccgguaaugacauagcagccugccucaggaaaaacgggaagaaagucauucaauuaagcaggaagacauuugauacugaauauauaaagacucguacuaacgauugggauuuuguaguuacuacagauauuagcgagaugggagcaaauuuuaaggcagaaagagugauagauccacgacgauguaugaaaccaguaauuuugacagacggugaggaacguguaauacuugcagggcccaugccuguaacgcauucguccgcggcacaaagaaggggucgaguaggucgaaaucccaaaaaugaaaacgaucaauacauuuacaugggugagccacuagaaaaugacgaagacugcgcucacuggaaagaggcaaaaaugcuucuggauaauaucaauaccccagaaggaaucauuccuucaauguuugaaccggaaagggaaaaaguagaugcuaucgacggggaguacagauugcgcggugaagcaaggaaaacuuuugucgaucuaaugcgucguggggauuuaccuguuugguuagcauacagaguugcagcugaaggaauuaacuacgccgauagacgcugguguuuugacggagugaagaacaaccaaauauuagaggagaauguggaaguagagauuuggaccaaagaaggggaaaggaagaaauuaaaaccaagguggcuagacgcaagaauuuacagugauccacuugcuuuaaaagaguucaaagaguuugcggcaggaagaaaaucgcugacucuuaaccuaauuacugaaaugggcagacuucccaccuucaugacacagaaagcaagaaaugcgcuggauaacuuagcugucuugcauacagccgaagccgguggaagggcuuauaaucaugcauuaucugaacuuccagaaacguuggaaacgcuuuuacuuuuaaccuuacuugccacuguuacagguggcauauuuuuauucuuaaugucaggcaaggggauuggaaaaaugacucucggaauguguuguauaauuacugccucgauucuucuuugguacgcacaaauccaaccucauuggaucgccgccaguauaauuuuggaguuuuucuuaauagugcuauugauaccggaacccgaaaaacaaaggacaccccaagauaaccaacucacauacguaguaauugccauauuaaccguaguggcugcgacaauggcuaacgagauggguuuccucgagaaaacaaagaaagauuuuggacuugguaguauuacuacacaacagccggaaucaaauauacuugauaucgaucugcgaccagcuuccgcuuggacacuuuaugcagucgcaacuacuuuuauuacaccuauguuacggcacucaauugaaaacucaucagugaacguaucucuuaccgcaauagcgaaucaagcuacaguauuaauggguuuaggaaagggcuggccucucaguaagauggauauaggaguaccacuacuugcuaucgggugcuauucgcaaguaaaucccauaacauuaacugcggccuuauuacuauugguaacccacuaugcaauuauugguccggggcuacaagcuaaagccacuagggaagcccagaaaagggcagcagccgggauaaugaaaauccccaccguggacggcauaacugucauugauuuagacccuauccccuaugaucccaaguuugaaaaacaauuaggccaagugauguuauugguucuaugcguaacacaaguuuugaugaugcgaacaacaugggcauuaugugaagcucugacuuuagcaacugggcccaucucuacucuaugggagggaaacccggggagauucuggaauaccacaauugcggugagcauggccaacaucuuucgugguagcuauuuagcgggcgcaggguuacuuuucaguauuaugaagaauacagcaaauacacgacgcggaacgggaaacaccggugaaacccucggugagaaauggaaaaauagacucaacgcccuaggcaaaagcgaauuucaaauauacaagaaaagugguauacaagaaguagaccgaacauuagcgaaggaagggaucaaacguggagaaacagaucaccacgcagugucacguggcagcgccaaacuccgcugguuuguggagcgaaacuuaguaacacccgaaggcaaaguaguagaucuaggcugcgggagagguggauggagcuauuacugugguggacuaaagaacguuaaagaagucaaaggcuuaacuaaaggaggaccuggacaugaagaaccaauaccaaugucuacuuacggguggaaucuaguuaggcuucaaucugguguagacguauuuuucacaccacccgaaaaaugcgauacgcuacuaugcgauaucggcgagucaucucccaaucccacuguugaggcuggcaggacauuaagaguccuaaauuugguugaaaacuggcugaacaauaauacgcaauuuuguauaaaggugcuuaacccauauaugccguccguaauagagaaaauggaagccuuacaaagaaaauacggaggggcacucguaagaaauccauuaucuagaaacaguacucacgaaauguauugggucaguaaugcaucuggaaacauuguaaguucaguaaauaugauaucaaggauguugaucaaucgcuucacuaugaggcauaagaaagcuacguacgaacccgacgucgaucucgguucuggaacaagaaacauagguauagagagugagacuccaaacuuggauauuaucggcaaacggaucgagaaaauaaaacaagaacaugaaacaucauggcauuaugaccaagaucauccauacaaaaccugggccuaucacgguagcuaugaaacuaaacaaacaggcucugcuaguucuaugguaaaugggguggugagguuauuaacaaaaccaugggaugugauucccaugguaacacagauggcaaugaccgauacuacuccauuugggcaacaaagagucuuuaaggaaaagguggacacucgaacgcaagagccuaaagaaggaacuaagaaacuuaugaaaauaacagcggaauggcuauggaaagaacuagguaaaaagaaaacaccacgaaugugcacuagggaagaguucacuaggaaaguacgauccaacgcugcauuaggcgcgauauucacugaugaaaacaaauggaaaagcgcaagagaggccguagaggauucaggauuuugggaguuaguagauaaggagcgaaauuuacacuuagaaggaaagugcgaaacuuguguuuacaauaugaugggaaaacgagagaagaaacuuggagaauuuggcaaagcuaaaggaucacgugcaauuugguauauguggcuaggagcacgauuucuggaauuugaagcacugggauucuuaaacgaagaucacugguuuucacgugaaaauucucuuucugggguugagggagagggccuucacaaacuagguuacauauugagagacguuaguaagaaagaaggaggugccauguaugcugacgauacugcgggcugggacacaagaauuacgcuagaagaucucaaaaaugaggaaaugguaacaaaucauauggagggugaacauaagaaauuagcagaagcgauuuuuagacuuaccuaccaaaacaaagugguacgaguccagcguccuacaccgaggggaacgguuauggacauuauaagucggagagaccaacgaggaucuggccagguuguaacuuaugguuuaaauacauuuacgaauauggaagcucaacuaauccgacaaauggaaggagagggucuauucaaaagcauucagcaucuaaccguuacagaagaaauagcagugaaaaacuggcucguacgaguugguagggaacgacuaucccgcauggcaauaaguggagacgauuguguagugaaaccauuagacgaccgguuugcguccgcccugacagcauuaaaugauauggguaaaguucguaaagauauccaacaaugggaaccaaguagagguuggaaugauuggacacaaguaccauucugcagccaucauuuccacgaacuuaucaugaaggacggaagaguccuaguugucccaugucgaaaucaagaugaacuaauaggcagagcacgaauuagccaaggagcuggguggucuuuaagagaaacagcgugccuaggaaagucguaugcucaaauguggucauugauguauuuucaucguagagauuuaagauuggcugccaaugccauuugcagugccguccccagucauuggguccccacuucuaggacuacauggucgauacaugcaacucaugaauggaugacaaccgaagauaugcuaacaguguggaaucgcguuuggauacaggagaacccuuggauggaagacaaaacaccaguggaaaguugggaagaaauuccauaucucggaaagagagaagaccaguggugugguaguuuaauaggauuaaccucccgagcgacgugggccaaaaauauacaaacagcuauaaaucaaguaagaagucuuauagguaacgaagaauacacggauuauaugccaaguaugaaacguuucagaagggaagaggaagaagcuggaguauuaugguaa

SEQ ID NO: 22230 - RNA, 9876 nt, Artificial Sequence
  derived and/or modified CDS sequence (opt6) from DENV-2__KX380832__SS-prME
accgcuggaauuaucauuaugaugaucccgacuguaauggcauuucaucugacgacacgaaacggggaaccgcacaugaucguuucgagacaggaaaaaggaaaaucauuacuuuucaaaacagaaaacgguguaaauaugugcacauuaauggcaauggaccugggagaacuaugcgaagacacaaucacguacaacuguccacuucuacgacaaaacgaaccugaagacauugauuguuggugcaauuccaccagcacguggguaacauacggaaccugcacggcuacaggagaacauagacgugagaaaaggucuguagcgcuagugccucauguaggcaugggucuagaaacacguacugaaaccuggaugaguucugaaggggcauggaaacaugcgcaaagaauagaaacguggguacuaagacauccgggauucaccguaauggcagcuauucuggcauacacgaucggcacgacauacuuucagcgaguacuaauauuuauucuauuaacugcaguagcacccucgaugacuaugagaugcaucgguauuaguaacagggauuucguagaaggaguuaguggaggaucuuggguggauauagucuuggaacacgggucuugcguuaccacgauggcuaaaaauaaaccaacgcuagauuuugaauuaauaaaaacagaagcgaaacaucccgcaacuuuacguaaauauuguaucgaagcaaaauuaacaaacacuacaaccgcaucgcguugccccacucaaggugaaccaucacuuaaugaagaacaagacaaaagguucgucuguaaacacagcaugguugaucgcggcuggggaaacggauguggcuuauuugguaaagguggcauuguaacgugugcgauguuuaccuguaagaaaaauauggaaggaaaaauaguacagccugaaaaucuagaauacacuauagugauaacuccucauaguggagaagaaaaugcuguuggaaaugauacggguaaacauggaaaagaaauaaaaguuacaccucaaucgaguauaacugaagcugagcucacagguuauggcacagcaacaauggaaugcucuccaagaacugggcuagacuuuaaugaaaugguacuauuacaaauggaaaacaaagcguggcuaguacacagacagugguuucucgacuuaccacuuccauggcucccaggagcagauacacaaggcuccaacuggauucaaaaagaaacguuaguuacauucaagaauccgcaugccaagaaacaggauguuguuguauuagguagucaagaaggugcaaugcacacugcacuaacuggugcuaccgaaauccagauguccaguggaaaucuuuuauucacgggccaucuaaaaugucgauuaaggauggacaagcuacaauuaaaagggaugaguuauagcauguguaccgguaaauuuaaaguaguuaaggaaauagcagaaacacaacauggaacuaucgugauuaggguacaguaugagggcgauggaaguccuugcaaaauacccuucgaaauaauggacuuagagaaacgacacgucuuagguagacuaauaacuguuaacccuauaguaacagagaaagauucccccguaaacauagaggcagagcccccuuucggagauucauauauaauaauuggaguggaaccaggucaauugaaacuuagcugguucaagaaagggagcuccauaggucaaauguucgaaacaacgaugaggggagcaaagcguauggccauacucggggauacagcgugggacuucgguaguuuaggagguguauuuacaucuauagguaaagcgcuucaccagguuuuuggcgcuauuuauggugcagcauucuccggaguuagcuggacaaugaaaauuuugauaggcguagucauuacuuggauaggaaugaacaguagaaguacuucccuaucaguaagucuggucuuagugggcauagucacguuauaucucggcgugauggugcaagcugauucaggaugcguaguuaguuggaagaauaaggaauuaaagugcgguucugguauauuuauaacugauaauguacacacguggacggaacaguauaaauuccaaccggagucuccaaguaagcucgcaucagcaauucaaaaggcacacgaagaaggcauuugcgguauuagaagcguaacgcgacuugaaaaucuuauguggaaacagaucacccccgaauuaaaucacauacucucggaaaaugaaguaaaauuaacaauaaugacuggggauauaaaaggcauuaugcaagcaggaaaaaggaguuugagaccccagcccaccgagcuaaaauacucauggaaagcauggggaaaagcaaagaugcuuagcaccgagcuacauaaucauacauuucuaauagauggaccagaaaccgcugaaugucccaauacuaacagagcuuggaacucacuggagguagaagauuauggauucggaguauuuaccacgaauauuugguuaaaacuaaaagaacgacaagaugucuuuugugauagcaaacucaugucugcugcaauaaaagauaauagggcuguccaugcggauaugggcuauuggauagaauccgcucuuaaugacacuuggaaaauugagaaggcgaguuuuaucgaaguuaaaucaugucauuggccgaagucccacacccuguggaguaacggaguauuagaaucugagaugauuauuccgaaaaauuucgcaggaccagugagucaacauaauuaccguccuggcuaucauacacaaacagcaggucccuggcaucucggaagguuagaaauggacuuugauuucugugaagguacaacuguuguaguuacugaggacugcggaaaucgagggccgagcuuaagaacgacuaccgcaucgggaaaauugaucacagaaugguguugcagaucuuguacucuuccacccuuaagauauagaggugaagacgguuguugguauggaauggagaucagaccacugaaagaaaaagaggaaaaccuaguaaauagcuuaguaaccgcaggacaugggcaaauugacaacuuuucucuggguguucucggaauggcauuauuuuuagaagaaauguuaaggacuagaguuggcacaaaacacgcuauauugcuaguugcgguuucuuucguaacccucauuacuggcaacauguccuuuagggauuuaggaagaguaauggucaugguaggagcaacaaugacagacgacauugggauggggguaacuuauuuagcguuacuagcagcuuuuaaaguuagaccgacauucgcggcaggacugcucuuacguaaacuuaccuccaaagaacuuaugaugacaacuauaggaauuguuuuacuaagccaauccacaaucccagaaacuauacuagaacugacugaugcuuuggcacucgggaugaugguuuuaaaaauuguuagaaauauggagaaguaucaacuagcaguuacgauaaugacaauacuaugcguaccuaacgcagugauacuucaaaaugcguggaaaguaucaugcacuauacuggcaguuguaucaguaaguccucugcuacucaccagcagucaacaaaaagcagacuggaucccgcuagcucugacaaucaaagggcugaauccaacagcaauauuuuuaaccacccucaguaggacaaguaagaaaaggaguuggccauugaaugaagcuauaauggcaguagguaugguaaguauacuagccucgucgcugcucaaaaaugacauaccuaugacggguccguuaguagcaggaggacucuuaacgguauguuauguuuuaacuggaagaagugcagauuuagaauuggagcgagccgcugaugugcguugggaagaacaagcagaaaucaguggaaguagcccuauucuaaguauaacaaucagugaagacggcucaauguccaucaagaaugaggaagaagaacagacucugacaauccucauacgaacaggccuccuaguaauaagcggguuguuuccaguaaguauuccuaucacagcagcggcuugguauuuaugggaggucaagaaacaacgugcaggagugcucugggacgucccgucaccaccuccuguagggaaggcggaacucgaagacggugcuuacagaaucaaacaaaagggaauauuaggcuauucgcaaaucggagcagggguguacaaagaggggacuuuccauacaauguggcaugugacuagaggggcgguauuaaugcauaaaggcaaacgaauagaaccuaguugggcugauguaaagaaagauuugauaaguuauggagguggauggaaacucgaaggagaguggaaagaaggugaagaaguccaaguacuagcauuagaaccaggcaagaaccccagagcgguacaaacaaaacccggacuuuucaaaacaaacacuggcacgaucggagcaguaucccuagauuuuucgccugguacaucgggaucuccgauagucgauaagaaaggaaaaguuguaggacuuuauggaaacggugugguuacacgcucuggaacauaugugagugcuauagcccagacugagaaaagcauagaagacaauccugagaucgaagaugauauuuuucguaagaaacgacuaaccauuauggaucuucauccuggugcaggaaaaacaaagcgguaccucccugccauuguuagagaggccauuaaacgcggccuaagaacuuugauacuagccccaacucggguaguagcugcagagauggaagaggcguuaagggggcuuccaauucgcuaccagacgccggccauacgagcggaacauacggggcgggaaauuguagaucuaaugugucacgcuacguucacaaugcggcuccuaucaccaauuagagugccuaauuauaacuuaauaauaauggacgaagcccauuuuacggauccagcaucaauagccgcacgaggauauauuucaacccgcguugaaaugggagaggcugcgggcaucuucaugacagcaacaccuccagggucuagagauccguuuccccaaaguaaugcaccaauaauggaugaagaacgugagauaccugaaagaaguuggaauaguggucaugaguggguaacugacuuuaaagguaaaacaguuugguuuguacccucgauuaaagcuggaaaugacauuaccgcauguuuaaggaaaaauggcaagaaagugauacaacuuagucguaagacguuugauagugaauauauuaagacccgcacuaaugacugggauuucguagucaccacagauauuagugaaaugggagcgaauuuuaaagcugaaaggguuauugauccgcgaagauguaugaaaccuguaauucuaacagacggggaagaaagaguuauacuugcaggcccgaugccuguuacucauaguucagcagcccagcgacgcggucgagugggaagaaaucccaagaacgaaaacgaucaauacauauauaugggugagccguuggaaaaugacgaagacugcgcucacuggaaagaagcgaaaauguuacuugacaauauuaauacgccagaagggaucauaccaucuauguucgaaccagaaagggaaaaaguggacgcgauugacggagaauaucgccuccguggagaagccagaaaaacuuucguagaucuaaugaggcguggagacuuaccugucuggcuggcguacaggguagcagcagaggggauuaauuaugcggaucgaagauggugcuucgacggagucaaaaauaaucaaauacuggaagaaaauguagaaguagaaaucuggaccaaggaaggggaaagaaagaaacucaaaccucguugguuggaugcaagaauauauucagauccacuggcuuuaaaagaauuuaaagaauuugcugcaggaaggaaaagucuaacacuaaauuuaaucacggaaaugggcaggcugccgacuuuuaugacgcaaaaagcucguaaugcguuagauaacuuagcuguucuacauacagcugaggcaggagggagagcuuauaaucacgcccuaucagaguuacccgagacauuagaaacguuauuacucuuaacucuuuuggcaacuguaacagggggaauuuuccuuuuucuuaugucaggaaaaggaauagggaagaugacacuaggaauguguugcauaauuacugcaagcauuuuacuuugguacgcccaaauacagccacacuggauagcggcgagcaucauacuagaguuuuucuuaaucguucuauuaauuccagaaccggaaaaacaaagaacaccacaggauaaucaauugacguauguuguaaucgcaauccugacagugguagcggccacgauggcuaacgagaugggauuucuagagaaaacgaagaaagauuuuggccuaggcucaauaacuacacaacaaccagauucaaacauuuuagacauagauuuacggccggcgucggcuuggacuuuauaugcaguagcuacuacuuucauaacgccuauguuaaggcacagcauagaaaauucaagcguuaauguaucauuaacggcuaucgcgaaucaagcaacaguacuaaugggucuugguaaaggauggccccuaagcaaaauggacauuggagugccccuucuugcuauaggaugcuacucgcaagucaauccaauaacauuaacagcggcguuauuacuucuaguagcucacuaugcaauuauaggcccaggucuacaagcaaaagcuacucgcgaagcgcagaaaagagcggccgcggguaucaugaaaauuccggcugcagauggaauaacaguuaucgacuuggaccccauuccuuacgauccaaaauucgaaaaacaauuaggacaggugaugcuuuuaguacuuuguguuacacaaguccuaaugaugcguacuaccugggcacuaugugaagcccuaacauuagcaacagguccuauuagcacccuuugggaagguaauccaggacgguucuggaacaccacgaucgcaguaucgauggcaaacauauuucgaggcucuuacuuggccggugcgggauuauuauuuucuauaaugaaaaauacugcaaacacccgaagaggaaccgggaauacuggggagacauuaggugaaaaauggaaaaaucgauuaaaugcccuuggcaaaucggaguuccaaauauacaaaaagucugguauacaggaaguugacagaacacuugccaaggaaggcauaaaaagaggagaaacagaccaucacgcuguaucacgcggcucugcuaaauuacguugguuuguagaaagaaaccucguaaccccugaggguaaagucguagaucuaggaugugggagaggugguuggagcuacuacugugguggccugaaaaauguuaaagaagugaaaggucucaccaaaggagggccugggcaugaagaaccaauuccaaugucaacauacggcuggaaccuuguuagacuucagucuggugucgacguguucuuuacaccaccagaaaaaugugacacacuucugugugauauuggagaaucuucacccaauccuacaguagaagcaggucgaacucuacgcguucuaaauuuaguagaaaauuggcuaaauaauaacacacaauucuguauuaaaguauuaaauccuuacaugccaagcguaauugagaaaauggaagcauuacagagaaaauacgggggagcguuaguuagaaacccguugucgcgcaacucaacccacgaaauguacuggguuucaaacgcuucuggaaauauagucagcucugucaauaugauuucccgaauguuaauuaauagguucacaaugaaacacaagaaagcuacauacgagccggauguagaccuagguucaggaacaagaaauauagguaucgagucugaaacaccgaacuuagauauaauuggaaaaagaauagaaaagaucaaacaggaacaugagaccagcuggcacuaugaccaagaucacccauauaagacgugggcguaucacgggaguuaugaaacaaagcagacaggcucugcaaguaguaugguuaauggaguaguaagauugcuuacgaaacccugggacguaaucccaaugguaacucaaauggcgaugacugacacaacaccguuuggacaacaaagaguguuuaaagaaaaaguagacacacgcacacaagaaccaaaagaaggaacuaagaaauuaaugaaaauaaccgcagagugguuauggaaggaauuaggaaagaagaaaaccccacgaaugugcacuagagaagaguucacuagaaaaguucgaucuaaugcagcuuugggagcaauuuucaccgacgaaaauaaguggaaaagcgcaagggaagcugucgaggacagcggguuuugggaacuuguggauaaagaaagaaauuuacaucuggagggaaagugcgagacgugcgucuacaauaugauggguaaaagagagaagaaauugggcgaguucggaaaagcgaaaggaaguagagcaauaugguauauguggcuaggggcucgguuccucgaguucgaagcccuuggguucuuaaacgaagaccacugguuuaguagagagaacucuuuguccgggguggaaggcgagggacuccauaagcuggguuauauacuaagagacguuaguaagaaagaaggaggagcuauguaugcagacgacacugcagguugggauacaagaauuacacuagaagaucuaaagaacgaagagaugguaacaaaucauauggaaggagaacaccggaaauuagcagaggcaauuuuuagauuaacauaucaaaauaaaguuguacguguucaaagaccuacacccagaggaacagugauggacauaauaagccggagagaucaaagaggaaguggacaaguaguuacauacgggcuaaauacuuuuacgaauauggaagcgcaacuaauacgacaaauggaaggagaaggcguauucaagucaauucaacauuugacugucacugaagaaauagccgucaaaaauugguuagaacgagucggucgagaaaggcugucacguauggcaaucucgggcgaugacugcguggucaagccacuggaugacagguucgcgucagcgcugacagcacugaaugauaugggcaaggugcgaaaagacauacaacaaugggaacccucaagaggguggaacgacuggacacagguuccauucuguucacaccacuuucacgaacuuauaaugaaagacggaagaguccuagugguacccugucgcaaccaagacgaauuaauugguagagcaaggaucucccaaggggcaggauggucacuaagagaaacugcaugcuuggguaagaguuaugcacaaauguggagucuaauguauuuucauagacgggaucuaagacuagcagcgaacgcaauuuguagugcaguaccaagccacugggugccaaccaguagaacgacguggagcauccaugcaacccacgaauggaugacaaccgaagauauguuaacgguauggaaccgaguauggauccaagaaaauccauggauggaggauaagacgccagucgaaucaugggaagaaauaccguauuuagggaagagagaggaucaauggugugguucacugauuggucuuaccagucgcgcgacuugggcaaagaauauacaaacggcaaucaaucagguaagaucauuaauuggaaaugaagaauauacagacuauaugccgagcaugaagagguuucgaagggaagaggaagaggcaggcguucuaugguga

SEQ ID NO: 22231 - RNA, 9876 nt, Artificial Sequence
  derived and/or modified CDS sequence (opt6) from DENV-2__KX380833__SS-prME
accgcagguauuauuaucaugaugauucccacgguaauggcuuuucacuuaacgacgagaaauggagaaccccacaugauaguuagccgacaagaaaaagguaaaucacucuuguuuaaaacagaaaacggagugaacaugugcacucuuauggcaauggaccucggagaauugugcgaagacacaauaacauauaacuguccucuucuaagacaaaacgaaccugaagauauugauugcuggugcaacaguacuucgacuuggguaacauacggaacaugcacagcaacaggggaacaucgccgugaaaaacgcuccguugcguuggugccucacguaggaaugggucuugaaacaaggacagaaacauggaugagcagugagggagcguggaaacaugcucagcguauagagacauggguacucaggcauccaggcuuuacagugauggcagcaauucucgcguacacuauaggaacgaccuacuuucagcgagugcugaucuuuauucucuugacagcggucgcaccuucuaugacgaugcggugcauaggaauuucaaauagagauuuuguagagggaguuucgggaggaucauggguggauaucguauuagaacaugguuccugcguuaccaccauggcgaaaaacaaacccacuuuggauuucgaauugauuaaaacggaagcgaaacaccccgcaacgcuacgaaaauacuguauagaggcaaaauugacuaacacaacuacugccucgagauguccaacacaaggugaaccuucuuuaaaugaggagcaagauaaaagguucguuugcaaacauucaauggucgauaggggcuggggaaauggaugcggucuguucggcaaaggaggaauaguaacaugugcuauguucacaugcaagaaaaauauggagggaaaaaucguacaaccagaaaacuuagaauacacaauaguaauuaccccacacucaggugaagaaaaugcgguuggaaaugauacugguaaacacggaaaagagauaaaaguuacuccgcaaagcucuauaaccgaagcagaauugacgggauauggaaccgcuacaauggaauguucuccaagaacaggguuagacuuuaaugaaaugguucuucugcaaauggaaaauaaagcauggcuaguacacaggcaaugguuuuuagaucuuccguugccguggcuacccggagccgacacccaaggaucaaauuggauccaaaaagaaaccuuggucacauuuaaaaauccacacgccaaaaagcaagauguuguaguccuugggagucaagaaggagcgaugcauacugcucucacaggugcaaccgagauacaaaugucuucgggaaaucuacuauuuacugggcaccuuaaaugucgccuacgaauggauaaacuucagcucaaaggcaugucguauucaaugugcacagggaaguuuaaaguggucaaagaaauagcagagacacaacacgguacaauuguaauacguguucaauacgaaggagauggaucaccaugcaaaauaccguuugaaaucauggacuuggaaaaacgucauguucugggcagacuaauuacgguaaauccaauuguaaccgagaaagacaguccuguuaacaucgaagcugaaccaccauuuggugauagcuauauaauaauaggaguugaacccgggcagcugaaauugucaugguucaagaaagggaguucaaucggacagauguuugagacaacuaugcguggagccaaaagaauggccauacuuggugauaccgcuugggacuuugggagucucggaggaguguuuacgucaauaggaaaggcuuuacaucaaguuuuuggagcgauuuacggagcagcauuuagugguguaaguuggacuaugaaaauucuuauaggagugguaauaacuuggauugguaugaacucaagaucaacgagucuuaguguuucccuuguccuagucggcauaguuacucuauaccuuggagucauggugcaggccgauucaggcuguguuguaagcuggaagaauaaggaauugaaaugcggaaguggaauauuuauaacggacaaugugcacacauggacggaacaauauaaguuucagccggaguccccaaguaagcuagcuucugcaauacaaaaagcgcacgaggaaggaauaugcgguauaaggagugucacucgcuuagaaaauuugauguggaaacaaauaacaccagaguuaaaucauaucuuaucugaaaaugagguaaaguuaaccauaaugacaggcgacauaaaaggaaucaugcaagcaggaaagcggucccuaaggccacaaccaacagaauuaaaauacagcuggaaagcauggggcaaagccaagauguuaucaaccgaacugcacaaucauacauuucuaauagauggaccugagacugcggaaugcccaaacacuaaucgggccuggaauaguuuagagguugaagauuacggcuuuggcguauucacaacaaacaucuggcucaaacuaaaagaaagacaagauguguuuugugauagcaaacucaugagcgccgcuauaaaagacaaucgagcaguacaugcagauaugggauauuggauagaauccgcacugaaugauacuuggaagauugagaaagcgucauuuauugagguaaaaaguugucauuggccaaaaucgcauacacuauggucgaauggaguccuagaaagcgaaaugauaauaccuaaaaauuucgcuggcccaguuucgcagcauaauuauagaccagguuaucacacccaaacggcaggaccauggcaccucggacgccuugagauggacuuugauuucugugaaggaacgacaguaguaguuacagaagauugcggaaacagggggccaucucuaagaacaaccacugcaucuggaaaacuaaucacagaaugguguugcagauccuguacguugcccccucuccgauauagaggagaggacggguguugguaugggauggaaaucagaccacuaaaggagaaagaggaaaauuuggucaacucacuugucacggcaggccauggacagaucgauaauuucagucuaggaguacuuggcauggcauuauuuuuagaagaaaugcuacgaacacgagugggaaccaaacaugcuauauuauuaguagcugucucauuugucacacuaauaacgggcaauaugucauuucgagaucugggaaggguaaugguuaugguaggcgcaaccaugaccgacgauauaggaauggguguaaccuacuuagcgcuauuagccgcauuuaagguaagaccaaccuuugcagccggguuauugcuacgcaaacuaacgucgaaagaauuaaugaugacuacgauugggauaguauuguuaucucagaguacaauuccggagacgauacuagaguugaccgaugcauuggcacuugguaugauggugcuaaaaauugugagaaacauggaaaaauaucagcuugccgugacuauaauggccauauuaugugucccuaaugcaguaauucuucaaaacgcauggaagguaagcugcacgauucuggcaguuguuuccguaaguccucuacugcucacaucuucacaacaaaaagcugauuggauaccauuagcuuugaccaucaaagguuuaaauccgaccgccaucuuucuaacaacacuaucaaggacaucuaagaaaagaucuuggccacuuaacgaagcgauuauggcuguugguaugguuaguauuuuagcaaguagccucuugaaaaacgauauuccuaugacagguccucugguggcaggaggacuacuuacgguuuguuauguacuuacuggucgcucugcagaucuagaacuugagagagcagcagauguaagaugggaagaacaggcagagaucucagguucuucuccaauacuuucaauuacaauuucagaagauggauccaugucgaucaaaaaugaagaggaagaacaaacguuaaccauucuuauucgaacgggguugcuaguaauaucaggguuauucccugugaguauaccaauuacggccgccgcaugguaucuuugggaagucaagaaacagagagcugguguguugugggauguaccuucaccaccacccguagguaaagcugaacuagaagauggcgcguauagaauuaaacagaaaggcauccuuggcuacucucagauaggcgcaggaguuuacaaagaaggaacuuuucacacgauguggcacguaacuagaggugcuguauuaaugcauaaagguaaaagaauagaaccaucaugggcagauguaaagaaagaccuaaucaguuaugggggcggcuggaaauuggagggggaauggaaagagggagaagaaguucaggugcuagcgcuggaaccagggaagaauccucgggcgguucagacuaaaccaggccuauuuaagacaaauaccggaacuauuggugcgguauccuuagacuuuucuccuggcacgucgggaagccccauaguagacaaaaaggggaaaguuguaggccuuuaugggaacgguguaguaacucguucagggacguauguuagugcaaucgcacaaacggaaaaaucaaucgaagauaaucccgaaauugaggaugacauuuucagaaagaaacgacucacaauuauggauuuacauccgggugcaggaaaaaccaaaagauaucugccagccauaguacgggaagcaaucaaaagagguuuaaggacacuaauacucgcgccuacacgggucguugcagcagaaauggaagaagcguugagaggauugccaaucagauaucaaacuccggcaaucagagcggaacauacaggucgugaaauaguagaccuaaugugucacgcgacuuuuacaaugagauuauugucuccuauaagagugccuaauuacaauuuaauaauaauggacgaagcacauuucaccgaucccgcaaguauagcagcaaggggauacaucucaacuaggguagagaugggugaagccgcaggaauauuuaugacagccaccccaccaggaucuagggauccauuuccacaaucaaaugcgccaaucauggacgaggaacgagagauucccgaaagaucguggaauagugggcaugaauggguuacugauuuuaaagguaaaacugugugguuugucccaucgauaaaagcagggaaugacauagccgcaugcuuaaggaaaaaugggaagaaaguaauucaguugagucggaaaacuuuugauucagaguauauaaaaacucguaccaaugauugggacuuuguugugacaacugacaucucugaaaugggcgcgaauuucaaagcagaaagaguaauagauccaagacgcugcaugaaaccagucauacugacagauggagaagaacgggucauacuagccgguccaaugcccguuacucacaguagugcagcccaacguagggguagaguaggcagaaauccuaaaaaugaaaacgaccaauauauuuauaugggugaaccucucgaaaaugacgaagauugugcacacuggaaagaagcaaaaauguuacuagauaauaucaacacaccagaaggcauuauaccaaguauguucgaacccgagcgggaaaaaguggaugcaaucgacggugaauauagauugagaggcgaggcuagaaagacauucguagaccuuaugagacggggagauuuaccaguauggcucgcauaucggguggcugcagaaggaauaaauuacgcggacagacgguggugcuuugauggagugaaaaauaaucaaauccuagaagaaaacguagagguugaaauauggacgaaggaaggagaacgaaagaaacuuaaaccacgauggcuagaugcgcgcauuuacagcgacccacucgcguuaaaggaauuuaaagaauuugcagcuggacgaaagagcuugacucuaaaucuaauuacagaaaugggaaggcucccuacauuuaugacgcaaaaggcaagaaacgcauuagauaauuuagcugucuuacacaccgccgaagcgggaggacgugcuuauaaccaugccuugucugaauuaccggagacucuggaaacucuuuuauuauuaacauuacuugcuacgguaacaggaggcaucuuccuauuuuuaaugucuggcaaaggaauaggaaagaugacccuaggcauguguugcaucauuacagcuaguauauugcugugguaugcccaaauccaaccgcacuggaucgcagcaagcauaauacuggaguucuuuuuaaucgugcuacuaauaccagaaccugaaaaacaacguacaccacaagacaaucagcuaacguauguaguuaucgccaucuuaacgguggucgcagcgacuauggcgaaugaaaugggauuuuuagagaaaacuaaaaaggauuuuggucuaggaucaauaacgacgcaacaacccgacucuaacauacucgauauagacuuaagacccgcuagugcauggacacuuuacgcugucgcaacaacauucauaacaccuaugcuaagacauucuaucgaaaauucaaguguaaaugugucacucacugcaauugcgaaucaggcaacgguuuugauggguuuggggaaaggauggcccuuaucuaagauggacauaggcguuccacucuuggcgauagguuguuacucccaaguaaacccaauaacguuaacggccgcauuauuauuauuagucgcacauuaugcaauaaucggcccuggauuacaagcaaaagcaacccgagaggcgcaaaaacgugcagcagccggaaucaugaaaauaccagccgccgacggcauaaccgucaucgacuuagaucccauucccuaugauccaaaauucgagaagcaacuuggacaaguuauguuauugguauuauguguuacgcaaguacuuaugaugcggacuaccugggccuuaugcgaggcccucacccucgcuacggggcccauaucgacgcuuugggaaggaaacccgggacguuucuggaauacaacgauagcaguuaguauggccaacauuuuucgcggcucuuacuuggcgggagcugguuuauuauuuucgaucaugaaaaauacggcaaacacacggagagguacuggcaacacaggagaaacauuaggugaaaaauggaagaauagguuaaaugcccucgguaagucagaguuccagaucuauaagaaaucagggauccaagaaguagaccgaacacuagcuaaggaagguauuaaaagaggagagacugaucaucacgcgguaucacgugguagugcaaaauugagaugguucguggaaagaaauuugguaacuccugaggguaaaguuguugaucuagguugcgggaggggugguuggaguuacuacugugggggccucaaaaauguuaaagagguuaaaggacuaacgaaaggaggcccaggacaugaagaaccaauccccaugaguacguacggauggaaucuagucagauuacaaucaggaguagacgucuucuuuaccccuccagagaaaugugacacacuacugugcgauauuggugaaucuaguccaaacccuaccguggaagcugguaggacccuucgaguauuaaauuuaguggaaaauuggcuaaauaauaauacgcaguuuuguauaaaaguguuaaauccauauaugccgucaguaauagaaaagauggaagcacuccagagaaaguaugguggugccuuaguucggaaucccuuaucaaggaacagcacacacgaaauguauuggguaucgaaugcauccgguaacauuguuucaucgguuaacaugauaagcaggauguuaaucaacagauuuaccaugaaacauaagaaagcaacauaugaaccagauguugacuuaggcucggguacaaggaauaucggcauagagucagagacgccaaaccuugauaucauugguaaacguauugagaaaauaaaacaggagcaugaaacguccuggcacuaugaucaggaucauccauacaaaacaugggccuaccaugguucauacgaaacaaagcaaacugggagugcaucuucuaugguuaaugguguaguucgauuauugacuaagccaugggacguuaucccaauggucacacaaauggccaugacagauacuacaccauuuggucagcagagaguauucaaggaaaaaguugauacaagaacucaagagccaaaagaagguacgaagaaacuuaugaaaaucaccgcugaauggcuuuggaaggaacuagguaagaagaaaaccccucguaugugcaccagagaggaauuuaccagaaaaguccgcucaaaugcugcccuaggugcaauuuuuacggaugagaauaaauggaaaucugcaagagaagcagucgaggacucaggcuuuugggagcuaguugauaaagaaagaaaucuccaucuggaaggcaaaugcgaaacaugugucuauaauaugauggguaaacgagagaagaaauuaggcgaguucggaaaagccaaaggcagcagggcuaucugguauaugugguuaggugcuagauuucuagaauuugaagcacuuggguucuuaaacgaagaucauugguucucacgagagaacucuuuaagcgguguagagggcgaggguuuacauaaacuggguuauauucuaagggacguaucuaagaaagaaggaggagccauguacgcggacgacaccgcaggaugggauacccguauaacucuugaggaucuaaagaaugaggagaugguaacuaaccacauggaaggugaacauaggaaguuggcugaagcaaucuucagauugacguaucaaaauaaaguagucaggguacaacguccaacgcccagagguacuguaauggacauuauaagucgacgggaccaacgagguuccggacagguagugacauacggauugaacacauucaccaauauggaagcccaguuaauccgccagauggagggagagggaguauucaaaucaauccaacauuuaacggucaccgaagaaauagcuguaaagaauuggcuggaaagaguugggagagagcgcuuaucaaggauggcaauuucaggcgaugacugcguagugaaaccauuagaugauagauuugcauccgcgcuuacagcacucaaugacaugggaaagguaagaaaagacauucaacagugggaaccaagccgaggauggaaugacuggacucaagugcccuuuugcagucaccauuuccacgaguuaauuaugaaagauggacggguguuagucguaccuuguagaaaccaagacgaacuuaucggcagggcaagaaucagccagggagcggguuggagucuaagagaaacggcgugcuuagggaaauccuaugcucaaauguggucgcuaauguauuuccauagacgggaucuuagguuggcagcgaaugcaauaugcagugcugucccaagucauuggguaccuauaagcaggaccacauggaguauccacgcaacccaugaauggaugacaacggaagauaugcugaccguauggaaucgcguguggauccaagaaaacccauggauggaagacaaaacuccaguggaauccugggaagaaauaccauaccuuggaaagagagaagaucaauggugcgguaguuugauaggacuuacuagcagagcaaccugggcuaaaaauauucaaacagccauaaaucaaguacgaagucugauaggcaacgaagaguauaccgacuacaugcccaguaugaaaagguucagaagggaggaagaagaagcaggggugcuaugguga

SEQ ID NO: 22232 - RNA, 9876 nt, Artificial Sequence
  derived and/or modified CDS sequence (opt6) from DENV-2__KX380834__SS-prME
acugcugguauaauaauuaugaugauuccuacuguaauggcuuuucaccugacgacucgaaauggugaaccucauaugauuguuucacgacaagaaaaaggaaaaagucuguuguuuaaaacagaaaauggagugaauaugugcacuuuaauggcuauggaucuuggggagcuaugugaggacacuauaacauacaauuguccauugcuaagacaaaaugaacccgaggacaucgauugcugguguaauaguaccucaacauggguuacauacgguacuuguacagcgacaggagaacauagacgagagaaaagaucaguagcauuaguaccccacgugggaaugggacucgagacuagaacagaaaccuggaugucgagcgaaggggcuuggaaacacgcucaacgaauugagacguggauucuucgacauccaggcuuuacaauaauggccgcaauccuagcuuauacaauaggaacuacauauuuucaacgaguauuaaucuuuauacuauugacagcgguaacgccaagcauggcgaugagguguaucggcauaucuaauagggacuucguagaaggaguaagugggggaaguuggguagauauaguccuggaacacgggucgugcguuacaacaauggcgaaaaauaaaccgacgcuugauuucgaauugaucaaaaccgaagcaaaacaucuugcaacguuacguaaauacuguguugaggcaaaauugacgaauaccacgaccgccagucgcugcccaacucagggcgaaccaagccugaacgaggaacaagauaaaagguuugugugcaaacauucuaugguugaucgaggcugggguaacggcugcggacuuuuuggaaaaggcgggauaguuacaugcgcaauguucacaugcaagaaaaacauggaagguaaagucgugcaaccagagaaccucgaguacacaauagucauaacgccacauaguggcgaagaaaaugcaguuggcaaugacacagguaaacauggaaaagaaauaaaaguuacaccgcagaguucaauuaccgaagcugaacugacaggauacggaacaguaacaauggaaugcagccccagaacaggauuagacuuuaacgaaaugguacugcuccaaauggaaaacaaagcguggcuaguacauaggcaaugguuucuggaucucccgcuuccaugguugccgggagcagauacucaagguagcaauuggauucaaaaagaaaccuugguaacuuuuaaaaauccccaugcgaagaaacaagauguaguagugcuugguagccaagaaggagcgaugcauacagcacugacgggcgcuaccgagauucaaaugaguaguggcaaucuguuauuuacgggucaucugaaaugcagacuccgaauggauaaauuacaguugaaaggaaugucguacucgaugugcacuggcaaauuuaaagugguaaaagaaauagcagagacccaacacggaacaauagucauacgaguacaauaugaaggggaugguaguccauguaaaauuccuuucgaaauaauggaucuggagaaacgacauguacuaggacgacuaauaacgguaaacccuauagucacugaaaaagauagcccagugaacauugaggcagaacccccuuuuggcgauaguuauauaauaauaggaguugagccaggacaauuaaaauugucuugguuuaagaaaggcucaagcauagggcagauguucgaaacgacuaugcgaggagcaaaaaggauggcuaucuuaggcgauacagcaugggacuucgguucacugggcgggguauucacuucuauagguaaggcuuuacaucagguuuucggggcuauuuauggagcggccuuuucaggaguaaguuggacuaugaaaauccuaauaggggugguaauaacguggauagguaugaauagcagaucuacaucacuaucgguuucuuuaguuuugguggguguugucacacuguacuuaggugugaugguacaggcagauucaggaugugucgucucauggaaaaacaaagaauuaaaaugugggucggggauauuuauaacugauaacguucauacguggacagaacaauacaaauuccagccugaaagcccauccaaacuagcuucggcuauacaaaaggcacacgaagagggaauuugugggauucggucuguuacacgucuggaaaauuuaauguggaaacaaaucacaccagaacucaaccauauccugaccgaaaaugagguuaaacugacaaucaugacaggagauauuaaaggaauaaugcaggcggguaaacgaucgcuuagaccucaaccuacugaacuaaaauacucauggaaggccugggguaaggcuaaaauguugaguacagaauuacauaaucauaccuuuuugauagacgggccagaaacugcagaauguccgaauaccaauagagcuuggaauagucuagaaguagaggauuacgguuucgguguuuucaccacuaauauauggcuuaaacuaaaagaacgacaggaugucuuuugcgauucuaaccucaugagugcagcgauaaaggauaaccgggcugugcaugcagauaugggauacuggauagaaucagcucuuaacgauacauggaaaauagagaaggcuuccuucauugaaguaaaguccugucauuggcccaagucacauacacucuggucuaaugggguuuuagaaucagaaaugaucaucccuaaaaauuucgcaggaccaguuucucagcauaauuaucgccccggcuaucauacgcaaacagcaggcccguggcacuugggaaggcuagaaauggauuucgauuuuugcgaaggaacgacaguuguaguaacagaagauugugguaacaggggacccagcuugaggacaacaacugcaucugggaaauuaauaaccgaauggugcugcagaucaugcacucuaccaccacugagguaucgaggagaagauggauguugguauggaauggagaucagaccguuaaaagaaaaggaagaaaacuuggucaauaguuuggugacugcgggucauggccagauagauaauuucagcuuaggaguucugggaauggcccucuuucuggaagagaugcuacgaacuagaguugggacgaaacaugcaauacuccucguagcaguuucuuuuguaacuuuaauaacaggaaauaugucauuucgagauuuaggucgagugaugguuauggucggcgcaacaaugacugaugauaucggaaugggagugacauaucuagcccuccuagcugcauuuaaagugcgaccaacuuucgcugcaggguuguuacuuagaaagcuaacaaguaaagaacuaaugaugacaacaauaggcauaguuuuacucagccaaagcacaauuccagaaaguauacuggaacugacugacgcgcuagcucuugguaugaugguacuaaaaauugugcgcaacauggagaaauaccaacucgcaguuacaauuauggcuauacuuugcgugccaaaugcuguaauucuucaaaaugcguggaaaguaucgugcacaacauuggcuguagucucagugagcccauuacucuugacgucuucacaacaaaaagcugauuggauaccauuggcguugacaauuaaaggcuuaaauccaacggcuauauuuuuaacuacacucucaagaacaucaaagaagcgaagcuggcccuugaaugaggcuauaauggcaguuggcauggugaguauccuagcauccagcuuauugaaaaaugacaucccuaugacgggcccgcuaguugcuggcgguuuauugacuguaugcuacguauuaacaggacguagcgccgaucucgaguuagagagagcagcagacgugcgcugggaagaacaagcugagauauccggaucaucgccaauucugucaaucacaauaucugaagaugggucuaugagcaucaaaaacgaagaagaagaacaaaccuugacuaucuugaucaggacugggcuucugguaaucucggggcuauucccagugaguauaccaauaacagcggcugccugguaccuuugggaggucaagaaacagcgagcaggaguguuaugggauguaccaaguccacccccuguagguaaagcagaauuggaagacggggcguaucgcauaaaacagaaggguauauugggguauucacagauaggagcuggagucuacaaagaaggcacguuccacacgauguggcaugucacacgaggagcaguguuaaugcacaaaggaaaacgaauugaacccucuugggcugauguuaagaaggacuuaauaucauacgguggaggauggaaguuggagggugaauggaaagaaggggaagaaguccagguccuagcuuuagaaccaggcaaaaauccacgugccguacagacaaaaccuggacucuuuaagacaaauacaggcacgauuggagccguaucacuggacuucucacccggcaccagcgggaguccgaucguugacaaaaaggguaaaguugucggucuauauggaaauggaguaguuaccagaaguggaacauauguuagugcuaucgcacagacugagaaaaguauugaagauaaucccgaaauagaagaugauauauuucgaaagaaacgccuaaccauaauggacuuacauccgggcgcgggaaaaaccaagagauauuuaccggcaauuguucgagaagccauaaaaagggguuuacgcaccuugauuuuagcaccaacucguguagucgcagcugaaauggaagaggcucuaagaggauugccaauuagauaucaaacgccugcaauaagggcagagcauacuggaagagaaauuguagauuugaugugucacgcgacauuuacaaugagauuguugucuccaauaagaguaccgaauuacaauuuaauaauaauggacgaagcucauuuuacugauccagcaucuauagccgcucguggauacaucucgacucgcguugagaugggagaagcagcaggaauuuuuaugacugcuacaccaccaggaucuagggauccuuucccacagagcaacgcuccaauaauggaugaagaaagggagauuccagaaagaucauggaacucuggacaugaauggguaacagacuuuaaaggaaaaacuguaugguucguacccucaauaaaggcuggaaaugacauagcagcuugucugaggaaaaacggcaagaaagugauacaacuaucaagaaaaacauucgauuccgaguauauaaaaacacguacaaaugauugggauuuuguaguaacgacagauauuucggaaaugggagcuaauuuuaaagcggaacguguaauugaucccaggagauguaugaagccagugauccuaacagacggcgaagaaagaguuauucuagccgggccgaugccugucacucauucaucagccgcacaaagacgugggcgcguaggaaggaaucccaaaaaugaaaaugaucaauauauauacaugggcgaaccauuagaaaaugacgaggauugcgcucauuggaaagaagcaaagaugcuauuagauaauauaaauacgccugaaggaauaauuccgucaauguuugaaccugaacgagaaaaagucgacgcuauagacggagaauaccgauuaagaggugaagcucgcaaaacguucguugaccuaaugcgccgaggugaucuaccaguuugguuagcauauagagucgcggccgagggaauuaacuaugcggaucgucguugguguuucgacggcgucaaaaauaaucaaaucuuagaagagaauguugaaguagaaauauggacaaaagaaggagaaagaaagaaauuaaaaccuagauggcucgacgcacgcauauacagugauccuuuagccuuaaaggaauuuaaagaauuugcugccggucgaaaaagucuuaccuuaaaucuaauuaccgaaaugggaagauuaccuacguucaugacacagaaagccaaaaaugcacuagauaauuuagccguacuacacacagcagaagcaggaggacgagcuuauaaucacgcauugucugaauugccagaaacucucgaaacauuauuacuauuaacacuccuagcaacgguaaccggagguauauucuuauucuuaaugucuggaaaaggaauagggaaaaugacccucggaauguguuguaucauuacggcaucaauauuacucugguacgcacaaauacagccacauuggauagccgcuucgauaauacuggaauuuuuccuaauaguauuauuaauaccugaaccagaaaaacaacguaccccacaagauaaccaauuaacuuauguagugauagcuaucuuaacagucguugcagcgacgauggcgaaugaaaugggauuuuuagagaaaaccaagaaagauuuuggacuggggucgauuacgacgcagcagccggaaaguaacauauuagacauugaucuccgaccugcgucugcuuggacauuauaugcaguugccacgacauucauaacccccauguuaagacacucaauugaaaauuccucaguuaauguuucauuaacugcaaucgccaaucaagcaacuguuuuaaugggauuagguaaaggguggccgcugucaaaaauggacauuggaguaccucuucuagccauaggcugcuacucacaggugaauccgaucaccuuaacggcggcccugcuauugcuaguggcacauuaugccauuauuggacccggacuucaagccaaagccacaagggaggcacaaaagcgugcagcugcaggaauuaugaaaaauccuaccguagauggaaugacaguaauugauuuggauccaauucccuaugauccaaaauuugaaaagcaacuuggacaagucaugcuauuaguacuauguguuacgcaaguuuugaugaugcgaacgacaugggcacuuugcgaagcucucaccuuggcuacgggcccuauuaguacccuaugggaggguaacccagguagauucuggaauaccacaaucgcuguaucuauggcgaauauauuuagaggcaguuaccuggccggagcaggguuacucuuuaguaucaugaaaaauacagccaacacacggcgaggaacugguaauacuggagaaacacuaggagaaaaguggaaaaacagauuaaaugcccuaggaaaaagcgaauuucagauauacaaaaaguccggaauacaagaaguggacagaaccuuggcaaaagagggaauaaagagaggagaaacugaucaucaugcaguaucuagggggagugcaaaacuucggugguucguugaacguaauuuagugacuccugaagguaagguugucgauuuaggcugcggaagaggaggauggagcuauuacugugggggacuuaaaaacguaaaagagguaaaaggccuaacuaagggaggaccaggacacgaagaaccuauacccaugaguaccuauggauggaaucuuguccgacugcaaaguggaguagauguauucuuuacaccaccugagaagugugauacacugcucugugacauuggagaaucgucuccaaacccaacuguugaagccggacgaacccuccgaguucuaaaucuaguagagaauuggcuaaacaacaauacucaguucuguauuaagguguuaaauccauacaugccuucuguuauugaaaagauggaagcauuacaacgaaaauacgguggagccuugguacgcaauccuuuaucaagaaacucgacacacgaaauguacuggguauccaacgcuaguggaaauauuguuuccucugucaauaugauaucaagaaugcugauuaacagauucacuaugcgacauaagaaagcgacuuaugaaccggaugucgaccuaggguccggcacuagaaauaucggcauagaaucagaaaccccuaaucuagacauaauaggcaagcgaauagagaaaauuaaacaggaacaugagacuucauggcacuacgaucaagaccacccuuauaaaacaugggcauaucauggcucuuacgaaaccaaacaaacgggcagcgcaucgucuauggucaauggugugguccguuuacuaacgaaaccgugggauguaauaccuauggucacucaaauggcaaugaccgauacgacgccauuugggcagcagagaguauuuaaagagaaaguggauacccguacgcaggaaccgaaggaagggacgaagaaacuaaugaaaauuacugcugagugguuguggaaagaauuaggaaagaagaaaacaccaagaaugugcacucgagaagaauuuacaaggaagguuagaagcaacgcagcucuaggagcgauauuuacugaugaaaauaaauggaaaucagcgagagaagcaguugaagacagcggauuuugggaauuaguagacaaagaacguaacuugcacuuggaaggaaaaugugaaaccuguguauauaauaugaugggaaagagagagaaaaagcuaggugaauuuggaaaggcaaaaggcuccagggcgauuugguacaugugguuaggggcucgauuccuugaauuugaagcccuaggcuuuuuaaaugaagaccauugguuuucacgggaaaauucacuaucuggcguagaaggggaaggguuacacaagcuggguuauauauugcgagauguaucuaagaaagaaggaggagcgauguaugccgacgauacugccgguugggacacaagaaucacacuagaagaucucaaaaaugaagagauggugacaaaucacauggaaggagaacauaagaaacuagcagaagcaauuuuuaaacugacauaucagaacaaaguuguacgcgugcagagacccacgccaagggggacaguuauggacauuauaucgcgaagggaccaaagggguaguggucaagugguaacguaugggcucaauacauuuacaaauauggaagcacaacugaucagacagauggaaggcgagggggucuuuaaaucaauacaacagcugacgguaaaagaagagaucgcagugaaaaacuggcuaauccgaguaggaagagaaagauuaucucguauggcaauuuccggugacgauuguguuguaaaaccacuugacgaucgguucgcauccgcacuuacugcguugaaugauaugggaaaaguacgaaaagauauccagcaaugggaaccaaguagagguuggaaugacuggacgcaaguaccauuuuguagucaccauuuccaugaacuaauuaugaaagauggaaggguccugguuguccccugucgaaaucaggaugaacuuaucggcagagcacguaucucacaaggagcgggauggagcuuaagagaaacugccugccuagguaaauccuaugcccaaauguggucgcuaauguauuuucauagacgagaucugagauuagcagcuaaugcuauauguucugcgguuccaagucauuggaucccaacgucuagaacaaccuggucaauacacgccacacacgaauggaugacgacggaagacauguugacaguauggaaccgaguauggauucaagagaauccauggauggaggauaagacuccgguugagaguugggaagagauacccuauuuaggaaaaagggaagaccaaugguguggcucacuaauaggacuaacuucacgugcuacgugggcgaagaacauccagacagcgauaaaccaggucagaucacuaauaggcaaugaagaauauacagauuauaugccaucuaugaaaagauuccgaagagaggaagaagaagcaggagucuuaugguaa

SEQ ID NO: 22233 - RNA, 9876 nt, Artificial Sequence
  derived and/or modified CDS sequence (opt6) from DENV-2__KX380835__SS-prME
acugcagggauaaucauaaugaugauuccaacaguaauggcguuucacuugacaacacgaaauggugaaccacauaugauuguaaguagacaagaaaaagguaaaucgcuacucuuuaaaacugaaaauggugucaauauguguacauuaauggcaauggauuugggagaacuuugcgaagauacuaucacguacaauuguccucuuuuaagacaaaaugaaccagaagacauugacugcuggugcaacucuacaaguacauggguuacuuauggaacguguaccgcaacaggagaacaucgacgagagaaaaggucgguagcucucguaccgcauguaggcaugggucucgaaacccgaacugaaacuuggaugucaagugaaggugcauggaaacaugcacagagaaucgaaacauggguucucaggcacccuggcuuuacagucauggcagcaauauuagcauacacuaucgggacuacauauuuucaaaggguguuaaucuucauccucuuaacggcagucgcacccagcaugacaaugcgauguauugggauaagcaaucgagacuuuguagaagggguuucaggaggauccuggguagacaucgucuuagaacacgggagcugugugaccacaauggccaaaaauaaaccaacccuagacuuugaauuaauaaaaacugaagcaaaacacccugcuacauuaagaaaauacugcauugaagcuaaacugacuaacacgacaacggcgaguagguguccuacacaaggugaaccaagccugaacgaagaacaggacaaaagauuuguaugcaaacauucuaugguggaucgaggauggggaaaugguugcgggcuauuuggcaaaggugggauagugacuugugcaauguuuacauguaagaaaaauauggaagggaaaauuguccaaccagagaaucuagaauacacaaucgugaucacaccucauucgggggaggagaaugccguuggaaaugauacaggaaaacaugggaaagaaauuaaagucaccccacagucuagcaucacagaggcagaguuaacagguuacggaacugcaacuauggaaugcucaccuagaacuggauuagauuucaacgaaaugguucuucuacaaauggaaaauaaagcauggcucguacacagacaaugguuuuuagaccuaccccucccaugguugcccggugcugacacacaaggaagcaauuggauacaaaaagaaacgcucguuacauucaaaaauccccaugccaagaaacaagauguuguaguacugggcagccaagaaggggcuaugcacacagcucugacgggagcgaccgaaauccaaaugucuagugguaaccuauuguucacgggccauuuaaaaugucguuugaggauggauaaauuacaguuaaaaggaaugaguuauucaaugugcacgggaaaauuuaagguaguaaaagaaauugcugagacccaacacggaacgaucguuauucguguacaauaugaaggggaugguucaccaugcaaaauaccauuugagauaauggaucuugaaaagagacauguucucgggagacuuauuacagucaaccccauaguaacagaaaaagauagucccguaaauauagaagcggagcccccauucggagacuccuauauaaucauaggaguagagccaggacaacuaaagcuaucaugguucaagaaaggcuccagcauaggacagauguuugaaacaacuaugagaggugcuaagagaauggcuauauuaggagauacugcuugggauuucgguucccuagguggcguuuucacuucuauagguaaggcgcuccaucaaguauucggugcaauauacggcgcagcuuuuuccggaguaucauggacaaugaaaauucuaauugguguaguuauuacguggauugggaugaacucgagaagcaccucauuaagcgugucccugguauugguugggauagugacacuauaucuagggguaauggugcaagcugacagugguugcguaguauccuggaagaauaaagaacuaaaaugcgguaguggaauauuuauuacagauaacgugcauacuuggacggaacaauauaaauuucagccugaaucacccaguaaauuagcgucagcgauucaaaaggcccaugaggaggguauaugugggauacgcuccguuacgagacuagagaauuugauguggaagcaaauaacacccgaacuaaaucacauauuaagcgaaaaugaagugaaauuaacaauaaugacgggugacaucaaaggaauaaugcaggcuggaaaacgaagucuaagaccccaacccacagaauuaaaguauuccuggaaggcuugggguaaagcuaaaauguuaucuacagaacuccauaaucauacguuucuaauugaugguccagagacggcugaauguccgaauaccaauagggccuggaacucucuagaaguagaggauuacggauuugguguguuuaccacaaauaucuggcucaaauuaaaagaaagacaagauguauuuugcgacucaaaauuaaugagcgcggcaauaaaagacaaccgagcaguucaugcagauaugggauauuggaucgagagcgccuuaaaugauacauggaaaaucgaaaaagcuaguuuuauagaagucaaguccugccauuggccaaaaagucauacacuuuggaguaaugggguacucgaguccgaaaugaucauccccaaaaauuuugcaggucccgucucacaacacaacuauagacccggauaccauacacaaaccgcaggaccguggcacuugggaagacuagaaauggauuucgauuuuugugaagguacgacaguaguaguaacugaagauugcggaaauagggguccaagucuaaggacaacuaccgccucgggcaaacuaauaacugaaugguguugccgcucuuguacguuaccucccuugcguuauagaggagaagauggauguugguacggaauggaaauacgaccacuuaaagagaaagaagaaaacuuagucaauucacugguaacagcaggacacggucaaauagacaacuuuucacuagguguauuaggaauggcauuguuuuuagaagaaaugcuucguacaaggguaggaacgaaacaugccauacuauuaguugcgguaucauuuguaacauuaauuacgggaaacaugucguuuagggaucuggggcguguaaugguuauggugggagcgaccaugacagacgauauaggaauggggguaacauaucuugcuuugcuggcagcguuuaaaguaagaccaacauuugcagcuggacuacuucuaagaaaauuaacuucaaaagaauuaaugaugacaacaauuggaauaguguuacuaucccaaucaacaauuccagagacuauuuuggaguuaacagacgcguuagcacucggcaugaugguacucaaaaucguucgaaacauggaaaaauaucaacuagcggucacgauaauggcuauacuuuguguaccaaacgcuguuauucugcagaacgcauggaaaguaagcugcacaauuuuagcgguuguuucggucagcccucuucuacucacaucuucucaacaaaaagcagauuggauuccacuugccuuaacaaucaaaggccugaacccgacggcaauauuuuuaacaacucuuagccgaacaaguaaaaagagaucauggccguuaaaugaagcaauaauggcaguaggaaugguaagcauuuuagccagcucgcuacucaaaaacgauauaccuaugaccggcccucuggucgccgguggucuacucaccguauguuauguucuuacaggucgaagugcagaccuagagcuggaaagggcagccgacguaaggugggaggaacaagcugagauuagcgggucuaguccuauacuaaguaucacuauaucagaagacggaagcaugaguaucaaaaaugaagaggaggaacaaacgcuaacaauacuaauaaggacuggucuauuagucauaucggguuuguuuccagucucuauuccgauaaccgcagcagcaugguauuuaugggaaguaaagaaacaaagagcggggguguuaugggauguuccuucaccgccgcccgucgggaaggcugagcuagaagauggugccuauaggaucaaacaaaaagguauucuuggauauagccagaucggagcaggcguauacaaagaagguacauuucacacgauguggcauguaacacgaggcgcaguauuaaugcauaaagggaagaggauagagccaucuugggcagauguaaagaaagaucugauuucauauggaggcgguuggaaacuagaaggagaguggaaagaaggugaagaaguacaaguucuagcuuuagaaccggguaaaaauccccgugcuguacagacuaaacccgguuuguuuaaaacgaauacuggaacaauaggggccgugucauuggauuuuaguccuggcacgaguggcucaccaauuguugauaagaaaggaaaaguaguaggacuguauggaaacgggguaguuacaagaucggggacuuaugucucugcuauagcucagaccgagaaaaguauagaggauaauccugaaauugaggacgauaucuuuagaaagaaacgcuuaaccaucauggaccuucauccaggugcugguaaaacaaaaagauaucuaccagccauuguaagagaagcaauaaaacgcgguuuacgcacacucauauuggcuccuaccagaguuguggcggcugaaauggaagaagcauuaagaggccuaccaauaagauaccagacgcccgcaauacgagcagaacacacugggagagagaucguagacuuaaugugucacgcaacguuuaccaugagguuacuuagucccauacgaguaccgaacuacaaucuuauaaucauggacgaagcucauuucacugaucccgcaucaauugcugcucggggauauauaucgacucgaguugaaaugggugaggcggcugguauauuuaugaccgcuacaccuccugggagucgcgaucccuucccccaaaguaacgcacccauaauggaugaagaaagggaaauaccugaacgcagcuggaacucgggacaugagugggugacagacuuuaaaggaaagacaguuugguucguaccaucgauuaaagcaggaaaugauauagcagcaugucuuagaaagaaugggaagaagguuauacaguuaucacgaaagacguucgauagcgaauacauuaaaacacggaccaacgauugggacuucguaguaaccacggacauaagugaaaugggcgcuaacuucaaagcagaacggguaauugauccuagacgcuguaugaaaccggucauccuaacagauggagaagaacgcguaauucuagcaggaccaaugcccguuacucacucaagugcggcucaacgaagaggacggguagguagaaaucccaaaaaugaaaaugaucaguacauuuauaugggcgaaccauuagagaacgaugaggacugugcccacuggaaagaagcaaaaaugcuauuagauaauaucaauacacccgaaggaauuauuccuucaauguucgagccugaacgagaaaaaguagaugcaaucgacggcgaauacagacuucgaggagaagcuaggaagacauuuguugacuuaaugcgcagaggcgauuuaccuguauggcuagcuuauagaguugcagcggaagguauuaauuacgccgaucgucggugguguuucgauggagucaaaaacaaucaaauuuuggaggagaauguagagguagaaauuuggacaaaggaaggugaaaggaagaaacuuaaaccucgaugguuggacgcacggauuuacucagaucccuuagcgcugaaagaguucaaagaauuugcggcggggagaaagagcuuaaccuugaacuugauaacagaaauggggagacuccccacauuuaugacacaaaaagcacgaaacgcacucgauaaucucgcgguacuucauaccgcagaggcagggggucgugccuauaaccaugcguugagcgaacuccccgaaacucuugaaacgcuauuguugcuaacccuuuuggcuacuguaacaggagggauuuuucuguuucuaaugucaggaaaaggcauuggcaaaaugacacuggggaugugcuguaucauaacugcgaguauauuguuaugguaugcacagauucaaccucacuggauagccgcaucuauuauauuggaauuuuucuuaauaguacuuuuaauuccagaaccugagaaacagcgcaccccucaggauaaccagcuaaccuauguaguaauagcaauuuuaacagugguagcagcaacaauggcuaacgagaugggauuccuugagaaaacuaagaaagauuuugguuuaggguccauaacuacacagcaacccgauucaaauauacuugauauagacuugcgaccagcguccgcauggacauuauacgcgguggcuacaacguuuauaacgccaauguuaagacauaguaucgagaauagcaguguuaaugucuccuuaacagcaaucgcaaaccaagcgacaguacuaaugggguuaggaaaaggauggccacugaguaaaauggauauagguguuccuuuauuagccaucgguuguuauagucaaguuaauccgauaacgcuaaccgcggcuuuacuacuacuuguugcgcauuaugccauaauaggacccggacuucaggccaaagcaacucgugaagcacaaaaacgcgcggcugcuggaauuaugaagaaucccacuguagacgguaugaccguuaucgauuuggacccaauaccuuaugaccccaaauucgaaaaacaauugggucagguaauguuguuaguucuaugcguuacgcaaguguuaaugaugcgaacuacaugggcucugugcgaagcauuaacacuugcuacaggaccaaucucaacccuuugggaagggaauccuggacgauucuggaacacaaccauugcagugucuauggcuaacauuuuuagaggaucguaucucgcuggcgcaggacugcuauuuucaauuaugaaaaauacggcuaauacaagaagaggaacaggaaauacaggggagacguuaggugaaaaguggaagaaccgccuaaacgcauuaggaaaaagugaguuccaaauauacaagaaaagcggaauacaagaaguugacaggaccuuagcaaaagaagguauaaagagaggcgaaacagaucaucaugccgucucaaggggaucagcaaaacuuaggugguucguagaacgcaaucuuguuacgccggaagguaaaguagucgauuuaggauguggucgcgguggcuggaguuacuacugcggugggcuaaagaaugugaaagaagucaagggucugacaaaaggaggaccagggcacgaagaaccgauuccuaugagcacauacgguuggaaccuagugcgucugcagucagggguagauguauucuucacaccuccugaaaagugugauacacuacuuugugauauuggagaaagcucaccaaauccgaccguggaggccgggcggacuuuaaggguuuuaaaccuaguugaaaauugguuaaacaauaacacacaauucuguauaaaaguuuuaaauccuuauaugccaucuguaaucgagaagauggaagcauuacagagaaaauacggaggagcucugguaaggaacccacuaagcagaaauucuacacaugagauguacugggugaguaaugcaagcggaaacauugucaguagugucaacaugauuagccgaaugcucauuaauagauuuacuaugaagcacaagaaagcaacauaugaaccggacgucgacuuagggagcgggacuaggaauauagggaucgagucagaaaccccgaauuuagauauaaucgggaaaagaauugagaagauaaaacaagaacaugaaacaagcuggcauuaugaucaagaccaucccuauaaaaccugggcauaccauggaucguaugaaacaaaacaaacagggagcgcaagcucaauggucaauggcguagugagauuauuaacgaagccuugggacguaauaccaauggucacacagauggccaugaccgacacuaccccuuuuggucaacaaagaguauucaaggagaaagucgauacucgaacgcaagagccaaaagaaggcacuaagaaacugaugaaaauuacagccgaauggcuguggaaggaacuaggcaagaagaaaacgccccgcaugugcacuagagaagaguucacaagaaaagugaggucuaacgcggcacuaggagcuaucuuuaccgacgaaaacaaauggaagagugcgagggaagcggucgaggauucagguuuuugggaguugguagauaaagaacggaacuugcacuuggaagguaaaugugaaacaugcguauacaauaugaugggaaaacgagaaaagaagcuaggagaguucgggaaggcaaagggauccagagcaauaugguacaugugguuaggggcacgcuuucuagaguucgaagccuuaggauuuuuaaaugaagaucauugguuuagccgagagaacucauuauccggaguugaaggcgaaggauuacacaagcugggauauauauuacgagacguuucuaagaaagagggaggagcaauguaugcagaugauacagccgguugggacacgaggauaacucuagaagaucuaaagaacgaagagauggucaccaaccacauggagggagaacacagaaaacuugcagaagcaauuuucagacuaacguaucaaaauaaagucguucguguacaaaggccaacaccaagggguaccguaauggacaucauaucaagacgugaucaacgagguaguggucaaguaguaacuuaugggcuuaauacauucacaaacauggaagcccaacugauacggcaaauggaaggugaggguguguuuaagucaauacagcaucuaacgguuacagaagaaauugcagugaaaaauuggcuagaacggguggggagagagcgguugagccgaauggccauaaguggugacgacugcguaguaaaaccauuggacgauagguuugcuucagcuuugacagcauuaaaugacauggggaaaguucgaaaagauauucagcagugggaaccuucaagaggguggaaugacuggacucaagugccguucuguucacaccauuuucacgaauuaauaaugaaggauggacguguccuaguaguuccaugucgaaaucaagacgaguuaauugggagagcuagaaucucgcaaggggcaggauggucauuacgagaaaccgcuugccuuggcaaaucuuaugcucaaauguggaguuugauguacuuccaccggcgagaccuaagauuagccgccaacgccauaugcucugcaguaccaucccauuggguacccauaucacguacaacguggaguauacaugccacucaugaauggaugacaacugaagauaugcugacaguguggaaucgaguauggauacaagaaaacccauggauggaagauaaaaccccgguggaguccugggaggagauaccguaucuggguaaacgcgaagaucaaugguguggguccuuaauuggucuaacuucaagagccacuugggcuaagaauauccagacagccauaaaucaaguacgaucacuaaucggaaacgaagaauauacagauuauaugccaucaaugaaaagauuuaggagagaggaagaagaagcaggaguauuaugguaa

SEQ ID NO: 22234 - RNA, 9876 nt, Artificial Sequence
  derived and/or modified CDS sequence (opt6) from DENV-2__KX380836__SS-prME
acugcugggaucauuaucaugaugauaccgacuguaauggcauuccauuuaacuacaagaaacggugaaccucacaugaucguaucacggcaagaaaaaggaaaaucccuacuauuuaaaacggaaaacggcgugaacaugugcacauuaauggcuauggaccuaggagaacuuugcgaagacaccauaacauacaauugcccauuacuacggcagaaugaaccagaagauaucgacugcugguguaauagcacuucgacuugggugacauauggaacauguaccgcaaccggggaacaucgccgagaaaaacgaucuguugccuuaguuccgcauguuggaauggggcuagaaacacgaacagaaacauggauguccagugaaggcgcuuggaaacacgcacaaagaaucgaaaccuggguacuuagacauccaggauuuacuguaauggcugcaauacuagcauacacaauuggaacuacauauuuucaacguguacucauauucauacuacucacugcaguagcaccaucgaugacuaugcgcuguauagggauaucaaaccgagauuuuguugaaggaguuucagggggaaguuggguugacaucgugcuagaacacgguucaugcguuacgacgauggcgaaaaauaaaccaacacuugacuuugaacucauaaaaacugaagccaaacauccugcgacucuuagaaaauacuguauagaagcuaaauuaacgaauacaacaacagcuaguagaugucccacgcaaggagagccaaguuugaacgaggaacaagauaaacgguuuguguguaaacauucaaugguagacaggggaugggguaauggguguggucuauuuggaaaagggggaauaguuaccugcgcaauguuuaccuguaagaaaaauauggaaggaaaaauuguucaaccagaaaaccuggaauauacgauaguuaucacaccacacucaggugaggagaacgcaguaggaaacgauacgggcaaacaugguaaagaaauaaaagucacaccacagucuaguauaaccgaagcugaauuaacagguuacgguacagcaacaauggaaugcuccccaagaacgggacucgacuuuaacgaaaugguguuacugcaaauggagaauaaagcauggcuaguacauaggcagugguuccuugacuuaccauuacccuggcuucccggagcggauacccaaggaaguaauuggauccaaaaagaaacccuagugacguuuaaaaacccacacgcuaagaaacaagauguaguuguauuagggagucaagaaggagccaugcauacagcgcuuacaggagcuacagaaauacaaaugagcagcggcaauuuacuauucacaggucaccuaaaauguagauuaaggauggauaaacuacaacugaaaggaaugucuuauucuaugugcaccggaaaauucaaaguaguuaaagaaauagccgagacacaacauggaacaaucgugauuaggguccaauaugaaggagacggcucgccaugcaaaauaccauucgagauaauggauuuggagaaaagacacgugcuaggaaggcuuaucacgguuaauccgauugucacugaaaaagacucaccaguaaacauagaagcugaaccaccguuuggcgauucguacauuaucauuggcgucgagcccgggcaauuaaaauuaucaugguucaagaaaggaagcagcauaggucagauguucgaaacgaccaugcgaggggcaaaaagaauggcaauucuaggagauacagccugggauuuuggcaguuuaggaggagucuuuacgucaauagguaaagcacugcaccaaguauucggcgcuauauauggagcagcuuuuagcggugugaguuggacaaugaagauucuuauaggagugguuauaacauggauuggaaugaacucucgaucaacaaguuugaguguuucguugguauugguaggaaucgucacccuuuacuuagguguaaugguacaagcggauagugguugugucguaagcuggaaaaauaaagaauuaaaaugcgggucugggauauuuauaacagauaauguccauacauggacagaacaguacaaguuucaaccagaaaguccuagcaaauuggcaucagcgauccagaaagcucaugaggaaggaauaugcggcauacgaucaguaacaagguuggaaaaccugauguggaaacagauuacccccgagcugaaucacauacuuuccgaaaacgaaguuaaauuaacaauaaugaccggcgauauaaaagggauaaugcaggcaggaaaaagaaguuuaagaccccaaccuacugaauugaaauacucauggaaagcaugggguaaggccaaaauguugucaacagaacuucacaaucauacguuccuaauagacggaccggaaacugcggaguguccuaacacuaauagagccuggaacucccuugaaguugaggacuacggcuucggcguauuuacaacaaacauuuggcucaaauugaaagagcgacaggauguguucugcgacuccaaauugaugucagcagcuaucaaggacaauagggcaguucaugcagauauggguuauuggauugaauccgcacuaaaugacacuuggaagaucgagaaagcuaguuucauugaagucaaaagcugccauuggccuaaaucgcacacucuuuggaguaauggaguacucgaauccgagaugaucauaccuaaaaacuucgcagguccgguuagucagcauaauuaucgcccuggauaucauacgcagacagcuggaccauggcacuuaggaagacuagagauggauuuugauuuuugugagggcaccacugucguagugacugaagacugcggaaaucgugguccaucacugcgcacaacaacggccagcggaaaacuaauuaccgaaugguguuguaggucaugcaccuugccuccucuaagauaucguggagaagauggcuguugguacggaauggagauuagaccucugaaggagaaagaagagaaucuaguuaacagccuuguaacagcuggacacggacagaucgauaacuuuucgcugggugugcuaggcauggcauuauuccuagaagaaaugcucagaacaagaguggguacuaaacacgccauauuauuaguagccguuaguuuuguaacacugauuacagggaauaugucauuuagagaccuaggcagaguaaugguuaugguaggugcaacuaugacagaugauauagguaugggcgucacuuauuuagcacuuuuggcggcuuuuaaagugagacccacauucgcugcaggacuauuacuuagaaagcucacaucuaaagagcuuaugaugaccacaauaggaauaguccuauugagucaaaguacuauacccgaaacaauccuagaauuaacggaugcauuagcccuuggaaugauggucuugaaaauugucagaaauauggaaaaguaccaguuggccgugacgauuauggccauucuguguguuccaaacgcggucauuuuacaaaacgcauggaaaguuucgugcacaauauuagcaguaguuucgguaaguccacuucuauuaacaucuucucagcaaaaagcagacuggauaccucuugcucuuacgauaaaagguuugaauccaaccgcaaucuucuuaacuacucuaucucgcacaaguaagaaaagaucguggccauugaaugaagcaauaauggcgguuggaaugguuucaauuuuagcaucaucacuacugaaaaaugauauacccaugacaggcccauuaguugcuggugguuuacucacaguaugcuauguucucacugguagguccgcagaccucgaacucgagcgggcagcggacguuagaugggaagaacaggcugaaauauccggauccuccccuauccuuucaauaacaauauccgaagaugggucgaugagcaucaaaaacgaagaagaagaacaaaccuuaacgauauuaauccguacugggcuccuaguaaucucgggacuauucccggucucgauuccgauaacagcggccgccugguaucuaugggaggucaagaaacaacgcgcaggaguccuaugggauguuccgagucccccgccagucggcaaagcagaauuagaagauggcgccuaucggauaaaacaaaaaggaauccuuggauacucccagauaggugcggguguauauaaagaaggaacauuucauacuauguggcacgucacgcggggagcaguauugaugcacaaaggcaaaagaauagaacccuccugggcggaugucaagaaagaccuuauaaguuauggaggaggauggaaguuggaaggagaauggaaagaaggugaagagguacagguacuugcgcuugaaccagguaaaaacccaagggcuguacaaacaaaaccuggacuauuuaaaacuaacacuggaaccauaggugcagugagccuagacuuuuccccaggaaccagugggucaccaauaguagauaagaaaggcaaaguagucgggcuauaugguaacggagucgucaccagaagcggaacguauguuucagccauugcucagacggaaaagaguauagaagacaacccagaaaucgaggaugacauauuuaggaaaaagagacucacuaucauggauuuacauccuggcgcagggaaaacaaaaagguaucuaccagcaauuguuagagaagccauuaaaaggggauuaagaacuuuaauacuagcuccaacacgaguaguugcagcugaaauggaagaagccuugaggggacuaccaauuagauaccaaacuccugcgauacgagcagagcacacaggaagggagauaguagauuugaugugucacgcuaccuucacaaugagauuauuaagcccuauccguguucccaauuauaaucugaucauaauggacgaagcgcauuucacagauccugccucgauagcagcacguggguacaucucuacucgcguagaaaugggagaagcagcgggcauuuucaugacugcaacaccgccuggaagcagagauccuuuuccucaaaguaaugcaccuauuauggacgaggaaagggaaauccccgagaggucauggaacucaggucaugaguggguuacugauuucaagggaaagacugucugguucgugccuucaauaaaggccggcaaugauaucgcagcgugccugcguaaaaacggcaagaaaguaauucaacuaaguagaaaaacauucgacucagaauauaucaaaacuagaacaaaugacugggacuuuguaguaaccacugauauuagugaaaugggagccaauuucaaagccgaacgcgugaucgacccccggagauguaugaagccaguaauuuuaacggacggcgaagaacgagugauucuugcaggaccuaugccaguaacacauucuagugcagcucagagaaggggucgugucggacguaacccuaagaacgaaaaugaucaguauauauauaugggugaaccucuagagaaugaugaagacugugcccauuggaaggaggcaaaaaugcugcucgauaauauaaacacaccugaaggaauuaucccgagcauguuugaaccugaaagagaaaaagucgaugcaaucgauggggaauacagacugcgaggcgaagcccgaaagacuuucguggacuuaaugagacgaggagaccuaccggugugguuagcauaucgaguugcagcggaggguauaaacuaugccgauaggcgauggugcuuugauggaguuaaaaacaaccaaaucuuagaagaaaacguagaagucgaaaucuggacuaaagagggugaaagaaagaaacugaaaccaagguggcuugaugccagaauauacucugacccacuagcauuaaaagaguucaaggaauuugcggcagguaggaaaaguuugacacuaaaccuaaucaccgaaaugggucgucugccgacauuuaugacucaaaaggccaaaaacgcauuagacaaccucgccguauugcauacggcagaagcuggaggcagagcauauaaucaugccuuaagcgagcugccagagacccuagaaacacuuuuacuucuaacacuucucgcgacaguuacagguggaauauuccucuuucuuaugaguggaaagggaauagggaagaugaccuugggaauguguugcauaauuaccgcaaguauacuacuaugguacgcacagauccagccgcauuggauagccgcaagcauaauacuugaguucuucuuaauaguucuucucauacccgagcccgaaaaacaaagaacaccucaagauaaccaacuaacuuauguaguaauagcuauucugacaguagucgcagcgacaauggcaaaugaaaugggauuucuagaaaagacuaagaaagacuuuggacuagguucaauaaccacccaacaaccugaaaguaacauucuagacaucgauuuaaggccagcgucagcuuggacucuguacgcuguugcgacgacauuuauaacgccuaugcugagacauaguauagaaaacaguagcgucaauguaucguuaacagcaauagcuaaccaagcgaccguccucaugggauuaggcaaaggcuggccguuaagcaagauggacauuggaguaccauuacuugccauuggaugcuauucacaaguuaauccuauaacauugacugccgcacuccuucuauuaguagcucauuaugccauaauagggcccggccuacaagccaaagcaacuagagaggcgcaaaaacgugcggcugcgggcauuaugaaaaauccgacagucgacggaaugacugugauagaucuagacccaauuccguaugacccaaaauuugaaaaacaacuaggacaggugaugcuucugguacuguguguuacucagguacuuaugaugcgaaccacgugggcauugugugaggccuuaacauuagccacaggaccaauuucuacgcuaugggaaggaaauccuggucgauuuuggaauacaaccauugccguaagcauggcaaacauauuucgagguucauaccuggcaggagcuggccuccuuuucucgaucaugaaaaacacagcaaacacucgaagagggacuggcaauacaggcgaaacacuaggugaaaaauggaaaaauagauuaaacgcacuaggaaaaucagaguuccaaauauacaagaaaucggguauucaagaaguugacaggacuuuagcaaaagagggaaucaagaggggcgaaacagaccaccaugcuguuagccggggaagugcaaaauugagaugguucguagaaagaaauuuaguaaccccugaaggaaaaguaguggaucuuggcugugguagaggcggauggucauacuacuguggaggguugaaaaaugucaaggaagugaagggcuugacuaaaggaggccccggccaugaggaaccaauaccaauguccacauacggguggaaucuaguucgguuacaaagcgggguagacguauucuucacuccaccagagaagugugacacccucuuaugugauauuggagaaucaucaccgaacccuaccguagaagcugguagaacucuaagaguucuaaauuuagucgaaaauuggcuaaacaacaacacacaauuuuguauuaaagucuuaaaccccuacaugccaucaguuauugagaaaauggaggcucuacaaagaaaauacgguggagcauuagugagaaacccuuugucucguaauucaacacaugaaauguacugggugucaaacgcuucgggaaacauugucucaagcguuaacaugauuaguagaaugcuaauaaaccguuuuaccaugaaacauaagaaagccacauaugaaccagauguagaucuagguucuggaacaagaaauauuggaaucgaaucggaaacaccaaaucuugacauaauaggaaaaagaauugagaaaauaaaacaagaacacgaaacaaguuggcauuacgaucaggaucauccauacaaaacaugggcguaccacgguucuuacgaaacuaagcaaaccgguucagcaucaagcauggugaauggaguugucagauuguugaccaaaccaugggacgugauaccaaugguaacgcaaauggccaugacagauaccacccccuuuggccaacaacgaguauucaaagagaagguagacacuaggacucaagaaccgaaagaaggaaccaaaaagcuaaugaaaauaacugccgaauggcuauggaaagaacuagguaagaagaaaacaccaagaauguguacuagagaagaauuuacuaggaaagucaggaguaacgcagcucuuggagcuauuuucacagacgaaaauaaauggaaaagcgccagagaagcaguugaagacaguggauuuugggagcuaguagauaaggagcgcaaucuucauuuagaaggcaaaugugaaacgugcgucuauaauaugaugggaaaaagagagaagaaacuaggagaauuugggaaggccaaaggaaguagagccauaugguauauguggcucggcgcucgcuucuuagaauuugaagcauugggcuuucucaacgaagaucacugguuuucaagggaaaauucgcuaagcggaguggaaggcgaagggcugcauaaguuaggguacauacuuagagacgucagcaagaaagaagguggcgcuauguaugcugaugacacagcuggcugggacacacgaauaacccuugaggaucugaaaaaugaggaaaugguaaccaaccacauggagggagagcauaggaaauuggcagaggccauauucagguuaacuuaucagaauaaaguagugcgcguucaacgaccaacucccagggguacaguaauggacaucaucuccaggagggaccaacgggguaguggacagguagugacuuacggacuaaacaccuucacaaauauggaagcccagcuuauaaggcaaauggaaggagaaggugucuuuaaaagcauacagcauuuaacagugacggaagagauagcggucaaaaauugguuagaacguguaggcagagaaaggcuaaguagaauggcuauaaguggugacgauugcgucgucaaaccauuagaugacagguucgcaucagcucuaacagcacugaacgacauggguaaagugagaaaagauauacaacaaugggaaccgagucgugguuggaaugacuggacacaagugccauuuugcucacaucacuuucaugaacuaauaaugaaagauggaagaguacugguaguuccuugccggaaccaggacgagcuaauuggaagggcacgaauaagccaaggugcuggguggucccuaagagagacagcgugucuuggaaaaucauaugcgcaaauguggucucuuauguauuuucaucgccgugauuuaaggcucgccgcuaaugcaauuugcagcgcaguacccucacauuggguuccgauaucacgaacaaccuggucgauucaugcgacucacgaauggaugacuacagaagacaugcuuacuguauggaaccgaguuuggauacaagagaauccuuggauggaggauaaaacaccagucgaaucuugggaagaaaucccauauuuaggaaaaagggaagaccaguggugugguucacugauaggauuaacaaguagagcuacgugggccaaaaacauccaaacugcaauaaaccaaguacguagucuaaucggaaacgaagaauacacggacuauaugccaagcaugaaaagauuuagaagagaagaagaggaagcaggaguauuaugguaa

SEQ ID NO: 22235 - RNA, 9876 nt, Artificial Sequence
  derived and/or modified CDS sequence (opt6) from DENV-2__KX380838__SS-prME
acggcaggaauuaucauaaugaugauucccaccguaauggcauuucaccugacaacucguaauggagaaccucacaugauagucucacgacaagaaaaaggcaaaaguuuacucuucaaaacugaaaacggagugaacauguguacccucauggcgauggaucuuggggaacuaugugaagauacuauaacauauaauugcccacuauuacgccaaaaugaaccagaagauaucgacuguugguguaacucuacuagcacauggguuacauacgguacguguacagcuacgggagaacacagaagagaaaaacguuccguggcucucguaccccaugugggaaugggccuagaaacaagaacugaaacauggaugucaucugaaggcgcguggaaacaugcacagagaaucgaaacauggguguuaagacauccagguuuuacagucauggcugccauacuagcauauacgaucggcacaacauauuuccaaagaguacuaaucuuuaucuuacuuacagcaguggcuccaagcaugacaaugagauguauaggaauuuccaauagagauuucguggaaggaguauccgguggaucauggguagauauuguguuagaacaugguucuuguguaaccacgauggccaaaaauaaaccaacauuggacuucgaacuaauuaaaacugaagccaaacaccccgcuacgcuucgcaaauauuguaucgaagcgaaauugacaaauacuaccacagcaagucgauguccgacucaaggagaaccaucuuuaaaugaagaacaggauaaacgcuuuguaugcaaacauucaaugguugauagggguugggggaauggaugcggguuauuugguaaaggcggaauagucacaugcgcuauguuuacgugcaagaaaaauauggaagggaaaaucguccaaccggaaaauuuagaguauacaauaguaaucacuccccacucaggagaagaaaacgccguagguaaugauacagggaagcaugguaaggaaauaaaaguuacgccacaaucaaguaucacagaagcggaauuaacgggauacggaacugcuacuauggaaugcagcccaagaacaggauuggauuuuaacgagaugguauuacuacaaauggaaaauaaagcauggcuaguucaccgacagugguucuuagauuuacccuuaccuuggcuuccuggugcugauacacagggcucaaauuggauacagaaagaaacauugguaacuuucaaaaauccucaugccaagaaacaagacgucguuguacuaggaagucaagaaggcgcuaugcacacagcccucacuggcgcuacggaaauacaaaugucgucggguaaucuucucuucacaggacaucugaagugccggcuuaggauggauaagcuacaacuuaaaggaaugucauauucaauguguacgggaaaauuuaaaguagucaaagaaauugcggaaacucaacauggcaccauaguaauaagagugcaauaugaaggcgauggauccccauguaaaaucccauucgaaauaauggaccuugaaaaacgacacguacucgguagacuaauaacagugaacccuauaguaacagaaaaggauaguccggucaauauugaagcugaacccccuuucggugauagcuacauuauuauugggguggagccgggacaacuuaaguuaaguugguuuaaaaagggaucuucgauaggucaaauguucgaaaccacuaugcgaggagcaaaacguauggcuauccuaggcgauacagccugggauuucggcagccugggagggguuuuuacuucaauugguaaggcucuccaccaaguauuuggugcaaucuauggcgcugccuuuuccggagugagcuggaccaugaaaauacuaauaggugugguaaucacguggaucgguaugaacucaagaagcaccagucuaucgguaagucuaguauuagugggaaucguaacguuauacuuaggcguaaugguacaagcugauucuggaugcguuguauccuggaagaacaaggaguuaaaauguggcucagguauuuucauuacagauaauguacauacuuggacugaacaguacaaguuccaaccugaaucuccaucaaaacucgcaagugccauccaaaaggcccacgaagaaggaauuuguggcauacgaucaguuacgcgacuagaaaaucucauguggaaacaaauaacuccugaauugaaucauauccuguccgaaaaugaaguuaaacucaccauuaugacgggggauauuaaagguaucaugcaagcuggcaaaaggucgcugagaccacaaccuacagaacugaaauauucauggaaagcaugggguaaagcuaaaaugcuuucaacugaauuacauaaccauaccuuuuuaauugacggaccggaaaccgcugaauguccgaacaccaacagagcguggaacucucuggagguugaagacuacggauucgguguauuuacuacuaauauuugguuaaagcuaaaagagcgccaagacguauuuugugauucuaaguuaaugagugcagccauaaaagauaaucgagcaguacaugcagauaugggcuauuggauagaauccgcccuaaaugauaccuggaaaauagaaaaagcgaguuuuauugaagugaaaucaugucauuggccuaaaucccacacucuauggaguaauggaguacucgaaagcgaaaugauaauaccaaagaauuuugcagguccagugucacagcacaauuacagacccgguuaccauacacaaacugcuggaccuuggcacuugggcagacuagaaauggacuucgacuucugugaaggaacaacuguaguuguuacugaagacuguggaaauagagggccaagucuccguacgacaacugcaucagguaaguuaauaacggaauggugcugcaggucauguacuuugccaccguuaagguauagaggugaagauggaugcugguaugguauggaaauacgaccacugaaggaaaaagaagaaaaucuugucaauucauugguaacagcaggacauggucaaauugauaauuuuaguuugggggugcuaggaauggcacuguuccucgaagaaauguuaagaacccguguaggaacuaagcaugcuauuuuauuaguagcuguaaguuucguaaccuugauaacuggaaacauguccuuucgugacuuaggccgagucaugguaauggugggcgcaaccaugacagaugacaucggaaugggugugacguaccuggcguuauuggcagcuuuuaaaguucgaccaacauuugccgccgguuugcuauuacguaaguuaaccaguaaagagcucaugaugacaacaauagguauuguacuucuuagccagucuacaauaccugaaacuauauuagaauuaacugaugcacuagcucuaggaaugaugguucucaagaucguacguaauauggaaaaauaucaauuagcagugacuauuauggcgacccucuguguacccaaugcaguuauucuacaaaaugcguggaaaguuaguuguacaauauuggccguagucucugucucaccgcuauugcuaacaucgucucagcaaaaagcagacuggauuccgcuagcauuaaccauaaaggggcuaaauccaacugcaauauuucugacuacgcuaagcagaacuagcaagaaaagaucuuggccacugaacgaagcaauuauggcuguagguauggugucuauucuggcgucaagucuucugaaaaacgauauuccgaugacaggaccacucgucgcaggagggcugcugacaguuuguuacguccucacagggcgauccgcugauuuagagcuggagcgugccgcugauguaagaugggaggagcaggccgagauuuccgguagcucacccauucuaaguauuacgauaucugaagauggcagcaugagcaucaaaaaugaagaagaagaacagacacuuacuauucuaauaaggacaggauugcuagucauuucaggacuuuucccgguaaguaucccuauaacagcagcagccugguauuuaugggaagugaagaaacaacgugcagggguccuaugggauguaccuucgccaccuccaguuggaaaggcagaauuggaagauggagcuuaccguaucaaacaaaaagguauacucggauacagucaaauaggggcgggugucuauaaagaagggacauuucauaccauguggcacguaacaagaggagcuguccuaaugcauaaggguaaaagaauugaaccaucuugggcugauguaaagaaagaucuaauuucauaugguggaggcuggaaauuagaaggagaguggaaagaaggugaggagguacaggugcucgcacuagaaccugggaaaaacccaagggcgguccaaacgaaaccaggucuuuucaagacaaauacagguacaauuggagcggugagucuagauuuuagucccggcacaagugggucgccaauaguagauaagaaaggaaagguaguugggcuuuaugguaaugguguaguaacaagguccggaacauacgugagugcgauagcgcaaacugaaaaaucgauugaggauaaccccgaaauagaagaugauauauuucggaaaaagagauuaacaauaauggaccuccacccuggggcaggaaaaacuaaacguuacuuaccugcuaucguaagggaggcaauuaagcgaggcuuaaggacucucauucuagcuccgacccgugugguagcagcagaaauggaggaagccuuacgggggcuaccaauacgauaccaaacacccgcaaucagggccgaacauacaggacgagaaauuguagaucuaaugugccaugcuacuuuuacgaugaggcuacucagcccgauuagggugccuaacuauaauuugauaauaauggacgaagcacacuucacggauccagcaucaauagcugcgcgagguuauaucucgacaagaguugaaaugggcgaagcagcagguauauuuaugaccgcaacucccccugguucaagagauccuuuuccgcaaaguaaugcaccuauuauggaugaagaaagggaaauaccagaaagaucauggaauagcggacaugaauggguuacagacuuuaaaggcaaaacgguaugguucgucccguccauaaaggcagguaacgauauugcugcuugccuaaggaagaauggcaagaaaguaauccaguuaucacgaaaaacauuugauagugaauauauaaagacacgaacaaacgauugggacuuuguugugacaacagacauaucggaaaugggagcaaacuuuaaagcugaaagaguuaucgacccucguagguguaugaaaccugucauauuaacugacggugaggaacgagugauucuugcaggaccuaugcccguaacccacagcucagcugcacaaaggcguggccgaguaggaagaaauccuaagaacgagaacgaucaauauauuuauaugggcgagccauuagaaaaugacgaagacugugcccacuggaaagaggcaaaaaugcuuuuagauaauauaaauacuccugaaggcaucauuccaagcauguucgaaccagaaagggagaaagucgaugcaaucgauggagaauacagacuacgaggcgaagcacggaagacuuuugucgaucuaaugcguaggggcgaucuaccaguauggcuggcauacagaguagccgcugagggaauaaauuaugccgauagaagauggugcuuugauggcguuaaaaauaaccagauuuuagaggaaaacguagaagucgaaauauggacaaaagagggcgaaaggaagaaacucaaaccgaggugguuggacgcuagaaucuauucagauccacuagcguuaaaagaguucaaagaguuugcagccgggagaaaaucuuuaacgcucaauuuaauuacugagauggguagacuccccacauuuaugacacagaaagcccgaaaugcgcucgacaauuuggcuguucuacacacugcugaagccggcggaagggcuuauaaucaugcccuaucagaauuaccugagacauuagaaacacuacuucuauugacauugcuugcuaccguaacgggaggcauauuuuuauuuuugaugagcggaaaaggaaucggcaagaugacucuugggauguguugcauaauaacagcgaguauacuauuaugguaugcacaaauucaaccacacuggauugcggcuucuauuauucuggaguucuuuuuaauagucuugcucauccccgaaccagaaaaacaaagaacgccacaagacaaccaauuaacuuacguaguuaucgcaauauuaacaguaguagcugcaaccauggcuaacgaaaugggauuccuagagaaaaccaaaaaggauuuugguuuaggaaguaucacuacacaacaaccagacucaaauauuuuagauauugaucuucgacccgcuucagcauggacguuguaugcuguugcuacuacauuuauaacuccuaugcucaggcauucuauugaaaauuccucuguaaauguaucacuaacugcaauagccaaucaggccacuguauuaaugggauuagguaaaggauggccgcuuagcaaaauggauaucggcguaccacuguuagcgauuggcuguuauagucaaguuaauccuaucacauugacugcggcauuacuguuacugguagcacacuacgccauaauuggcccuggucugcaagcaaaggcgacgagggaagcccagaaaagagccgcagcaggcauaaugaaaauacccgcugcugacggaauuacgguaauagauuuagaccccaucccauaugauccaaaauucgaaaagcaacuaggacagguaaugcuauuagucuuguguguuacgcaagugcucaugaugcgaacaacuugggcgcuaugugaagcauuaacccuggcgacggguccaauauccacgcuaugggaaggaaauccugggagauuuuggaacacaaccauagcaguaaguauggcaaacauauuuagaggcagcuacuuggcuggcgccggucugcuauucucaauuaugaagaacaccgcuaauacucgaagagggacagguaauaccggcgaaacuuuaggagaaaaauggaaaaaucggcuaaaugcccuugggaagucagaguuccaaauauacaagaaaaguggcauccaagagguugauagaacccucgcaaaagagggaauaaaaagaggagaaacagaucaccacgcaguaaguagaggaagcgcaaaauuaagaugguuuguugaacgcaaccugguaaccccugaaggaaaagucguagacuuaggaugcggacgaggaggcuggucauauuacugcggcgguuuaaagaauguaaaagaggucaagggacuuacuaaaggggguccaggacaugaagaacccauuccaaugucaacuuacggcuggaaccuaguucggcuacaaagcgguguggacgucuuuuucacuccgccagaaaaaugcgauacccuucuuugcgauauaggugaaucuucaccgaauccgaccgucgaagcaggaaggacguuacggguguugaacuuaguugaaaauuggcuaaauaacaauacacaauucugcauaaaaguucugaacccuuacaugccuucaguaauagaaaagauggaggccuugcaaaggaaauacggaggggccuugguuagaaauccacuuucgaggaauaguacacaugagauguacuggguuagcaaugcuagugggaauauaguaucaagugucaauaugaucagccgaauguuaauaaauagguuuacaaugaaacauaagaaagcuacuuaugaaccugacguagaucuagguagugggacaagaaauaucgguauagaaagugaaacuccaaaccuugauauaauaggaaagagaauugagaaaauaaagcaggaacacgaaacgaguuggcauuaugaucaagaucacccauauaaaacuugggcauaccauggcuccuaugaaacaaagcagaccgguagcgccuccucuaugguuaacggagucguuagacuucucacaaagccaugggauguaauuccuauggugacccaaauggcgaugacagauacgacuccguuuggccaacagcggguguucaaggaaaagguugacacacgaacccaagaaccaaaggaggggacaaagaaacuuaugaagauaacagcugagugguuguggaaagaauuggguaaaaagaaaaccccaagaauguguacucgugaagaauuuacucgaaaaguaagaucuaaugcggcgcucggcgcuauuuucacagaugaaaacaaauggaaauccgcucgugaagccguugaagauucagguuuuugggaacugguugauaaagaacggaaccuacacuuagaaggaaaaugugagacuuguguuuauaauaugaugggaaaaagagagaagaaacugggcgaauuuggaaaggcuaaagguucacgggcaauuugguauauguggcuaggugcgagauuuuuggaauuugaagcacuaggauuuuugaaugaagaucauugguucagucgcgaaaacucgcuaucuggaguagaaggugaaggauuacauaaacuaggauacauauugagggacguaagcaagaaagagggaggugcuauguaugcugacgacacagcuggaugggacacuagaauaacuuuagaggacuuaaagaaugaagaaaugguaacaaaucauauggaaggagagcauaggaagcuggccgaagccaucuuuagacuaacauaucaaaacaagguuguaagaguccaaagacccacaccaagaggcacagugauggacauaauaucaagaagggaucaaagaggaagcggucaaguugucacuuacggucuaaacacguucacgaauauggaagcgcaauuaauuaggcagauggagggagaaggcguguucaaaaguauccaacaccuuacuguaacggaagagauagcuguuaaaaacuggcucgaaagaguaggaagagagagguuauccagaauggcuauuagcggggaugauuguguagucaagccacucgaugaucgauuugcgagcgcguuaacugcacucaacgacauggguaaaguuagaaaagacauacagcaaugggaaccgucgcgcggauggaacgacuggacacaagucccauucugcagccaccacuuucacgaauugaucaugaaagaugguagaguacuuguuguuccaugucguaaucaggaugaauuaauaggacgugcacgcauuagucaaggggcuggauggagucucagagaaacagcuugucuuggcaaaagcuaugcucaaauguggucuuuaauguacuuccaccgacgggaucuaaggcuugcugcaaaugcaauaugcucagcgguuccuucucauuggguuccgauaucucgaacgacauggagcauucacgcaacacacgaauggaugacaaccgaagacaugcuaacaguauggaaucguguauggauacaagaaaaccccuggauggaagauaagacuccaguagagagcugggaagaaauaccguauuuaggaaaaagagaggaucaguggugugguucucuuaucggccugacaucucgagcuacgugggcuaaaaacauucaaacagcaauaaaucaagucagaaguuuaauaggcaaugaagaauacaccgauuacaugccgucaaugaaacguuuccggagagaagaagaagaggcuggaguacuaugguga

SEQ ID NO: 22236 - RNA, 9876 nt, Artificial Sequence
  derived and/or modified CDS sequence (opt6) from DENV-2__KM279515__SS-prME
acagcagggauaauaauaaugaugauacccacagugauggcuuuucacuugaccacccguaacggggaaccccauaugauaguaucaagacaagaaaaaggaaaaucacuguuguuuaaaacagaaaacggaguaaauaugugcacguuaauggcaauggaucugggggaacuaugcgaagacaccauaacauacaacuguccgcuacuuagacaaaacgaaccagaagacauagacuguugguguaauucaacuucuacauggguaacuuacggcacuuguacugcuacuggggaacauagaagggagaaaaggaguguagcacucgugccgcauguaggaaugggacuggaaacucgaacagaaaccuggaugucuuccgaaggugcguggaaacaugcacagcgaauagaaacauggauuuuacgacauccaggauuuacgauaauggcggcgauacuggcauacacaauugggacaacauauuuccaaagaguacuaauauucaucuuacucaccgcggucacgccauccauggcaaugcguuguauagggaucucaaacagagacuuuguagaaggcguauccggaggaucuuggguggacauugucuuagaacaugguucgugcguaacaacuauggcuaaaaauaaaccuacauuagauuucgaauuaauaaaaaccgaagcuaagcaccuagcaacucuaagaaaauauuguguagaagcuaaauuaacaaauacuacgaccgcauccagaugcccaacacaaggugaaccuucccugaaugaagaacaggauaaaagauucguguguaaacauucgaugguagaucgcggauggggcaaugggugcggcuuauucgggaagggcggaauaguuacaugcgcuauguucacuuguaagaaaaauauggagggcaaaguuguacaaccugaaaaucuggaguauacgauaguaauuacaccacauaguggugaagagaaugcagugggaaacgacacagggaaacauggaaaagaaauaaaaguuacuccccagaguucaauaacagaggccgaacucacagguuacgguacaguaacaauggaaugcagcccuaggaccggacuagacuuuaacgaaaugguuuuguuacaaauggaaaauaaggcuugguuggugcauagacaaugguuuuuagacuuaccacugccuugguuaccaggcgcugacacgcaaggaucuaacuggauacaaaaagaaacgcuuguaaccuuuaaaaacccacacgcaaagaaacaagaugugguaguacuugguucacaagagggugcgaugcacaccgcucugacuggcgcgaccgagauacaaaugucaaguggcaaccuucucuucacuggacauuuaaaaugucgccuacgcauggauaaacuucaacucaaaggcaugucguacucuaugugcacgggaaaauuuaaaguaguaaaagaaaucgcggaaacacaacaugguaccauugucauucguguacaauaugaaggagacggaagcccuuguaaaaucccauucgaaauaauggacuuggagaagagacaugcauuaggaaggcuaauaacggucaauccaauaguaacugaaaaggacagucccgugaacauugaggcugagcccccuuucggagacucauauauuauaauaggcguugagccgggacaacucaagcucucuugguuuaaaaagggaaguaguaucggacagauguuugaaacaacgaugaggggugcaaaaaggauggcuauccuaggugauacggcuugggauuuuggaucccuagguggaguuuucaccaguauagggaaagcauuacaucaagucuuuggggcgauauauggagcagcuuuuucuggaguauccuggacgaugaagauucuaaucggagucguuauaacauggauaggaaugaacucccgaucaacgucccuaaguguaagccuaguucuuguaggggucguaacauuauaucuaggggucauggugcaagcagauucuggauguguaguauccuggaaaaauaaagagcuaaaaugcggaagcgguaucuuuauuacagauaacguucacaccuggacggaacaauauaaauuccaaccggaaucaccgagcaaacuugcuucggcuauacaaaaagcacaugaggaaggaauaugcgggaucaggucaguaacaagguuagagaaccugauguggaaacaaauaacuccagaauugaaccauauauugacugaaaacgaaguaaaacucacaaucaugaccggagacauaaaaggaauaaugcaagcaggaaaacguaguuugagaccucaaccaacagaacuaaaauauagcuggaaagcauggggaaaagcaaagaugcugucgacugaacuucauaaccauacauuuuugaucgaugggccggaaacagcggaaugcccaaauacgaauagagccuggaauaguuuagaaguagaagauuaugguuuuggaguuuuuacaacuaauauauggcuaaaacuaaaagaacgccaggacguguucugugauucaaaacucaugagcgcggcaaucaaagacaaccgagccguucaugcugauaugggauacuggauagaaagugcccuuaacgacacauggaaaauugagaaagcaucauuuauagaggucaaaucaugucauuggccgaagucgcauacucuuugguccaaugggguuuuggaaagcgagaugauuaucccuaaaaauuuugcaggaccugugagucaacacaauuacagacccgguuaccauacacaaacagcugguccauggcauuuaggacgauuagaaauggauuuugacuuuugcgaaggaacuacuguaguaguaacugaagauugcgguaauagggguccaucauugagaacgacaacugcaaguggaaaacuaauaaccgaaugguguugccguaguugcacguuaccacccuugagauauagaggugaggauggaugcugguacgguauggaaauaaggccacugaaagaaaaagaagaaaacuuaguaaauagcuuaguuacugcaggucauggacagauugauaacuucucucuaggaguccucggaauggcccuauuccuggaagaaauguugaggacucggguaggaacaaaacacgcaauccuauuaguagcuguaucauuuguaacacuaaucacaggaaauaugaguuuuagagaucucggaagagucaugguaaugguuggugccacaaugaccgaugauaucggcaugggagugacauaccuugcccugcuugcagcuuuuaaagugcgcccaaccuuugccgcagggcucuuacuuagaaaauugacaagcaaagagcuaaugaugacaaccaucggcauagugcugcucucgcaaaguaccauuccagaaucgaucuuagagcuuacggacgcucucgcccuuggaaugaugguccuuaaaauuguuagaaauauggaaaaguaccaauuagcagugacgauaauggcaauccuaugugucccaaaugcugugauauuacagaaugccuggaaaguuucgugcacuacauuagcagugguuagcgucagcccauuguuacuaacaucuucccagcaaaaagcagacuggauaccacuagcauuaaccauaaaggggcugaaucccacagcuauauuccuaaccacacugagcagaacaucuaagaaaaggucguggccccuuaacgaggcaauuauggcgguaggcauggucagcauacuagcgaguaguuuacugaaaaacgauauaccgaugaccgguccauuaguggcaggaggccucuugacggucuguuauguuuugacaggaaggagugcagauuuagaacuagaacgugcggcugauguucgaugggaagaacaagccgagauaucugguaguucacccauccuaaguauaacgaucucagaagacggaaguaugucaaucaaaaaugaagaggaagaacagacacuaacaauacucauucggacaggacuauuagugauaagugguuuauuuccagugucuauaccaauaaccgcagcggccugguaccuuugggagguaaagaaacaaagggcggguguauugugggauguuccaaguccaccaccuguuggaaaagcagaauuggaagauggugcauaccgaauuaaacaaaaagggauuuuaggauacagccaaauaggcgcgggagucuacaaggaggguacguuucacacaauguggcauguuacucgcggggcuguacuaaugcacaaaggcaagagaauagagccuucaugggcugacguuaagaaagauuuaauuucauacgguggagguuggaaguuagaaggagaauggaaggaaggggaggaagugcaaguacuugcauuagagcccgguaagaauccaagagcagugcaaacaaagccaggguuguucaaaacaaauacagggacaaucggagcgguuagcuuagacuucucaccugggacaucaggaaguccuauaguugacaagaaaggaaaggucguaggucuauaugguaauggaguuguaacaagaagcgguacuuaugugagugcaauugcgcagaccgaaaagagcaucgaagacaauccugagauagaagacgauauauuuagaaagaaacgacuuacaauuauggaucuucauccgggcgccgguaaaacaaaaagauaccuuccagcaauugucagggaagccauuaaaaggggccuuagaacccuuaucuuagcaccaaccagagugguagccgccgagauggaagaagcucuaaggggauugccgauaagauaucaaacuccugcgaucagggcagaacacaccggaagagaaauaguagacuuaaugugucaugcaacauucacaaugcgcuugcucucuccuauucgaguaccuaauuacaauuuaauuauaauggacgaggcacauuuuaccgauccggcaaguauagcagcgaggggauacauaaguacgagaguagaaaugggagaagccgcaggcaucuuuaugacugcaacgcccccaggaucucgggacccuuucccgcaaaguaaugcgccuauaauggaugaagaacgcgaaauaccggaaagaaguuggaacuccggacaugaaugggucacagauuuuaaagggaaaacaguaugguuuguacccagcauuaaggcuggaaacgauauagcagcaugccuucguaaaaacgguaaaaaggucauacaauugucaagaaaaacguucgacagugaauauauaaagacacguacaaacgauugggauuuuguuguuaccaccgacauaagugaaaugggagcaaauuucaaagcugagagaguuauugacccgagaagguguaugaaaccuguaauuuuaacagacggagaggaaagaguuauucuagccggaccaaugccagucacacauaguagcgcugcgcagagaagagguagagucgggcgaaacccgaaaaacgaaaacgaucaauacauauauaugggugaaccauuagaaaaugaugaggauugugcacacuggaaagaagccaaaaugcuacuagauaacauaaauacgccugaaggcauuauuccaucaauguuugagccagaacgagaaaagguugaugccauagauggcgaauacagauuaagaggggaagcucguaaaacuuuugucgaucuuaugcggaggggagaucuuccagugugguuagcguacaggguagcagcggaagguauaaacuacgcggacagaagaugguguuuugauggugugaaaaauaaucagauucuggaagaaaauguagaaguggaaauauggacaaaagaaggagagagaaagaaauuaaaaccaagguggcuggacgcacguauauacagugacccucucgcuuuaaaagaguucaaagaauuugcugcaggucguaaaagccuaacuuugaaccuaauaacagaaaugggcagacugcccacuuuuaugacacaaaaagccaaaaacgcauuagacaauuuagcaguuuugcacacagcugaagcuggugguagggcauauaaccaugcuuuaucugaauuaccggaaacucuagaaacacuauugcuuuuaacguuacuggcaacgguaaccggugguauauuccuauuuuuaaugagcggcaaagggauugggaaaaugacccuaggaauguguuguaucauaaccgcaaguauucugcucugguacgcucaaauucaaccccacuggauagcggcuagcauuauauuagaguucuuucuuauuguccuuuuaauaccagaaccagaaaaacaacgaaccccacaggauaaucaacuaacauauguaguuauagcgauccucacaguaguugccgcaacuauggccaaugagaugggcuucuuagagaaaaccaaaaaggacuuuggacuagggucuauuacaacacaacagccggaaaguaauauauuagauauugaucuaagaccggccucagcguggacacuauaugcaguagccacaacuuucauaacacccauguuacgacauaguaucgaaaacaguucaguuaacguauccuugacggccauugcaaaccaggcuacgguacucauggggcucggcaaaggcuggccccucuccaaaauggauaucggagugccgcuacuagcuauugguugcuauucacaaguuaauccaauaacauuaacagcugcucuguugcucuuagucgcucacuaugcaaucauaggaccuggccuucaggccaaagcaacaagagaggcgcaaaaacgugcagccgcaggaaucaugaagaauccgacaguggacggaaugaccguaaucgaucuggaucccauaccuuaugacccaaaauuugagaaacaacuuggacaaguuaugcuauuaguauuauguguaacucaagucuuaaugaugaggacuaccugggcauuaugugaagcccuuacguuagcgacugggccaauaucgacuuugugggaaggaaacccaggcagguucuggaacacaacaauagcggugucgauggcaaauauauuccgcggaucauaccuagcuggagccggacucuuauuuagcauaaugaaaaacacugcgaauacucgcagggguacuggaaacacaggugaaacauuaggugaaaaauggaaaaauaggcugaaugcacuaggaaaaagcgaguuccaaauauacaagaaaucuggcauucaggaaguugacagaacuuuagcuaaggaaggaaucaaaagaggcgagacugaucaccacgcagucucacgaggcagugcaaaacuucgcugguuugucgaaagaaaucuuguaacaccggaaggcaaaguuguagaucuugggugugggcgagguggauggaguuacuacugugguggucuaaagaacgucaaagaagugaaaggauuaacaaaaggagggccagggcacgaagaaccaauucccaugucaaccuauggguggaacuuaguuagguuacaaaguggaguagauguauucuuuacaccgccagaaaaaugcgacacucuacucugugauauuggcgaaucgaguccaaauccgacgguagaagccgggagaacuuugcguguccuaaaccuuguagaaaauuggcucaauaauaauacacaauucuguaucaaagugcucaaucccuauaugccuucaguaaucgagaaaauggaagcacugcaacgaaaauacggcggcgcucuaguaagaaauccucuuucuagaaauucaacucaugagauguauugggugaguaacgcaagcgguaauauagucucguccgugaacaugauaucuaggauguuaaucaacagauuuacaaugagacauaagaaagcaaccuacgaaccugauguagaucuuggaucugggacccgaaacaucggcauagaauccgagacgccgaaccuggacauaaucggaaaacguauagagaaaauaaaacaagaacacgaaacgucuuggcauuacgaucaagaucauccauauaaaacaugggccuaccacgguuccuaugaaacaaaacagacggggucagcuucuucuaugguuaacggugugguuagacuguuaacaaagccgugggauguaauaccgaugguaacucaaauggcaaugacugauacaacuccauuuggucagcaaaggguauuuaaggagaagguggauacaagaacgcaggagccaaaagaaggaacuaagaaauuaaugaagauuacggcggaguggcucuggaaggagcuaggcaagaagaaaacaccaagaauguguacucgugaagaauuuacccgaaaaguaagaaguaaugccgcccugggagccauauuuacagacgaaaauaaauggaaaucugcuagagaagcugucgaagauaguggauucugggaacucguagauaaagaaagaaauuuacaucuagaaggcaaaugcgaaacauguguauacaauaugaugggaaaaagagaaaagaaauugggcgaguucgguaaagccaaggguucgagagcgauuugguauaugugguuaggugcccgcuucuuggaguuugaggcauuggguuucuuaaacgaggaccacugguuuagcagggaaaacucuuuaaguggagucgaaggggaagggcuucacaaacuaggauauauauuaagggauguaucaaagaaggaaggaggcgcaauguaugcugaugacacugccggaugggauacaaggauaacacuggaagauuugaaaaaugaagaaaugguuacaaaucauauggaaggagaacacaagaaacucgccgaagcaauauucaaacuaacauaucaaaauaagguuguaaggguccaaagaccuaccccgaggggaacaguuauggauauuauaucucgacgugaucagagagguucuggucaaguugucacauacggauuaaacacuuucaccaacauggaggcucaacuuauaaggcaaauggagggugaaggaguguuuaaaucaauacaacaacuuaccguuaaagaagaaauagccguuaaaaauuggcuaauucgugugggucgggagagauuaucaaggauggcuauaucaggagacgauugugugguaaagccacuagaugacagauucgcauccgcacugacugcacucaaugauaugggaaagguucgaaaggauauucagcaaugggaaccaucccguggauggaacgacuggacgcaagugccauuuugcucucaucauuuccacgaacuaaucaugaaagaugggagggucuuaguaguuccuugucggaaucaggaugaacucauaggacgugcaagaaucucacaaggagcuggauggucacucagggaaacggccuguuugggaaaaucguacgcucaaauguggucgcuuauguauuuucaucguagagaccucagguuagccgcgaaugcuauauguagugcaguaccaagucauuggauccccacuagccgaacaaccuggucuauacacgcaacgcacgaauggaugacaacagaagacaugcuaaccgucuggaaucgcguauggauacaggaaaauccguggauggaagauaagaccccaguagaaacaugggaagaaauaccuuaucuagggaagcgcgaagaccaguggugugguucccuuauaggacuuacaaguagggccacaugggccaaaaacauucagacagcuauuaaucaagucaggagcuuaauuggcaacgaagaauauacugacuauaugccaucaaugaaaagauuuagacgggaggaggaggaagcagggguauuaugguga

SEQ ID NO: 22237 - RNA, 9876 nt, Artificial Sequence
  derived and/or modified CDS sequence (opt6) from DENV-2__KM279516__SS-prME
acagcaggaauaauuauaaugaugaucccaacuguuauggcauuccaucuaacaacacgaaauggggaaccacacaugauaguuucacgucaagaaaaagguaaaucacuucuuuucaaaacggaaaauggaguaaauauguguacucuaauggcuauggaucugggagaacuaugugaagacacaauuacauauaacuguccacuccuuaggcaaaaugaaccugaagauauugacuguuggugcaacucaacgucgaccuggguaacguauggaacauguacugcuaccggugaacaccguagagagaaacgaucaguagcuuuaguaccgcacguagguauggggcuagaaacaagaacagaaaccuggaugucauccgaaggagcauggaaacacgcgcaaagaauagaaacauggauauuacgacauccuggauuuacgauaauggcugcaaucuuggcauauaccauuggcacaaccuauuuucagagaguguuaauauucauacuccuaacagcgguaacuccaagcauggcaaugcgaugcauuggaauaagcaauagggauuucguugaaggaguuaguggagguucuuggguugauauagugcucgaacacggaucguguguuacgacuauggccaaaaauaaaccaacacuugauuuugaauuaaucaaaacugaagcgaaacaucuggcaacacuacguaaauacuguguggaagcuaaacuuacaaauacuacgacggcuucacgauguccuacucaaggagaaccaaguuuaaaugaagaacaagacaaaagauucguguguaaacauucuaugguagauagggguuggggaaacgggugcggacuauuuggaaaaggugggauaguaacuugcgcaauguuuacauguaagaaaaauauggagggaaaagucguucaaccagaaaauuuagaguauacaauagugauaacaccucacucuggggaagaaaaugcagucgguaacgauacgggaaaacauggaaaagagauuaaaguaacaccacaaucuaguaucacagaagccgagcuuacugguuacggcacgguaacgauggagugcucaccgagaacgggguuagacuuuaaugaaaugguauuauugcaaauggaaaacaaagcgugguuaguccauaggcaaugguuuuuagaucuuccacuaccguggcuccccggcgcggauacccaagguucaaacuggauacaaaaagagacacucguaacauuuaaaaacccacaugccaagaaacaggacguugucgucuugggaagucaagaaggggcuaugcauaccgcgcuaacaggagcaacugaaauucagaugucgucaggcaaccuucuauucaccgggcacuugaaaugucgauuaagaauggacaaauugcaauugaaagguaugaguuauucaaugugcacagguaaauuuaaaguugucaaagaaauugcagagacacagcacggcacuauaguuauccggguccaauacgagggggacggaucuccuuguaaaaucccauucgaaaucauggaucucgagaaacggcacguguuaggaagacuuauaacaguuaaccccauugucacugaaaaagauucgccaguaaacauugaagcugaacccccuuucggggauucauacauaaucauagguguugaaccagggcagcugaaauuaucaugguuuaagaaagguucuagcaucggccagauguucgaaacaacgaugcgcggugcaaaaagaauggcaauauuaggugacacugcaugggacuuuggcaguuuaggaggugucuucacaagcaucgguaaagcacuucaccaaguuuuuggagcaauauauggagcagcuuuuucgggugugucauggacaaugaaaauacuaauuggcgucguuauuacguggauugguaugaauaguaggaguacaucucucucaguaaguuuagugcuuguuggagugguaacucuguaucuaggaguuaugguccaagccgauagcgguuguguagucuccuggaaaaauaaagaauuaaaaugcggauccggcauauucauaacagacaauguccauacuuggacggagcaauacaaauuccaaccugaaucaccuagcaaauuagcgucagcuauccagaaagcucacgaagaaggcauuugcggcauccgcuccgugaccagguuagagaaucuuauguggaaacaaauaacccccgagcuuaaucacauuuugacugagaaugagguaaaauugacuauuaugacaggugacauuaaagguauaaugcaagcaggcaaacgcucccuacgaccacagccuacagagcuaaaauacucauggaaagccugggguaaagcuaaaaugcuaaguaccgaguugcauaaucauacguuucugauagacggaccagaaaccgccgaauguccaaauacuaauagggcauggaacucgcuagaaguagaagauuacggauucggagucuuuaccacaaauauaugguugaaauugaaagaacggcaggauguuuucugugauucuaaauuaaugucugcagcaaucaaagacaaccgagcuguacaugcugauaugggauacuggaucgaaagcgcgcuaaaugacacauggaaaauagagaaggcaucuuuuauagaaguuaaaucaugccauuggccaaaaucacauacccucugguccaacgguguguuagaaagugaaaugaucauucccaaaaacuuugcaggaccggucucucaacauaauuauagaccaggauaccauacacaaacggcgggacccuggcaucuggggcgccuagaaauggauuuugauuuuugugaaggaacaacuguaguagucacggaagauuguggaaauagaggcccaucacuaaggacaacuacagccagugguaaauuaauuacugaaugguguuguaggaguuguacacuaccgccacuuagauauagaggagaggauggcugcugguauggcauggaaauccguccauuaaaagagaaggaagagaaccuuguuaauagcuugguaaccgcuggccacgggcagauugacaacuuuucccuagguguauuagguauggcuuuguuucuugaagaaaugcuacgcacaagagucgggacuaaacaugcaauccuucuaguggcagucaguuuuguuacguuaauuacuggaaauaugucauuuagagauuuagggcgaguuauggucauggugggagcaacaaugaccgacgacauagggaugggaguaaccuacuuggcguuacuugcagcuuuuaaaguacgccccacuuuugcagcuggauuacucuuaaggaaacugacaucaaaagaacugaugaugacaaccaucggcaucguccuacuaucucaauccacaauaccugaaaauauucuagaacuuacugaugcacuggcucucggaaugaugguauuaaaaaucguuagaaauauggaaaaauaucaacuagcaguuacaauaauggcaauucuaugcgugcccaacgccguaauacuccaaaaugcauggaaggucucgugcacuacauuggcugugguuucgguuucaccgcuacuauugaccucaucacaacaaaaggcggauuggauaccacuagccuugaccaucaagggauuaaauccgacagcaauauuuuugacgacucuaagucgaaccagcaagaaaagaucauggccacuuaacgaagcgauuauggcgguuggcaugguuuccauauuagccucuagccuauugaaaaaugauauaccaaugacugguccgcuaguagcaggaggacuuuuaaccguuuguuauguucugacaggaagaucggcagauuuagaauuagaaagagcagccgacguucgaugggaagaacaagccgagauaagugguagcuccccaaucuugucaauuaccauuucagaggacggaucaaugagcauaaagaacgaagaggaggagcaaacauuaaccauccuaauucggacaggacucuuaguaaucagugguuuauuuccaguaucgauaccuaucacggccgcugcgugguauuuaugggaggucaagaaacaaagggcgggcguauuaugggacguucccucuccaccaccaguagguaaggcagaacuugaggauggugccuaccgaaucaaacaaaaaggaauauuaggcuauucacagauaggugcugggguguauaaagaagggaccuuucauacaauguggcaugugacuaggggcgcgguauuaaugcacaaagggaagcgaauugaaccgaguugggcugaugucaagaaagaucucaucucauacggagggggauggaagcuagaaggugaauggaaggaaggugaggaaguccagguauuagcucuagaacccgggaaaaacccacgggcuguucagacaaaaccgggccucuucaaaacgaauacuggaacaauaggagcuguaucacuugauuucuccccaggaacaucagguucuccaauuguggauaagaaaggaaaaguaguuggacucuacgguaaugggguaguuacucgaucugggacauacguaagugcaauagcucaaaccgagaaaaguauagaagauaaucccgaaaucgaggacgauauauuuaggaagaaacgauuaacaaucauggacuuacacccaggcgccggaaaaacgaaacguuauuuaccagcaauagugcgugaagcuauaaaacguggacucagaacuuuaauauuagcuccuacuagaguaguugcugcugaaauggaagaggcauuaaggggacuaccgaucagauaucaaacccccgcaauacgugcugaacacacggguagagagaucguggaucucaugugucaugcgacuuuuacaaugcggcuauugucuccuauacguguaccaaacuauaaccuuaucauuauggacgaggcucauuuuacagauccagcuuccaucgcugcaagagguuauaucucuacuaggguugaaaugggugaggcugcggguauauucaugacagcuacaccaccaggcucgagggauccguuuccccaaucaaacgcucccaucauggacgaagaacgggaaauaccagaacgaucauggaacucagggcaugagugggucacagacuucaaagguaagacaguaugguucguuccaucaauaaaagcaggcaaugacauugcugcuuguuuaagaaagaacggaaagaaaguaauacaacuuucaaggaaaacguuugauucugaguauaucaaaacacgaacuaaugacugggauuucgucguaaccacagacauaucagagaugggcgcuaauuuuaaagcggaacgaguaaucgacccacgaagaugcaugaaaccuguuaucuuaacugacggugaagagagaguuauuuuagcuggaccaaugccaguaacccacucaagcgcagcgcaaaggagggggagaguaggaagaaaucccaaaaaugaaaacgaucaauauaucuauaugggugaaccccuagaaaaugaugaagacugcgcacauuggaaagaggcaaaaaugcuccuugauaauauaaacaccccugaagguauaaucccuucaauguucgaaccugaaagagaaaagguagacgcaaucgauggagaauaucgguuaagaggagaggcaaggaaaacguucguagaccuaaugagaagaggggaucucccaguuuggcuagccuacagagucgcugcugaaggaaucaacuaugcugauaggcgaugguguuucgauggagucaaaaacaaccaaauauuagaagagaauguagagguugaaaucuggacaaaagaaggcgaaagaaagaaacucaagccgaggugguuagaugcaagaauauauucugacccguuagccuuaaaggaguuuaaagaauuugcagcuggccguaaaucacucacgcuaaauuugaucacagaaaugggcagauuaccaaccuucaugacccaaaaagcuaaaaaugcguuagacaaucuugcaguucuccacacagccgaagcuggaggucgggcauacaaccaugccuuaagcgaauuaccggaaacauuagagacgcugcuacuacuaacuuuauuagcgaccgugacaggaggaauauuuuuauuuuuaaugagcggcaaaggaauuggaaaaaugacauuaggaauguguuguauaauaacagcuucaaucuuauuaugguacgcucagauacagccacacuggauugcagcgucuauaauauuagaguuuuuccuuauugucuuauuaaucccugagccagaaaaacaaagaacaccccaggacaaucaauuaacauacguaguaaucgcaaucuuaacuguugucgcagccacuauggcaaaugagaugggcuuucuagagaaaacgaagaaagauuucggucuaggcucuauuacaacacaacagcccgagagcaauauacuagacauugaucuacgucccgcaucggcauggacguuguacgcaguagcuacaacauucauuacuccuaugcuccgucauucuauugaaaauagcagcguuaaugugucuuuaaccgcaauagccaaucaggcaaccgugcugaugggcuuaggcaaagguuggccacuaucgaagauggauauagggguaccccuguuggcaauagguuguuacucacaaguuaacccgauaaccuuaacugccgcccuucucuuauuaguagcacauuaugccauaauaggacccggauuacaggcgaaagcaacuagggaagcacaaaagagagccgccgcggggauuaugaaaaauccaacagucgacgggaugacggugaucgaccuagauccuauaccuuaugacccgaaauucgagaaacaauuaggccaagucaugcuauuaguacuuugcgucacgcaaguucuuaugaugcgcacuaccugggcguuaugcgaagcucuaacacuagcaacagggccgaucucgacacucugggaaggaaauccuggaagguuuuggaacacuacaauugcaguuucuauggcaaacauauuucgaggaagcuaucuagcgggagccggucuucuauucagcaucaugaagaacacagccaauacuagacgugggacggguaauacaggugaaaccuuaggagaaaaauggaaaaauagacucaaugcauuagggaaauccgaguuccaaauauauaagaaaucagggauacaagaaguagacagaaccuuagcuaaagaagggauuaaacguggagaaacggaccaucacgcagucagcagggguucugcaaaacuccguugguuuguagaaagaaaucuuguuaccccugaaggaaaagugguggaccuggguuguggaagaggaggcuggagcuauuacuguggaggucugaagaauguaaaggaaguaaaaggacuaacuaaaggaggaccgggacacgaagaaccgauaccuaugucaacguauggauggaaucuaguaagacuacaaagcgggguagauguauucuuuaccccuccggaaaaaugugacacauuauuaugugauauaggcgagucaucgccgaacccuacgguagaagcaggaagaacgcucagaguccuuaaucugguagaaaacugguuaaauaauaacacacaauucuguauaaaaguccuaaauccguauaugccaucgguaaucgagaaaauggaagcacuacaacgaaaauacggaggagcucuaguaagaaauccacuuucacgaaacaguacgcacgaaauguauuggguuuccaaugcaucgggaaacauaguaagcaguguuaauaugauaucaaggauguugauuaaucguuucacaaugcgccacaagaaagcaaccuaugaaccggauguugacuugggaucagguacuagaaauauugguauugaaucagaaacgccaaauuuggauaucauaggaaagaggauugaaaagauaaagcaggaacaugagacuucauggcauuacgaccaagaccauccauacaagacuugggcauaucacgggucauaugaaacaaaacaaacaggaagcgcaucuucaauggugaauggaguaguucgacuauugaccaaaccaugggacguuauacccaugguaacacaaauggcuaugaccgauacuacucccuuuggacaacagcggguguucaaagagaaagucgauacaaggacccaagaaccaaaagaagggaccaagaaacuuaugaaaauuacagccgagugguuauggaaggagcuuggcaagaagaaaacgcccaggauguguacgcgugaagaguucacgagaaaaguuagauccaaugcagcauugggagcuauauucacagaugaaaacaaauggaaaucggcgagggaagccguagaggauaguggauucugggagcuaguagacaaggaaaggaaucuucaccuugaagguaagugugaaaccugcgucuauaacaugaugggaaagagagagaagaaacugggagaguuuggcaaggcaaaagggaguagagcaauuugguauaugugguugggugcaagauuuuuggaauuugaagcauuagguuuccuaaaugaagaucacugguuuucaagagagaauagcuugucugguguagagggagaaggguuacacaaacuaggauacauauuacgugacguauccaagaaagaaggaggugccauguaugcagacgauaccgcuggaugggauacucgaauaaccuuagaggaucuuaaaaaugaagagaugguuacaaaucacauggagggugagcacaagaaauuagcagaggcuaucuucaaauugacauaccaaaauaagguugucagaguacaaagaccaaccccacgaggaacuguaauggacaucauaucucgaagagaucaacguggaucaggucaaguaguaaccuauggucuaaauacauucacaaauauggaagcacaauuaauuaggcagauggagggugaggguguauuuaagucuauccaacaacuaacaguaaaagaagaaaucgcagugaaaaacugguuaaucagaguagggagagaacggcugucgcguauggcaauaucuggggaugacugcgucguuaaacccuuagaugacagauuugcgagcgcacuuacugcucuaaacgauaugggaaaagugagaaaggacauacaacaaugggaaccgaguagaggauggaaugauuggacucaaguaccuuuuuguucgcaucauuuucacgaauuaauaaugaaagacggaagggugcugguaguacccugcagaaaucaagaugaauuaauaggaagggccagaauaucucagggggcagguuggucguugcgagaaacugcaugucuuggcaaaucuuaugcacaaauguggucucucauguacuuucauaggagggauuugagauuagccgcaaacgcgauauguagcgccgucccaagccacuggauaccuacgucccggacuacguggagcauucaugcaacccacgaguggaugaccacugaagauaugcuuacgguuuggaaucguguauggauacaagaaaaccccuggauggaagacaaaacgccuguugagucaugggaagaaauuccguaucuaggcaaaagggaagaucaauggugugguucuuugauaggacucaccagucgagccacaugggccaaaaacauccagacugcgauaaaccaaguucguucacucauaggaaaugaagaauauacagauuauaugccuagcaugaagcgauuccgacgugaggaagaagaagcgggaguccuaugguga

SEQ ID NO: 22238 - RNA, 9876 nt, Artificial Sequence
  derived and/or modified CDS sequence (opt6) from DENV-2__KM279517__SS-prME
acggcgggaaucauuauaaugaugauaccuaccguuauggcuuuccaucuuacgaccagaaauggugaaccucacaugaucguuagucgucaagaaaaaggaaaaagucuccuguucaaaacugaaaauggugugaauaugugcacucuaauggcuauggaccuaggugaauugugcgaagacacgauaacuuacaauugcccauuauuaagacaaaaugaaccugaagacaucgacuguugguguaauucaacguccacauggguaacauacggaacauguacugcaacaggugaacaucgaagagagaaacgaucaguugcacuugugccucauguuggcaugggcuuagaaacacguacagaaacuuggauguccucugaaggggcauggaaacaugcacaaagaauagaaaccuggauauuacgucacccuggguuuaccauaauggcggcgauauuagcauacacuauaggcacuacuuauuuucaaagaguauuaauauucauacuacuaacugcaguuacaccuucaauggccaugcgauguauagguaucucaaaucgugacuuuguagaaggggugucgggagggucaugggucgauauagugcuagaacaugguucaugcgugaccacgauggccaaaaauaaaccaaccuuggauuuugaacugauaaaaacagaagcuaaacaccucgccacuuuaagaaaauauuguguagaagcaaaacucacgaauacuaccacugcaagucgcuguccuacacaaggggaacccagucugaaugaagaacaagacaaacgauuuguaugcaaacauagcaugguugaucguggcuggggcaauggguguggacuauuugggaaaggggguauaguuacaugugccauguucacauguaagaaaaacauggaagggaaagugguucaacccgaaaacuuagaauacacaauagucauaaccccgcauucgggugaagaaaaugcgguaggaaaugauacagggaaacacggaaaagaaauaaaaguaacaccccaaagcucaauaacagaagcagaauuaacuggauacggaaccguaacaauggaauguuccccaaggacaggccucgacuucaaugaaaugguauuauuacagauggaaaauaaagcgugguuaguccacagacaaugguuucuagaccucccacuuccuuggcuaccgggagcagauacucaagguucuaacuggauacaaaaagaaacccuagugacauuuaaaaacccacaugccaagaaacaggauguugucguguuaggcagucaagagggagcaaugcacacggcauugacaggugcgacggagauacaaaugaguucuggaaacuuacuguucacuggacaucucaaauguagacuaaggauggacaaguuacaacucaaagguaugaguuacucgaugugcacagggaaauuuaagguggugaaggagauugcagagacacaacauggaacaauuguuauacgaguacaauacgaaggcgauggaucuccauguaaaauuccuuucgaaaucauggaucuggaaaagcgacauguauuagggagauuaauuacagugaauccuaucguuacugaaaaagauagcccuguaaacauugaggcggaaccaccauucggagauuccuacauuaucauugguguagagcccggacaauugaaguuguccugguucaaaaaggguucaucgaucggccaaauguuugaaaccacuaugaggggcgccaaaagaauggcaauacuaggugauacagcaugggauuuuggcagcuuagggggcguuuucacaaguaucgguaaagcacuacaccaaguauucggggccaucuacggagccgcuuuuuccggagucagcuggacaaugaaaauauugauagggguugucauuacauggauaggaaugaauaguagaucuacaaguuuaaguguaucauuagucuuaguugguguaguaacacuguaucugggaguaaugguacaggcagacucgggauguguaguaucuuggaaaaauaaagaauuaaagugcgguucaggcaucuucauaacggauaauguccauacauggacagagcaauacaaauuucaaccagaaagcccaccaaagcucgcaagcgcaauccaaaaggcacacgaagagggaauuugcggaaucaggucuguaacuagacuagaaaaucucauguggaaacaaauuacaccagaguugaaucacauucuaacggaaaacgaaguuaagcucacaauuaugacaggcgauauaaaggguaucaugcaagcuggcaaacgauccuugagaccucagcccaccgaacuuaaauauucauggaaggcuugggguaaggcuaaaaugcuaucaacagaacuucauaaccacacauuccucauugauggaccugaaacagcugaauguccuaacaccaauagagccuggaacucucuagaaguagaggauuacgguuuuggcguauuuacgacaaacauuuggcugaagcugaaggaacgacaggacguguuuugcgacaguaagcucauguccgccgcuaucaaagacaaucgggcaguucacgccgauaugggcuacuggauagagagcgcuuuaaacgacacguggaaaauagagaaagccagcuuuaucgaaguaaagagcugccacuggccaaagagucacacguuguggucgaauggaguucuggagagcgaaaugauuauacccaagaacuuugcaggaccuguaucucaacacaauuauaggccagguuaucauacacaaaccgcuggaccuuggcauuuagguagacuagaaauggauuuugauuuuugcgaaggaaccacgguuguaguaaccgaagacuguggcaacagaggcccgucgcuaagaaccacuacagcaaguggaaaacuaaucacggaauggugcugcagaucaugcacucucccuccgcuuagauauagaggcgaagaugguuguugguacggaauggaaauacggccccuaaaagagaaagaagaaaauuuaguaaauagccuagugacagcaggccacggacaaauagacaauuuuucacuugguguccugggaauggcauuguuucuggaggagaugcuccguaccagagugggcacaaagcacgcaauacuuuugguagcuguuagcuuugugacacuaauaacaggaaacaugucuuuucgugacuuaggccgaguuaugguaaugguaggagcuaccaugacagaugauauagggaugggcguuacauaccuugcucuacuagcugcauucaaagugagaccuacauuugcagcugguuuacuucuccguaaacuaacaucaaaggaauuaaugaugaccacgaucggaauaguauuguugucacagucaaccaucccugaaucuauucuagaauuaacggacgcgcuagcgcuggguaugauggucuuaaaaauuguccggaauauggaaaaguaccaauuagcaguuacgauaauggcaauuuuauguguaccuaaugcggucauuuugcaaaaugccuggaaagugaguuguacaacgcucgcaguagugucagugaguccacuccuguugaccagcucacaacagaaagcugacuggauaccgcuagcacuaacuauaaaaggacugaauccgacugccauauuuuugaccaccuuaaguaggacaucgaagaaaagaucauggccacuaaacgaagcaauaauggccguuggaaugguaaguauacuggcaagcucauuauuaaagaaugauauucccaugacagggccccuaguggcuggaggacuauuaacaguuugcuacguuuugacagggaggucagcagaccuggaacuugaaagggcagcagauguacggugggaggaacaagcugagaucucaggaucuucgccaauccuauccauaacaauaucagaagacggaaguaugagcaucaaaaaugaggaggaagaacaaacccuaacaauuuuaauuagaacaggauuauuagucaucucaggauuguuuccaguaucaaucccaauuacagcugcagcaugguaucuaugggaggucaagaaacaaagggcaggaguauuaugggaugugccgucaccaccuccugucggcaaagcagaacucgaagauggcgcguauagaauuaagcaaaaagguauccucggauauucacagauuggagccgggguauauaaggaaggaacuuuccauacaauguggcauguaacuagaggggcuguauugaugcauaaaggaaaacgaaucgagccaucaugggccgauguuaagaaagauuuaauaaguuacggagguggguggaaacuugaaggugaauggaaagaaggagaagaaguacaaguacuugcacuagaaccagggaaaaauccacgggccguucaaacaaaaccaggauuauucaagacuaacacagguacgauaggugcuguaucacuagauuucaguccuggaacgucgggaaguccuauugucgauaaaaagggaaaaguugucggucuauacggaaacggugucgucacaagaagugguacauacguaucagccauagcucagaccgagaaaucaauagaggauaauccagaaauugaagacgauaucuuuagaaagaaaagguugacgaucauggaucuacauccuggagcagguaagacaaaaagauaucuuccagcuauaguaagagaagccauaaaaagaggguuacggacacuaauacuugcaccaacaagagucguugcagcagaaauggaagaagccuuaagggggcuucccauaagauaucaaacccccgcgauacgugcggaacauacagggagagaaaucguggaucuaaugugccaugcuacuuuuacaaugcggcuacucucaccaauccgcgugccaaauuauaaucuaauuauuauggaugaagcacacuuuacugauccagcaaguaucgcugcaagaggauauauaucaacaagaguagaaaugggugaggcugccggaauauuuaugacagccacaccgccugguagucgggaccccuucccucagucaaacgcaccaauaauggaugaggaaagggaaauaccagagagguccuggaacucaggucacgagugggugacagacuucaaagguaaaacgguaugguucguaccuaguauaaaagcuggaaaugauauagccgcaugucuacggaaaaauggcaagaaaguaauucaacuauccaggaaaacauuugacucugaauauauaaagacacgaacaaaugauugggacuuuguuguuacaacugauauuuccgaaaugggagcaaauuuuaaagcagaaagaguaauugacccuaggagauguaugaaaccgguuauccuaacagauggggaagagagagucauccucgcaggcccaaugccaguaacccauuccagcgcggcucagcgcagagggagaguugggcgcaauccaaagaacgagaacgaccaauauauauauaugggugagccacuugaaaaugaugaagauugugcgcauuggaaagaagccaagaugcuuuuagacaauauaaauacaccagaggggauaauaccgaguauguuugaacccgaacgugagaaaguggaugcaauugauggagaauaucgauuacgaggagaagcaagaaagacuuucgucgaucuaaugagacgcggggaucucccuguuuggcuugcauacagaguggcagcagaggggauaaauuaugcugaucgacgaugguguuucgauggagucaaaaauaaucaaauauuagaagaaaacguugaaguagaaauuuggaccaaggaaggggaacguaagaagcuaaaaccucgaugguuagacgcgcgaauuuacagugauccuuuagcauugaaagaguucaaagaauuugcagcugguaggaagagucuuacacuuaauuuaauuacagaaauggggcggcucccaacauuuaugacacagaaagcaaagaacgcacuugacaaucuagcagucuuacacacugcagaggcgggagggagagcauauaaucacgcacuuucugaauuaccugaaacauuagaaacuuugcuacuucugacccuccuagcaacgguaacgggaggaauuuuccuauuucuuaugucggguaaagguaucggcaaaaugacgcucgguaugugcuguauaaucacggcguccauucuacuuugguacgcccaaauacaaccacauuggauagccgcgucuauuauucucgaguucuuuuuaauagugcuucuaaucccugaaccugaaaaacaacguacaccccaagauaaucaacuaacguacguaguaaucgcaauucuaacuguaguagcugcaaccauggcuaacgaaaugggauuuuuagaaaagacgaagaaagauuucggucuaggaagcauaacaacacaacaacccgaaaguaacauccucgauaucgacuuacgaccggcuucagcauggacuuuauaugcagucgcaacgacguuuauuacuccaauguugcgucauucaauagaaaauucgucugugaacgucucacuaacagcaauagcaaaucaagcaacgguccucaugggacuuggcaaaggauggccauugagcaagauggauaucggugugccucuauuagcaauagguuguuauagccaaguuaauccaauuacauuaacggcugcacuacuucuauuaguagcucauuacgcgauaauuggaccagggcuacaggcaaaagcuacaagagaggcacagaaaagagcugcggcgggaauuaugaaaaauccaacgguagauggcaugacgguuauugaccucgauccaauacccuaugauccaaaauuugaaaagcaauuaggccaaguaauguuacuugugcuaugugucacccagguacugaugaugcgaacuacuugggcucucugcgaagcacuuacacucgcaacgggaccuauaucaacauuaugggaagggaaccccgguagauuuuggaauacaacuauugcagucucaauggcuaacauuuuucgggggaguuaucuagcuggugcaggauuacuguuuagcauaaugaagaacaccgcaaauacaagaagaggcacaggaaauaccggagaaacauuaggagaaaaauggaaaaaucguuuaaaugcccucggcaaaucggaauuucaaaucuacaagaaaucagggauacaggagguugacagaacccuagccaaagaagggauaaagcgaggugagacugaccaucaugcagugucucguggaucagcaaaacuucgcugguucguagaaaggaauuuaguaacaccugaagguaaaguuguagaccuagggugcggaaggggaggauggagcuauuacuguggaggacucaagaacguaaaagaaguuaagggcuuaacaaaaggaggaccaggucaugaagaaccaauaccuaugagcacauacggcuggaauuuaguccgucuucaaucuggaguagauguauuuuucacaccuccagaaaaaugcgacacacuccugugcgauauuggagaaaguucgccuaauccaacaguggaagcugguagaacauuaagaguccuuaauuuaguagagaauugguuaaacaauaauacgcaauuuuguauaaaaguucuaaacccuuacaugccaaguguuaucgagaaaauggaaacauuacaaagaaaauaugguggagcacucgugaggaaucccuugucacguaauucaacacaugagauguauuggguaucaaacgcgucggggaauaucguauccagugugaauaugauuucucgaaugcucauuaauagguuuaccaugagacauaaaaaggcaacuuacgaaccagauguggauuuagggagugguacaagaaauauaggaauagaauccgaaacgcccaaucuagauaucauuggcaaacguauagagaaaauaaagcaagaacaugagacaucauggcacuaugaccaagaucacccauacaagacaugggcauaucauggaagcuaugaaacuaagcaaacaggguccgcaucaucaauggucaauggcguaguccgucuucuuacuaaaccaugggaugugaucccaauggugacgcaaauggcaaugacugauacgacucccuucgggcaacagcgaguuuuuaaagaaaaaguagauacccgcacucaagaacccaaagaaggcacuaagaaguuaaugaagauaacagcggaaugguuauggaaagaacucggcaagaagaaaacaccccggauguguacaagggaagaguucacgcguaaaguacgaucuaaugccgcguuaggagcuauuuucacggacgaaaacaaauggaaauccgcaagagaagcgguagaagacucaggcuucugggagcuaguugauaaagaacguaaccuacacuuggaaggcaagugugaaacgugcguauacaacaugaugggaaaacgcgagaagaaacuaggagaauuuggcaaagcgaaagguagcagagcaaucugguauauguggcuaggggcaagguuucuagaauuugaagccuuggguuuccuuaacgaagaucacugguuuucgagagaaaauagucuuucggguguagaaggugagggauuacauaaauugggauauauucuacgagauguuagcaagaaagaagguggugcaauguaugcggacgauacggccgggugggacacacggauaacauuggaagaucuuaagaaugaagaaauggucaccaaccacauggagggagagcauaaaaagcuagcugaagcaauauuuaaauuaacauaccaaaauaaaguggucagaguucagaggccaacuccccgugguacuguuauggacauuaucaguagaagagaucaacguggcucgggacaaguaguuacguacgggcucaauacauucacuaacauggaagcacaacuaauacgccaaauggaaggugaaggcguguucaaaagcauacaacaacuaacuguuaaagaagaaauagcggucaaaaacugguuaauuaggguuggacgugaacgauuaucgagaauggcuauaaguggagaugauugugucguaaaaccauuagaugacagauuugcgucagcgcuuacagcacuaaaugacaugggaaaaguuagaaaggauauacaacaaugggaaccauccaggggauggaaugacuggacgcaaguaccauucuguagucaucacuuccacgaauugaucaugaaagauggucgcguccuaguggucccaugucguaaccaggacgaacuaauuggcagggcuaggauuagccaaggugcaggcuggagcuugcgugagacggcguguuuagguaagaguuaugcgcaaauguggucacuaauguacuuccacaggagagaccuaagauuagcugcgaacgcaauuuguuccgcaguuccaagucacuggauaccaacaucaaggacaacauggucaauacaugcuacacacgaguggaugacaacagaagauaugcugacuguauggaacagagucuggauccaagaaaacccuuggauggaggacaagacaccgguugaaagcugggaagagauaccguaccucgggaaaagagaagaucaauggugugguucacuuaucgggcuaacuucaagggcuacaugggcuaaaaauauacaaaccgcuauaaaucaaguacguagcuuaaucggaaaugaggaguauacagauuauaugccgucuaugaagagauuccgccgugaagaggaggaggccgguguauuaugguag

SEQ ID NO: 22239 - RNA, 9876 nt, Artificial Sequence
  derived and/or modified CDS sequence (opt6) from DENV-2__KM279518__SS-prME
acugcagguauaaucauaaugaugauuccaacaguaauggcauuccaucuaacuacaagaaauggggaaccucauaugauuguuaguaggcaagaaaaagguaaaaguuuacucuuuaaaacagaaaacggggugaauauguguacgcugauggcuauggauuugggagaacuaugcgaagacacuauaacguacaauuguccacugcuaagacaaaacgaaccggaagauauugauuguugguguaauucuacaaguacauggguaacauacgguacaugcacagcaacgggugaacaccggagagagaaaagaagugucgcuuuaguuccucauguugggaugggucuggaaacaagaacagaaacuuggaugucauccgaaggagcauggaaacaugcgcaaagaaucgaaacuuggauauuacgccauccuggguuuacuauaauggcagcgauucuggcauacacaaucgggacaacuuauuuccaaagaguauugauuuuuauccuuuugacggcggucacuccaaguauggcuaugcgauguauagggauuagcaacagagacuucgucgaagggguauccggagguucauggguugacauagucuuggaacauggaagcugcgucaccacaauggccaaaaauaaaccaacuuuggauuucgaacugauaaaaacagaggccaaacauuuagcgaccuuaaggaaauauuguguagaggcaaaauuaacgaauacuacuacugcuagccggugucccacacaaggagaaccuucauuaaaugaagaacaagacaaaagauucguuugcaaacauucuaugguugauaggggauggggaaacggaugcggcuuguucgguaaaggaggaaucguuacaugcgccauguuuacuuguaagaaaaacauggaaggaaaaguuguacaacccgaaaaccuggaauauaccauaguuauuaccccacacucaggagaagaaaaugcaguuggaaaugauaccgguaaacauggaaaagagauuaaaguaacaccucaauccagcaucacugaagccgaauugacaggguacggcacagucacgauggaauguuccccaaggacaggacuugauuucaaugagaugguucuccuacaaauggaaaauaaagccuggcuuguucauagacaaugguucuuggaucuaccacucccuuggcugccgggagccgacacccaagguaguaauuggauccaaaaagagacucuuguaacuuucaaaaacccacaugccaagaaacaagaugugguaguccucggaucacaagaaggcgccaugcauacugcucuuacgggcgcaacugaaauacaaaugucuucuggaaaccuauuguuuacuggacauuugaaauguagacuuagaauggauaaacuccaacuaaaaggcaugucuuauucuaugugcacuggaaaauuuaaagugguuaaggaaauagcugagacgcaacacggaacuauuguuauuagaguacaauaugagggagauggaaguccauguaagauacccuucgaaaucauggaccuagaaaaacggcacgucuuaggcagacuaauuacaguuaacccuauuguaacugaaaaagauucaccaguuaacaucgaagcagaaccuccguucggagacucauauauaauaauaggaguagagccagggcagcugaaauuguccugguuuaaaaagggaucgucuauaggucaaauguuugagacaacuaugcguggcgcgaagcggauggcuauccuaggcgacacugcaugggauuuugggucacugggaggggucuucaccucaauaggaaaagcucuacaucaaguauuuggagcaaucuacggggcugcauuuaguggaguuucuuggacgaugaaaauacuuauugggguugugaucacauggaucggaaugaacucgcgaagcacgagucucucaguuagucuugucuuaguugguguugugacucuguaucuuggaguuaugguacaggccgauucuggaugcgucguaucauggaaaaauaaagaacuuaaaugcggaaguggaauuuuuauuacagauaacguacauacuuggacagaacaauauaaauuucaaccagaaagccccucuaaauuagcgucagccauucaaaaagcccaugaagaaggaaucuguggaaucaggagcgucacgagacuagaaaaucugauguggaagcaaauuacgccagaauuaaaccacauacuuacagagaacgagguaaaauugaccaucaugacgggagacaucaaggguauaaugcaagcagguaagcguucuuuaaggccucagccuacagaacuuaaauacucuuggaaggccugggguaaagcaaaaauguuaagcaccgaguuacacaaucauaccuuccugauugauggcccggagaccgcagaaugcccgaauaccaaucgggccuggaauagccuagaaguggaagacuacggauucgguguguuuaccacuaacauaugguuaaaacugaaagagagacaagauguauucugugacucgaaauuaaugucggcggcaauaaaagacaaccgugcugugcaugcagauauggguuacuggaucgaaagcgcacugaaugauacauggaaaauagaaaaagcaucauucauagaaguaaaaucuugccauuggcccaagucucauacguuauggucaaacgggguuuuagaaucggagaugauuauaccaaagaauuuugcugguccgguuucgcaacacaacuaucguccgggauaccacacacaaacagcaggaccuuggcaccuagguagguuggagauggauuuugacuuuugcgaagguacuacuguagucguuaccgaagacugcggcaacagaggcccgucacuucggaccacaacugcuucuggcaaacuaauaacagaaugguguugcagaaguuguacacuuccuccauuaagguaccggggugaagacggaugcugguacggaauggaaauaagaccacuuaaagaaaaagaagaaaauuuaguuaacucguuaguuacggcaggacacgggcagauagauaauuuuucccuaggagugcugggaauggccuuguuucuggaggaaaugcuacgaacucguguagguaccaagcaugcaauacuccuaguugcaguaucauuugucacccugauuacuggaaauaugagcuuucgagauuugggucgaguuaugguaaugguaggagcuacaaugaccgaugauauaggaaugggggucacauaucuagcauuacuagccgcauuuaagguacgcccuaccuuugcagcgggacuucuauuacgaaagcucaccucuaaggaauuaaugaugaccaccauaggaaucgugcuacucagucaaucgacaauucccgaaaguauuuuagaacugacggaugcucuggcccuaggcaugaugguuuuaaagauaguccguaacauggagaaguaucaacuugcagugacuauaauggcaauccuuuguguaccuaaugcgguuauauuacagaaugcauggaaaguaaguuguacaacauuagccguaguaucugugucuccauuacugcuuacaucaagucagcagaaggcagauuggauaccacuagcucuuaccaucaagggccuaaauccuacagcaaucuucuuaacaacauugucuagaaccagcaagaaaaggaguuggccccuaaacgaggccauaauggcagugggaauggugaguauauuagcaucuaguuuacucaaaaacgauauaccaaugacaggaccguuaguagcaggcggacucuuaacaguaugcuacguuuuaaccggucgaucugcagaccuagaacuggagcgagcagcagauguuagaugggaagaacaggcagaaauaaguggaucuagccccauucuuucuauaacgaucucagaagauggaagcaugucgauaaagaaugaagaggaggaacaaacauuaacaauuuuaauacgcacaggacuauuaguaauaaguggauuauucccuguuaguaucccgauaacggcagcugcuugguacuugugggaaguaaagaaacaacgagcugggguacucugggacguccccaguccaccgccaguagggaaagcagaacuagaggauggugcauaucgaauaaaacagaaaggcauccugggauauagucagaucggugcggguguauauaaagaaggaaccuuucauaccauguggcaugugacacgaggggcaguacugaugcauaaagggaaacgaauagagccaucuugggcagacgucaaaaaggaucuaauaucauacgggggaggauggaagcuagaaggugaauggaaagaaggagaagaaguacaaguucuagcucuagaaccaggcaaaaauccucgagccguucaaaccaaaccaggucuguuuaagacaaauacggguacaauaggcgcaguaucucucgauuuuaguccaggaacaucaggaucuccaauagucgacaaaaagggaaaaguuguuggauuauacggaaacgguguagugacacgaucagguaccuacgucagugcgauugcccagacugagaaaaguauugaagacaauccagagauugaagaugacauuuuccggaagaaaagacucacaauaauggauuugcauccaggugcgggaaagacuaagagauauuuaccggccauuguccgcgaagcaauaaaaagaggguuacgcaccuugauuuuggcuccuacgcgaguaguagcagcagagauggaagaagcguuaaggggauuaccuauucguuaucaaaccccugcgauucgggcagaacacacugguagagagauagucgacuugaugugccaugcaacauuuacgaugagacuauuaucuccgauacgagucccaaauuacaacuugauaauuauggacgaagcacacuuuacugacccagcgucgauagcugcaagagguuauauaagcacacgaguugaaaugggagaagcagcaggaauauucaugacugcgacaccacccgguagcagagauccauucccgcaaucaaacgcaccuauaauggaugaagagagagagauccccgaacggucauggaacuccggacacgaguggguuacagauuuuaaagguaaaacugucugguucguacccaguauaaaggcaggcaaugacauagccgccugcuuaaggaaaaacggaaagaagguuauccagcuuucaaggaaaacauuugauagugaguauaucaagacuagaaccaaugacugggauuucguagugacaacugauauuagugaaaugggugccaauuucaaagcagaaagaguaauagacccgcgaagaugcaugaaaccagucauacucacugacggggaagagagaguaauauuagccgguccgaugccaguuacccacaguucagcagcacagaggagaggucgagucggcagaaaucccaaaaacgaaaacgaucaauacauauacaugggagaaccauuggaaaacgacgaagacugugcgcauuggaaagaagcuaaaaugcuacuugacaacauaaacacaccagaaggcauaaucccaagcauguuugaaccagagagagaaaaaguagaugcgauagauggcgaguacaggcugagaggagaagcacguaaaacuuucguugaccuaaugcggcgaggcgacuuacccguuuggcucgccuacaggguagccgcagaagggauaaauuaugcagaucgucgcuggugcuucgauggugucaaaaauaaucaaauacuugaagaaaauguagagguagaaauauggacaaaagaaggagaaagaaagaagcuaaagccccgauggcuugacgcaagaauuuauagcgaccccuuggcccugaaggaauuuaaagaauuugccgcagggagaaagagucuaacauuaaaccuaaucacugaaauggggcggcuuccaacuuuuaugacacaaaaagccaaaaacgcacuugauaauuuagcagugcuacacacagcagaagcaggcgguagggcauauaaucaugcucuauccgaacuuccugagacucuagaaacgcuauuacuucuaacacuacuggcaacgguuacuggcgggauauuucuauuuuuaaugucuggaaaagggauaggaaaaaugacuuuaggcaugugcuguauuaucaccgcgucaauacugcugugguaugcacaaauucaaccucauuggaucgcggcaucaaucauccuugaauuuuucuugauaguacuacuuaucccagagccagagaaacaacggacaccccaggauaaccaauuaaccuauguggugauagccauacugaccguaguagcagccacuauggcuaaugaaaugggauuuuuagagaaaaccaaaaaggauuuuggacugggcagcauaacaacacaacaaccagagagcaauauauuggauauugaucucagaccagcgucagcauggacacuauacgcuguggccaccacauuuauaacaccaauguugaggcauaguauugaaaacaguucuguuaaugugucauuaacugccaucgcuaaucaagcgacaguucuaaugggacuagguaaaggguggccccuuucuaagauggauauaggaguaccauuauuagcaaucggauguuauagccagguaaauccaauaacacucacagcggcauugcuguuauuggucgcccauuaugccauaauaggcccaggacuacaggcuaaagcuacacgcgaagcacagaaaagggccgcagccggaauaaugaagaacccaaccguugauggaaugacgguaauugacuuagauccuauaccguacgauccuaaauucgaaaagcaauuaggucagguuaugcuauuaguucuaugcguaacacaagucuuaaugaugcgaacaacgugggcauuaugugaggcauuaacacuugcgacgggcccaauaagcacauugugggaagggaacccaggucguuuuuggaauacaacaauagcuguaucaauggcaaacauauuccgcggcucauaucuagcaggcgcaggacuacuauucucaauaaugaagaauaccgcgaauacgagacgugguaccggaaacacgggcgaaacccucggcgaaaaauggaaaaauagguuaaacgcauugggaaagagugaguuccagauauauaagaaaagcgggauacaagaaguagacaggacuuuggcuaaagaaggcauaaagcgaggagaaacagaccaucaugcaguaagucgagguagugcaaaauuaagaugguuuguggaaagaaacuuggucacgccugaagggaaaguuguagaucuuggaugugggagaggggguuggucuuauuauugcggcggucucaaaaauguuaaagaaguuaaaggacuaacaaagggaggaccaggacaugaagaaccuauuccgaugaguaccuacggcuggaaucuuguacguuuacaaucaggaguagauguauuuuucaccccaccagaaaaaugugauacgcuuuugugugauauuggagaaucuuccccuaaucccaccguggaagccggaagaacacugagaguauugaaucuaguugaaaauugguuaaauaauaauacacaauuuugcauaaaaguauuaaauccuuacaugccuaguguaauugagaaaauggaggcuuuacagcgaaaauauggaggagcuuuaguacgaaauccgcucucucguaauagcacgcaugagauguauuggguaagcaaugcuagugguaauauaguuucauccguaaauaugauuucaagaauguuaauaaaccgauucacaaugaggcauaagaaagcaacauaugaaccagacguggacuuggguuccgggacccgcaauauagguauagaaucagaaacucccaaucuugauauaauaggaaaaagaauugaaaagauuaagcaggaacacgaaacuagcuggcauuaugaucaagaccacccauacaaaacaugggcuuaucauggcaguuaugaaacgaaacagacaggaagugcaucuagcaugguaaacgguguuguaagacuacugacaaaaccaugggauguaauacccaugguuacucaaauggccaugacagauacaaccccauucggccagcaacggguguuuaaggaaaagguagacacgagaacccaagaaccaaaagaaggaaccaagaaacucaugaaaauuacggcugaaugguuguggaaagaauugggcaagaagaaaacaccccgcaugugcacuagagaagaauuuacacgaaaaguuagaucgaacgcggcccuaggcgcaaucuuuacggaugaaaauaaauggaagucagcaagagaagcaguggaagauucaggguuuugggaauuaguagauaaggaacguaaccuccaccuugaagguaaaugugagaccugcguauacaacaugaugggcaaaagagagaagaaacugggggaauuuggcaaagcgaaaggcuccagagcaaucugguauaugugguuaggagcgagauuucuagaguuugaagcguuaggauuuuuaaaugaggaccacugguuuagcagagaaaauucucuaucgggagucgaaggagaggguuugcauaaacuuggauacauacugcgagacguuagcaagaaagaaggaggagcaauguacgcggaugauacugcuggaugggacaccagaaucacgcuagaggacuuaaagaaugaagaaaugguuacaaaccacauggaaggugaacacaagaaacuagcugaagcaauauucaaacuaacauaucagaauaaagucguacgcguacaaagacagaccccacgagguacggucauggacaucauauccagaagagaucaacguggaucuggccagguuguaacauacggacuaaauacauuuacgaauauggaagcucaacucauacgacagauggaaggagaaggaguuuuuaaaucaauacagcaauuaacaguaaaagaagaaauagcagucaaaaacuggcucauuagaguaggaagagaaagguuaucucgaauggcgauuagcggugaugacuguguuguaaaaccacuugaugacagauucgccucggcuuuaacagcauuaaaugauaugggaaaagucagaaaagacauucagcaaugggaacccagucggggauggaaugacuggacacaaguaccguucugcucacaucauuuucaugaguuaaucaugaaagacggaagaguacuggugguucccuguagaaaucaagaugaacuaaucgggagagcccgaaucagccaaggagcuggcuggagucucagggagacugccugccucgggaagucauaugcgcaaauguggagcuuaauguacuuccauagaagagaucuccgacuggccgcaaaugcuaucuguucagcagugccuagccauuggaucccaaccuccagaaccaccugguccauacaugccacgcaugaauggaugacaacggaggauaugcuaacuguauggaaccgugucuggauacaagaaaacccuuggauggaagacaaaacacccguugaaucaugggaagagauccccuaucuaggaaaaagagaagaucaauggugcgguucccucauaggccuaacaaguagagcgacuugggcuaaaaacauacaaacagcuauuaaccaggucaggagucuaaucggaaaugaagaguauaccgauuauaugccgagcaugaagagauucagacgagaagaagaagaggccggagucuuaugguga

SEQ ID NO: 22240 - RNA, 9876 nt, Artificial Sequence
  derived and/or modified CDS sequence (opt6) from DENV-2__KM279519__SS-prME
acugcgggaaucauaauuaugaugauaccaaccgugauggcuuuucaccuuacgacuagaaauggagaaccacacaugauuguaucccgucaggaaaaaggaaaaucucuacuguucaaaacagaaaacggcguaaacaugugcacucuuauggcuauggaccuaggugaauuaugcgaagauaccaucacauauaacuguccacuacugagacaaaaugaaccagaagauauugauuguuggugcaacucuacuagcacuuggguuaccuauggaaccuguacagcaaccggagaacaccgaagagagaaacgauccguggcgcuuguaccucacguagggaugggacuagaaaccagaacugaaacauggaugucaucugaaggggcauggaaacacgcacagagaauagaaacauggauacugagacauccuggcuuuacaauuauggccgcaauauuggcauauaccauaggcacgacuuauuuccaaagaguauuaauauuuauucuguuaacugcaguaacaccaucaauggcaaugagauguauaggaauaaguaacagggacuuuguagaaggagucuccggugggaguuggguggauauagugcucgaacauggcuccugugugacaacaauggccaaaaauaaaccaacguuagacuucgaauugauaaaaacugaagcuaaacaucuggcaacacugagaaaauacugcgucgaagcgaaauuaacuaauaccacaaccgcgucacgauguccaacgcaaggugaaccgucucuuaaugaagaacaagauaaacguuuugucugcaaacauucgaugguggaucgagguuggggaaauggaugcggauuguucggcaaaggugggauuguaaccugugcaauguucacuugcaagaaaaacauggaagguaaagucguccagccugaaaaucucgaauauacgauaguaauaaccccacacuccggugaagaaaacgcagugggaaacgauacaggcaaacauggaaaagaaauaaaaguaacgccgcagagcagcauuaccgaagccgaacuaacaggguacgguaccguuacgauggaauguucaccucgcacgggcuuagacuuuaacgaaaugguacugcuucaaauggaaaacaaagcauggcuagugcacaggcagugguuccuugaccugccucuaccauggcuaccgggagcugauacccaaggaucuaacuggauucaaaaagagacauuaguuaccuucaagaacccacacgcuaagaagcaagauguagucguauuggguucacaggaaggugcuaugcacacggcacuaacgggcgcuacggaaauccaaaugagcagcggaaaccuauuauuuacaggucaucuuaaaugcagacuuaggauggauaagcuccagcuaaaaggcaugucuuacuccaugugcacaggaaaauucaaaguaguaaaagaaauagcggaaacacaacauggaacaauaguuauacgaguacaauaugaaggcgauggaagucccuguaaaauaccauucgaaauuauggauuuagagaaaagacauguucuagguagguuaauaacuguaaaccccaucguuacugaaaaagauuccccugucaacauagaggcugagccaccauucggcgauuccuauauaauaauaggcguagaacccggacaacucaaacugucuugguucaagaaagguucuucgauaggacagauguucgaaacgaccaugaggggugccaaaagaauggcuauauuaggugacacagcaugggauuuuggcucguugggugguguauuuacaucaaucggaaaggcuuuacaucaaguauuuggugcaaucuauggagcggcauucucuggagugaguuggacuaugaaaauacuuauuggggugguaaucacauggauugggaugaacagcagaucaaccagccugucaguuaguuugguuuugguuggcguuguaacauuauaccugggugucaugguacaggcagauucagguuguguagucaguuggaaaaauaaagaauuaaaguguggaagcggaauauucauaacugauaacguacacacauggaccgaacaauauaaguuucagccagaaagucccagcaaacuugcaagugcgauacagaaagcacacgaggaaggcauaugcggcaucagaucaguaacaagacuggagaaccuaauguggaaacagauaacucccgaauuaaaucacauccuaacggaaaaugaggugaaauuaaccaucaugacuggugauauuaaaggaauaaugcaagcgggaaagagaucacuacggccacaaccaacugaauugaaauacaguuggaaggcguggggcaaagccaaaauguuaucuaccgaauuacauaaccacacauuuuuaauagacgguccugaaacugcugaaugcccaaacacaaaucgagcguggaacucuuuagagguagaggacuauggguucggaguauuuacaacuaauauuuggcuaaaacuuaaggaacgacaggacguauuuugugauucuaaauuaaugucugcggcaauaaaagacaacagagccguucaugcagauaugggauauuggauagaaucggcauuaaacgacacauggaagauugaaaaagccaguuucauagaaguaaagagcugccacuggccuaagucccacaccuuauggucuaacgguguacucgaaucagaaaugauaauucccaaaaauuuugcaggaccaguaucccaacauaacuaucgaccuggauaucauacgcaaaccgccgggccguggcacuugggaagguuagaaauggauuucgauuucugugagggaacgacugugguagucacugaggauugcggaaaccgcgggccgucucuucguaccacuacugcuuccgggaaauuaauaacagaauggugcuguagauccuguacccuaccuccauuacgauauagaggagaggacggaugcugguacggcauggagauaaggccauuaaaagagaaagaggaaaaucuaguaaauucguuggucaccgcuggacauggccagauugacaacuuuucacuuggggucuuaggaauggcucuuuuucuugaagaaauguuaagaacccgcguagggacgaaacaugcaauauuauuaguagcaguuucuuucguuacauuaauuacagguaacaugucuuuuagggaucucggccgugugauggucaugguuggggcuacaaugacagaugacaucgguaugggaguaacauacuuagcuuuacuagccgccuucaaaguacgcccaaccuuugcagcaggauuacuccuaagaaaacugacaaguaaggaauugaugaugacgacgauuggaauaguccucuuaagucagagcacaauucccgaaucuauauuggaacuaacagacgcuuuagcacuaggaaugaugguacuaaagauaguucgaaacauggaaaaauaucaacuugcagucaccauuauggccauucucugugucccaaaugcagugauauuacaaaaugcuuggaagguaucauguacgacuuuagcaguuguaucagucucuccgcuacuauuaacaucaagucaacaaaaagcugauuggauaccacuagcauuaacgauaaaagggcuuaauccaacggcaauuuuccuaacaacucugucacguacaucgaagaagagaucauggccucucaacgaagcaauuauggcaguaggaaugguauccaucuuagcgucgucacuucuaaagaaugauaucccuaugacaggucccuugguagcgggaggauuacuaacagucuguuacgucuuaaccggcaggucagcagauuuagaauuagaaagggcugcagaugugcgcugggaggagcaggccgaaaucucaggcaguucuccuauuuugucuauaacaauuucugaagauggaagcaugucuaucaaaaaugaagaagaagaacagacacuuaccauacucauacguacuggcuuacuggucauuagcggacuauucccgguaucgauaccaauaacagccgcagcuugguaucuaugggaggugaagaagcaaagagcagggguauugugggauguaccauccccaccgccaguaggcaaagcagaauuggaagacggagcauauaggauaaaacaaaagggaauauuaggauauagccaaaucggcgcugguguuuauaaggaagguacuuuccauacaauguggcauguuacacguggugcuguauugaugcacaaagguaaaagaauagaaccaucaugggccgaugucaagaaagaccuuauaaguuacggaggggguuggaaacuugaaggugaauggaaagaaggagaggaaguacaaguauuggcuuuagagccgggcaaaaauccuagagcaguucaaacaaaaccaggacuauuuaaaacgaacacaggaacgauaggcgcaguuucacuagauuuuucgccagguacaucgggcaguccaaucguagauaagaaaggaaagguggucggccuguacggcaacggaguaguaacacgauccgguacguacguuucagccauugcccaaacugagaaaaguaucgaagacaauccugaaauagaagaugauaucuucaggaagaaaagacuaacuauuauggauuuacauccuggagcggguaaaacaaagagauaucucccagcuauagucagagaagcaauaaaaagaggacuaaggacguuaauacuugcgccgacacggguggucgcugcugaaauggaagaagcucuaagagguuugccgauaagauaucaaacaccagccauccgugcugaacauacuggaagggagaucguggaccugaugugccaugcaacuuuuacaaugcgauugcucagcccaauacggguuccgaauuacaaucuaauaauuauggaugaagcacauuuuaccgauccugcaucaauagcggcacguggguacauuagcacacgaguggaaaugggugaggcugcgggaauauuuaugacagcaacgccaccaggaaguagagauccuuuuccucaaucuaaugccccuaucauggacgaggagaaagaaaucccagaaagguccuggaacucgggacaugagugggucacagauuuuaaaggaaaaacaguaugguucguaccauccauuaaagcggguaacgauauugcugcauguuuaaggaaaaauggcaagaaagucauacaauugagcagaaaaacuuucgauucagaauacauuaagacuagaacgaacgauugggacuuuguggucacgacggauaucagcgaaaugggggcaaauuuuaaagcagaaagaguaauugauccaagaagaugcaugaaacccgugauauuaaccgauggagaggaaaggguuauacucgcugguccaaugccaguaacacauuccagcgcugcacagaggagaggcagaguaggacgaaaucccaaaaaugagaacgaucaauacauauacaugggcgagcccuuggaaaacgacgaggauugcgcgcacuggaaagaagcgaaaauguuauuggacaauauuaacacaccggagggaauaauaccguccauguuugagccagaaagggagaaaguagaugcaauugauggagaauaccgauuacguggggaagcuagaaaaacauucguagaccugaugcguaggggcgauuugccuguguggcuagcguauaggguggcagcugaaggcaucaauuaugcagacagacgcugguguuuugauggagucaaaaauaaccaaauucuagaagaaaacguugaaguugagauuuggacaaaagaaggugaaaggaagaaacugaagccaagauggcuagacgccagaauuuauucagacccacuagcccuuaaagaauuuaaagaauuugcggcuggcaggaaaucauuaacauuaaaccuuaucaccgaaaugggcagacuaccuaccuuuaugacacagaaagcaaagaaugcauuagauaaccuggcaguuuuacauaccgcagaggcuggugggcgcgcguauaaccaugcauuaucggaguuaccagaaacccuugaaacauuauugcuacucacacuucuagcuaccgugacaggcggaaucuuuuuauuucuuaugagcggcaaaggaauugguaagaugacauuaggaauguguugcauaauaacagcaucaauuuuauuaugguaugcacaaauccaaccacacuggauagcagcuaguauaauauuagaguucuuuuuaauuguauuguuaauccccgaaccugaaaaacaaaggacaccgcaagauaaucaacuaacuuauguuguaauagcuauccuaacagucguugcggcaaccauggcaaaugaaaugggauucuuagaaaagacaaagaaagauuucggccucggaagcauaacaacacaacaaccggagucaaauauacuagauauagauuuaagaccagccucugcauggacucuauaugccguugcaacaaccuucaucaccccuauguuaaggcauaguaucgaaaacucaaguguaaacgugagucuaacagccauagcuaaucaggcuaccguacucauggguuuaggaaagggauggccacuuucaaaaauggacauuggaguaccccucuuagcuauaggcuguuauagucaagucaauccaauaacauuaacugcggcuuuauuacuuuugguugcccacuacgcaaucauugggccaggccuacaagcaaaggcaacucgagaggcccaaaaacgggcagcagcaggaauaaugaaaaacccuacuguagaugguaugaccguaauugaucucgauccaauuccauaugauccaaaguucgaaaaacaacucggccaagugaugcuucucguucuuugcgucacacaaguacuuaugaugagaacaacaugggcguuaugugaagcguuaacacuagcaacugggccuauaucaacgcuaugggagggcaauccaggccgauuuuggaauacuacaauugcuguaucuauggccaauauuuuccggggcaguuauuuggccggugcgggauuacuauuuucaauaaugaagaacaccgcaaacacacguagggguacuggaaacacgggagaaacauugggagaaaaauggaagaauagauugaaugcccuaggaaaaagcgaguuccagaucuauaagaaaucagguauacaggaaguagaccguacgcuugccaaagaaggcauaaagagaggagagacugaccaucacgccguaagcagaggaagcgccaaauuacguugguuuguugaaagaaaucuuguaacgccagaggggaagguaguugaccuagguugcggacguggugguuggucguauuacuguggaggucuuaaaaauguuaaagagguuaaaggcuuaacaaaaggcggaccaggccaugaggagcccaucccaauguccacguauggcuggaauuuagugcgguuacaauccggaguagauguauuuuucacaccaccggaaaaaugcgacacuuuauuaugugauaucggugagucaagcccaaauccaacgguggaagcuggccgaacauugcgaguccuaaaccucguugaaaauuggcucaauaauaauacacaauucuguauaaaagucuuaaaucccuauaugcccucaguaauagagaaaauggaggcccuacaacgcaaauaugguggggcauugguccgaaauccauugaguagaaauuccacccacgagauguacuggguaaguaaugcaagugguaacauuguaaguuccgucaauaugauuucaagaaugcuaauuaaccgguuuacgaugagacacaagaaagcuacuuaugaaccagauguugaucuggggaguggaacgagaaauaucgguaucgaaucggaaacaccgaauuuagacauuauaggaaaaaggauagagaaaaucaagcaagaacaugaaacuagcuggcacuaugaucaagaucacccuuacaagacaugggccuaccacgguucauaugaaacaaaacaaacaggcuccgcgucgagcauggugaaugggguuguaagguuauuaacuaagccaugggacguaauuccuaugguaacgcaaauggcgaugaccgauaccacuccauucggucaacagcgagucuucaaggaaaagguggauacaagaacacaagaacccaaggaaggaacaaagaaauuaaugaaaauaacggcggaguggcuauggaaagaauuaggaaagaaaaagacacccaggaugugcacaagggaagaauuuaccaggaaaguucguucaaacgcugcucuuggugccauauucacugacgaaaauaaauggaaaagcgcucgcgaagcgguugaagacagcggauuuugggaauuagucgacaaagagaggaacuuacaucuagaagggaaaugcgagacaugcguuuauaacaugaugggaaagagagagaagaaacuuggagaguucggaaaagcuaagggaucuagggcgauaugguauauguggcugggggcacgauuuuuagaauuugaagccuuaggauuuuuaaacgaagaucauugguucucaagagaaaacuccuuaucaggaguugagggagagggguugcauaaacuaggauauauauuacgcgaugugagcaagaaagaaggaggcgcgauguacgcggacgacacggccggcugggacacgagaauuacguuggaagauuugaaaaaugaggaaaugguuaccaaucacauggaaggagaacauaagaaacucgcagaggcaauuuucaaacuaacguaucagaauaaaguuguucguguccaaagaccuacgccaagaggaacugucauggauauaauuagccgccgagaccaaagaggaaguggacaagugguaacauauggucucaauacuuuuacaaauauggaggcgcagcuaaucagacaaauggagggugaagggguauuuaaaucuauacaacaacugacuguuaaagaggagauugccgucaaaaauugguuaauaaggguagguagagagagacuaucaaggauggcaauauccggggacgacugcguugugaagccuuuagaugaccgcuuugccagugcgcucacugcccuuaaugauaugggaaaaguccgcaaggacauacaacaaugggagccaaguagaggguggaacgacuggacacaaguaccauucuguucacaccacuuucacgaacuaauaaugaaagauggacggguccuugcaguaccguguagaaaucaagaugaauuaaucggucgggcacgcauaucacaaggugcaggauggagccuaagagaaacagcaugucucgguaagucauaugcacaaauguggagcuugauguacuuucauaggagagaucuaagauuagcugccaaugccauauguagugcagugccaagucacuggauaccuacaaguagaacaacuuggucaauacaugcaacucaugaauggaugacuacagaagacaugcuuacgguauggaauagggucuggauccaagaaaauccauggauggaagacaagacaccaguagaaaguugggaagaaaucccauauuuagguaagcgagaggaucagugguguggaagucucauagguuuaacaaguagagcaacaugggcgaaaaauauacagacagcgauaaaucagguucggagccucauagggaacgaagaauauaccgacuauaugccgucaaugaaaagauuucgcagagaagaagaagaggcgggaguguuaugguaa

SEQ ID NO: 22241 - RNA, 9876 nt, Artificial Sequence
  derived and/or modified CDS sequence (opt6) from DENV-2__KM279520__SS-prME
acugcagggauuauaauaaugaugauuccaacaguuauggcauuucacuugacuacuagaaauggagaaccacauaugauuguuucaaggcaagaaaaagguaaaucauuacuauuuaaaacagaaaacggaguaaauauguguacgcuaauggcaauggaccuaggcgaacuuugcgaagacaccaucacuuauaauuguccacuuuuacgacaaaacgaaccagaagauaucgacugcuggugcaauucaacgucuacuuggguaaccuacgguacaugcacugcuacaggagaacacagaagagagaaacgcucuguagcguuaguaccacacguuggaaugggacuggaaacacgcacagagacauggaugucuucagaaggagcauggaaacacgcucaacgcauugaaacuuggauauuaagacauccuggauuuacaaucauggcagcuauucucgcauacacgauagguacuacauauuuucaaagaguuuuaaucuuuauacuacuaacugcaguuacucccuccauggcaaugagaugcaucggcaucucaaacagagauuucguagaaggaguaagcggcggcagcuggguagauauaguccuagaacacgguaguugcgugacgacaauggcacgaaauaaacccacauuggauuucgaauuaaucaaaacggaagcaaaacaccuugcuacauuacggaaauauugcguggaagcgaaauugacaaauacuacaacagccucgcgauguccuacucaaggagagccaucguuaaaugaagaacaagauaaaagauucgucugcaaacauaguaugguagauaggggauggggcaauggcuguggucuauucggaaaagggggaauaguaacaugugcuauguuuaccugcaagaaaaacauggaaggaaaagugguacaaccagaaaacuuagaauauaccauaguuaucacgccucacucuggcgaggaaaacgccgucgggaacgacaccggaaaacauggaaaagaaauuaaaguaacaccucaaucgaguauaaccgaagcugaacucacgggauauggaacgguuacaauggaauguucacccaggacagggcuggauuucaacgagaugguccuuuuacaaauggaaaacaaagcaugguugguacaccgucaaugguucuuggaucuuccacuccccuggcuaccaggggcggacacccagggcucaaauuggauacaaaaagagaccuuagucaccuuuaaaaauccccacgccaagaaacaggaugucguaguacucgguucucaagaaggagcgaugcacacugcccucacaggugcaacagaaauacaaaugaguagcgguaacuuacuguuuaccggacauuuaaaaugcagacuacggauggauaaacuacaguugaaaggaauguccuacucaauguguaccggcaaauuuaaaguagucaaagagauugcagaaacccagcaugguaccauaguaauccgcguucaguacgaaggcgacgguaguccuuguaaaaucccauuugagauuauggauuuagagaaaagacacgcacuaggacgauuaaucacgguaaauccaauagugacugaaaaagauaguccaguuaauauagaagcagagccacccuucggagacagcuauauuaucaucggaguagaaccgggccagcucaagcucaguugguucaagaaagguagcaguaucggucaaauguuugaaaccacgaugcguggugcaaaaagaauggcaauuuuaggugauacugcaugggacuucggaaguuuagggggaguguucacaucaauagggaaagcacugcaucaaguguuuggagcaaucuauggcgcggcauuuuccggaguaucguggacuaugaagauucuuauuggaguaguaauaacuuggauaggaaugaauaguagaucaacaaguuuaucaguaucccuugucuugguuggugucgucacacucuauuuaggcguaauggugcaggcagacuccgguugugugguuucuuggaaaaacaaagaacugaaauguggaaguggcauauucauaacugauaauguacacacauggacagaacaguauaaauuucaacccgaaucaccaaguaaacuugcaagcgcaauccaaaaagcacaugaagaagggauaugugguaucagaucaguaacucgccucgaaaacuuaauguggaagcaaauaacgcccgaauuaaaccauauauuaacagagaaugaaguuaaauuaacgauaaugacuggcgacauaaaggguaucaugcaagccgguaagcgaucgcuccgaccccaaccgacagaacugaaauauucauggaaggcuugggguaaggccaagauguuaagcacugagcuacauaaucacacauucuugauagacgguccugaaacagcugaauguccaaauacaaacagggcuuggaacucccuugaaguugaagauuauggauuuggcguauuuaccacaaauauaugguugaaauugaaagaaaggcaagacgucuuuugugauaguaaacuuaugagugcagcuauaaaagauaauagggccguccaugcggacaugggguauuggauugaaagcgcgcuuaaugauacauggaaaauagaaaaggcuuccuucauagaaguaaagucaugccacuggccuaagucacacacauuauggucaaacggaguucucgaaucggaaaugauaauaccgaaaaauuucgcagggcccguuucccaacauaauuauaggccaggauaucauacucaaacugccggccccuggcacuuagggagacuagaaauggauuucgacuuuugugaagguacaacugugguggucaccgaagacugcggaaacagaggaccgucccuacggacaacaacagcgucagggaaacucaucacugaaugguguugucggaguuguacauugcccccacugagguaccgcggugaagauggaugcugguauggaauggagaucagaccauuaaaagaaaaagaggagaaucuagugaacuccuuagugacagcaggccauggucaaauugacaauuucagucuugguguacucgguauggcgcuauuccuagaagagaugcuacgcacaagagugggcacgaaacaugcuauuuugcuuguugccguuucuuuugucacauuaauaacaggaaacaugucguuuagggaccuuggcagaguaaugguuaugguuggagcaacgaugacagaugauauagggaugggcguuaccuacuuggcccugcucgcagcauucaaaguucgucccacguucgcggcugguuuacuguuacgcaaacucacaucuaaggaacuuaugaugacaacaauuggcauaguauuauuaucacagucaaccauaccagaaaguauuuuagaacugacagaugcacuagcgcuagguaugaugguacucaaaauaguacguaauauggaaaaguaucaacuugcagugacaauuauggcaauauuauguguaccgaaugcagucauccuucaaaaugcuuggaaaguaaguuguacgacuuuagcuguuguuaguguuaguccauuacuccucaccuccucgcaacaaaaagcggauuggauuccauuagcauuaaccauaaagggauugaauccaacagcuauauuccugacaacucucucuagaacaucgaagaaaagaagcuggccuuugaacgaagcaauaauggcaguagggaugguuaguauccuagcuaguucacuguugaaaaacgauaucccaaugacuggaccuuuaguugcaggcggcuuacuaacgguaugcuauguacucacaggaagaucugcugaccuagaacucgagagagccgcggacguaagaugggaggaacaggcagaaauaaguggaucgucaccaauucuuaguauuaccauuagcgaagacggcaguaugucaauuaaaaaugaggaagaagaacaaacguuaacaauuuuaauuagaacaggacuauuagugauuagcggacucuuuccaguuagcauuccaaucacggcagcugcgugguaucuaugggaagucaagaaacagcgugcugguguccuuugggacgugccuagcccuccgccuguagguaaagcugaguuagaggacggagcguaccggauaaaacaaaaaggaauacugggcuauucacagauaggugccggaguauauaaagagggcacauuucacaccauguggcacguuacacgcggagcugugcuaaugcauaaggggaagcgaauagagcccaguugggcagacgucaagaaagaucuaauaagcuacgguggugguuggaaguuagagggugaauggaaagaaggagaagaaguacaaguacuggcauuagagccagguaaaaaucccagagcgguacagacuaaacccggacuauuuaaaacgaauacaggcacuaucggugcgguauccuuagauuucucacccggcacaaguggcagucccauaguagacaaaaagggcaagguugugggacuauacggaaacggaguaguuacgcgaucugggacauacguuucagcaauagcacagaccgaaaagucuauagaggacaauccagaaaucgaagacgauauauuuaggaaaaagcgguuaaccauaauggaucuacauccgggugcaggcaaaacuaaacguuacuuaccagcgauagucagagaagcaauaaaacgcggacuccgaacauugaucuuagcaccaacgaggguagucgcugcugaaauggaagaggcauuaaggggucuucccauuagauaucaaaccccugcaauaagagcagagcauacaggacgugaaauaguagacuugaugugucacgcaaccuuuacaaugaggcuauuaucaccgauaagagucccgaauuauaauuuaauuauuauggaugaagcgcauuucacagacccagccagcauagcggcgcggggguacauuaguacuaggguagaaaugggcgaggcugcagguauuuucaugacagcgacaccacccgguagccgggacccauucccucaaucuaaugcacccauaauggaugaagaacgagaaauaccagaaagaucuuggaacucaggucaugaauggguaacagauuuuaaagguaaaaccguaugguuuguaccaucuauaaaagcagguaacgauauagcugcuuguuugcgcaagaaugggaagaaaguaauucaacuuuccaggaaaacauucgacucggaauauauuaaaaccagaacuaaugacugggacuuugugguuacgacagauauuucagaaaugggcgcaaauuuuaaggcagaaagaguaauagaccccagaagaugcaugaaaccuguuauauuaacggauggggaggaaagagucauauuggcaggaccaaugccagucacucauagcagugcugcccaacggcgaggacgcguuggccguaaucccaaaaaugagaacgaucaauauauauauaugggugagccguuagaaaacgaugaagauugugcacauuggaaagaagccaagaugcuauuagacaauaucaauacuccugaagguauuauuccaucaauguuugaaccagagcgagaaaaaguagacgcaaucgauggggaguauagauugagaggcgaagcucgaaagacauuuguagaucucaugcggaggggugaccugccggugugguuagcuuauaggguagccgcggaagggauaaauuaugccgauagacguuggugcuucgauggagucaaaaauaaccagauauuagaggaaaauguagagguagaaauauggacaaaagaaggugaaaggaagaaacuuaaaccaagauggcuugaugcacguauuuauuccgacccauuagcacucaaagaguucaaagaauuugcugcaggacgaaaaucuuugaccuugaauuuaauaacggaaauggggcgacucccaacauucaugacgcagaaggccaaaaaugcuuuagauaaucuggcaguacuucauacagcagaagcaggaggacgagcauacaaccacgcauuaucagagcuaccugaaacauuagagacccuacuguuauuaacacuacuugcgacagugacuggaggcauauuuuuauuucucaugagugguaaagguauugguaagaugacuuuaggaauguguuguauaauuacagcuucaauuuuauuaugguaugcccaaauccagccgcauuggauugccgcuagcauaauauuagaguucuuuuuaauaguccuucugauccccgaaccugagaagcagagaacuccucaagauaaucaguuaacuuauguuguuauugcaauauugacaguugucgccgcuacaauggcgaaugaaaugggauuuuuagagaaaacaaagaaagauuuuggauuagguucaauuacgacccaacagccagaguccaacauucuagauaucgaccuacguccagcaucggcguggacauuauaugcaguagcuacaacuuuuaucaccccaaugcuuagacacucgauagaaaauaguuccguuaaugucucauuaacagcaaucgccaaccaggcaacugucuugaugggauuaggaaaagguuggccacuaucuaaaauggacauaggaguaccucuauuagccaucggguguuacagucaaguaaacccuauuacucucacugcagcacuguuacuauuaguagcacauuacgccauaaucggaccggggcuacaagccaaagcgacacgagaggcucagaaaagagcagccgcugggauaaugaaaaauccuacgguugauggcaugacuguuauugauuuagacccuauaccguaugaccccaaauuugaaaagcaauuaggacaagugaugcuauuaguccuaugcgugacccaaguacuuaugaugcgaacaacuugggcauuaugugaagcauuaaccuuggcaaccggacccauaucuacguugugggaagguaacccaggaagauucuggaacacgacaaucgcagucucgauggcgaacauauuccgaggcucuuauuuggccggugcagggcuauuguucuccauaaugaagaacacagcgaauacucgaagggguacaggaaacaccggagaaacauuaggagagaaauggaaaaaccgguuaaaugcccuggggaaaucugaguuucagauauacaagaaaucugggauccaggaaguagauagaacauuagcaaaggaaggcaucaagagaggugaaacagaccaucacgcagugucaagaggaagcgcuaaacuaaggugguucguugaaagaaaccucgucacucccgaaggaaagguuguagaucuuggaugugggagaggaggguggucguacuacugcggaggucuuaaaaauguaaaggaagugaaaggguugacaaaaggagggccaggucacgaagaaccuauccccaugaguacauacgguuggaaucuaguuagacuccaaaguggaguugaugucuucuucacgccgccugagaaaugugauaccuuacucugugacauuggagaaucgagcccuaauccaacgguagaagcggggagaacucuacgaguauugaaucucguagaaaacuggcuaaauaacaauacucaauucuguauaaaaguccuuaauccauacaugccuucggugauagaaaagauggaagccuuacaaagaaaauaugguggggcgcuaguacgcaacccccuuucgcgcaacucuacacaugagauguauuggguuaguaacgcaucaggaaacauuguaucuaguguuaacaugauaucaagaaugcuaauaaacagguuuacuaugaggcauaagaaagcaaccuaugagccagauguagauuuaggaucuggcacgaggaacauaggaauagagagugagaccccuaaucuggauauaauagguaaaagaauugaaaagauaaaacaggaacacgagacguccuggcauuaugaucaagaccacccuuauaaaacuugggcuuaucacgguucauacgaaacuaaacagacugggucugcuucaaguauggucaacggggucguaagacuuuuaacuaaacccugggacgucauuccaaugguaacacaaauggcgaugacagacacaacaccauuuggacaacaaagagucuuuaaagaaaaaguagauaccagaacucaggaaccuaaagagggaacaaagaagcuaaugaaaauaaccgcugaaugguuauggaaagagcuaggcaagaagaaaacaccacgcauguguacaagagaagaauuuacgcgaaagguaaggucaaaugccgcauuaggagccaucuuuacugaugagaacaaauggaaaagugccagagaagcagucgaagacuccggcuucugggaauuaguagauaaggaacgaaauuuacacuuggagggaaagugcgagacguguguuuacaauaugauggguaagagagagaagaaauuaggcgaauuugguaaagcaaaaggaucuagagcaauuugguacaugugguuaggggcgcgauuucuagaauuugaagcacuugguuuucuaaaugaggaucacugguuuuccagagagaacagccuuagcgguguagaaggagaaggccuccacaaauuaggauauauacuaagggauguaagcaagaaagaagggggugcaauguaugcugaugauaccgcgggcugggauaccagaauaacuuuggaagauuuaaagaacgaagaaauggucacuaaucauauggaaggagaacauaagaaauuagccgaagcaauuuuuaaguuaaccuaccaaaauaaaguaguacgcguacaaagaccaacaccgcggggaacugucauggauauaauuucucggcgagaucaaaggggcucagggcaaguuguaaccuacggauuaaacaccuucacuaauauggaagcgcagcuuaucagacaaauggaaggagaaggagucuuuaaaagcauacagcaacuuacgguaaaagaagagauagcagucaaaaacuggcucauucgcguuggaagagaaagauuaucccgaauggcaaucaguggagaugacugcguaguuaagccacuagaugauagauucgcuagugcucuuacagcguuaaacgauauggguaaaguccgaaaagauauacaacagugggaacccucccguggauggaaugacuggacgcagguuccguucuguagucaccauuuucacgagcugauuaugaaagauggcaggguguuaguaguuccaugcagaaaccaagaugagcuuauugggagagcgaggaucagucaaggugcagguuggucucuacgagaaaccgcgugucuaggcaaaagcuacgcacaaauguggagucucauguacuuccaucgaagggauuugcgguuagcagcgaaugccauauguucagcaguuccuucacauuggaucccaacaagcaggaccacaugguccauccaugcaacacacgaauggaugacgacagaggauauguuaaccgucuggaaucguguuuggauucaagagaaucccuggauggaagauaaaacucccguggaaacuugggaagaaauaccauaucuagggaagagagaagaucaauggugugguagucucauaggauuaacaaguagagcgacaugggccaaaaauauucagacugcaauaaaccaggucaggucauuaauagggaaugaagaauauacugauuacaugccaucgaugaaaagguuuagaagagaagaagaggaagcugggguacuaugguaa

SEQ ID NO: 22242 - RNA, 9876 nt, Artificial Sequence
  derived and/or modified CDS sequence (opt6) from DENV-2__KM279521__SS-prME
acagcugguauaaucauuaugaugauccccaccgugauggcauuucacuugacaacacgaaauggcgagccacauaugaucguaucccggcaagagaaaggaaaaaguuuacuauucaaaacugaaaauggugugaacaugugcacauugauggcaauggaccuuggagaacuuugcgaagauacuauaacuuauaauugcccauuauugagacaaaaugaaccagaagacauagauuguuggugcaauucaacaaguacauggguaacauacggaacuugcacugcaacgggagaacaccgcagagagaaacgaagcguggcucuagugccccacguaggaaugggauuagaaacacguacagaaacguggaugaguagugaaggagcuuggaaacaugcacagagaauagaaacuuggauucugaggcauccagguuuuacaauaauggcugcuauccucgcauauacaauugggacaacuuauuuucagagaguacucaucuuuauccuauuaacagcuguaacaccaucuauggcgaugagauguauuggaauaagcaacagggauuucguugaagguguguccggaggcucauggguugauaucguguuagagcacgguaguugcguaaccacaauggcgaaaaacaaaccaacacucgauuucgaguuaauaaaaacggaagcaaaacaccucgcuaccuuaagaaaauauuguguugaagcaaaacugaccaacacaacuacugcuucacguugcccuacacaaggagaaccaagccuuaaugaagaacaagacaaacgguuuguuuguaaacauagcaugguagaccgagguuggggaaacggaugcggauuauucggaaaagguggaauaguuacuugugcgauguuuaccugcaagaagaauauggaaggcaaggucguucaaccggagaacuuagaauacacuauagugauuacaccccauucgggagaagaaaaugcaguagguaaugauacggguaaacauggaaaagaaauuaaagugacuccucaaaguuccaucacagaagcggaauugaccggguaugggacggugacaauggagugcaguccuagaacaggguuggacuucaacgagaugguccuauugcaaauggaaaacaaagcaugguuaguacaucggcaaugguuucuugaccuaccgcuucccugguuaccaggugcagacacccagggaucaaauuggauucagaaagagacauugguaacguucaaaaauccacaugccaagaaacaggacguaguggugcuaggaagucaagaaggcgcaaugcauacggcacuaacaggagcgacugaaauccagaugagcucaggcaaccuacuauucacaggacauuugaaauguagauuacggauggauaaauuacaacuaaaagguaugucauauucaauguguacugguaaauucaaaguaguaaaagagauagccgaaacucaacauggaacaaucguaauaagaguacaauaugaaggcgacggcucacccuguaaaauuccguuugagauuauggacuuagaaaaacgacauguuuugggacgucuaauuacgguaaacccaauagucacugaaaaagacaguaccgucaauauagaagcugaaccaccauuuggugauucauacauuauaauuggcguagaaccaggucagcuaaaauuaucgugguucaagaaagggaguaguauuggucaaauguuugaaacaacaaugcggggagcgaaaagaauggcaauuuuaggugacacugcaugggacuucggaagccucggcggaguauuuacuucuaucgguaaagccuuacaccaaguguucggcgcuaucuacggagcagccuuuaguggaguaucuuggacaaugaaaaucuuaauuggcguaguaauaacguggaucggaaugaacucaagaagcaccagucuuucaguaagccuaguguuagugggagucgugacuuuguacuuaggcguaaugguacaagcagauucuggauguguagugagcuggaaaaacaaagaacuuaaaugugguagugguauuuucaucacagacaacgugcauacuuggacagaacaauacaaguuccaaccagagucaccuaguaaacuugcaagugcuauccaaaaagcacacgaagaaggaauuugcgguaucagaucuguaaccagacuagaaaauuuaauguggaaacaaauaacaccugaacuaaaucacaucuuaacagaaaacgaaguuaaacugacgauuaugacaggugauaucaaaggaauaaugcaagcuggaaagcgaucucuccguccacagccaacagaacuaaaauacuccuggaaagcguggggaaaagcuaaaaugcuuucaaccgaauuacauaaucauaccuuucuaauagacgggccggagacugcagaaugcccuaacacgaacagagcauggaacagucuagaaguugaagacuauggcuucggcguuuuuacaaccaacaucugguuaaagcugaaggaaagacaggacguuuucugugacucgaaacugaugucggcagcuauaaaggauaacagggcaguacacgccgauauggguuacuggauagagagcgcuuuaaacgauacuuggaaaauagaaaaagcaaguuucaucgaaguaaagucuugucauuggccgaaaagucacacacuaugguccaacggaguacuagaaagcgagaugaucaucccuaaaaacuuugcugggccaguaucacaacauaauuaucgaccgggguaccauacucaaacggcaggcccauggcaucuaggcagacuggaaauggacuuugauuucugugaagguacgacaguuguugucaccgaagauugcggaaacagaggcccgucacuaagaacaacgacugcaucaggcaaauuaauaacugaauggugcugccgcuccuguacucuucccccacuaagguacaggggugaagauggauguugguacggcauggagauucggccgcuaaaagaaaaggaagaaaacuugguaaauagcuuaguaacagcaggccauggucaaaucgauaauuucagccuagguguuuuaggcauggcacuguuuuuagaagagauguuaaggacaagagucgggacaaaacaugcuauucuauuaguggcuguaucauuugucacgcuaauaacaggaaauaugucuuuuagggacuuaggaagaguuauggugaugguuggcgcuacgaugaccgacgacauaggaaugggggugacguaccuagccuuacuagcugcauuuaagguuagaccgacuuuugcugccggauuguuauuacguaaauuaacaucuaaagaacuuaugaugacuaccaucggaauagugcuacuuagucagucgaccauaccugaaagcauauuggaauuaacggaugcauuagcucuagggaugaugguacugaaaaucguacgaaauauggagaaauaucaauuagcggugacgauaauggccaucuuauguguaccuaacgcgguuauacuacaaaacgcuuggaagguaucuugcacaacacucgccguaguauccgugaguccgcuacuucuuacaucuagucagcaaaaagccgauuggaucccauuagccuuaacaauuaaaggucucaauccgacugcgauauuccuaacuacauugucucgaacaagcaagaaaagaucuuggccccuaaacgaagcaauaauggcaguaggaaugguaucaauacuugccucaucucuuuugaagaaugacauucccaugacuggcccgcuagucgcgggagguuuguuaacaguauguuaugugcuaacugggcgaucagcagauuuggaauuagaaagagccgccgauguucgaugggaagaacaagcugagauaagugggagcucgccaauauuaaguauaacaauauccgaagauggcaguaugagcaucaaaaaugaagaggaagaacagacguugacgauucuaauuagaaccggauugcucguuauaucgggauuauuuccaguaucaauaccgauaacugcagcugcaugguaucugugggaggugaagaaacaacgugccggaguucuaugggauguaccaagucccccgcccguugguaaagcggagcuagaagacggcgcuuaucgaaucaaacagaaagggauauuaggauauucccagauuggagcugggguuuauaaggaagguacguuccauacaauguggcaugugacgaggggagcaguccucaugcacaaaggaaagcgaauagaaccaucaugggccgacguuaagaaagaucugauuuccuauggaggagguuggaaauuagaaggagaauggaaagaaggugaggaaguacaaguauuagcuuuagagccagguaaaaauccucgagcuguacaaacgaaaccugggcuuuucaaaacuaacacagggacuauaggggcuguuagucucgauuucucacccggaacaucagggucaccaauaguagauaagaaagguaagguagugggauuguaugguaacgguguaguaacgcgaucagguacguaugucagugcaauugcucagacugagaagucgauagaagauaacccagagauugaagaugacaucuucagaaagaaaagacuaacaauaauggauuuacacccaggggcaggaaaaacaaagagauaucuuccugcaauaguucgugaagcgauuaaacgaggauuaaggacauuaauacuagcuccaacaagagugguugcggcggaaauggaagaggcucuccguggauuaccuauacguuaccaaacgccggcaaucagggccgaacauacaggaagagaaauaguagauuugaugugccacgccacuuuuacgaugagguuacuaucucccauccgaguacccaacuauaacuugauaauaauggacgaggcccauuuuacagaucccgccaguauagcggcaagagguuauauaucaacuagaguggaaaugggagaagccgcagggauauuuaugacagcaacgcccccugguucaagagacccauucccacagucgaacgcaccuauaauggaugaggaaagggaaauuccagaaagaucauggaacucaggccaugagugggugacugacuucaagggaaagacugugugguucguaccuaguauuaaggcggguaacgacauagcagcaugcuuacguaagaaugggaaaaaggugauacaauugagcagaaagacauuugauucugaguacauaaaaacaaggacgaaugauugggacuucgucgugacuacagacauauccgagaugggagcuaauuuuaaagccgagaggguaauugauccacgacggugcaugaaaccaguaauacuaacugacggggaagaacguguaauccuagcaggaccgaugcccgucacucauaguagcgcugcccagaggaggggaagagugggccgaaaccccaagaaugaaaaugaucaauauauauauaugggcgaaccacuagaaaacgaugaagauugcgcucauuggaaagaggcgaaaauguugcuugauaauauaaauacaccggaagguauuauucccucaauguuugaaccugaaagagaaaagguugaugcuauagacggugaauacagacuaaggggcgaagcgcggaaaaccuuuguugaucuaaugaggaggggugauuugccuguauggcuugcguauagaguugccgcagaagggauuaacuacgcugacagaagaugguguuucgacggugugaaaaauaaucaaauacucgaagaaaauguagaaguugaaauuuggacaaaagagggagaaagaaagaaacuaaaaccuaggugguuagaugcaagaauauauucagacccuuuagcacuuaaagaauuuaaggaguucgccgcugggaggaagucauuaacccugaaucuaaucacagaaaugggacgguuacccacguucaugacucagaaagccaaaaacgcacucgauaaucuagcaguauugcauacugcagaagcaggaggucgugcauacaaccaugcuuuaucagaacuuccugaaacauuagaaacauuauuguuacuaacauuacuagcuacaguaacuggaggaauauuuuuguuucugauguccggcaaaggcauuggcaaaaugacauuaggaauguguugcauuauuacugcgucaauauuguugugguaugcucaaauccagccucauuggauagcagcaucgauuaucuuagaguuuuuccuuaucguuuuguugauuccugaaccagagaaacaaagaacuccacaagacaaucaacucacauauguagugauagccauuuugacggugguagcugcgacuauggccaaugagaugggcuucuuagagaaaacuaagaaagauuuuggucuuggaaguaucacaacgcaacaaccugaaucaaauauauuggacaucgaucuucgaccggcgagugcguggacacuauaugcagucgcaacuacauuuauaacaccuaugcuacgccacucgauugaaaacagcagcguaaauguaagccucacagcuauagcaaaccaagcaacgguacuaaugggcuuggguaaaggauggccacuaagcaaaauggauauaggagugccacugcucgcaauugggugcuacucccaaguaaaccccaucacauuaacugcugcauuacuacuccuaguggcacauuacgcaaucauaggcccugguuuacaagcuaaggcuacccgagaagcacaaaaacgcgcagccgcgggcauaaugaagaacccuacaguagaugguaugacaguaauugaucuugauccgauucccuaugauccgaaauucgaaaagcaauugggucagguaauguuauuaguucucugcgucacccaaguauugaugaugcgaacuacgugggccuuaugugaagcucuaacuuuggcuacaggaccgauaucgaccuuaugggaaggaaacccagggagauucuggaauacuaccauugcagugucaauggccaacaucuuccguggaaguuaccuagcgggagcgggacugcuauuuaguauuaugaaaaauacugcuaauacaagacgggguacggggaauacuggagaaacauuaggugaaaaauggaagaaccguuuaaaugcucuaggcaagucagaauuucaaauauauaagaaauccggaauccaagagguugacagaaccuuggccaaagagggcauuaaacgaggcgaaacagaccaucacgccgucaguaggggcagugcuaaacuccggugguuuguagaaagaaaucuugugacucccgaagguaaaguaguggaucucggaugcgguagaggaggguggucauacuauugugguggauuaaagaauguuaaggaaguaaagggauuaacaaaagggggcccaggucaugaggaaccaaucccuaugucuacauacggcuggaaucugguaaggcuacagaguggcguagauguauucuuuacaccacccgaaaaaugugauacuuuacuuugugacauaggagaaagcagcccgaauccgaccguggaagccgguagaaccuuacgaguccuuaaccuaguagaaaacuggcucaauaacaauacacaguuuuguauuaaaguuuuaaacccguacaugccaucagucauugagaaaauggaagcacuucaaagaaaauaugggggugcguugguucguaauccguugucgaggaacaguacucaugaaauguauugggucagcaaugccaguggaaauaucgucucaucagugaauaugauuagcagaauguuaauaaaccgcuuuacuaugcgccacaagaaagcgacauacgaaccagacguagaccuugggaguggaaccagaaacaucggaauugaaagugagacaccaaaucuugauauaauuggcaaaagaauagaaaagauaaagcaagaacacgagaccaguuggcauuacgaucaagaucauccuuacaaaacaugggcauaccauggauccuacgaaacaaagcagaccgguagugcuucuaguaugguuaacgggguuguuaggcuauuaacuaagcccugggacguuauuccgauggugacacaaauggccaugacugauacaacaccauuuggacaacagagaguauuuaaggaaaaaguggauacgagaacucaagaaccaaaagaagguacuaagaaacuaaugaaaauaacagcagaauggcuauggaaagaacuagggaagaagaaaaccccaagaaugugcacgagagaagaauuuaccagaaaaguaagaucaaaugcagcccucggcgcaaucuucacagaugaaaacaaauggaaaagugcuagagaggcaguagaagacucagguuucugggaauugguggacaaggaacgaaaucuucauuuggaagguaaaugugagacuuguguuuacaacaugaugggcaagcgugaaaagaaauugggcgaguuuggaaaggcgaagggaucaagggcuaucugguauaugugguuaggcgcccgauuuuuggaauuugaagcacuuggauuucuaaaugaagaucacugguuuagccgagagaacucguuaagcggugucgagggagagggauuacacaaguuaggauacauccuccgagacguaucaaagaaagagggaggagcaauguacgcggaugauacagcggggugggacacuaggaucacgcuugaggauuuaaagaacgaggaaaugguaaccaaccacauggaaggagaacauaaaaaguuagcugaggcaauauuuaaauuaacuuaucaaaauaagguuguucgcguccaacguccaacgccgagaggaacaguuauggacaucaucucacgcagggaucaacguggcucaggacaaguaguuacauaugggcuaaauacuuucacgaauauggaagcucaacugauaagacaaauggaaggagaaggcgucuuuaaauccauucagcagcuaacaguaaaagaggaaauugcagucaaaaauuggcuuauaagaguaggacgagagcggcuuagucgaauggcuauaucaggagaugauugcguaguaaaaccccuugacgacagauuugcuagcgcauuaacagcuuuaaaugauaugggcaaaguucguaaagauauccagcaaugggaaccuucgcgagguuggaaugacuggacucagguaccauucuguagucaccauuuccacgaauuaauaaugaaagauggacgcguccuagucguuccaugccguaaucaagaugaauuaauagguagagcacgaaucucacaaggagcugguuggucucuaagagaaaccgcuugcuuaggcaagucuuaugcacagaugugguccuugauguauuuucacaggagggaccuaagacuagccgcaaaugcgauaugcagcgcaguaccgagucacuggauaccuaccaguagaacgacuuggagcauccacgcuacacaugaauggaugaccacggaggauauguuaacaguuuggaaucgaguauggauccaagaaaauccuuggauggaagauaaaacuccaguggaaucaugggaagaaauacccuaucuggguaaacgagaagaucaaugguguggaaguuuaauaggucuaaccagucgagcuacgugggccaaaaacauccaaacagcaaucaaccaaguaagaucacuuauaggcaacgaagaguauaccgauuauaugcccuccaugaaaagauucagacgggaagaagaagaagcaggaguguugugguaa

SEQ ID NO: 22243 - RNA, 9876 nt, Artificial Sequence
  derived and/or modified CDS sequence (opt6) from DENV-2__KM279583__SS-prME
acugcggguauuauaauuaugaugauacccacgguaauggcauuccaccucacaacgagaaauggagaaccacauaugauaguaucaaggcaggaaaaagguaaaagucuauuguuuaaaaccgaaaacggagugaauaugugcacguuaauggcgauggauuuaggagaauuaugcgaagauacgauuacauauaacuguccucuacuacggcagaaugaaccagaagacauugauugcugguguaauucaacaucuacauggguaacuuacgguacauguacggcaacaggugaacauaggagagagaaaagaaguguagcuuugguaccccacguuggcaugggacuagaaacgcgaacugaaaccuggaugucaagugaaggcgcuuggaaacaugcucaaaggauagaaacauggauacuaagacauccuggcuuuacuauaauggcagcaauauuggcauauaccaucggcacuacguacuuucaacgugucuugauauuuauacuucucacagcaguaacuccaucaauggccaugagaugcauuggcauaucaaauagagauuucguagaaggugucuccggaggcucuuggguugauauaguccuggaacauggcagcuguguaacuacaauggcuaaaaacaaaccaacauuggacuuugaacuaauaaaaacggaagcaaaacacuuagcaacauuaagaaaauauugcguggaagcaaaauuaacaaauacuacaacggcaagucgauguccgacacaaggagaaccaucauuaaaugaagaacaagauaaaagguuuguaugcaaacacucaauggucgaucgagguuggggaaauggaugcggucuauucggaaaaggagguauagugacaugcgcaauguuuacauguaagaaaaauauggaaggaaaagugguucaaccugaaaaucuagaauacaccauuguaauuacgccacauucuggugaagagaacgcuguuggaaaugacacuggaaaacacgggaaagaaauaaaaguaacuccucagaguucaauaaccgaagcggaauuaacaggauauggaacugugaccauggaauguucaccaaggacgggauuagauuuuaaugaaauggcacuacuacaaauggaaaauaaagccugguugguccaucgacaaugguuuuuggaucuaccacuuccuugguugccaggagcggacacccaaggaucgaauuggauucagaaagaaacgcucguaacauuuaaaaauccucaugcgaaaaagcaagauguugucguacuagggucgcaagaaggagcuaugcauacggcccuuacgggggcaacagaaauacaaaugucuucagguaacuuauuauuuacuggacaucuaaaauguagguuacgaauggauaaacuccagcuuaaggguaugaguuauucgauguguacgggaaaauuuaaaguaguuaaagaaauugcagaaacucaacacgguacaauaguuauuaggguacaauaugaaggcgacgggaguccauguaaaauaccauuugaaauaauggaccuugaaaaacgacacguuuuaggccgguuaauaacuguuaauccaauuguuacagaaaaggauaguccagucaauauugaggcugaaccaccuuucggagacucauauaucaucauaggagucgagcccggacaauuaaaacuaaguugguucaagaaaggaucgagcauaggacagauguucgaaacaaccaugagaggggcgaaacggauggcuauacuaggugacacugcaugggauuuuggaagccuuggcgggguauucaccucaauugggaaagcacuccaucaaguuuuuggagcgauuuacggcgcagcuuucucaggaguaaguuggacgaugaaaauucuaauuggcguagucaucacauggaucgggaugaacucgaggucaacuucccuaagcguaucucuuguccuaguaggaguaguaacacuuuacuuagguguaaugguacaggcagacucugguuguguagugucuuggaagaacaaagaacuaaaauguggaucugguauauuuauaacagauaaugugcacacuuggacagaacaauacaaguuucaacccgagagcccgucaaaacuagccagcgcgauucaaaaagcgcacgaagaaggaauuuguggaauacgaucagucacacgucuugaaaaucuuauguggaaacaaaucaccccggaacugaaucacauacugacugaaaacgaaguuaaacuaaccauuaugaccggugauauaaaagguauaaugcaagcagguaaacgcucuuuacgcccacaaccuacugaauuaaaauauaguuggaaagccugggguaaagcgaagauguugaguacggaauuacacaaucacacauuucuuauagacgggccagaaaccgcagaaugcccgaauacgaaucgagcauggaacucacuugagguagaagacuacggcuuuggcguuuuuacuacuaacaucugguugaaacuaaaagaacgacaagacguauucugcgauuccaaacuuaugucggcagcaauaaaagauaaucgugccguacaugcugauaugggcuacuggauagagagcgcacuaaacgauacauggaaaauagagaaagcaaguuucauugaaguaaaaaguugucauuggccaaaaucgcauacucuauggaguaauggcguuuuagaaucagagaugauaauccccaagaacuuugcgggcccuguuucgcaacauaauuaccgaccggguuaucacacucaaacagcgggacccuggcaucucgguagacuagaaauggauuuugacuucugugaggggacaacgguaguugucacagaagauuguggaaacagaggaccuagcuuaagaacuacuacggcaucagggaaacuuauaacggaaugguguugccgcucgugcacucuuccuccauuacguuacagaggagaagauggcuguugguauggaauggagauacggccuuugaaagaaaaagaagaaaacuugguaaauucauuaguaacggcaggccauggacagauagauaacuuuucccuaggaguacuuggcauggcauuguuucuugaagaaauguuaagaacuagggucggaacuaaacacgcaauucuauuaguagcugugaguuucguaacguuaauaacagggaacaugucuuuuagagaucuuggacgcguaaugguaaugguaggagcaacaaugacugacgauauaggaaugggaguaacauaucuagcucuauuggcagcauucaaaguuaggccuacauuugcugcuggucuacugcuaagaaaauugaccaguaaagaauuaaugaugacaacaaucggcauuguucugcuuucucaaaguacuauaccagaauccauacuugagcuuacagaugcacuagcauuaggcaugaugguguuaaaaauugucagaaacauggaaaaauaucaacuagcuguaacaaucauggcgauauuaugcguuccuaaugcaguaauccuucaaaacgcauggaaggucucauguaccacucuagcaguaguuuccgugaguccauuauuauugacuucaucccagcaaaaagccgacuggauaccacucgcguuaacuauaaaaggucuaaaucccacggcaauauuucucaccacauuaucccguacuucuaagaaacgaaguuggccauuaaaugaagcaauaauggcaguggggaugguuaguauacuugccucgucauuacucaaaaaugauauaccaaugacaggaccauuaguagccggcggacuacuaacuguuuguuauguacuaacaggucgaagugccgauuuagaguuggaaagagcugcagacguacgcugggaagaacaagcggaaauuuccggaucuaguccaauuuuaucgauuacgauaucugaagauggaaguaugucaaucaaaaaugaagaagaagaacagacacugacaauucuaauaagaaccggauuauuaguuauuucgggccucuuucccgugucuauaccaauuacagccgcugcaugguacuuaugggaagucaaaaagcagcgugcaggaguccuaugggauguaccuucaccuccaccgguaggaaaagcggaauuggaagauggggcguaccggauuaaacaaaaagguauuuuaggcuauagucagauaggggcuggaguauauaaagaagggacuuuucauaccauguggcaugucacacgaggagcgguacuuaugcauaaaggaaaacgcauagaacccaguugggccgacgucaagaaagaucuaauuuccuacgggggaggcuggaaauuagaaggugaguggaaagaaggagaggaaguccaaguacucgcccuagagccagguaaaaauccucgggcaguacaaacuaagcccggacucuuuaaaacgaauacgggcacuauuggagcugucucuuuagacuuuucgccaggaacaagugggucuccgauaguugauaagaagggaaaaguagucggacuguauggaaauggaguuguuacuaggaguggaacguauguaucugcgauagcacaaacugaaaaaucuauagaagauaauccggaaaucgaagaugauauuuucagaaagaaacgauuaacgaucauggaucuccauccaggagcuggcaaaaccaaacgauaucuucccgcgauaguaagagaagcaauuaagagagggcucagaacacugauacuugcaccuaccagaguaguagcugcugagauggaggaagcauuacgaggccuaccgauaagauaccagacccccgccauuagagcagaacauaccggacgagaaauaguagacuuaaugugccacgcuacauucacgaugcggcuuuuaagcccuauacggguaccuaacuauaauuugauuauaauggaugaagcgcacuucacagacccugcaagcauagcugcccgaggguauauaucaaccaggguagaaaugggcgaagcagcagguaucuucaugacugcuacgccuccaggcaguagagauccauuuccgcaaaguaacgcucccauaauggaugaagaacgggagaucccugagagauccuggaauagcggccaugaguggguuaccgauuuuaaaggaaagacuguaugguuuguaccaaguauuaaggcuggcaaugacauagcagcuugccuacggaaaaaugguaagaaaguaauucaacuaucccgaaaaaccuucgacucagaauauaucaaaacaagaacuaaugacugggauuucguaguaacaaccgacaucagugagaugggagccaauuuuaaagcagagagaguuauugacccaagacgauguaugaaaccaguaauccuaacugauggcgaggagagagugauucucgccgguccaaugccagucacacacagcagcgcggcacaacgcagagggcgggucggcagaaaucccaaaaaugagaaugaccaauauauauacaugggugaaccacuagagaaugacgaagacugugcacacuggaaagaagcuaaaauguuacucgauaacaucaauacaccagaaggaauaauaccuucaauguuugaaccggagagggaaaaaguugacgcuauagacggcgaguacaggcuaagaggagaagcccggaaaacuuucguagaccugaugcggagaggggaucuucccgucuggcuagcauauaggguugcugcagaggguaucaacuaugcagaucguagaugguguuuugacggagugaaaaacaaccagauuuuagaggaaaacguggagguagagauauggacuaaggaaggggaaaggaagaaacugaagccucguugguuagacgcuagaauauauucugacccacuugcguuaaaagaguuuaaagaauuugcagcagggaggaaaagccuaacucugaaccugaucaccgaaaugggcagauuacccacuuucaugacacagaaggccaaaaaugcacuggauaaucucgccguacuucauacugcugaagcaggaggacgggcuuauaaucaugcgcugucugaacugccagagacucuagaaacucucuugcuauuaacacuacuggcuacuguaacgggagguauauuuuuauuucuaaugagcgguaaagguauagggaaaaugacgcugggaauguguuguauuaucacagccucuauucucuuaugguaugcacagauacaaccacauuggauugccgcaucuauaauuuuggaguucuuucugauuguucugcuuauaccagaaccugaaaaacaaagaacuccccaggauaaccaauugacauacguuguaauagcaauuuuaaccgugguugccgcgacgauggcuaaugaaaugggcuuccuagagaaaacgaagaaggauuuugggcucgguaguauaacaacucaacaaccugaaaguaacauacuagauaucgacuugagaccugcaucagcuuggacacuauacgcagucgcuacuacauuuauuacuccgaugcugcgucacucaauugagaacuccucaguuaacgucucacugacggcaauagcgaaccaagcuaccguauuaaugggucuuggaaaaggauggccucuaucaaagauggauauugguguaccacucuuagcuauuggauguuauagucaggucaaucccauuacauugacugcugccuuauuacuacuugucgcacauuacgcuauaauugguccaggccuacaggcaaaagccacucgcgaggcacagaaacgagcugcagcaggaaucaugaaaaauccaacaguagacggcaugacagucauagaucuugauccaauaccuuaugacccuaaauucgagaaacaacuaggccaagugauguuauuaguacuaugugucacgcagguucuaaugaugaggacuacgugggcucuaugugaagcacuaacauuggccacgggcccaauaucuacguugugggaaggaaauccgggaagauuuuggaacacgacaauugcgguuuccauggcuaauauuuuccgggggucauauuuagcaggagcgggauugcuauuuucgauaaugaaaaacacggcaaacacuagacgcgggacagguaauaccggcgaaacucuaggcgagaaauggaaaaacagacuaaaugcguuaggaaagagugaguuccaaauauauaagaaaaguggaauacaggaggucgacagaacuuuagcaaaagaggguaucaagagaggugaaacagaucaucacgcggucucgagaggcucggcgaaauugaggugguucguagagcgaaaccuugucacaccagaaggaaaagugguagauuuaggguguggaaggggaggauggaguuauuauuguggagggcuuaaaaaugugaaagaaguuaaaggccugacgaaaggcgguccaggacacgaagaaccaauaccaaugucaacauauggauggaacuuaguaagacuacagaguggagucgauguauucuuuacgccacccgagaaaugcgacaccuuauuaugcgacauaggggaaagcucaccuaauccaacgguugaggcaggcagaacacuacgcguacuaaaucuuguagaaaauuggcuaaacaauaauacacaguuuuguauuaaaguacuuaauccguacaugccaucgguuauugagaaaauggaagcgcuacaacgaaaauaugggggagcuuuaguccguaacccguuaagccgaaacucgacgcaugaaauguauugggugagcaacgcuaguggcaauauuguaaguucaguuaacaugauaaguagaaugcuuaucaaucguuuuacaaugagacacaagaaagcaaccuacgaaccggacguggaccuugguagcggaacuagaaacauuggaauagaaucagaaaccccaaaccuugauauaauagguaaaaggauagagaaaauuaaacaagaacaugagacuucuuggcacuaugaucaagaucauccuuauaaaacuugggccuaccauggcucguaugaaaccaaacaaacaggaucagcaucaucuaugguuaacgguguugucagacuuuugacaaagccuugggauguaauuccuaugguuacgcagauggcaaugacggauacuaccccguuuggacagcaaagaguuuuuaaagagaaagucgacacgcggacgcaagagccaaaggaagguacuaagaaacuuaugaagauaacagcagaauggcuauggaaagaacuuggcaagaagaaaacuccucgaauguguaccagagaggaguucacccgaaagguacguaguaacgccgcauuaggagcaaucuucacugaugagaacaaguggaaaucagcccgagaagcaguugaagauagugguuuuugggagcuaguugauaaagaacgcaaccuccaccucgaagguaagugcgagaccugugucuacaacaugauggggaagcgugagaagaaauuaggcgaauuugguaaagcuaaaggcucgagagcuaucugguacauguggcuaggcgcuagauuuuuggaguucgaagcucuuggauuucuaaacgaagaucauugguuuucaagagagaacagucuuaguggaguagaaggagaagguuugcauaaguugggauauauauuaagagaugugaguaagaaagaaggcggugcgauguaugcagaugacaccgccggaugggacacaagaauaacauuagaagaucuuaaaaacgaggagauggugacaaaucacauggaaggagaacacaagaaauuagcagaagccauuuucaaacuaacguaucagaacaagguaguaagaguucagagaccaacuccccggggaaccguuauggacauuaucucgcgucgagaccaaagaggcaguggccaagucguaacauauggacuaaauacauucacaaacauggaggcucaacuaauacgacagauggaaggagaaggcgucuucaaaucgauacaacaauugacugugaaagaagaaaucgcagugaaaaauuggcuaauaagaguaggcagggaaagacuaaguagaauggcaauuucaggcgaugauuguguaguuaaaccacuagacgaccguuuugcaagcgcacuaacugcacucaacgauaugggaaagguccgcaaagauauccagcaaugggaaccgucacggggcuggaaugauuggacacaaguccccuuuuguucgcaucacuuucaugaacuuaucaugaaagacggaaggguacugguaguaccuugcagaaaucaggaugaguuaaucgguagagcaagaauaucucaaggggcaggguggucacucagggagaccgcaugccuggggaaaucguacgcucaaauguggaguuuaauguauuuucaccgcagagacuuaagacuugcggcaaaugcaauuugcuccgcaguuccuucacauuggauaccgacaucacgcacaacauggucaauucaugcaacccaugaauggaugacgaccgaagauaugcucacgguuuggaacagagucuggauacaggaaaauccuuggauggaagacaaaacaccgguugagagcugggaagaaauacccuauuuagguaaaagagaggaccaaugguguggcagcuuaauugggcuaacgagucgugcaacgugggcgaaaaauauacaaacggccauaaaccagguaaggaguuugauuggcaacgaagaauauacugacuacaugccaucuaugaaacgcuuuagaagggaagaagaagaggccgggguacuaugguag

SEQ ID NO: 22244 - RNA, 9876 nt, Artificial Sequence
  derived and/or modified CDS sequence (opt6) from DENV-2__KM279585__SS-prME
acugcaggaauaauuauuaugaugauacccacgguuauggcuuuucaccugacaacuagaaacggagaaccucauaugaucguaagccggcaagaaaaagguaaaucacuucuauucaaaacagaaaacggaguuaacauguguacauuaauggcuauggaucuaggugaacuaugugaagauacaauaacguauaacuguccgcuauuaaggcaaaaugaaccagaagauaucgacuguugguguaacucaacgucaacauggguaacauauggaacaugcacagcuacaggcgaacauagacgagagaaaaggucaguugccuuaguaccacacguggguaugggccuagaaacacgaacagaaacguggauguccagugaaggugcuuggaaacacgcacaacgcauagaaacuuggauuuugagacauccgggguucacaauuauggcagcuauuuuagcguauacaauuggaaccacauacuuucagcgaguucuaauauuuauccugcuaacagcaguuacaccaaguauggcgaugagauguauagggaucaguaaucgcgauuucguggaagggguaagcggaggaaguuggguugauaucguguuagaacaugguuccugcguaacgaccauggcuaaaaauaaaccuacacuugauuuugaauuaauaaaaacugaagcaaaacauuuggcuacauugcgaaaauauugugucgaagcaaaacuuacaaauacgacuaccgcguccagaugcccaacucaaggugaaccgucauuaaaugaagaacaggacaaaagauucgugugcaaacacaguaugguugaucgaggcugggguaauggaugcggauuauuugguaaaggagggauuguaacaugcgcuauguucacauguaagaagaauauggaaggaaagguaguacagccagaaaacuuagaauauacaauaguaauaaccccucacucgggggaagaaaacgcaguaggaaaugauacuggaaaacacggaaaagaaauuaaagucacuccacaaucuagcauaaccgaagcggaacuaacuggauacgggacggucacuauggaaugcagcccgaggacugguuuagauuuuaacgaaaugguccuccugcaaauggagaauaaagcauggcuaguacaccgccaaugguuuuuagaccuaccacuaccaugguuaccuggggcugauacacaaggaucaaauuggauucaaaaagaaacacucguaacauuuaaaaauccacaugcaaagaaacaagauguuguuguauuagggucucaagaaggagcaaugcauaccgcauuaaccggggccaccgaaauucagaugagcucaggaaaccuauuguuuacaggacaccuaaaauguagacugagaauggacaaauugcaacugaaaggaaugagcuauaguauguguacagguaaauuuaaagucguuaaagaaaucgcagagacccaacaugguacgauuguagucagaguccaauaugaaggggauggaagcccaugcaaaaucccauucgagauuauggauuuggagaaacgacacguacuuggccgucuuauaacagugaauccuauuguaacggaaaaggauuccccuguuaacauagaagcggaacccccuuucggagacagcuauauaauaauaggagucgaacccggacaacuuaaauuaagcugguuuaagaaagguucaucuauuggucaaauguucgaaacaaccaugcgaggggcaaaaagaauggcgauucucggugauacggcaugggauuuuggcucauugggaggaguuuuuaccucaauaggaaaggcacuucaucaaguuuucggcgccaucuauggagcagcguuuagcgguguauccuggacaaugaaaauccuaauagguguagugauuacguggauaggaaugaauagcagaucgacuucucucaguguaucgcuaguccuaguaggggugguaacucuauaucuugguguaaugguucaagcagacuccggauguguagucaguuggaagaauaaggaacuaaagugugguaguggaauauucauaacagacaaugugcauacauggacggaacaguauaaguuucaaccagagagcccuucaaaauuagcaucagcgauacagaaagcccaugaagaggguauuuguggaauaagaagugugacgcgauuagaaaaccuaauguggaaacaaauuaccccagaauuaaaucauauucuaacagaaaacgagguaaaacucacaaucaugaccggagauauuaaaggaauaaugcaggcaggcaaacgaagccuacgaccacaaccaacggaguuaaaauauaguuggaaagcauggggaaaagcaaaaaugcuuaguacagaauuacacaaucauacguuuuugauagaugggccugaaacugcugaauguccuaauacaaacagagcauggaacucucuagaaguagaagauuacggauucggggucuuuacaacgaauauauggcuaaaacuuaaggaaagacaggauguguuuugugacucaaaacuaaugagugcagcgaucaaggauaaucgugcagugcaugcugacaugggguauuggaucgaaucagcacuaaacgacacuuggaaaauugaaaaggcuagcuucaucgaaguuaaaaguugucauuggccgaaaagucauaccuugugguccaacggaguuuuagaaucagaaaugauaauaccgaaaaauuuugcagguccagucagucaacauaauuauagaccuggauaccauacacagacagccgguccauggcaucuaggaagacuagaaauggacuuugacuucugcgaggguacuacagucgugguaaccgaggauugcggcaacaggggacccagucuuagaaccaccaccgcuucuggaaaguuaauuacugaaugguguugccgaaguuguaccuuaccgccauugcgauauagaggagaggacggcuguugguauggcauggaaauaagaccccuaaaagaaaaggaagaaaaucucguaaauuccuuaguuacugcaggacauggucagauugacaauuuuucacuaggaguacucgggauggcauuauuuuuagaagaaaugcuaaggacacgggucgggaccaagcaugcuauccuauuaguggccgucucauuuguuacguugauaacugggaauaugucauuuagagacuuaggaagaguuauggugauggugggugcaacuaugaccgaugauauaggaaugggcguaacguacuuagcgcuguuggccgcuuucaaaguaagaccaacauucgcagcaggucuuuuacugaggaaacuaacuucaaaggaacuaaugaugacaacaaucggaaucguguuguuaucacaauccaccauucccgaauccauacucgaacucacagacgcacuagcccuggguaugaugguacucaagauaguaaggaacauggaaaaauaucagcuugcaguaacaaucauggcuaucuuaugcguaccgaacgcggucaucuuacaaaaugcguggaaaguaaguugcaccacauuagccguagucagcgucucaccucuccuauuaacauccucacaacagaaagcagauuggaucccucuugcccucaccauuaagggcuuaaacccaacagcaaucuuuuuaaccacacuaagucgcaccuccaagaaaagaucauggccucuuaacgaagcaaucauggcgguagggaugguaagcauauuggcuaguucguuacucaaaaaugauauaccgaugacggguccccuaguugcugguggucuucuuacagucugcuauguuuuaacgggucggucggcugaucuugaguuagaacgcgcagcagauguacguugggaagaacaagcagaaauaucaggcuccaguccaauacuuuccaucaccauaucugaggauggaagcauguccauuaagaacgaggaagaagaacagacguugacaauccuaauccggaccgggcuauuagugauaucuggcuuguuuccgguaagcauaccaaucacggcagcugcaugguaccuuugggaagugaagaaacagagagcgggaguauugugggauguacccaguccaccaccaguuggaaaggcugaacuagaagacggagcuuauagaauaaaacagaaaggaauauugggcuauagucaaauaggagcugguguuuacaaagaagggaccuuucauaccauguggcauguaacccgaggagcgguauuaaugcauaaaggaaaaagaaucgaacccucaugggcagauguuaagaaagaccuuaucucguaugguggaggauggaaacuugaaggcgaauggaaagaaggugaagaaguucaaguauuagcguuagaaccggggaaaaauccccgcgcaguccaaacaaaacccggacuauuuaaaacuaauacugguacaauuggugcagucucguuggauuuuaguccagguacaagugggagcccgauuguggauaagaaaggaaaaguaguuggacuauauggaaacggaguaguaacacgauccgggaccuauguaucggcaauugcgcaaacggagaaaaguaucgaagacaauccugaaauagaagaugauaucuuccgaaagaaaagguuaacgauaauggaucuucacccgggagcugggaaaacgaaaagauaccuaccagcaaucguuagagaagcaauuaaacggggacuaagaaccuuaauacuagcuccgaccagaguaguagcagcugaaauggaagaggcccuacggggacugccuauucguuaccaaacacccgcaauccgugcagaacacacaggacgagaaauaguagaucuuaugugccaugcuacuuuuacgaugcgacuucuuucaccuauacgcguaccgaauuauaaucuaaucaucauggaugaagcacauuuuacugauccugcaucuaucgcggcgaggggauacauaucuacucgugucgaaaugggugaggcagcagggauauuuaugacugcaacuccaccgggaaguagggauccauucccgcaaucaaacgcuccuauaauggaugaggagagagaaauaccagaaagaucguggaauagcggucaugaauggguaacugauuucaaagguaaaaccgucugguucgucccuuccauaaaggcggguaacgauauugccgcgugucuuagaaagaacggcaagaaagugauacaauuauccagaaaaacauuugacucagaauacaucaagacaagaacuaaugacugggauuuugucguuacuacagauauaucagaaaugggugccaacuucaaggcagagagaguaauagacccaaggcguugcaugaaaccaguaauuuuaacagacggagaagaaagaguaauccuggccggaccuaugcccguaacccacucaagugcugcacagcgaagggggagaguaggucggaauccuaaaaacgaaaaugaucaauauauuuacaugggugaaccacuugaaaacgacgaagauugcgcccauuggaaagaagcuaaaaugcuucuagauaauaucaacaccccagaagguauaauaccaucaauguucgaaccagagcgcgagaaaguugaugccauugauggggaauaccgacuccgaggagaagcacgaaaaacuuucguagauuuaaugaggcgaggggaucuaccaguauggcucgccuacagaguagcagcagaaggcauuaauuacgcagaucgacgaugguguuucgacggagucaaaaacaaucagauacuagaagagaauguagaaguagaaauauggacuaaagaaggagagcguaagaaacucaaaccacgaugguuagaugcgagaauuuacagugauccucuggcacucaaagaauuuaaagaguuugcagcggguagaaagagucucacccuaaaccucauaacagaaauggguagacucccaacauucaugacucaaaaggcgaagaacgcacuagacaauuuggccguacuacacacagcugaagcgggugggagagcuuauaaucacgcuuugucugaauuacccgagacauuagagacacuacuauuacuaacgcugcuagccacaguuaccgggggaauuuucuuauuucuaauguccgggaaaggaauagggaagaugacacuagggauguguugcauaauuacagcaucuaucuuacuuugguacgcccagauucaaccucauuggauugccgcaucgauaauuuuagaguucuuucucaucguacuacuaauaccagaaccagaaaaacaaaggacuccccaggauaaucaacuaaccuauguaguaauagcgauacuuacagugguagcagcaacaauggcaaacgaaaugggauuccuggagaaaacaaagaaagauuucggguuaggaaguauaacaacccaacagccagaaagcaauauauuagacauagaccuaagaccagcgagugcuuggaccuuauaugccguagccaccacauuuaucacgccuaugcugaggcacaguaucgaaaauucaucagugaauguaucccuaacagcaaucgcaaaccaagcuacaguucuuaugggauuaggaaaaggauggccauuaucaaaaauggauaucggugucccccuuuuagcgauugggugcuacucacaagugaacccaauuacucuaacagcugcacuuuuguuacugguugcccauuaugcaauaauaggaccaggauuacaagcgaaagcuacaagagaagcacaaaaacgagcagcagcagggaucaugaaaaauccgacuguugacggaaugacuguaauugaccuagauccaauuccauacgauccaaaauuugagaaacaacuaggucaggucauguugcuggucuuaugugucacacaggugcucaugaugaggacgacgugggcauugugcgaagcucuuacguuggcaacaggaccaauaucaacauugugggaaggaaauccaggacgcuuuuggaauacaacaauagcugucucuauggcuaacaucuuccgcggcuccuaucuagcuggcgcagguuuacuauucucuauaaugaaaaacacagcuaauacacgaaggggaaccggaaauacaggagaaacacuaggagaaaaauggaaaaacagacuaaacgcacucgguaagagcgaauuucaaauuuacaaaaaguccggaauacaggaaguggaucggacacuugccaaagagggaauuaaacguggagagacggaccaccacgcgguaucucgaggcucggcuaaacuacgaugguucgucgaaagaaauuugguaacuccagaaggaaaggucgucgauuuagggugcggcagaggcggauggagcuauuauugcgguggacuuaaaaaugugaaagaagugaagggucuaacgaaaggugggccagggcaugaagaaccuauucccaugucaacuuaugguuggaaccuaguaagacuccagucaggaguggacguauuuuucaccccgccagaaaaaugcgacacgcuauuaugugauauaggagaaucuaguccaaauccuacuguugaagcgggaagaacauuaagaguucuuaaucuuguagauaauuggcucaauaauaacacgcaauucugcauuaaaguacuaaacccuuauaugcccaguguaauagagaagauggaagcccuacaacgaaaauacggaggcgcucuuguacguaacccgcuuucaagaaauuccacacaugagauguauugggugucaaacgcuuccgguaacauugucuccucuguaaacaugaucucucggauguuaaucaauagauuuacuaugcgacauaagaaagcaacuuaugaaccagacgucgaucuaggaaguggaacacgcaauaucggcauagaaucugaaacuccaaaucuugauauaauugguaaaaggauugagaagauaaaacaagaacaugagacgucguggcauuaugaccaagaucacccauacaaaaccugggccuaucauggaucuuacgaaaccaaacaaacaggaucugccagcucuaugguaaaugggguaguccggcugcuaacaaaaccaugggacguaaucccuaugguuacucagauggcaaugacugauacaacuccuuuuggucaacaaagaguauucaaagaaaaaguugauacgcguacacaagagccuaaagagggaacgaagaaauuaaugaagaucacggcagaaugguuauggaaagaacuaggcaagaagaaaacgcccagaauguguacucgggaagaguucacucguaaaguuagaucuaacgcagcucuuggagcaauuuuuaccgacgagaacaaauggaaaucagcgcgcgaagcaguugaggacucaggcuucugggaauugguagauaaggaaagaaaccuucaccuagaaggcaaaugugagacuugcguauauaauaugauggggaaaagagagaagaaacucggggaauuugggaaggcaaaagguucccgcgcuauaugguauauguggcuaggggcaagauuuuuagaguucgaagcauugggauuuuugaaugaagaucauugguucucucgcgaaaauucguuauccggaguagagggagaaggccugcauaaauuggguuauauucuacgagacgugucuaagaaagaagguggagccauguaugcugaugauacggcggguugggacacaagaaucacauuagaagaucuuaaaaaugaagaaauggugacaaaccacauggagggagaacacaagaaacuggcugaagccauauucaaacuuacauaccaaaauaaaguaguacgaguacaaagaccuacaccaagagguacagucauggacaucauaagcagaagggaccaaagagguucaggucaaguaguuacauauggcuuaaauacuuucaccaauauggaagcucaacuuauaagacaaauggaaggagaagggguauuuaaaaguauccaacaauuaacaguuaaggaagagauagcaguaaagaacuggcuaauucguguuggaagggagcgauugucgcguauggcuaucucgggagaugauugcguagucaagccgcucgacgaucgauuugcuuccgcacuuacagcucucaacgauaugggcaaggugcgcaaagauauucagcaaugggaaccgucuagagguuggaaugauuggacccaagugccauuuuguagccaucauuuccaugaguugauuaugaaagacgggcgcgugcucguagucccaugucguaaucaagaugaauuaauuggucgcgcacgcaucucgcaaggugcggguuggucguugcgugaaacugcaugccucggcaagagcuaugcccagauguggaaccucauguauuuccauagacgagauuuaaggcuugccgccaaugccauuuguagugcgguaccaucacacuggauaccuaccucuagaacgacauggucuauccacgcaacgcacgaauggaugacaacugaagacaugcugacaguuuggaaccgaguuuggauucaagaaaacccauggauggaagauaaaacuccuguagagaguugggaagaaaucccauaucugggaaaaagagaagaucaauggugugguucccuaauuggauugacaucccgagccacaugggcgaaaaauauccaaaccgcaauuaaccaaguccguucccuaauuggaaacgaagaguacacagacuacaugccaucaaugaagagauuuagaagagaagaagaagaagcaggcguucuuugguag

SEQ ID NO: 22245 - RNA, 9876 nt, Artificial Sequence
  derived and/or modified CDS sequence (opt6) from DENV-2__KM279525__SS-prME
acugcuggaauaauaauaaugaugauaccaacuguaauggcguuucauuuaaccacgaggaauggagaaccucauaugauuguuucucgacaagaaaaaggcaaaucucuccuauuuaaaacagaaaaugguguaaauauguguacccugauggcaauggaccuuggugaauuaugcgaagauacaauuacguauaauugcccccuucuucgacaaaaugaaccggaagauaucgauuguugguguaacucaacaaguacauggguuacauacgggacguguacggcgacaggagaacacaggcgagagaaacggaguguugcgcucguaccgcauguagguaugggacuagaaacaaggacggaaaccuggaugucuucagaaggggcuuggaaacaugcgcaaagaauugaaacauggauuuugaggcacccggguuucacaauaauggcggcaauauuagcauacacaauuggaaccacauauuuccagcgaguuuugauauucaucuugcugaccgcaguuacaccauccauggcgaugcguugcauaggaaucucuaaccgugacuucguggaaggaguauccgguggaaguuggguagacauuguauuagaacaugguaguugcguuacaacuauggccaaaaauaaaccuacccucgacuuugagcugauaaaaacagaagcgaaacacuuggcaacccuccguaaauauugcgucgaggcuaaauuaacuaauaccacaacagcaucacgaugucccacucaaggugagcccagucucaacgaggagcaagacaaacgauucguuuguaaacauucaauggucgauaggggaugggguaacgggugugguuuauuuggaaaaggugguaucguaacaugcgcaauguucacauguaagaaaaauauggaagguaaaguuguacaaccggaaaaccuagaauacacaauuguaaucacgccacacaguggagaagaaaaugcaguuggcaaugauacaggcaaacaugggaaagaaauuaaagugaccccacagucaucaauaacggaagcagaauuaacugguuauggaacaguuacuauggaauguagcccccgcaccggcuuagacuucaaugaaaugguauuacuacaaauggagaacaaagcaugguuaguacauaggcaaugguucuuagauuuaccguuaccauggcuaccaggagcagauacccagggaucgaacuggauacaaaaagagacauuagucacguucaaaaauccacaugccaagaaacaagacgugguuguauuaggaucccaggagggagcgaugcauacagcucugacuggagcuacagagauucaaaugaguucaggaaaccuacuauuuacuggacaccucaaauguagauugagaauggauaaauugcaauuaaaaggaaugucguacuccaugugcacaggaaaauucaaaguuguuaaagagauagcagagacacaacauggcacaaucgugauaagaguccaauaugaaggagauggcagcccauguaaaauucccuucgaaaucauggaucuagagaaaagacauguucuggggcgguugauaacagucaacccuauaguaacggaaaaagauucgccgguaaauauagaagcagaaccuccauucggagauaguuauauaauaauugggguggagcccggacaacuuaaauuauccugguuuaaaaagggaaguucaaucggucagauguuugaaacaacgaugagaggcgcuaaacgaauggcaauucuaggcgacacagcaugggacuuuggcucccuugguggcguguuuacaaguaucgguaaagcguugcaucaaguuuuuggagccauauacggagcggcguuuagcggagugagcuggacaaugaaaauuuugaucggagucguuauaacauggauuggaaugaacuccagaucaacgucgcuuucggucucgcuuguuuuaguaggagugguuacacuguaccucggaguaaugguucaagcugauagugguugcgucgucaguuggaaaaauaaagaauuaaaaugcggaagcgguauauucauaacagacaacguacacacauggacugaacaauacaaguuucagccagagucaccaagcaagcucgccucugcaauacaaaaagcccaugaagaggguauuugcgggaucaggaguguaacacguuuggaaaaccugauguggaaacagauaacaccggaacuuaaucauauccuaacugaaaaugaaguuaaacuaaccauaaugacgggugauauuaaagguauaaugcaagcuggaaagcgaagucuaagaccucaaccuacagaauuaaaguauucguggaaagcaugggggaaagccaagauguuaucgacggaauugcauaaucacacuuuccuuauagacggaccagaaacagcggaaugucccaauacaaacagagcguggaacucauuggaaguugaagauuauggauuuggcguguuuacaacuaauauuugguuaaaauuaaaagaacgacaagauguauuuugugauucgaaacuaaugagugcagcaauaaaagacaacagagcuguacaugcugacaugggguacuggaucgaaucagcacuaaacgacacguggaaaauugaaaaagcgucuuuuauugaaguaaaguccugccacuggccuaagucucauaccuuauggucuaauggaguacuugaauccgaaaugaucauuccuaaaaauuuugcuggaccgguaagucagcacaauuacagacccggauaucauacucaaacugcagguccuuggcaucucggccgacuugaaauggacuucgacuuuugugaaggaaccacaguaguuguaacagaagacuguggaaaucguggcccuagcuuacgaacaaccacagcauccggcaaauugauaacugaauggugcugccgaaguuguacuuuaccuccucuucgcuaucgcggugaagacggauguugguauggaauggagauucggcccuuaaaggaaaaagaagaaaauuuggucaacaguuugguaacggcagggcauggucaaaucgauaauuucagcuugggaguacuaggaauggcacucuuccucgaagagauguugaggacucgaguaggcacuaaacaugcuaucuuauuaguagcuguuucguucguuauacuaauaaccggaaacaugaguuuuagagaccucggucgugugaugguuauggugggggcaacgaugaccgaugauauugggaugggaguaacauaucuugcuuuauuagcagccuuuaaaguccggcccacuuuugcugccggauuacuccuaagaaaacuaacaaguaaagaauuaaugaugacaacaauuggaauaguuuuguuaucucaaucaacuauaccugaaaacauucuggaacuuacugacgcuuuagcuuuaggaaugauggugcugaaaauagucagaaauauggaaaaauaucaacuagcaguaacuaucauggcuauauuaugcguaccuaaugcagugauuuuacaaaacgcuuggaaaguuuccuguaccacccucgcggugguuagcgucaguccauuauuacucacauccucccaacaaaaggccgauuggauuccacuugcucucacaauaaaaggauugaauccgacagcaauauucuuaacaacucuaagcagaacgagcaagaaacgcuccuggccccuaaacgaagcuauuauggcaguaggcauggucuccauacucgcuucaucguuacugaaaaacgauauaccaaugacaggaccccuuguggcaggaggccuauugacggugugcuauguuuuaacaggacgaagugccgaucuugaauuagaacgugcagcggauguccgcugggaagaacaagcugaaaucucagguaguucuccuauucucucgauaacgaucucugaggacgguucuaugucaauuaaaaacgaggaagaagaacaaacauugacuauauugauacgcacaggucuauuaguuauuucgggucuuuuuccagucagcauaccuauaacagccgcugcgugguaccucugggaggucaagaaacaacgcgcaggaguuuugugggacgugccuagcccaccgccaguuggaaaagccgaacuagaggacggcgcauacagaauuaagcaaaaaggaauauuaggauacucucaaauuggugccggcguauauaaagaaggcacguuucacacuauguggcacguaacuagaggggcuguacuaaugcauaaggguaaacgcauagaaccgucaugggcagauguuaagaaagaucuaauaucauacggcggaggguggaaguuagagggagaauggaaagagggagaagaaguucaaguacuagcucuagagccugguaaaaauccuagggcuguucaaacaaaaccugguuuauuuaagacaaacacagguacuauaggugcaguuucucuugauuucucgccaggcaccuccggaucuccaauaguugacaagaaaggaaaaguaguuggacuauaugguaauggaguaguaacaaggaguggcacauacguaagcgcaauagcgcagacugaaaagucaauagaagauaauccggaaauagaagaugauaucuuccguaaaaagcgauugaccauaauggaccuacauccaggagccggaaaaacuaaaagauaucugccggccauuguaagggaagccauaaagagaggauugagaaccuugauacuagcaccgacucgaguaguagcggcugaaauggaagaggcuuuacgagggcuaccgauccguuaucaaacuccugcuauccgugccgagcauacaggcagggagaucguagaccugaugugucacgcaacuuuuacaaugagacuacucucaccgauccgaguuccgaacuacaauuuaauaauaauggacgaggcucacuucacggaccccgcuucuauagcugcaagaggauacaucaguacucgcguagaaaugggagaggcagcuggaauuuuuaugacagccacuccacccggcagucgggauccauuuccucaaucuaaugcuccaauaauggacgaagaacgcgaaauaccagagcgaagcuggaacaguggucaugaauggguuacagacuuuaaaggaaaaacagugugguuugucccgucaauaaaagcugguaaugauauagcugccugucuacgaaagaacgggaagaaaguaauccagcucucuaggaagacuuucgauagugaguauauuaagacgcggacgaaugacugggauuuuguuguuaccaccgacauaucagagaugggggcgaauuuuaaggcagaaagagucauagauccgaggcgaugcaugaaacccguaauacuaacagacggugaagaacgaguaauuuuggcagggccaaugcccguuacccauagcucugcagcccaacgaagggguagaguuggucgcaacccuaagaaugagaacgaucaauauaucuauaugggugaaccacucgaaaaugacgaagauugcgcacauuggaaagaagcaaagauguuacucgacaacaucaauacgcccgaaggcauuauuccuagcauguuugaaccagaaagagagaaaguugacgcuauugauggcgaauauaggcuucgaggagaagccagaaaaacuuuuguagacuugaugcgacgcggcgaucuuccaguaugguuagccuaccggguugcagccgaagggauaaacuacgcugauaggagaugguguuuugauggggugaaaaauaaucaaauacucgaggagaacguagaaguggaaauauggacuaaagaaggcgagcgaaagaaacuaaaaccaagaugguuagaugcccggaucuauucagauccgcuugccuuaaaagaguucaaagaguucgcugccggcagaaaaagucuuacucucaaccuuauuacagaaauggggagauuaccgaccuucaugacacaaaaggcuaaaaacgcauuagacaauuuggcaguacuucauacagcggaagcuggcggucgagcauauaaccacgcacugucugaacuaccggaaacuuuagaaacacuacuauuauuaacacuucucgccacagugaccggcggcauuuuucuauuuuuaauguccgggaagggaauagggaagaugacucucgggauguguuguauaauaaccgcaucuauuuuacuaugguaugcgcagauucaaccucauuggauagcagccagcauaauucucgaauuuuuccuaauagucuuacuuauacccgagcccgagaaacaacgaacuccacaagacaaccagcucacauaugucguuauugcgauauugacgguuguagcugcgacaauggcaaaugaaaugggauuuuuagagaaaacuaagaaagacuuuggucuugguucgauuacgacacaacaaccugaaucaaauaucuuagacauagaccugcgacccgcaagcgcauggacucuauaugcuguagcaacaaccuuuauuacacccauguuaagacauucuauugaaaacucaucagugaacguuucccucacagcuauagcgaaccaagcaaccguguuaaugggcuuggguaaaggauggccuuugaguaaaauggauaucggggucccacuacuagcgauugguuguuacucacaagucaauccuauuacccucacugcagcguugcuucuccuaguugcucacuaugcaauaauagggccaggacuucaagcgaaggccacccgagaggcucagaaaagggccgcagccgggauaaugaaaaauccgacaguagaugguaugaccguuauagaccuugaucccauuccauacgauccuaaguucgagaaacaauuaggucaagugaugcucuuaguucuaugugucacccaaguacugaugaugagaacaacgugggcacugugugaggcgcugacauuagccacagguccaauaaguacgcugugggaaggcaauccaggaagauucuggaacacgacaauugcuguguccauggcuaauauuuuucgaggcucauaucucgccggugcgggauuguuauuuucgauaaugaaaaauacggcaaacacucgaagaggaacaggaaacaccggagaaacguuaggagaaaaauggaaaaacagacuaaaugcauuaggaaaaagcgaguuucaaaucuacaaaaagucgggcauucaagaagucgaucguacauuagcaaaggaagggauaaaaaggggugagacggaucaccacgcgguaucgagaggauccgcgaaacuuagaugguuuguugaaagaaaucuaguuacacccgaaggaaaagugguugaucuaggauguggacguggggguuggucguauuauuguggcggacucaaaaacguuaaggaagugaagggccuaacgaaaggugggccgggacacgaagaaccaauuccaaugaguaccuauggauggaaucuaguacgacuacaaucuggaguugaugucuuuuucacaccacccgaaaaaugugauacauuguuaugugacauaggcgaaucuaguccgaauccaacaguggaagcagggcgaacucuaagaguauuaaacuuaguagaaaauuggcugaauaauaacacccaauucuguauaaagguucuuaacccuuacaugccuucagucauugagaaaauggaagcucuacaaagaaaauacggaggggcacuuguucgaaacccucuaagcagaaauucuacucacgaaauguacuggguuucaaacgcuaguggaaauaucguuuccucugugaacaugauaucacgcauguugauuaaucgcuuuacgaugaggcacaagaaagcgacuuacgaaccagauguugacuuagguagcggcacaagaaauauagguauagaaagugaaaccccaaauuuagacauaauagggaagcguauugagaaaauaaaacaagagcacgaaacaagcuggcacuacgaccaggaccauccuuacaaaacaugggcguaucacgggaguuacgaaacuaaacagacugguuccgccaguaguauggucaacggaguaguaagacuauuaacaaaaccaugggauguuauaccgauggucacccagauggcuaugacagacacaacgccuuuuggacaacaacguguguucaaagaaaagguagauaccaggacccaagaaccaaaagaaggaacuaagaaacuaaugaaaauuacagcugaguggcucuggaaagaacuaggcaagaagaaaacgccccggauguguacgagagaagaauuuacucguaaaguacgcuccaacgcagcuuuaggagcuaucuuuacugacgagaauaaauggaaauccgcacgagaagcuguagaagauucaggcuuuugggaacuuguagauaaagaaaggaaucuccaucuagaaggaaaaugcgaaacuugugucuauaacaugaugggaaaacgugaaaagaagcucggggaguucggcaaagccaagggaagucgagcgauuugguauaugugguuaggggcccguuuucuagaguucgaagcgcucggcuucuuaaacgaagaucauugguuuaguagggaaaauucccugaguggcguagaaggagagggccuccauaaguuaggcuacauucugagagauguuucuaaaaaggaaggaggagcaauguacgcugacgauacugcagguugggacacaagaauuacauuagaggaucuuaaaaaugaagaaaugguuacaaaccacauggaaggugagcacaaaaaguuggcagaagcuauauuuaagcugacauaccaaaacaaaguagucagaguucaaagaccaacuccgcgaggaacaguuauggauauaauaaguagacgagaucaacgagguaguggccaaguugucacguacggauugaauacauucaccaacauggaagcgcagcucaucagacaaauggagggagaagguguauuuaaaucuauucaacaacugaccguaaaggaagaaauagcagucaaaaauugguugauuagagucgggcgcgaaagacuuaguaggauggccauuucaggcgaugauugcguaguuaaaccguuagaugaucgguucgcaucugcuuuaacugcacuaaaugacaugggaaaaguacgaaaagacauucagcaaugggagccuagccgugguuggaacgauuggacacaaguaccauuuugcucacaucacuuucaugaacuaauuaugaaggauggacguguucuuguaguuccuuguaggaaucaagaugagcuuaucggaagggcaaggauaucacagggagcaggcuggucgcuacgggaaaccgcuuguuuaggaaagaguuacgcacaaauguggucauuaauguauuuucacagacgugaucugcgguuagcugcgaaugcuauuuguagcgcuguuccgagucacuggauuccaacuucacgaaccaccuggaguauccaugcuacacacgaauggaugacaacagaggacauguuaacaguauggaacagaguuuggauacaagaaaauccuuggauggaagauaagacgccaguagaauccugggaagagauuccauacuuaggaaaaagagaagaucaauggugugguuccuuaauaggccucacaucgcgugcaacaugggcaaagaacauacaaacggcaauaaaccaaguacguucacucaucgggaacgaagaguacacagacuacaugccaucuaugaaacgcuuuagaagggaagaagaagaagccggugugcuuugguaa

SEQ ID NO: 22246 - RNA, 9876 nt, Artificial Sequence
  derived and/or modified CDS sequence (opt6) from DENV-2__KM279528__SS-prME
acugcaggaauaauaauaaugaugauacccacuguaauggcauuucacuuaaccaccagaaacggagaaccccauaugauaguaucucgccaagaaaaaggaaaaucucuccuauuuaaaacugaaaauggcguaaacauguguacccuaauggcgauggacuuaggcgaacuaugcgaagacacaauaacuuacaauugcccacugcuacggcaaaaugaaccagaagauauagauuguugguguaacagcacuucgacuugggucacauauggaacauguacagccacuggugaacaccguagagagaaaagaucugucgcguuaguaccacacguugggaugggacuagaaacucgaaccgaaacauggaugagcucagaaggcgcguggaaacaugcgcagagaauagagacauggauacuaagacacccaggauuuacaaucauggcggcgauuuuagcguauacaauagggacaacauauuuccaaagaguuuuaauauucauacuccucacagccgucacaccaucgauggcgaugagauguauuggaaucucaaauagagacuuugucgaaggaguaagcgggggaucuuggguggauauaguguuagagcacggaucuugugucacgaccauggcuaaaaauaaaccuacguuagacuucgaauugauaaaaaccgaggccaaacaucuagcuacacuaagaaaauacuguguugaagccaaacugaccaacacuacaacagcuucaagauguccuacacagggggaaccaagccuaaaugaagaacaagauaaaagauuuguuuguaaacacucgaugguagaucgcggauggggaaacgggugcggucuguuugguaaaggugggauaguuacaugugcaauguuuacguguaagaaaaacauggaaggcaaaguugugcagccagaaaaucucgaauauacuauugugauaacaccacacaguggggaggagaaugcuguuggcaaugacacagguaaacauggaaaagaaauuaaaguaacaccccaaucuucuaucacggaagcagagcuaaccggguauggaaccguaacaauggaauguucuccaagaacgggacuagauuuuaaugagaugguuuuauuacaaauggaaaauaaagccugguuaguucacagacagugguuucucgacuuaccacuucccuggcuacccggugcagacacucaaggaucgaauuggauucaaaaagagacacuuguuacuuucaaaaauccucaugccaagaaacaagacguggucguuuuggguucucaagaaggagcuaugcacacggcacuaaccggagcaacagaaauccaaaugucaagcgggaauuuauuguuuacugggcauuuaaaaugccggcuuagaauggacaaacuccaauuaaaaggaaugucauauucaauguguacugguaaauuuaaaguuguaaaagaaauugcagaaacgcaacauggaacuauagucauaagaguccaauaugaaggugauggguccccuuguaaaauuccuuuugaaauuauggaucuugaaaaacggcauguucugggacgauuaauuacugugaacccaauaguaaccgaaaaagauucgccugucaacaucgaagcugaaccaccauuuggugauucauacaucauuauaggagucgaaccagggcaacuuaaauugucuugguucaagaaagggaguaguauagggcaaauguucgagacaacaaugagaggggccaaacgaauggcaauacuaggcgacaccgcaugggacuucggaagucucgggggaguauuuacaucuauagggaaagcccuccaccaaguauuuggagcuauauauggagcagcauucuccggagugucauggacuaugaaaauccuuauaggggucgucaucacguggauaggaaugaauagcagaucaacuucacuuuccguuagcuuaguacuuguagguguaguuacucuguacuuaggaguaaugguccaagcagauagcggauguguuguuagcuggaaaaacaaagagcuuaaauguggaagcgguaucuucaucacggauaauguccacaccuggacugaacaauauaaguuucagccagaaaguccuaguaaguuggcuucugcaauccaaaaagcacacgaagagggaauaugugguauucguucgguuaccagacucgaaaaccuuauguggaagcagauaacuccagaauugaaucauauucuuacagagaaugagguaaaacuaaccauaaugaccggugacauaaaaggaauuaugcaagccgggaaaagaucauuaagaccacaaccuacugaauugaaauauucguggaaagcauggggaaaagcaaagaugcugagcaccgaacuacauaaucacacguucuugauagauggaccggaaacugcagaaugcccgaauacuaauagagcuuggaacucacuagaaguagaagacuauggauuuggagucuuuacuaccaacaucugguugaaacuaaaagaacgccaggacguauuuugugacaguaaacuuaugagcgcagcuauuaaggauaacagagcagugcaugcagauaugggauacuggauagagucugcacuuaacgacacauggaaaauugagaaggcuucguucaucgaaguuaagucaugucauuggcccaaaagucacacuuuauggucaaaugguguauuagaaucagaaaugauaauaccaaagaauuucgccgguccugucucacaacauaauuauagacccggguaucauacacagacggcugguccauggcaccugggaagauuagaaauggauuucgauuuuugugaggguacgacuguagucgucacagaggauuguggcaacagaggaccaucucuaagaacaacuacugccucagggaagcugauuacagaaugguguuguagaucguguacuuugccaccccucagauaccguggcgaagacggaugcugguaugguauggaaaucagaccacuuaaagaaaaagaggaaaacuuaguaaauagcuugguuacggcgggacauggccagauugacaauuuuucgcuuggcguuuuaggcauggcacucuuccucgaagaaaugcuacgaacacgaguugguaccaagcacgcgauacuauuaguugcagucagcuucguaacacuaauaacuggaaacaugucuuuucgugaucuuggaagggugaugguaaugguuggagcaacaaugacugaugacaucggcauggguguuacuuaucuagcccugcuagcagccuuuaaaguacguccaacauucgcugcagguuuguuguugaggaaacuaacuucgaaagaguuaaugaugacuaccauaggaauugucuugcuuucucagagcacuauaccgaaaaguaucuuggaacuaacagaugcguuggcauuaggcaugaugguacuaaaaaucgucaggaauauggaaaaauaucaauuagcagucacuauuauggcuauccuuuguguaccaaaugcgguaauauuacaaaacgcguggaaagugagcugcaccacucuagcaguaguguccguaucgccacuacugcugaccucaucucagcaaaaggcugauuggauuccacucgcuuuaacuauaaaaggacuaaauccaacagcgauauuucuuacgacauugagucggacuuccaagaagcgaagcuggccauuaaacgaagcuauuauggcgguagguauggucucaauacuagccagcagucucuugaaaaacgauauuccaaugacaggaccccucguugcagggggauuauugacagucuguuacguacuuacaggaagaucugcggaucucgaacucgaacgugccgcagauguccgcugggaagaacaagccgagaucagcggaucaagcccgauuuuguccauuacgauaagugaagacggcaguaugaguaucaaaaaugaagaggaagaacaaacucuaaccauccugauacguacgggucuauugguuaucuccgggcuuuucccugucagcauucccauaaccgcggccgcaugguauuugugggaagugaagaaacagcgcgcaggaguucuaugggaugucccaucaccucccccagugggaaaagcagaauuggaagauggagcauaucggauuaaacaaaaaggaauccuaggguacucacaaauaggugcaggaguuuauaaggaaggcacauuucacacuauguggcauguuacccggggcgcaguuuugaugcauaaagggaaacggaucgagccaagcugggcagacgugaagaaagauuugauuucauauggaggaggauggaaacuugaaggagaauggaaagagggagaagaagugcaaguccuggcccuagagccaggcaaaaauccucgggcaguucaaacuaaacccggguuguuuaaaaccaacacgggaacaauuggugcuguuagucuagauuucaguccaggaacauccggaucaccgaucguagacaagaaaggaaaaguugugggccuauaugguaaugguguagucacucgaagugggacauauguaagugccauagcucaaaccgaaaaguccaucgaggauaaccccgaaauagaggacgauaucuuucguaagaaaagacuaacuaucauggaccuccacccuggcgcgggaaaaacgaaacgauauuuaccggcaauuguaagggaagcaauaaagagaggucuucgaacauuaauucuugcuccgaccagagugguagccgccgaaauggaagaagcacuuagaggacuccccauuagauaucaaacuccagcgaucagggcugaacacacagggcgagagauaguggaucuaaugugccacgccaccuuuacaaugagacuuuuaaguccaaucaggguaccaaacuauaauuugauuauuauggaugaagcacacuuuacagauccagcaagcauagcagcacgagguuauauaaguacaagagucgaaaugggugaagcagcgggaauuuucaugacagcgacaccacccggguccagggauccauucccucaaaguaaugcaccuauaauggaugaagaacgcgaaauccccgaaaggucauggaacucuggacacgagugggucacggacuuuaaaggaaagacuguuugguuuguaccuucgaucaaggcagguaaugacaucgcggccugcuugcgcaaaaacgggaagaaaguaauacaauuaucucgaaaaacguuugauucugaguauauuaaaacacguacaaacgauugggauuuuguugugacaacagauauaagcgaaaugggugcgaacuucaaagcggagaggguuaucgacccaagaagaugcaugaaacccguaaucuuaacugacggcgaagaacguguaauucuagcagggccaaugccaguaacgcacagcuccgcagcacaacgcagaggacgaguugguaggaaucccaaaaacgagaaugaucaauacauuuacaugggugaaccguuggaaaacgacgaggauugugcacacuggaaagaagccaaaaugcuacucgacaauauuaacacaccugaaggcauuauuccaucaauguuugagccagaaagagagaagguggacgcgauugauggggaauauagauuaagaggagaagcacguaaaacuuucguugauuugaugagacgcggggaucuaccgguuuggcuugcuuaucgaguugccgcugaagggauuaacuaugcagaucgucgauggugcuucgacggggucaaaaacaaucaaaucuuagaagaaaacguagagguagaaauauggacuaaagagggagaaaggaagaaauuaaaaccuagaugguuagacgcacgaaucuauagugauccacucgcauuaaaggaauuuaaagaauuugccgccggaagaaaaucgcuuacauuaaauuuaauaacagaaaugggaagacuaccaaccuucaugacacaaaaagcuaagaacgcgcuagauaauuuagcagugcugcacacugccgaagcgggaggacgugcauacaaucacgcucucagugaacugccugaaacccuggaaacuuuacugcugcuaacgcugcucgcgaccguuaccgggggaauauuccuuuuccuaaugucugggaaaggaauuggaaaaaugacguuaggcaugugcuguauaauuacggccaguauacuauuaugguacgcucaaauucagccacauuggauagcugcgaguauaauucuugaguucuuuuuaauuguccuucuaauccccgagccagaaaaacagcgaacgccacaggauaaucaguuaacauacgucguaauagcaauuuuaacagugguagcugccacgauggcuaaugagaugggauuuuuagagaaaaccaagaaagacuuuggacugggauccauaaccacucagcaacccgagucaaauaucuuagauauagaucuucgaccugcuagcgcauggacccuauaugcuguggcaaccacuuucauaacacccaugcuuagacauucaaucgaaaauaguucagucaacguaagccugacugcuauagcuaaccaagcuacaguauuaaugggauuagguaaaggauggccacucucuaagauggauauugggguuccacuauuagcaauuggaugcuacucgcaaguaaacccaauaacacuaacugcagcauuauuacugcuaguugcucacuaugcaauuauagguccugggcuacaagcuaaagcgacgcgcgaagcacaaaagcgcgcagcagcuggaauuaugaaaaauccaacaguagauggaaugacagugauugauuuagauccaauuccuuacgauccuaaauucgaaaagcaguuaggacagguaauguuacugguccuaugugugacccaaguacuaaugaugagaacaacaugggcccucugcgaagcccuuacccuagcaacugguccaauuucuacauuaugggaaggaaacccgggacgauucuggaacacuacgauagcagucucuauggcuaauauauuccguggaucuuaucuagcuggagcaggacuccuguuuaguauuaugaagaauacugcaaauacccggcgggguacaggcaauacuggcgagacguugggagaaaaauggaaaaaucgucugaacgcgcuuggaaagucagaguuccaaauauauaagaaaucaggaauacaagagguagaucgaacucucgcuaaagaagguaucaaaagaggcgaaacugaccaccaugcagugagucgagguuccgccaaacuucgaugguucguugaacggaauuuaguuacucccgaggguaaagucguagaucucggaugugguagaggcggaugguccuauuauuguggaggauugaaaaauguaaaagaaguaaaaggucuaacaaagggugguccgggacaugaagaacccauaccaaugaguacauauggcuggaaccuugugcgauugcagucggggguagacgucuucuuuacacccccugaaaaaugcgauacucuacugugcgacauaggagagaguaguccgaauccaacaguugaggcagguagaacauuaaggguuuugaaucuaguggaaaacugguuaaacaauaacacacaauuuugcauuaaagucuuaaauccuuacaugcccaguguaaucgagaagauggaagcauuacaacgaaaauauggaggugcccucgugagaaauccgcuaucccgaaauucgacucaugaaauguauuggguuuccaaugcuuccgguaauauagucaguagcgugaauaugaucucuaggauguuaauaaauagguucaccaugagacauaagaaagcgacuuacgaaccugacguagaucuggguucagggacgcgcaauauaggaauagagucggaaaccccuaaucuggacauuauaggcaaaagaauugaaaagauuaaacaggagcaugaaacguccuggcauuaugaucaggaucaccccuacaaaacuugggccuaccacggaucguacgaaaccaaacaaacagguagugcaucaaguaugguuaauggugucguuagguuauuaacaaaaccaugggauguaauucccaugguaacacaaauggcaaugacugauacuacaccauuuggccaacaaagaguauuuaaagaaaagguagacacuagaacacaggaaccaaaggaagggacuaagaaacugaugaaaauaacagccgaaugguuauggaaggagcuugggaagaagaaaacuccaagaauguguaccagagaggaguuuacucgaaaagugagaucuaacgcugcacuuggagcaauauuuacagaugaaaauaaauggaaaucggcgagagaagcggucgaagacuccggauucugggagcugguagauaaggagcgaaaccuucaccucgagggaaaaugcgagaccugcguauauaacaugaugggcaaacgggagaagaaauuaggagaguuuggaaaggcgaaagggucacgagcaaucugguacauguggcuaggagcgagauuccucgaguuugaggcacuaggauuccuuaacgaagaccauugguuuucuagagaaaauucauuaagcggaguagaaggugaggguuugcacaaacuaggauacauauugagagaugugucgaagaaggaagguggagcaauguaugccgacgacacagcgggaugggauaccagaauaacucuugaagaucuaaagaacgaagaaauggugacuaaccauauggagggagaacauaagaaauuggcagaagcgauauuuaaacuaaccuaucaaaacaaaguuguccguguucaacgacccacuccgcggggcacaguaauggauauaaucucaagacgcgaucaacgugguucuggccagguuguuacguacgggcugaauacauucacaaauauggaggcgcagcucauaaggcaaauggaaggggagggaguauuuaaaaguauccagcaauuaacagugaaagaggaaauugccgucaaaaacugguugauaagagugggaagagaacgucuuaguagaauggcaauuaguggugacgauugcguagugaagccacuagacgacagauuugcaucggcauuaacagcguuaaaugauauggguaagguacgcaaagacauacaacagugggagccaagcaggggauggaacgauuggacucagguaccauuuuguucacaccacuuucacgaguuaauaaugaaggauggccguguauuaguugugccuugcagaaaccaagaugaacuaauaggucgggcucggauaucccagggagccggguggucacugagggagacagcaugucuagggaaaaguuaugcccagauguggagcuuaauguacuuccacagacgugaccuccguuuagcagcaaacgcaaucuguucggcuguacccagccauuggauuccaacaagcaggaccacaugguccauacaugcaacacacgaguggaugaccacugaagauaugcuaacaguuuggaauagagucuggauacaggaaaauccauggauggaggauaaaaccccaguagagucaugggaagaaaucccuuacuuagggaaaagagaggaucaauggugugggucuuuaauaggucucacaucacgcgcuacaugggccaaaaauauacaaacggcgauaaaucaaguaagaucauugauagggaacgaagaauacacugauuacaugcccagcaugaaacgguuccgaagagaagaagaagaagcaggaguacugugguaa

SEQ ID NO: 22247 - RNA, 9876 nt, Artificial Sequence
  derived and/or modified CDS sequence (opt6) from DENV-2__KM279533__SS-prME
acagcggguauaauaauaaugaugauuccaacgguaauggcauuucaucuaaccacaaggaauggugaaccacauaugaucgucaguagacaagaaaaaggcaaaagccuauuguuuaaaacggaaaauggagucaacaugugcacucuaauggcaauggaucuaggagaauugugcgaagacacaauaaccuauaauuguccacuacuacgccaaaaugaaccggaagauauugacugcugguguaauucgacgaguaccugggucacauacggaaccuguaccgcaacaggagaacaucgacgugagaaacgaagcguagcauugguaccucacguaggaauggguuuagaaacacgaaccgaaacauggaugagcagugaaggagcauggaaacacgcacaaaggauagaaaccuggauccuacgccacccaggauucacaauaauggcugcaaucuuggcguauaccauaggaacgacuuauuuucaacguguuuuaaucuuuauacuauuaacggccgucacucccucgauggcgaugcguugcauaggcaucucgaaucgcgauuucgucgagggaguauccgguggaagcuggguagacauuguauuagaacaugggucaugcguaacaacaauggccaaaaauaaaccuacccuagacuucgagcuaauaaaaacugaagcaaaacaucuagccacccuaagaaaauauuguguggaggcgaaauuaacaaacacgacuacagcaucucguugccccacccaaggugaacccuccuuaaaugaagaacaagauaaacgcuucguauguaaacauucaaugguugaccgaggcuggggaaacggcugcggauuauucgguaaagguggaauagugacgugugcaauguucacaugcaagaaaaauauggaggguaaagugguacaacccgaaaauuuagaauauacaauaguuauaacaccucauaguggugaagaaaaugcaguaggaaaugacacagguaaacaugggaaggaaauuaaaguaaccccgcaaagcucuauuaccgaagcggaauuaacgggauauggaacaguuacaauggaaugcagcccaagaacaggauuagauuuuaaugaaaugguguuacuacagauggaaaacaaagcauggcucguacaccggcaaugguuucucgaucuaccauuaccauggcuaccaggagcagauacucaaggaucuaauuggauacaaaaggaaacacucguaacuuuuaagaauccccaugccaagaaacaagacgucguuguauuaggaucgcaagagggagccaugcauaccgcacucacgggugcaacggaaauccaaaugucgucuggaaacuuauuguuuacgggacaccuaaaauguagauuaaggauggacaagcuccagcugaaaggaaugagcuacaguauguguacugggaaauuuaaagugguaaaagaaauugcggaaacucagcauggaacaauagugauaagaguacaauacgaaggcgaugggucaccauguaaaaucccauuugaaauaauggauuuagaaaaacgacacguacuuggacgauuaauaacuguaaacccaauuguaacagaaaaagauagccccguaaacauugaagcggaaccuccauuuggagauuccuauauaaucauaggggucgaaccuggccaacuaaaacuaucaugguuuaagaaagguucaagcauaggucaaauguuugaaacaacuaugagaggugcaaaacgaauggcgauuuuaggcgacacagccugggauuuuggcuccuuagguggaguauuuacaucuauuggaaaagcacuacaccagguuuuuggugccauuuauggcgcggccuuuagcgggguuaguuggacaaugaaaauacuaauagggguaguuauuacuuggaucgguaugaacucacgaaguacgagcuuguccguaucccuagucuuaguaggagucguaacuuuauaucuggggguaaugguacaagccgauaguggaugcguagucaguuggaaaaacaaagaacuaaagugugggucaggcauauuuauuacagacaacguacacacauggacagaacaguauaaguuccaaccugaaucuccaaguaagcuagccucugcaauccaaaaggcucacgaggagggcauauguggaauacgaagugucacaaggcuugaaaauuuaauguggaaacagaucacuccagaacugaaccacaucuuaacagagaaugaaguuaaauuaacaaucaugacuggggauaucaaaggaauaaugcaagcagggaaaagaucacuaagaccgcaaccaacugagcuaaaauacuccuggaaagcgugggggaaggcuaaaaugcuaaguacugaacugcauaaccacacauuucuuauugauggaccagaaacugcagaaugcccgaauacaaauagggcuuggaauaguuuggagguagaggauuacggguucgguguuuucaccacgaauaucuggcuaaaguuaaaggagagacaagauguauucugugauaguaaacuuaugagugcagcuaucaaagacaaucgagcaguacacgcagauaugggauacuggauugagucagcauuaaaugauacauggaaaauagagaaggcaaguuucaucgaagucaaauccugucauuggcccaaaagucacacuuuauggucgaacgguguccuagagagugaaaugaucauuccuaaaaauuucgcuggcccgguaagucaacauaacuaccgaccggguuaucacacacagacagcgggaccuuggcaucuuggacgauuagaaauggacuuugauuucugcgaggggacgacuguaguagucacggaggauugcggaaauagaggacccucauuaaggacaacuacggcauccgggaaacuaauaaccgaaugguguugcaggucuuguacauuaccaccauugagauaucggggagaagauggauguugguauggaauggaaauaagaccauuaaaagaaaaggaagagaaucuaguaaauucgcucguaacagccggucacggacaaauagauaauuucagccuuggugucuuggguauggcccuauuuuuagaagaaaugcuuagaacuagaguaggaaccaaacaugcuauauuacucguagcuguuucauucgucacacuaauuacuggaaauauguccuuuagagaucuuggaagaguuaugguuauggucggagcuacaaugaccgaugauaucgguaugggaguaacauauuuagcacuucuagcagcuuuuaaaguaaggccuacauuugcagcgggucuucuccuuaggaaacuaacuagcaaagaacuuaugaugaccacaauaggaauuguuuuacuaucucaaaguacaauaccagaaucaauucuugagcuuacggacgcuuuagcacuagggaugaugguacuaaaaauaguucguaauauggaaaaauaccagcuggcuguuacaaucauggcaauauuaugcguuccgaaugcaguaauccuucaaaaugccuggaagguaucuuguacuacucuugcggucguaucggugagucccuuauuauugacaaguagucaacaaaaagcugauuggauaccauuagcuuugacaauaaagggacuaaacccuacugcuaucuuucuaacuacguugucaagaacaaguaagaaacggaguuggccacucaaugaagcaaucauggcuguaggaauggucaguauacucgcguccagccuacugaaaaaugacauuccaaugacugggccauugguagccggcggucuuuuaaccguauguuauguacuaacaggucggagugcugauuuagagcuagaaagggcagcugacgucagaugggaggaacaagcagagauaucaggaagcucuccaaucuuaucaauuacuauaagugaggauggauccaugagcaucaaaaaugaggaagaggagcaaacauuaaccauacuaaucagaacagggcuccuaguaauuaguggguuauuuccuguuagcauuccaauuacggccgcagcaugguauuugugggaagucaagaaacaaagagcaggcguacuuugggauguuccaucuccaccaccuguuggaaaagcagaacuugaagauggagcguauaggauaaaacaaaagggaauacuagguuacagucagauaggcgccgggguuuacaaagaaggcacauuccauacuauguggcaugucacccggggugcaguacucaugcauaaaggaaaacggauagaacccucaugggccgauguuaaaaaggauuuaauaucauacggugggggauggaaguuagaaggggaguggaaagagggugaagaaguccaaguacuggcauuagaaccagguaagaacccaagggccguucaaaccaagcccggauuauuuaaaacaaacacgggcacaaucggugcugugagucuagauuucagccccggaacaagcggaagcccaauuguugauaagaagggcaaaguaguaggucuuuacgggaauggcguugucacaaggagcggaacauacguauccgccaucgcacaaacggagaaaucaaucgaagauaauccagaaauagaagaugacaucuuuaggaaaaagcgacuaacaauaauggaccuucacccuggugcaggaaaaacaaaaagauacuugccagcgauaguaagagaagcgauuaaaagagguuuacgcacauuaauacuugcaccaaccagaguaguagcagccgaaauggaagaagcacuaagaggucuaccuaucagauaucagacucccgcuauuagagcugaacauacaggacgagagauuguagaccugaugugucacgcaacuuuuacuaugcgauuacuaucaccgauccgagucccgaacuauaaucuuauaauuauggacgaagcccauuuuacagauccggcaucaaucgcugccaggggguauauauccacacggguagaaaugggugaggcagcagggauauucaugacagcgaccccaccaggcucaagagacccuuuuccacagucaaaugcaccaauaauggacgaagaaagagaaauaccugagagaucuuggaacucuggccaugagugggucacggacuucaaaggaaaaacaguaugguucguacccucaauuaaggccgggaaugacauagcggcauguuuaagaaagaacgguaagaaagucauacaacuaagcaggaaaacuuuugauucugaauauauuaaaaccagaacaaaugauugggauuucgucguuaccacagauauaagcgagaugggugcuaacuuuaaagcugaacgcguaauugacccacgucgauguaugaagccuguaauccucacugauggggaagaacggguaauccuggcuggaccuaugccagucacgcacucaucugcugcucaaagaagagggagaguaggacgaaauccgaaaaacgaaaaugaucaauacauauauaugggcgaaccccuugaaaacgacgaagauugugcacauuggaaagaagcaaaaaugcuccuagacaauauaaacacaccggaaggaaucauuccaucuauguucgaaccugaaagagaaaaagucgaugcaauugacggugaauacagauuaagaggugaggcacgaaaaacuuuugucgauuuaaugcgccgaggagaccuuccgguuuggcuagccuauaggguugcggcggaggggauaaauuaugcagauagacgauggugcuucgauggaguuaaaaauaaucaaauccucgaagaaaacguugaaguagaaaucuggacuaaagaaggggaacgaaagaaacuuaagccaagauggcuagacgcccguauauauagugacccucuagccuuaaaagaauuuaaggaauuugcagccggaaggaaaagucuaaccuuaaaccuaaucacagagaugggaagacuacccacuuucaugacacaaaaagcaaagaaugccuuagauaaucuggccguauuacauacggcagaagcaggagguagagcuuacaaucaugcauuaagcgaacugccugaaacacuagaaacacuccuauugcuuacauuacuagcuacuguaacaggaggaauuuuucuuuuucuuaugucaggaaaggggauagggaaaaugacuuuaggaaugugcuguauaauuacggcauccaucuuacugugguaugcucaaauacagccacacuggauugcagccuccaucauacuggaguucuuucuaauuguacucuugauuccagaaccugaaaagcaaaggacgccacaggacaaucaguuaacauauguagucauagcuauccugacggucguagcagcaacaauggcuaaugaaaugggauuucuggagaaaacaaagaaagacuucggacucggaucaauaacaacucaacagccugaguccaacaucuuggauauagauuuaagaccugcgagcgcguggacucuauacgcgguagcaacaaccuuuaucacuccaauguugcggcacucgauagaaaauucuucaguaaauguaucgcucacagccaucgcuaaucaagcuacgguuuuaaugggccucggcaaaggcuggccccugucaaagauggauauugggguaccacugcuagcaauagggugcuauucucaaguaaacccgauaacauuaaccgcugcacuauugcuccuaguugcgcacuacgcaauuaucggaccggggcuacaagccaaagcaacuagagaagcacagaagagagcggcagcugguaucaugaaaaacccaacgguggacgggaugacuguuauagauuuggaucccauaccguacgacccaaaguucgagaagcaguuaggacaaguaaugcuucugguacuaugcgugacgcagguuuuaaugaugagaaccacuugggcucuaugcgaagcguuaacguuagccacuggaccuauaucuacauuaugggaagguaauccagguagguuuuggaauacuacaauugcuguaagcauggccaauauauuuaggggauccuaucuagccggugcugguuuacucuucucaauaaugaaaaacacagcaaauacacgcagggguacggguaacacaggugaaaccuuaggagaaaaauggaaaaauagauuaaacgcauugggaaaaucagaauuucaaauuuauaagaagucuggaauacaagaaguugauagaacccuagcuaaggaagggauaaaaaggggcgagacagaucaucacgcuguuagcaggggcagcgcaaaacuuagaugguuugucgaaagaaaccuaguuacacccgaagggaagguagucgaucuaggauguggacguggagguuggucauauuauugcggaggacucaaaaaugugaaggaaguaaaaggguugacaaaagguggaccgggacaugaggagccaauaccuaugucuacuuaugguuggaacuuaguacggcuucagagugguguugacguauucuuuaccccgccagaaaaaugcgauacacuauugugcgauauuggagaaaguucacccaauccaacuguagaagccggaagaacuuuaagaguguuaaauuuaguagaaaauugguuaaauaauaauacgcaguucuguauaaaagugcugaaucccuacaugccaucuguuauugagaaaauggaagcucugcagcguaaauauggaggcgcucuaguucgcaauccauuauccagaaauucuacgcacgaaauguauuggguguccaacgcaucuggaaacauuguaucuuccguuaauaugauaagccgaaugcugauaaauagauucacaaugagacauaagaaagcgacauaugagcccgauguagauuuaggaucgggaacaagaaauauaggcaucgaauccgaaacgccuaauuuagacauuaucgguaagcggauagagaaaauaaagcaagaacaugaaaccucuuggcacuaugaucaagaccauccuuacaaaacaugggcuuaucauggcagcuacgaaacuaaacaaaccggcagcgcaucuaguauggugaaugguguaguuagauuauugaccaagccaugggaugucauaccuauggugacgcaaauggcaaugacugauacgacaccauucggacaacaaaggguauuuaaagaaaagguagauacgcgaacccaggaaccgaaagaagguaccaaaaagcucaugaaaauaacagcugaaugguuauggaaggagcucggcaagaagaaaacgccucgaaugugcacgagagaagaauuuacccguaaaguucguagcaaugcggcccugggggcgauauucacagaugaaaauaaauggaaaagcgcaagagaagcaguagaagauuccggauucugggagcuaguugauaaggaaagaaaucuccauuuagaggguaaaugcgaaacaugcguguauaauaugauggggaaaagagaaaagaaguugggagaguucgggaaggcuaaggggucgagggcaauaugguauauguggcuaggugcccgauuuuuagaguuugaggcuuuaggauuucuaaaugaggaucacugguuuagccgggaaaacucguuaagugguguggaaggggagggacuacauaaauuagguuacauccuaagggacguaagcaagaaagaggguggcgccauguaugcggaugauacagccggcugggauacuagaauaacgcuugaggaccuuaaaaaugaagaaauggucacuaaucauauggaaggcgagcauaagaagcuagcagaagccauuuuuaaguugacauaccaaaauaaaguuguacgaguucaaagacccacaccucgugguacagucauggauaucauauccagacgagaucaacgaggaucaggucaaguagucacauauggcuugaauaccuuuaccaauauggaagcacaauuaauucgacaaauggaaggagagggaguuuuuaagucaauacagcaauuaacaguuaaagaagaaauagcggugaaaaauugguuaauacgggucggacgagaaagauuaaguagaauggcaauaucgggcgaugauugugugguuaaaccauuagacgaucgcuuugcguccgcguuaacugcucuaaaugauaugggaaaaguuagaaaagacauccagcagugggaaccaucuagaggauggaacgacuggacacagguaccauuuugcucucaucauuuucacgaguugaucaugaaagauggaagaguauugguuguuccauguaggaaccaagacgagcuaauuggacgagcgcgaaucucacaaggcgccggcuggagccugagagaaacagcaugccuaggcaaaaguuaugcucagaugugguccuuaauguacuuucauaggagagauuugcgacuugcagcaaacgcaauuugcagugcugugcccagccacuggauaccaacaucucgaacaacguggaguauacacgcgacucaugaauggaugacaacagagaacauguuaacuguuuggaauagagucuggauacaagagaauccauggauggaggauaaaacaccuguugaaucgugggaggaaauacccuauuuaggcaaacgagaagaccaguggugugggucacucaucggucugacuucaagggccacaugggccaaaaauauccagacagcuauuaaccaaguaaggagucuuauaggaaaugaagaguauaccgauuauaugccgagcaugaaaagauuccgcagagaggaagaagaagcaggaguucuaugguag

SEQ ID NO: 22248 - RNA, 9876 nt, Artificial Sequence
  derived and/or modified CDS sequence (opt6) from DENV-2__KM279535__SS-prME
accgcgggcauaauaauuaugaugauaccaacaguaauggcuuuucaccuaacgacaagaaacggagaaccacacaugauuguaagucgacaagaaaaagguaaaucauuacuuuuuaaaacagaaaauggcgugaauaugugcacauuaauggcgauggacuuaggggaauuaugugaagauacaaucacauacaauuguccgcuacuucgucagaacgaaccagaagacauugauuguugguguaauucuacaaguacaugggugacauacggaacauguacagccacuggugaacauaggagagagaaaagaucaguagcgcuaguuccacauguaggaaugggacucgaaaccagaacggaaacuuggaugaguucagaaggugcguggaaacacgcacaaagaauugaaacguggauacuuaggcaucccggauucacgauaauggccgcaauacuagccuauacaaucgggaccacuuacuuucaaaggguguuaauauucauauuguuaacagccguaacucccucaauggcaaugagaugcauaggaauauccaaucgugacuuuguagaaggcguaagcggaggaaguugggucgacauuguauuggaacacggauccuguguaacaacgauggcuaaaaauaaaccgacucuugauuuugaacuuauuaaaacagaagcaaaacacuuagcaacacuacgaaaauacuguguggaagcuaaauugaccaacacaacaacagcaucucguugucccacacagggagaaccgucguugaacgaagaacaagauaaacgauuuguaugcaaacauaguauggucgaucgaggguggggcaauggauguggacuauuugggaaaggaggaauagucacuugcgcaauguuuacuuguaagaagaacauggaaggaaaggucguccaaccagaaaauuuggaauauaccauagucauuaccccacacaguggugaagaaaaugcaguaggaaaugauacuggaaaacacggaaaagaaauaaaaguaacuccucaaucaucaauaacggaagcagaauugacaggguauggcacuguaacgauggaaugcaguccacgaacgggguuagauuucaacgagaugguacuuuugcagauggaaaacaaggccugguuaguacacagacaaugguuccucgauuuaccgcuuccaugguugcccggugcagacacacagggaucuaauuggauucaaaaggaaaccuuaguuaccuucaaaaauccgcaugccaagaaacaagaugucguaguacucggaagucaggaaggcgcaaugcacacugcauugaccggagcaaccgagauccaaaugucgucaggaaaucuauuauuuaccggucacuugaaaugcagacuaagaauggauaagcugcaauuaaaggguaugagcuauaguaugugcacuggcaaauucaaaguaguaaaagagauugcggaaacacaacacgggaccauuguaauccgaguacaguacgaaggggacgguagucccugcaaaauacccuuugaaaucauggaccuagagaaaagacacguuuuaggaaggcuaaucacaguaaauccuauugucacugagaaagauucgcccguuaacauagaagcagagcccccauuuggugauagcuauaucauaauaggggucgaaccaggacaauuaaaacuuucuugguuuaagaaagguaguaguauaggccagauguuugaaacuaccaugaggggcgcaaaaagaauggcuauauuaggugacacagccugggacuucggaucguuaggcgguguguuuacaagcauuggaaaagcacuccaucaagucuuuggcgccauauacggcgccgcuuuuagcgggguuagcuggacuaugaagauacucauaggggugguaauaacauggauaggcaugaacucacgaaguacgaguuugucaguaagucucgugcugguaggaguaguuacuuuauaucucggaguaaugguacaagcagacucugggugcguagucucauggaagaauaaagagcuaaaaugcggaagugguauauuuauuaccgauaacguucacacauggacagaacaguacaaauuccaaccggaaucgccuaguaaacuagccagcgcgauucaaaaagcucacgaagaagguaucugcgguauaaggucuguaacucgucuggaaaaccucauguggaaacaaauuacgcccgaauuaaaucauauacuuacugaaaacgaaguuaaacuuacaaucaugacaggcgauauuaaagggauaaugcaagcgggaaaaaggucacuacgcccgcaaccaaccgaauuaaaauauuccuggaaagccuggggaaaggccaaaauguuauccacggaacuacauaaucauaccuuucugauagauggaccagaaaccgcugagugccccaacacaaauagagcauggaauagucuagaaguagaggauuaugguuuuggcguuuucacuacaaauaucuggcuaaaauuaaaagagcgacaagacguauuuugugauucaaaauuaaugucugcagccauaaaggauaauagggccguacaugcagauaugggcuacuggauagagucugcacucaaugacacguggaagauagagaaagcgucguucauagagguuaaauccugccauuggccaaagagccacacauuauggaguaauggaguacuggagucugaaaugaucauacccaagaacuucgcugggccgguaagccaacauaauuauagaccaggguaucauacucaaacagcugguccauggcaucuggggcgucuugaaauggacuuugauuucugcgaaggcacaacuguaguaguaacugaagauuguggaaaccguggaccaucccuucggacuacaacggcgucaggaaaacuuauaacugaauggugcugccggucguguacgcuaccuccccuacguuaucgaggcgaagauggauguugguaugguauggaaauaagacccuuaaaggagaaggaggaaaauuuaguaaacucacucguuacugcaggacacggccaaauugauaacuucuccuuagguguauugggaauggccuuauuucuggaagagaugcuuagaacgcgcgugggaacaaaacacgcuaucuuauugguggccguuagcuucgucacucuaauuacagggaauaugucauucagagauuuggggcguguuaugguaaugguaggagcgacaaugacugacgacauugguaugggugucaccuacuuagcacuucuagcagcuuuuaaaguuagaccgacauuugcagcaggacuauuguugagaaaacuuacuucaaaggaacucaugaugacgaccauagguauaguuuuauuaagccaauccacuauaccggaaucaauucuugagcuuacugaugcucuagcccugggaaugaugguacuaaaaauaguucgaaauauggaaaaauaccagcuugcugucacuauaauggcaauuucaugugucccaaaugcugugauacuacagaaugccuggaaagugucauguacaacuuuagcggucguaaguguuucuccacuuuuguuaaccucuucucaacaaaaagcugauuggaucccauuagccuuaacgauaaaaggucucaacccaacugcgauauuucugaccacacuaaguagaacgaguaagaaaagaucuuggccauuaaaugaagcaauaauggcaguagguaugguaucaauucucgcgagcucacugcucaagaaugauauaccaaugacuggcccacuuguugcugguggccugcuuacggugugcuacguucuaacagggcgaucagcugaucuggaacuugaaagagcagccgauguacguugggaagaacaagcugaaauuagcgggagcucucccauacuuaguauaacaaucagugaggacgguagcaugucuauuaaaaacgaagaagaagaacagacauugacaauacucaucaggacaggccuguuaguaauaucagggcuguuuccgguaaguauaccuaucacugcugcugcaugguacuugugggaaguaaagaaacaacgagcugguguucugugggacguaccgucaccaccuccaguaggaaaagccgaacuagaggacggugcuuauagaaucaaacagaaaggcauacuuggcuauucucaaauuggagcugggguuuauaaggaagguacuuuucacacaauguggcacgucacucguggagcaguauuaaugcacaagggaaaaagaauagagccuaguugggcagaugugaagaaagacuugauuagcuaugggggcgguuggaaacuagaaggcgaguggaaagagggcgaagaagugcaaguguuggccuuagaaccugggaaaaauccgcgcgccguacaaacaaagccaggacucuucaaaacuaacaccgguacaauaggggccguaucucuugacuucaguccggggacguccgguagcccaauuguagacaagaaaggaaaaguagugggccuuuauggaaacggcguuguuacucgcucggguacuuacguuagugcaauagcacaaacugaaaagucgauugaggauaacccagaaauugaggacgauaucuuuaggaagaaaaggcuaacuauuauggaccuacacccaggagcuggaaaaacaaaaagauauuugcccgcaauagugcgcgaagccauuaaaagaggcuuacguacguuaauauuagcuccaacccgaguugucgcugcugagauggaagaagcacucagagguuuaccaauaagguaucaaacacccgcaauaagagcagaacacaccggcagagaaauaguagaucuuaugugucacgcgacuuuuacgaugagauuauuaucuccaauuagaguaccgaacuauaaucuaauuauaauggaugaagcacauuucacugauccagcaucuauugcagcacggggguacauauccacaagaguugaaaugggugaggcugcggguauuuuuaugacagcaacuccaccaggaucucgggaccccuuuccccagagcaacgcuccaaucauggaugaggaacgggaaauuccggagcgcucauggaauagugggcaugaauggguaacagauuucaaagggaaaaccguaugguuuguccccagcauaaaggccggcaaugauauugccgccugccugcggaaaaacggcaagaaagugauucaacuaagucggaaaacuuuugauucugaguacauaaagacacgcacuaaugauugggauuuuguaguaacuacugacauaucggaaaugggagccaacuuuaaagcugagcgugucaucgaccccagacgaugcaugaaacccgugauauuaacggauggagaagaaagaguuauauuagcaggaccgaugccaguuacucacucaagugcggcacaaaggagaggucggguagggcguaaccccaagaacgaaaaugaucaauauauauauaugggagaaccacuagagaaugacgaagauugugcgcauuggaaagaggcaaaaaugcuccuggacaauaucaauacaccugaagguauuauaccaucaauguuugaaccagaaagagagaaaguugaugcgauagauggagaguaucgacuaagaggagaagcuagaaagacuuuuguagaucuuaugagacgaggcgauuuaccgguuugguuggcauaccgaguugcggcagaagggauuaacuacgccgaucgacgauggugcuuugacggagucaaaaauaaucaaauuuuagaggaaaauguggaagucgaaauauggacuaaagaaggcgaaagaaagaaacuuaaaccaagaugguuggacgcaaggauauacucugauccuuuggcuuuaaaggaguucaaagaguuugcugcaggcagaaaaucauugacccucaacuuaauuacagaaaugggacguuuaccuaccuuuaugacccaaaaagcaaagaaugcuuuagauaaccuggcuguccuacacacggcagaggcuggcgguagagcauauaaucacgcauugucugaauugccggagaccuuagaaaccuugcuacuuuuaacgcuacucgcuacggucaccggaggaauuuuucuguucuuaaugucaggcaagggaauagguaaaaugacccuagguauguguuguauuaucacugcaaguauccuauugugguaugcucagauacaaccgcacuggauagcggcaucaauuauauuggaauuuuucuuaauaguuuuguuaauucccgaaccagaaaaacaaagaaccccacaagacaaucaacuaacauacguaguaauugcaauauugaccguaguugccgcaacgauggccaaugagaugggauuccuagagaagacuaagaaagacuuuggacucgguagcauaaccacacagcaaccagaaagcaacauacucgauauagacuuacgccccgcaucggcauggacgcuuuacgcaguugccacuaccuuuauaacgccaauguugagacacucaauagaaaacucgucuguuaauguaucuuuaacugcuauugcaaaccaagcaacaguccugaugggacuaggaaaaggguggccgcugaguaaaauggacaucgggguuccacuucucgcaauagguuguuacucucaagucaauccuauaacauuaacagccgcucuauuacuacucguagcucauuaugcaauaauagggccagguuuacaagcaaaagcaacuagagaggcacagaaacgagcggcagcaggcauuaugaaaaacccgacaguggacggcaugacugugauugaccuggacccuaucccauaugacccuaaguuugaaaaacaacugggccaagucauguuauuaguucuauguguuacacaaguauuaaugaugcggacuacgugggccuugugugaagcacugacuuuggcuaccggccccauaagcacacucugggaagguaauccaggacgguucuggaacacgacuauugcagugucuauggcgaauauauuucgcgguucguaucuagcaggggcaggacuauuguuuagcauuaugaaaaauacugcaaauacacguaggggaacugguaauacgggagaaacacuuggagaaaaauggaaaaacagguugaaugcauuagguaaaucugaguuucaaauauacaagaaaagugguauacaagagguagauaggacuuuagcuaaggaaggaauuaaacggggugaaacagaucaccaugcuguauccagaggcagugcgaaacugcgcugguucguagaaagaaauuuaguuacgccagaggguaagguugucgaucuuggauguggaagggguggguggucauacuauugugguggguuaaagaauguuaaagagguaaaaggucuaaccaaagguggccccgggcacgaggaaccaauaccuaugucaacuuauggauggaacuugguccgucuacagucaggaguugacgucuucuuuacgccaccugaaaaaugcgauacgcuuuuaugcgauaucggagaaucgagucccaaucccacaguggaagccgggcgaacccugaggguccuuaaccuuguugaaaauugguuaaauaauaauacacaauucugcauuaaagugcucaacccauacaugccuucagucauugagaaaauggaggcucugcaacgcaaauauggaggugcauuaguaagaaauccucuaagucgaaauagcacacacgaaauguacuggguuucaaaugcaaguggcaacauaguuuccagcgucaauaugauuucucgaauguuaauaaacagguuuacuaugcgucauaagaaagcaacguaugaaccagacguagaucuagguagcgggacgcgaaacauugguauugaaagugagacaccgaaucuugacauaauagguaaaagaaucgaaaagauuaaacaagaacacgaaacaaguuggcauuaugaucaagaucauccuuauaaaaccugggcguaucacggaucauaugagacuaaacaaacaggaucagcaucaagcaugguaaacgggguagugagacuacuaacaaaaccgugggacgucaucccaaugguuacacaaauggcaaugacagacaccaccccauucggacaacaacgugucuucaaggaaaagguagauacacguacacaggaaccuaaagagggaacuaagaaacuaaugaaaauaacugcggagugguuauggaaagaacuagguaagaagaaaacgccacgaauguguacacgagaagaguucacacggaagguuagaucuaaugcagcgcuaggggcaauuuuuacagaugagaacaaauggaaaagcgcuagagaagccguugaagauaguggauuuugggaacuugucgacaaagaaagaaaccuccacuuagaagguaaaugugaaaccuguguauauaacaugauggguaagagagagaagaaauuaggagaauuuggaaaagcaaaaggaucaagagcgauuugguauaugugguuaggugcacgauuucuugaauuugaagccuugggauuuuuaaacgaggaucacugguucuccagagaaaauagucuuucaggaguagaaggagaaggguuacacaaacuagguuacauccugagagacguaucaaagaaagaagggggugcgauguaugcagacgauacagcggggugggauacaaggaucacucuggaagaccuaaagaaugaagaaauggucacuaaccacauggagggcgaacacaagaaauuagcagaagcuaucuuuaaauuaacuuaccagaauaagguaguaagaguccaaagacccaccccucgaggaacagucauggacauuauaagccgacgugaucaacguggaucaggacaagucguuacuuacggacuuaauacuuucacuaacauggaggcacaacuuauaagacaaauggaaggugaaggaguauuuaaaucuauccaacaauuaacaguuaaagaagaaauagcaguuaaaaauugguugauacguguugggagagaaaggcugucuagaauggcuaucucuggugacgacuguguugugaagccauuagacgaucgauucgcuucagcacuuacagcgcuaaacgauauggguaaaguaagaaaagacauucaacaaugggaacccucaagagguuggaaugacuggacucagguaccuuucuguucgcaucacuuucaugaacuuauaaugaaagacggaagagucuuaguugucccauguaggaaucaagaugaacuaauuggacgagccagaauaucacaaggagcggguuggucuuugcgagaaacugccugucuagguaaaaguuacgcacaaauguggucuuuaauguauuuccaucgacgggauuuaagauuggcagcuaacgcuauuuguucugcagugcccucacacuggauaccuaccucaagaacuacuuggucaauacacgcuacucaugaguggaugacuacagaagacaugcugacuguauggaauagaguuuggauacaagaaaaucccuggauggaagauaaaaccccuguagaaucgugggaggaaauaccuuaucugggaaagagagaagaccaguggugcggguccuugauuggauugacaaguagagcuacaugggcuaaaaacauucagacugcuaucaaucaggugaggagccuaauaggcaaugaggaauauacagacuauaugccaaguaugaaaagauuucgccgcgaagaggaagaagcgggcgucuugugguaa

SEQ ID NO: 22249 - RNA, 9876 nt, Artificial Sequence
  derived and/or modified CDS sequence (opt6) from DENV-2__KM279539__SS-prME
acagcaggaaucauuauuaugaugaucccaacaguaauggcauuucaucuaacaacgcgaaauggagaaccucauaugauuguuagccgucaagagaagggcaaaagcuuauuauuuaaaacagaaaaugguguuaauaugugcacucuaauggcgauggacuugggcgaauuaugcgaagauacaauaacauauaauuguccuuuacuaagacaaaaugaaccugaggauaucgacuguuggugcaacagcacgagcacguggguaacguacggaacaugcaccgcuacgggcgaacaccgaagagaaaagagaaguguugcauugguaccgcauguagggaugggguuggaaacacguaccgagacauggauguccucagaaggagcauggaagcaugcccaacgaaucgaaacguggauccucaggcauccagguuuuacuauaauggcagcaauauuggcauauacaaucgggaccacguauuuccaacgagugcuaauuuuuauuuuacugacagccguuacacccucaauggcaaugcgaugcauugguaucaguaauagagauuuuguagaaggcguaaguggcggauccuggguagauauugucuuagaacacggaucuuguguaaccacgauggcaaaaaacaaaccuacauuagacuuugagcucauuaaaacugaagcaaaacaucuggcuacauuaaggaaauauuguguggaagcuaaacugaccaauacuacgacugcuagucgauguccgacucaaggcgagccgucuuuaaaugaagagcaagacaaacgauuugucuguaaacauaguaugguugauagaggguggggaaauggauguggccuuuucgguaaaggcgggauuguuacaugugcaauguucacauguaaaaaaaacauggagggaaaaguaguacagccagaaaaucuggaauacacgauuguaauaacaccacacagcggggaagaaaacgcugucggcaaugauacaggaaaacaugggaaggaaauaaaaguaacgccacaaucuagcauaaccgaggcugaacuaacaggauacgggacugugacuauggaaugcaguccaaggacaggauuagauuucaacgaaaugguacuacuacaaauggaaaacaaagcaugguuaguucacagacagugguuucuagaccuuccacuaccaugguuaccgggcgccgauacacaggguucaaauuggauacaaaaggagacacuugucacauuuaaaaacccgcacgcgaagaaacaggauguuguuguacuaggaucucaggaaggugcuaugcacacagcccugaccggcgcaacugagauacaaaugucgaguggaaaucuucuauucacaggucaucuaaaguguagacuacgaauggacaagcuucagcuuaaagggaugaguuacucgauguguacagggaaauuuaagguaguuaaggaaauugcugaaacgcagcacggcacuauuguaauucguguacaauacgaaggcgacggcagucccuguaaaauaccauucgaaauuauggauuuagagaaacgccacguauuggguagauuaauaacagugaacccuauaguaaccgaaaaagauaguccaguaaauauugaggcagaaccccccuuuggugauaguuauauaaucauuggaguggagccuggucaacuuaagcuaucuugguuuaaaaaagggaguagcauaggacaaauguucgagacaacaaugcggggagcuaaacgcauggcaauuuuaggagauacagcaugggauuuuggaagcuugggagguguauuuacaucgauuggaaaagcguugcaucagguguuuggagcaauuuauggagccgcauucucuggugucuccuggacaaugaaaauucuaaucggugucgucauaaccuggauuggcaugaacucucguaguacuagcuuaagcguuucgcuaguucuuguggggguagucacguuguaucugggaguaauggugcaagcagacucuggcugugugguaucuuggaaaaacaaggaauuaaagugcggaucagggauuuuuauaacagacaauguacauacauggacugaacaguauaaauuccaacccgaaagcccuucaaaacuagcuuccgcuauacaaaaagcucaugaagaagguauuugcgguauacgcucaguaacacgacucgaaaaucugauguggaagcaaaucacgccugaacuaaaccauauacuaacagaaaaugaggugaaacugacaaucaugacaggcgauauaaaggguauaaugcaagcuggaaaaaggucauugcgcccacaacccacagaauuaaaguauaguuggaaagcguggggcaaagccaaaaugcuaucaaccgaacuacauaaucacacguuucuaauugacgguccagaaacugcugaaugcccaaauacuaaucgugcuuggaauagccucgaaguagaagacuauggauuuggaguauucacgacgaacauuuggcuaaagcuuaaagagcgacaagauguauuuugcgauucgaaacuuauguccgcugcaauuaaagauaaucgugccguacaugccgacaugggauacuggauugaaucggcauuaaaugacacauggaaaaucgagaaagcaucuuucauagagguaaaaagcugccauuggccaaagucacacacauuauggucgaacggggugcucgagucagaaaugauaauaccgaaaaauuucgcuggaccaguaucgcaacauaacuacaggccugguuaucacacgcaaacagcggguccauggcaucucggaagacuugaaauggacuuugacuuuugugaaggaacaaccgucguuguaacagaagauuguggcaacagaggaccuucuuugagaacgacgacggcuucuggcaaacuaauaacagagugguguugcagauccuguaccuuaccaccuuuaagauaucgcggggaggauggauguugguaugguauggaaauuagaccauugaaagagaaagaggagaaucuaguuaauagccuagugaccgcuggccauggacagauagauaacuuuucuuuagguguucucgggauggcgcuuuuccuugaggaaaugcuccggaccagagugggaacuaaacaugcgauccuauuagucgcagugucguuuguuacauuaauaacgggcaauaugucauuccgcgaccuaggacguguuauggugaugguaggugcaaccaugacagaugacauagggauggggguuacauaucuagcccuuuuagcagcuuuuaaagucagaccgacauucgcugcuggcuuauuguuaagaaaacucacuagcaaagaacuuaugaugacuacgauagguaucgucuuauugucccaaucaacgauaccagaaucaauuuuagagcuuacagaugcccucgcccucggaaugaugguacuuaaaaucguacggaauauggagaaguaccaacuagcaguaacaauaauggcgauacucugcgucccaaaugccgugauacuccaaaaugcauggaagguaucaugcacuacacuagccguggucucaguuaguccucuauuauuaacuagcucacaacaaaaagcggauuggauccccuuagccuuaaccauuaaggggcugaaucccacggcaauauuccuuacgacacuaucacggacuaguaaaaaaagaucuuggccucucaaugaagccauaauggcaguggggauggugucaauauuagcaaguagcuuguugaaaaacgacaucccuaugaccggaccauuaguugcagguggguuauugacgguuuguuacguacuuaccggaagaagugcagacuuagaacuggaacgugcagcagauguaagaugggaagagcaagcagagaucagcgguucuucaccuauauugucaauuacaauauccgaagaugguucuaugucaauuaagaaugaggaagaagaacaaacguuaacaauacuuaucaggacaggacuccuuguaauaucaggacucuuuccuguaucaauaccuauaaccgcagccgcaugguaucuuugggagguuaagaaacaaagagcugguguucucugggauguacccucuccucccccgguuggaaaggcugaacuagaagauggggcauauaggauaaagcagaagggaauuuuggguuacucgcaaauuggugcggguguauacaaagaaggaacuuuccacacuauguggcauguaaccagaggugcaguccuaaugcacaaagguaaacgaauagaacccucgugggcagacguuaaaaaagaccucauaagcuaugggggcggauggaaacuagaaggggaguggaaggaaggagaagaagugcaaguacuagcauuagagccgggaaaaaauccuagagcaguucaaacaaagccaggcuuauuuaaaacuaacaccgguacaauaggagcugugucacuagacuuuucaccuggaaccuccgggucgcccauaguagacaaaaaagggaaaguggucggucuauaugggaauggaguagucacacguaguggaaccuauguguccgcuaucgcacagacagaggaaucuaucgaagauaacccugagauagaagaugacauauuucggaaaaagcgauuaacaauaauggauuugcacccgggagcuggaaagacgaagcguuacuuacccgcaauuguacgugaggcaauuaaaagaggccuuagaacauuaauuuuagcucccacuagaguagucgcggccgaaauggaagaagcauuaagaggacuaccaauacgguaucagacaccugcaauaagagcggaacacacgggaagggagauaguagaccucaugugccaugcaacuuucacuaugcgguuauuaucaccaauacgaguuccgaacuacaaccuaauaaucauggaugaagcacacuucacagacccugccagcaucgccgcacgaggauauauaucaacacgaguagaaaugggggaagcagcagggauuuuuaugacagcuacgccuccaggcuccagagacccguuuccacaaucaaacgcaccaauuauggaugaagaacgugaaauaccugaaagauccuggaauucugggcacgagugggucacagauuucaaggguaaaacaguuugguucguaccaucaaucaaggcugguaaugacauugcagccuguuuacgaaaaaacgguaagaaaguaauacaauugucucgaaaaacguuugauagugaguacauaaaaacaaggacaaacgauugggacuuuguagugacaaccgauauuagugagaugggggcgaauuucaaagcggagcgcguuaucgauccaagacguugcaugaaaccaguaauacucacugauggcgaggaaaggguaauauuagcaggaccgaugccaguaacacauuccagugccgcgcaacgacguggacguguggguagaaacccaaaaaaugaaaaugaucaauauaucuauaugggagaaccccuagaaaaugacgaggauugcgcccacuggaaagaggcgaaaauguuauuagauaauauaaauacaccagaagggauuauaccgucaauguuugaaccggaaagagagaaaguagacgcaaucgauggggaauaucguuugaggggagaagcuagaaaaacuuuugucgaucuuaugcgaagaggugaucuaccaguauggcuggcuuaucgggucgcugccgaaggaauaaacuaugcugacagaagaugguguuuugaugguguaaaaaauaaucaaauacuagaagaaaacgucgaggucgaaauuuggaccaaggagggagaacguaaaaaacuaaagccgcgcugguuagacgcacguauauauucagacccgcuagcacuaaaagaauucaaagaguucgcagccggacgaaaaucacuaacacuaaaccucauuacugaaaugggaagauuaccgacuuucaugacacaaaaagcuaaaaaugcccuagauaaccuugcaguacugcacacugcagaagcaggaggaagagcuuauaaucaugcacucucugaauuaccugaaacacuagaaacuuuguuguuauuaacucuacuugccacaguaaccggagguauauuccuuuuccuaaugucagguaaagggauaggaaaaaugacauugggaauguguuguauaauaacagcuaguauacuacuuugguaugcacaaauucaaccgcacuggauugcugcgaguauaaucuuagaguucuuuuuaauuguucuacuaauacccgaacccgagaaacaacgaacaccacaagacaaccaauuaacauauguagucauagcuauauuaacggugguagccgcuacgauggcaaaugaaaugggcuucuuagaaaaaacgaagaaagauuucggacuugggagcauaacaacgcaacaaccagagaguaacauccuugauaucgauuuacguccagccucugcuuggacucuguaugcggucgcaacgacuuuuauaacaccaaugcuucgacacucaauugagaacuccagcguaaauguuagcuuaacagcgauagcaaaccaagcuacuguccugaugggauugggaaaaggauggccucugaguaagauggacauaggugucccauuacuagcuauaggaugcuacucccaagucaaucccauaacgcucacugccgcucucuuacuauugguagcccauuacgccauaauaggaccuggccugcaagcgaaagcuacacgcgaagcgcaaaagcgagccgcugcgggcauaaugaaaaacccaacuguggacggaaugacugucauugauuuagacccgauacccuaugauccgaaauucgaaaaacaacuuggucagguuaugcuauuagugcuuugugucacccaagugcuaaugaugcgaacuacuugggcauugugugaggcguuaacacuagcgaccgggccaaucaguacucuuugggaaggaaauccuggacgauuuuggaauacaacaauagcaguuagcauggcaaauauuuuccgagggagcuaucuagcaggugcuggcuuacucuuuucaauaaugaaaaacacagcgaauacacggcgagguacuggaaauaccggugaaacacuuggcgaaaaguggaaaaaucgguuaaacgcacuaggaaaaagcgaguuucaaauuuacaaaaaaagcgguauacaggagguagaccgaacgcuagcaaaagagggaaucaagagaggagaaaccgaucaucaugcgguaucgcguggcucagcgaagcugcgcugguucguggagaggaaccuaguuacgcccgaaggaaagguaguggaccuuggaugcggucgugguggcuggagcuauuacugcggagguuuaaaaaauguaaaagaagucaaaggauuaacuaagggaggucccggacaugaagaaccuaucccgaugaguacauacggauggaaucuaguuagacuacaaucaggugucgauguuuuuuuuacaccaccagaaaaaugugauacuuuacuaugcgacauaggggagucaaguccgaauccuacgguagaggcugguaggacgcuaagaguguuaaacuugguggaaaauugguugaacaauaacacucaauuuuguauaaaagucuugaauccguauaugccuuccguaauagaaaaaauggaggcgcugcaacggaaauacggaggagcacuuguucggaauccccuaaguagaaacucuacgcaugaaauguacuggguaucuaaugcaucaggaaauauuguauccucgguaaauaugauaagucgcauguugaucaauagauuuacuaugagacauaaaaaagccacuuaugaaccugaugucgaccucgguucugguacuagaaauauagggaucgaaagcgagacaccuaauuuggauauaauaggaaaaagaauugagaagaucaaacaagaacaugagaccaguuggcauuaugaccaagaucacccauauaagaccugggcuuaccauggauccuaugagacuaaacaaacaggaucagcaagcuccaugguaaauggugucguaaggcugcuuacaaaaccaugggacguaauuccuauggugacacaaauggcaaugaccgauacuaccccuuuuggacaacaaagaguauucaaagaaaagguggauacacggacucaagaacccaaagaagguacgaagaaauuaaugaaaauaacugccgagugguuauggaaagaacucggaaaaaaaaaaacgccccgcauguguacucgagaagaauucacaagaaaaguucguucaaaugcggcauuaggagcuauuuuuacggaugagaauaaauggaaaucagcgcgcgaagcgguagaagacagcggauuuugggaacuaguugacaaagagcgcaaccuacauuuggaaggaaagugugaaacauguguuuauaacaugaugggaaagagagagaaaaaacugggagaguuuggaaaagcgaaaggcagucgagcuauuugguauauguggcuuggcgcaagauuucuagaguucgaggcacuaggcuuucuuaaugaggaucacugguuuaguagggaaaauucucuaagugggguugaaggcgaaggucuacacaagcuagguuauauucucagagauguuucuaaaaaagaaggaggagccauguacgccgacgauacugcaggcugggauacucgaauaacauuagaagaucuuaaaaaugaagaaauggucacuaaccauauggaaggagaacauaaaaaacuugcggaagcaauuuuuaagcuuacuuaucaaaacaaaguaguaaggguucaacguccuacaccuagaggcacaguuauggacaucauauccagacgggaucaaagagguaguggucagguugugacauauggucuaaacacauuuacuaauauggaagcacaguuaaucagacaaauggaaggugaagggguguuuaaaaguauccagcagcugacuguaaaagaagaaauugcgguuaaaaauuggcuaauaagaguugggagggagcgccuuucacgaauggccauuucaggggacgacuguguaguaaaaccuuuagaugacagguucgcguccgcacuuacagcacuaaacgacaugggaaaagucagaaaagauauacaacaaugggaaccuagucgaggauggaaugauuggacucaagugccguuuugcagucaccauuuucaugaguugauaaugaaagauggaagaguuuuagugguuccguguagaaaccaagacgaacuuaucggucgagcuaggauaucucaaggggcugguuggagcuuacgcgaaacagcauguuuaggaaagaguuacgcacagauguggucuuugauguacuuccaucggagggaccuaaggcuagcagcgaaugcaaucuguucugccgugccaagccacuggauacccacuagcaggacgacuuggucaauucacgcaacacaugaauggaugacgacggaagacauguuaacagucuggaaucgagucuggauucaagaaaauccuuggauggaagauaaaacccccguagaauccugggaagagauaccguauuugggaaaacgcgaagaccaguggugcggaucguuaauuggucuaacaucccgugcaacaugggccaaaaacauccaaacggcgaucaaucaaguacgaucuuuaauuggaaacgaagaauacacagauuauaugccaaguaugaagagguuucgacgagaagaagaagaagcagguguacuaugguaa

SEQ ID NO: 22250 - RNA, 9876 nt, Artificial Sequence
  derived and/or modified CDS sequence (opt6) from DENV-2__KM279543__SS-prME
acagcuggaauuauuauuaugaugauaccaacaguuauggcauuucaccuuacaacuagaaauggugaaccacauaugaucguuagccgucaagaaaaagggaaaagccuguuauucaaaacagaaaacggagugaauauguguacguuaauggcgauggaucuaggggaacuuugcgaagauaccauuacauauaacugcccacuucuaagacaaaaugaaccugaagauaucgacuguuggugcaauaguacaucgacauggguuaccuauggaacauguacugcaacaggugaacaccggcgcgagaaacguucuguagcguuggugccgcacguagggaugggauuggaaacuagaaccgagacuuggaugagcagugaaggggcauggaaacaugcacagcgaauagaaaccuggauauugagacauccaggauuuacaauaauggcugcaauauuagcauauacgauagggacgacuuacuuucaaagaguacuaauuuuuauauugcuaacagcagugacuccuagcauggcgaugcgauguauaggcauaucaaaucgagacuucgucgaagguguaucagguggaucauggguugauauagucuuagaacauggaaguuguguuacuacaauggccaaaaauaaaccaacguuggacuuugagcuuauuaaaacagaagcaaaacacuuagcaacacugaggaaauauuguguagaggcuaaauuaacaaacacgacaaccgccucgcgaugcccaacgcagggcgagccaucacuaaacgaagaacaggauaaacgguucguguguaaacauucaauggucgacagggguuggggcaacggauguggauuauucggaaaaggaggaauuguaacgugcgcuauguuuacaugcaagaaaaauauggaagggaaaguaguccagccagaaaauuuagaauacacuauaguaauaacaccucauaguggagaagagaacgcuguaggaaacgauacugguaaacaugguaaagaaauaaaaguaacaccccaaaguucaauaaccgaggcagaauuaacgggauacggcaccgucacuauggaauguucaccgcgaacaggacuagacuucaaugaaaugguauuauugcaaauggaaaauaaagcaugguuaguccaucgacagugguuucuagaccucccauuaccuuggcuccccggggcagauacucaaggaucaaauuggauccaaaaagagacgcuggugacauuuaaaaacccucacgccaagaaacaagacgugguaguucuaggaucgcaggaaggagccaugcacacagcgcuaacgggcgcgacugaaauacaaaugaguucuggaaaccuuuuauucacuggacacuuaaaauguagguuaagaauggacaaacuacaacuuaaaggaaugagcuauuccaugugcacggggaaauuuaaaguagugaaagaaaucgcugaaacgcaacaugggaccauaguaauuagagugcaauaugaaggagauggcucuccaugcaaaauaccauuugaaaucauggaucucgaaaagaggcacguacuaggaagacucauuacuguuaacccaaucguaacagaaaaggacucacccguaaauauagaagcugaaccgccguuuggagauagcuacauaauaauugggguagaaccuggacaauuaaaacugaguugguuuaagaaaggcucaaguauaggucaaauguuugaaacaacuaugaggggugcuaaaaggauggccauccuaggagauacagcuugggacuuuggaucacuaggaggaauguucacgucaauuggcaaggcuuugcaccaaguguuuggagcaauuuacggcgcugcauuuucaggaguauccuggacaaugaagauauugauaggaguuguuaucacauggauaggaaugaacucuagaucgacauccuuaucaguaagucucguccucguugggguagucacacuuuaccugggagucaugguacaagcugauagcggauguguaguuaguuggaaaaacaaagaauuaaaaugcgguagcggaauauuuauuaccgauaauguacacaccuggacugaacaguauaaauuucaaccagagucuccauccaaauuagcaucugcuauccaaaaagcacaugaagaagggauaugcgguauuagaucaguuacgagauuagagaaucuaauguggaaacaaauaaccccggaacugaaccacauauugacugagaaugaggucaagcuaacaauaaugaccggagauauaaaaggaaucaugcaagccggcaagcggucauugagaccacaaccaacugaacugaaauauagcuggaaagcauggggaaaagcuaaaaugcuaucuacugaacuacacaaucacacguucuugauugauggcccagaaacugcagaauguccuaacacaaauagggcauggaacuccuuagaaguggaagauuauggguucggaguuuuuacaacgaacauuugguuaaaacuuaaagagcggcaagacguguuuugugauucuaaacuaaugagugcugcuauaaaagauaaccgagcaguacacgccgauauggguuauuggauugagagcgcauuaaacgacacauggaaaauugaaaaagccucauucauugaagucaagucaugucauuggccgaagagucauacacuuuggaguaauggaguguuagaaagcgaaaugauaaucccuaaaaauuucgccggaccagugagucagcauaacuaucgaccuggauaccacacgcaaacagccggaccguggcacuuggggcgccuagagauggauuucgauuuuugcgaaggcacuacgguaguuguuacagaagauugcggaaauagaggcccaucacuacggacgaccacagcaucgggaaaauuaauaacugaguggugcugcagaagcuguacuuuaccaccacucagauauagaggagaagauggaugcugguaugggauggaaauacgaccucuaaaagagaaggaggaaaaccuagugaauaguuuaguuacagccggacacggccaaauagacaauuucagucucggugucuugggaauggcacuauuucuagaagaaaugcuacguacuagaguaggaacgaaacaugcaauucuccuaguagcagugucauucguaacuuugauaacugggaacaugucuuuccgagaucuaggacgaguaaugguaaugguaggagcuacaaugaccgacgacauaggaaugggugugacauaucuagccuugcuugcggcguuuaagguaagacccacuuuugccgcagguuuauugcugcgaaagcugacuagcaaagaacuuaugaugacuacaauaggcauaguguuguuaucgcaaaguaccauaccagagagcauacuugaauuaacagaugcacuggcccuagguaugaugguuuuaaagauaguaagaaacauggaaaaguaucaguuagcaguaacaauaauggcaauauuauguguaccgaaugcaguaauccuucaaaaugcauggaaagugaguugcacgacacucgcaguuguuucagucaguccacuuuuacuaacaaguagucagcagaaagcugacuggauaccacucgcacucacaauaaaagggcugaauccaaccgcgauuuucuugacuacucuaucgcgaaccaguaagaaacgaucauggccguugaacgaagcaauaauggcaguuggaaugguaaguauuuuagcaucaagccuccuaaagaacgauaucccaaugaccggacccuuaguagcaggaggucuauuaacuguauguuauguucugacgggaaggagcgcagauuuagaguuggaacgcgcagcugacguuaggugggaagaacaggccgaaauaucaggcucaucaccaauacucucaauaacaauuucugaagauggaaguaugucaaucaaaaacgaagaggaagaacaaacccucacgaucuuaauacgcacagguuuauuagucaucucuggguuguuuccuguaaguauaccaauaaccgcagcugcgugguaucugugggaaguuaagaaacagagagccgggguucuaugggacguaccaaguccuccaccuguuggcaaggcagaauuagaggacggagcauauagaauaaaacaaaaagguauccuuggauacagccagaucggugcaggggucuacaaagaagggacauuccacaccauguggcacguaacucguggagcgguccuaaugcauaaagguaagcgaauagaaccgucaugggcagacguuaagaaggaucugaucuccuacggaggaggauggaaacuugaaggugaauggaaggaaggagaagaaguacaagucuuagcccuagaaccggguaagaacccaagggcaguucaaacuaaacccggacuauuuaaaaccaacacaggcacaauuggcgcggucaguuuggauuuuagcccagggaccucggguagcccaauaguagauaagaaaggaaaagugguaggcuuauaugggaauggaguagugacgagaucgggaacauauguaucggcaauagcacagaccgagaaaucuaucgaagauaauccugaaauagaagaugauauauuuaggaagaaacgauugacuauaauggaucugcauccaggagccggaaaaaccaaaagauauuuaccugcgauagugcgugaagcuauuaaacgcgggcugaggacuuuaauacuggcaccuacucgagugguagcagcugaaauggaggaagcauuacgaggguugccaauuagguaccagacgccugcaauaagagcggaacauaccgguagagaaauagucgauuugaugugccaugccacuuuuacuaugagguuauuaagucccauacgcguaccaaacuauaaccugaucauaauggacgaagcacauuuuacagacccugcgagcauagcagcgagaggauacaucuccacaagaguggagaugggagaggcugccgggauuuucaugaccgcaacaccuccugguucucgagacccauuuccgcaaagcaaugcaccgauaauggaugaagaaagggagauaccugagcgcaguuggaacucuggucacgaguggguaacagauuuuaaaggaaaaacuguuugguuuguuccuuccauaaaagcugggaaugauauagcugccugucuaaggaaaaauggcaagaaagucauccaauuauccagaaaaacauuugacagcgaauauaucaaaacucggacuaacgacugggacuuuguaguaacaacugacauaagugaaaugggugcaaacuucaaggcugagagaguuauagacccaaggcguugcaugaaaccaguuauauuaacugauggugaggaaaggguuauacuagcuggaccuaugccugugacacauucaucagcggcacaaagacgaggaaggguuggucgaaauccgaagaaugaaaacgaucaauacaucuacaugggugaaccuuuagagaaugaugaagauugcgcacauuggaaagaagcuaagaugcuccuagauaacauuaauacccccgaaggcauaauuccgucuauguuugaaccggaacgagaaaaaguggacgcaauagauggcgaauaucguuuaagaggagaggcaagaaaaacuuucgucgauuuaaugagaagaggugaccuucccguguggcuggcguaccgaguugcagcugaaggaauaaauuacgcagacagaaggugguguuucgauggcgucaaaaacaaucaaauacuagaagaaaaugucgaaguggaaauauggacuaaagaaggcgagcgcaagaaguuaaagccacgcuggcuagaugcacgaauauauuccgauccccuagcgcucaaggaguucaaagaguuugcagcaggacguaaaucacugacucuuaaccuuauuacugagaugggaagacuaccgaccuuuaugacccaaaaggccaaaaaugcccuggauaaucuagcgguucuacauaccgcagaagcaggaggacgagccuacaaucaugcacugagcgagcuaccugaaacgcuagaaacacuguugcucuugacauuauuagccacagugaccggggguaucuuccucuuccuaaugagcggcaaagguauagguaaaaugacacuuggaaugugcugcauaauaacagcuucaauacucuuaugguaugcgcaaauacaaccacauuggauagcggcuucgauaauuuuagaauuuuucuugauaguacuacucauaccugaacccgaaaaacagagaacaccgcaagauaaucaauugacauacguuguuauagcaauacuaacagugguugcugccaccauggcgaaugaaaugggauuccucgagaaaaccaagaaagacuuuggauuggguaguauaacuacgcagcaaccggaaucgaacauucuugauauugaccuuagaccagccuccgcauggacacuuuaugccguagccacaacuuuuaucacuccuaugcuacgucacagcauagaaaauaguagugucaacguaaguuuaacagcuauugcgaaucaggcaaccguauugaugggucuagguaaaggguggccgcuuaguaaaauggauaucgggguaccacuucuagcaauuggguguuacagucaaguaaauccuauuacucucacggccgcauuauugcuccuaguagcucauuaugcaauuauagggccaggguugcaggcaaaagcaacucgagaagcacaaaagagggcagcggcugggauuaugaaaaacccaacaguagacgguaugacugucauagauuuggaucccauccccuaugaucccaaauuugaaaaacaacuaggacaaguaauguugcuuguccuuugcguuacgcaaguuuuaaugaugagaacaacuugggcauuaugugaggcucugacauuagcaacuggaccgaucaguaccuuaugggaagguaacccaggacgcuuuuggaacacgacaauagcaguaagcauggcaaauaucuuucgcggaagcuaccuugcaggagcuggauuguuauuuucaauuaugaaaaacacugcuaauacucguagaggaacaggaaauacgggggaaacacuuggagaaaaauggaaaaacagacuaaacgccuuggguaaaagcgaguuccagauauacaaaaaguccggcauucaagaaguugaccggacacuggccaaagaaggaauaaaaaggggagaaacggaucaccaugcaguuagcagagguucagccaaguuacguugguuuguagaaagaaauuuaguuacaccagaagguaaaguugucgaucuaggauguggucgaggagguuggucuuacuauugugguggacuaaagaacguuaaagagguuaaagggcuaaccaaaggugguccuggccacgaggaacccauuccuaugucgaccuauggauggaacuuaguucgccuacaaucuggaguagacguuuucuuuacacccccggaaaaaugcgacacacuauugugugauaucggagaaagcagcccaaacccaaccguagaagcuggaaggacacuuagaguuuuaaaccuaguagaaaauuggcuaaauaacaacacacaauucuguauaaaagugcugaauccauauaugccauccguaauagagaaaauggaagcucuacaaagaaaauauggaggcgcccuuguucgaaauccauuaucacguaauucgacacacgaaauguacugggugagcaacgcgagcggaaauauaguuucaaguguaaacaugauuagucguaugcuaaucaaucgauuuacgaugcgacauaaaaaggcaacguaugaaccggacguggaccuugguaguggaacuagaaacauaggaauagaaagcgaaacuccaaaucuggacauaaucggaaagcgcauagaaaagauuaaacaggaacaugagacuucauggcacuacgaccaggaccauccuuauaaaaccugggcuuaccaugguucuuaugaaacaaaacaaacaggaucagcaucaucgauggugaacgggguaguucgacuguuaacuaaacccugggauguuauaccaaugguuacacagauggcuaugacggacacaacaccguuuggccagcagaggguuuucaaagaaaaagucgauacucgaacccaagaaccaaaagagggcaccaagaaauugaugaaaaucacugcagaaugguuguggaaagaauugggcaagaaaaagacuccaaggauguguacgagagaagaguucacacggaaaguacggucuaaugcugcguugggagcaaucuucaccgaugaaaauaaguggaaaucagcacgcgaggcaguagaagauucuggguuuugggaauugguugacaaagagcgaaacuuacaccuggaaggaaaaugugaaacauguguguauaauaugaugggaaaacgcgaaaagaaguuaggagaauuuggcaaggcuaaaggaucucgagcgauaugguauaugugguuaggagcaagauuucucgaguuugaggcuuuaggguuccuaaaugaagaucacugguuuagccgagaaaauucucucucaggcguggaaggagaaggucuacauaaacuaggauacauccuaagagaugucaguaagaaagaaggcggagcaauguacgcagaugacacagccgguugggauacucgaauaacguuagaggaucuaaagaacgaggaaaugguuacuaaucauauggaaggggagcauaagaaacuggcugaggcaauuuucaaacugaccuaucaaaauaaaguagucagaguucagagaccaacgccacgaggaaccguuauggacauaauaaguagaagggaccagcgaggaaguggucaagugguaacguacggacuuaauacguuuaccaauauggaggcgcaacuaauacggcaaauggagggggagggaguuuuuaaguccauacaacaauuaacaguaaaggaggaaauagccgugaaaaauuggcuaauacgaguuggaagggaacgacuuagcagaauggcuaucagcggcgaugacugcguugucaagccguuagaugauagauuugcuagugcccuaacagcauuaaacgauauggguaagguacggaaggauauucagcaaugggaacccaguagagguuggaacgacuggacucaagugcccuuuuguagccaccacuuccaugaacuaaucaugaaggauggccgcguauuaguggucccaugcagaaaccaggacgaauuaauaggccgcgcacguaucagucaaggggccggguggucguugagagaaaccgcaugucuaggaaagaguuacgcacaaauguggucuuuaauguacuuucaccguagagaucuucgacucgcugcaaaugcgauauguuccgcaguaccaucacacuggaucccgacauccagaacaacauggucgauucacgcaacccaugaauggaugacaacugaggauauguuaaccguguggaaucgcguuuggauucaagaaaacccuuggauggaagauaaaacuccgguagaauccugggaagaaauaccuuauuuaggaaaaagagaagaucagugguguggauccuuaauaggacuuacuucuagagcuacaugggccaaaaacauacagaccgcaauaaaucaaguacgaagccuuauugguaacgaagaauacacagauuacaugccuagcaugaaaagauuucgaagggaagaggaagaggcugguguacucugguga

SEQ ID NO: 22251 - RNA, 9876 nt, Artificial Sequence
  derived and/or modified CDS sequence (opt6) from DENV-2__KM279571__SS-prME
acugcggguaucauuauaaugaugauuccgacaguaauggcuuuccaccuuaccaccagaaacggugaaccacacaugauuguuucaagacaagaaaaaggaaaaaguuuguuauuuaaaacagaaaauggaguuaacaugugcacauugauggcaauggaccuuggugaacuaugcgaagacacuaucacguacaacugcccgcuauuacggcaaaaugaaccagaagauauugacuguugguguaauucaacaaguaccuggguaacuuaugguacgugcaccgcuacaggagaacaccguagagagaaaagaucaguagcgcuaguaccacacgugggaaugggacuagaaacucggacugaaacauggauguccucugaaggagcuuggaaacaugcgcaaaggaucgaaacauggauacuacggcacccaggcuucaccauaauggcggcaauacuagcauauacaaucgggacaacguauuuccaacgugucuuaauauuuauacugcucaccgcaguuacaccaucaauggcgaugagauguauagggauuucaaauagagacuuugucgaaggaguuagcgggggauccugggucgacaucguuuuagaacacggaagcuguguaacuacuauggccaaaaacaaaccaacauuagauuuugaauuaauaaaaacggaagcaaaacaucuggcgacucuaagaaaauauuguguagaagcaaaauugacgaacacuacgaccgccucucggugcccaacgcaaggggagccaaguuuaaacgaggaacaagauaaacgauucguaugcaaacauucgaugguagaccgugguuggggaaacgguugcggguuauucggaaaagggggaaucguaacaugugccauguucacuugcaagaaaaauauggaggguaaagucgugcaaccggagaauuuagaguauacaauuguaauaacaccgcacucaggcgaggaaaacgcaguuggaaaugacacugguaaacacgggaaagaaauaaaaguuacaccacaaucaaguauaacagaagcggaacugaccgguuauggcacaguaacaauggagugcaguccgagaacaggguuggacuuuaacgagaugguucuacuucagauggaaaacaaagcauggcuaguacacagacagugguuucuagauuuaccgcuaccguggcuccccggagcagauacacaggggucuaauuggauucagaaagaaacacucgugaccuuuaaaaauccacaugccaagaaacaagaugucguaguucuuggaucucaagaaggagcaaugcacacagcucugacuggcgccacagaaauccaaauguccucugguaacuugcucuuuacaggacaccucaaaugcagacucagaauggauaaauugcaauugaaaggaaugagcuacucaauguguacaggaaaauuuaaagugguaaaagaaauagcagaaacacaacacggaacgauaguaauccgagugcaauacgaaggugauggcuccccauguaaaauaccuuuugaaaucauggacuuggagaaacgacacguguugggacgacuaauuaccgugaaccccaucgucacagaaaaagauucaccuguaaacauagaagcagaaccuccuuucggggauuccuauauuauaaucggcguagagccaggccagcuaaaacuaucgugguucaagaaagggagcaguauaggccagauguucgaaacaacuaugagaggagcuaaacguauggcaauucuaggcgauacagcuugggauuuuggcucuuugggugggguauuuaccaguaucggcaaagcacuucaucaaguuuuuggugcaauuuauggggccgcauuuaguggcgugucauggacaaugaaaauccuuauagguguagugaucacauggaucgggaugaauagccguucuacaucgcuauccguuucauuaguucuuguggggguuguaacgcucuacuuagguguaaugguccaagcagauucaggcuguguagugaguuggaaaaauaaagaauuaaaaugcgguucaggaaucuuuaucacagauaauguacauaccuggaccgagcaauacaaauuccagccagaaucuccaagcaaauuagcgagugcaauacaaaaagcucaugaagaaggaauuugugguauacgaagcguaacaagacuugaaaaucuaauguggaaacaaauuacuccagaauuaaaucacauacuuacagagaacgagguuaaauugaccaucaugacaggcgacaucaaagguauaaugcaggcggguaaacgaacauugagaccucaaccuacagaauuaaaauacucauggaaagcaugggggaaagcuaaaaugcuuucuacggaguuacauaaucacacguuucuaauugacggacccgaaacugccgagugcccuaacacgaauagggcguggaacaguuuagaaguugaagauuaugguuucgguguauuuaccaccaauauaugguuaaaacuaaaagaacgccaagacguauucugugacuccaaauuaaugucagcagccauuaaagauaaccgugccguucaugcagauaugggauacuggauugaauccgcccuaaaugauacauggaaaauugaaaaagcaucuuuuauagaaguaaagucaugucauuggccgaagucacauacucuuuggucuaacggagugcuugaaagugagaugauuauucccaaaaauuucgccggcccaguaucacagcacaauuaucgaccagguuaucauacacaaacagccggaccauggcaccuuggaagguuggagauggacuuugauuuuugcgaagggaccacuguagucgucacagaagacugugguaaccgcgguccaaguuuaagaaccacuaccgcuuccggaaaacuuauaacugaauggugcuguagaaguuguacauuaccuccgcucagauacagaggagaagacggauguugguauggaauggagauaaggccauuaaaagaaaaagaagaaaaccugguuaauaguuuaguuacagccggccacgggcagauugauaacuuuucccuagguguacuaggcauggcguuauuucucgaagaaauguuaaggacccgcguaggaacaaaacacgcaauacucuuaguagcgguaaguuucguaacguugauaacaggcaacaugucauuuagagauuuaggacgaguuaugguaaugguuggagcgacuaugacugaugauauaggaaugggaguuacauauuuggcuuuacuggcagcauucaaaauaaggccgacguuugcagcaggauuacuuuuaaggaaauugacaagcaaagaacucaugaugaccaccaucggaauaguucuacuuucacagaguacaauccccgaaucaauacuagaacuaacugaugcguuagcccucgguaugaugguacuaaaaauuguacguaauauggaaaaauaccaauuagcaguaacgaucauggcaauauugugcguuccaaaugcagucauauuacaaaacgcuuggaaagucagcugcacaacucuagcagucgugucaguaucgccgcuucuguuaacaagcagucaacaaaaagccgauuggaucccacuagcguuaacaauaaaaggauugaauccuacagcaauuuucuuaacaacguuaucaaggacaagcaagaaaaggaguuggccauuaaaugaagcaauaauggcagucggcaugguuaguauucuagcaucaucguuauuaaagaaugauaucccaaugacaggacccuugguggcuggaggucuauuaacuguaugcuacguacuaacgggucgaagugcagaucuggagcuagaacgagccgccgacguaagaugggaggaacaggcugaaauuucaggcaguucaccuauauugucgauuacgaucagugaagacgguuccaugucuaucaagaaugaagaagaagaacaaacguuaacaauauuaauccgaacuggacuuuuggucauaagugguuuguuuccggugucuauaccaauuaccgcugcagcuugguauuuaugggaggugaaaaagcagcgugcaggaguacucugggacguuccaaguccuccuccuguugguaaagcagaauuagaggauggcgccuaccgaauuaagcaaaaagguauucucggcuauucucaaauaggugcgggcguauauaaagaagguaccuuccacacgauguggcauguuacucgcggagcugugcuaaugcacaaagggaaaaggauugaaccaaguugggcagauguuaagaaagaccuaauaagcuauggugguggcuggaaacuagaaggugaauggaaagaaggggaagaaguccaaguguuagcauuggaaccagggaaaaacccacgagcuguacaaacuaaaccuggcuuauucaaaacaaacacugggaccauuggagcugugucauuagauuuuuccccugggacgucugguucaccaauuguggacaagaaaggcaaaguggugggcuuauacggcaacggagucgucacgagaucgggaacguauguaagugcaauugcccaaacggagaagaguauugaagacaacccugaaaucgaagacgauauauuuagaaagaaaagauugacuauuauggauuuacauccgggggcggguaaaacgaaaagauaccuaccagcuauaguacgcgaagccauaaaaagaggucugagaacguugauauuagcgccgacaagaguagucgcugcagaaauggaagaagcacuacgaggucuaccaaucagguaccaaacgccagcgaucagggcggaacauacuggaagagaaauugucgauuuaaugugucaugcgacauuuacaaugaggcuacuaaguccaauuaggguacccaauuacaauuuaaucauaauggacgaggcgcacuucacggauccagcaaguauagcugcccgaggauacauaagcacaagaguagaaaugggagaggcagcugguauauuuaugacugcaacuccaccaggauccagagauccauuuccucaaucuaacgcaccaauuauggacgaggaaaaggaaauuccugagaggaguuggaacucaggccaugaaugggugacugacuuuaaaggcaaaacaguaugguuuguaccgagcauuaaagcugggaacgacauagcagcguguuuaaggaaaaacgguaagaaaguaauccaguuaucaagaaaaacauuugacucagaauauauuaaaacacguacaaacgacugggacuucguugugacuacagacauuuccgaaaugggggcgaacuucaaggcugaaagggugauagauccgcggagauguaugaaacccguaauauugacagauggugaagaacgaguuauacuugcugggccaaugccaguaacacauucaucggcagcacaacguagaggccggguaggucguaaucccaaaaaugaaaacgaucaauacaucuauaugggugaaccccucgaaaacgaugaagacugugcccauuggaaagaagcuaaaaugcuauuagauaacaucaauacgccagaaggaauaauaccgaguauguuugagccagaacgugaaaagguagaugcaaucgauggagaauaccgucugaggggugaggcucggaaaacauuuguagaucuaaugcgucgcggggaccuaccaguaugguuagcuuauagaguagcggcagaagguaucaauuaugcugauaggaggugguguuuugauggagucaaaaauaaccaaauacuagaagagaauguugaaguggagauuuggacgaaagaaggggaaagaaagaaacuaaagcccagauggcuagaugcgcguauauauucagauccucuugcacuuaaagaguuuaaagaauuugcugccggaagaaagucucugacauuaaauuuaaucacagaaaugggaagauuaccuacguuuaugacgcagaaagcaaagaaugcacuagauaaucucgcaguguuacacacggcugaggccggaggccgugccuauaaucaugcacucucagaacuaccugaaacauuggaaacuuugcuucuacuuaccuugcuagcuacaguuacaggagguauauuuuuguucuuaaugucugguaaagguauugguaagaugacucuaggaauguguugcauaauaacggcaaguauccuucuaugguaugcccaaauccaaccacauuggaucgcugcaucaauaauuuuagaauuuuucuuaauaguucuccuaauaccggaaccggaaaaacagagaacgccacaagacaaucaauuaacuuauguaguaauagcuauucuaacaguuguugcggcaaccauggcgaacgaaaugggauuuuuagagaaaaccaagaaagacuuuggucugggaaguauaacgacccaacaaccagaaucaaauauucuugauaucgaucuacguccggccuccgccuggacuuuauaugcuguugccacaaccuuuauuacaccgaugcuaagacauucuauagaaaauucaucgguaaacguuuccuugaccgcuauugcuaaccaagcgacaguucuaaugggacuaggaaagggcuggccgcugaguaagauggauauagguguaccucuauuagcaaucgguuguuauucucaggugaaccccauuacgcuaacggcugcucucuuacuucuaguagcucauuacgcgauaauuggaccaggucuacaagccaaagcgacaagagaggcgcaaaagcgcgccgcagccggcauaaugaaaaaucccacgguagauggcaugacagucauugaccuggaucccauaccguaugauccaaaguuugaaaagcaauugggacaaguaaugcuccuagugcugugugugacucaagucuuaaugaugagaacaacuugggcgcuaugcgaggcuuuaacauuagcaacgggcccaauaagcacacuaugggaaggcaaccccggaagauucuggaauacaacuauagccgugagcauggcaaacauauucagagguucuuaucucgcuggagcggguuuacucuucaguaucaugaaaaacacugccaacacgagaaggggaacuggcaauacuggagaaacauuaggcgagaaauggaaaaaccgauugaaugcacugggaaaaagcgaguuccaaauauauaagaaaucaggaauccaggaggucgaucguacuuuggcgaaagagggcauaaagagaggggaaacagaccaucacgcaguaagcagaggaagugcuaaacuacguugguuuguagagagaaacuuggugacaccugaagguaaaguagucgaccuugguugcggacgcggaggguggucuuauuacugcggaggacucaaaaacgucaaagagguaaagggacuaacgaagggcggaccaggucaugaagaaccaauaccaaugaguacuuacggguggaaucuaguucgccuacaaucagggguagacguauucuuuacgccuccugaaaaaugugauacgcuuuugugugauaucggagaaagcucaccaaacccaacaguggaagcaggcagaacacuucgaguguuaaaccugguugaaaauuggcucaauaauaauacgcaauucuguauuaaaguauugaaucccuauaugccaucaguuauugagaaaauggaggcacuucaacgaaaauauggcggugcccuaguaagaaaucccuuaagccgcaacagcacgcacgagauguauugggugucaaaugcaucuggcaacauaguuucuucuguuaauaugauaucuagaaugcuaauuaaccguuucacaaugaggcauaagaaagcaacguaugaaccagauguagacuuagguuccgguacaaggaauauaggcauagaaagcgagacuccaaaucucgauauuauaggaaagcgaauugagaaaauaaaacaagagcaugaaaccagcuggcauuaugaccaagaccacccuuacaaaacaugggcauaccauggcucuuaugagaccaagcaaacuggaucagccucaaguaugguaaacggaguugucagguuacuuacaaaaccaugggauguuaucccaaugguaacucaaauggccaugaccgauacgaccccauucgggcaacagagggucuucaaggaaaaaguagacacucggacacaggagccgaaggaaggcacgaagaaauuaaugaaaauuacagcagaauggcuauggaaagaacuaggaaagaagaaaacuccacgaauguguacaagagaagaguucaccaggaaaguaaggucaaaugcagcacuuggugccauauucacagaugagaacaaauggaaaucagcccgagaagcuguggaagauagcggguuuugggaauuaguugacaaagaaagaaaccuccauuuagaagguaaaugcgaaacauguguguacaacaugauggggaaaagagagaagaaacuuggcgaauuuggcaaagcaaaaggcucaagggcuauaugguauaugugguuaggcgcuagauuccucgaguucgaagcauuagguuucuuaaaugaggaccauugguucagucgugagaacucccuauccggaguugaaggagaaggacuucauaaacuagguuauauccuuagagacguaaguaagaaagaagggggugcuauguacgcugaugacacggcagguugggacacucguauuacacuggaggauuuaaagaacgaggaaaugguuacaaaccauauggagggagagcauaagaaacuggccgaggcaauuuuuaaguugacauaccaaaacaaagugguacgaguacagcgacccacaccacgagguacggugauggacaucauuagucggagagaccaacgggguuccggucaagucgucacauacggacuuaauacguuuacuaacauggaagcacaauugauacgccaaauggaaggagagggaguauuuaagaguauacagcaauuaacgguuaaagaagaaaucgcgguuaaaaacugguuaauccgcguaggcagagagagauugucaagaauggcaaucucuggagaugauugcguuguaaaaccucuggacgaucguuuugcuagugcauuaacggcucucaaugauaugggaaaaguuagaaaggauauacaacagugggaaccaucuagaggauggaacgacuggacacaaguucccuuuuguucucaucauuuucaugaguuaauaaugaaggauggaaggguguuggucgugccuuguagaaaccaagaugagcuaaucggucgugcaagaauaucucaaggagcggguugguccuuaagggaaacggcuugccucggaaaaaguuacgcccaaauguggaguuugauguacuuucauagacgagaucuccgacuagcugcgaacgccauuuguagugcagugccuagucacuggauuccaacaaguaggacgacguggucaauccaugcaacacaugaauggaugaccacagaagauaugcuaacgguuuggaacagaguuuggauucaagaaaauccuuggauggaagauaagacaccaguugaaaguugggaagaaauaccuuaccucggaaagagagaggaccaauggugugggucacuaauaggacugaccagucgcgcuacuugggccaaaaacauucagaccgcgauaaaucaaguuagaucauuaauagguaaugaagaauacacugauuacaugccuucgaugaagcgguuuagaagagaagaggaagaagccggaguucuaugguaa

SEQ ID NO: 22252 - RNA, 9876 nt, Artificial Sequence
  derived and/or modified CDS sequence (opt6) from DENV-2__KM279544__SS-prME
accgcggggauaauaauaaugaugauuccaacaguaauggccuuucauuuaacuacucguaauggugaaccacacaugauaguaagucgacaagaaaaaggaaaaaguuuauuauuuaaaacagaaaacgguguuaacaugugcacacuuauggccauggaucuaggggaauuaugcgaagauacuaucacuuauaauugcccucuacuacgacagaacgaaccugaagacauagacuguuggugcaacaguaccaguaccuggguaaccuauggaacauguacagcuacuggagaacaccguagagaaaaacguagcguggcgcuaguuccacacguugguaugggcuuagaaacccgaacugaaacauggaugucuucugaaggugcguggaaacaugcccaaagaauagaaacauggauacuuagacauccagguuuuaccaucauggcggcaauccuagcauacacaauaggcaccacuuauuuucagagaguccuaauauucauucuauugacugcaguaacuccgucaauggcaaugcgaugcauagguaccaguaauagagacuuugucgaagguguaucaggcgguucauggguugacauagucuuagaacauggcucgugugugacaacaauggcuaaaaauaaaccuacccuugacuucgaauugaucaaaaccgaagccaaacaucuagcaaccuuaagaaaauacuguguggaagcaaaauuaaccaauacaaccacggcuucccgaugucccacucaaggcgaaccaucauugaaugaagaacaagauaaacgauucguauguaaacacaguaugguagaucgagggugggguaacggauguggacuauuuggcaaaggagggauuguaaccugugcaauguuuacuugcaagaaaaauauggaaggaaaaguaguacaaccugagaaccuagaauauacgauaguuauuacuccacauucaggugaagaaaaugcuguuggaaaugauaccgguaaacauggaaaagaaauaaaagucacuccgcagagcagcauuacagaggcugagcuaacgggcuauggaacaguuacgauggaauguucuccgaggacuggauuagauuucaaugaaaugguacuacuucaaauggaaaacaaggcuuggcucguacacagacaaugguucuuagaccucccauuaccauggcuuccaggagcagauacacaaggaucuaacuggauacaaaaagaaaccuuggucacauucaagaauccccacgccaagaaacaggaugucguuguuuuagguucccaagaaggugcuaugcacaccgcguugacaggagcuacugaaauccaaaugaguucgggcaaucuuuuguucacaggccaccuaaaguguagacuaaggauggauaaauuacaauuaaaagguaugucguacaguaugugcacaggaaaauucaaagugguaaaagaaauagcagaaacacaacaugguacaaucguaauucggguacaauaugaaggagauggaucgccauguaagaucccauuugaaauaauggaucuggaaaaacgacacguacuuggucgauuaauaacaguaaauccaaucguaacagaaaaagacucccccguuaauauagaagccgaaccgccuuuuggugacucuuauauaauaauagguguagaaccgggucaauuaaaacucagcugguuuaagaaaggaucaucaaucgggcaaauguuugaaacaacaaugcguggugcaaaaaggauggcaauacuuggcgacacagcgugggauuucgggucauuaggaggcauguuuacgucuaucggaaaagcgcuucaucaaguuuuuggggccauauauggagccgccuuuucuggagugucuuggaccaugaaaauccuuaucggaguuguuauaacuuggauaggaaugaacucgagaagcacuucucucagcguaucauugguauuaguaggcguagugacuuuauaucuuggggugaugguacaagcagauucaggauguguuguaucuuggaaaaacaaagaacuaaaaugcggcucuggcauauuuaucacagacaacguucauacuuggacugagcaguauaaauuccaaccggagucgccaucgaagcuagcuagugccauucaaaaagcgcacgaagaaggaauuugugguauccgaucagucacgcgacuugaaaaccuuauguggaaacaaauaacaccugaauuaaaccacauuuuaacagaaaaugaaguaaaacuuacaaucaugaccggagacauaaaaggcauuaugcaagccggaaaaaggucacugcguccucaaccaacugaacugaaauauaguuggaaagcaugggguaaagcaaaaauguuaucaacugagcuccauaaucauacauuucucaucgacgggccugagacugcugaauguccaaauacaaaucgggcguggaacucauuggagguagaagauuauggauuuggcguuuucacuacaaacauaugguuaaaacuaaaagagagacaagaugucuuuugugacucuaaacuuaugucagcagcaauuaaggauaauagagcaguacacgcagauaugggcuacuggaucgaauccgccuuaaacgauacguggaaaauagaaaaagccucauucauugagguuaaaagcugucauuggccuaaaagucacacuuuaugguccaaugguguacuagaaagugaaaugaucauacccaaaaauuuugccggaccaguuucgcaacacaauuaucgaccagguuaucauacccaaacggcaggaccauggcaucucgguagauuggaaauggacuucgauuucugugagggcacaacuguuguugucacagaagauugcggcaaccgaggcccaucuuugcggaccacuaccgcuagugguaaauuaauaacggaaugguguugucggaguuguaccuuaccaccacuaagauaccguggagaagauggaugcugguacgguauggaaauuagaccccuaaaagaaaaggaagaaaacuuaguaaacaguuuggugacggcagggcacggacaaauagauaauuucucucuagguguacuaggcauggcccuauuccuugaagaaauguuaaggacuagagucgguaccaagcacgcuauuuugcuuguagcuguuuccuuuguuacuuuaaucacuggaaacaugucauuucgagaucuagggagaguaaugguuauggugggagcaacuaugacagaugauauaggcaugggagucacuuaucuggcacuucuggcugcuuuuaagguccgaccaacguuugcagcaggauuacuuuuacguaaacugacgaguaaagaacuuaugaugacuacaauagguauaguauuauuaucacaaaguacaauucccgagucaauacuagaauuaacagacgcacucgcuuuaggaaugaugguuuuaaaaauugugcguaacauggaaaaguaccagcucgccgucacaaucauggcaauuuuaugcguuccuaaugccguaauacuucaaaacgcuuggaaaguguccugcacaacauuagccguugucucaguaucuccucuauuauuaaccucuagucaacaaaaggcugacuggauaccacuggcuuuaacaaucaaaggguuaaauccaacggcgauauuuuugacaacuuugaguagaacaagcaagaaaagaaguuggccuuuaaaugaagcaaucauggcgguggggaugguaaguauauuagccuccucacuacuuaaaaaugauauaccuaugacggggccuuuaguagcggguggguuguugacggucuguuacguuuuaacaggaaggagcgcagaucuggagcuugaacgugccgcugauguucguugggaggagcaagccgaaauuucugguucauccccaaucuuaaguauuacaauuuccgaagaugggucuaugaguaucaaaaaugaagaggaagaacaaacucugacaauacuaauaaggacgggacuuuuagucaucucggguuuauuucccgucucgauuccuauuacggcggccgcuugguacuuaugggaagugaaaaagcagcgagcuggaguguuaugggacguuccaagcccgccuccuguaggaaaagcagaacuggaagacggugcauauagaauaaagcagaaaggcauucuuggauauagucagauaggggcaggagucuacaaagagggaacguuccauacaauguggcauguuacaagaggagccguuuuaaugcauaaagguaaaagaauagaaccaaguugggcugauguuaagaaagauuuaauaucuuacggaggcggauggaaacuugaaggcgaguggaaagaaggggaagaggugcaagugcucgccuuagagccuggaaagaacccuagagcgguucaaacgaaaccagguuuauuuaagacuaauacgggaacgauaggagcuguuagucuugauuuuaguccagguacuucugguaguccgaucguagauaaaaagggaaaaguagucgggcucuaugguaaugguguaguaacccgaucagguacauaugucagcgcaauugcacagacugagaagucaaucgaagacaaucccgaaauagaagacgauauauucagaaagaagagacuaacaauuauggauuuacacccuggggcggguaaaacgaagcgguacuuacccgcuauuguaagagaagcgauuaaaagaggacuccggacccuuauacuagcucccacacgagugguagcagcagagauggaagaagccuuacgcggccucccuauaagauaucaaacaccggcgauucgugcugaacacacaggaagagaaauaguagauuugaugugucaugcaacuuucacuaugagauugcuaagcccuauacgagugccaaauuauaauuuaauuaucauggaugaagcacacuucacagaucccgccucuauugcagccagaggauacauaucaacaagaguugagaugggugaagccgcggguauuuuuaugacagcaacaccgccugggagcagagauccuuuuccacaaaguaaugcaccgaucauggaugaagaaagagaaaucccugagcguucguggaacucaggacacgaauggguaacggauuuuaaagggaaaacuguuugguuuguaccuucaauaaaagcagguaaugauauagcugccugccuaaggaaaaaugguaaaaagguaauccaauuaucaagaaaaacauuugauagugaguacaucaaaaccagaacaaaugauugggauuuuguaguaaccacggauauuagcgaaaugggagcaaauuucaaagcagaacggguaaucgacccacgucgcuguaugaaaccggugauauugaccgauggugaagaaagagucauccuagcaggcccaaugccuguuacacauucgucugcagcucaacgacgaggcagggugggucgcaacccgaagaaugaaaaugaccaauacauauauaugggagaaccacuugaaaacgaugaagauugugcccacuggaaggaagcuaaaauguugcuagauaauauaaauacaccugagggaauaauucccuccauguucgagccugaacgagaaaaaguggacgcuauagacggagaauacagacuucgaggagaagcacgcaaaacuuucguagaccuaaugaggcgaggcgaucucccaguuuggcuagcguauagaguagcugcugaaggaaucaauuacgcugaucguaggugguguuucgacggagucaaaaauaaccaaaucuuagaagaaaauguagagguagaaaucuggacaaaggagggugaacggaagaaauuaaaaccacguugguuagacgcccgaauuuacucggauccacuagcgcugaaagaguucaaagaguucgcugcgggacgaaaaagucuaacacuaaacuugauuaccgaaauggguagauuaccuacauuuaugacgcaaaaagcuaagaaugccuuggauaacuuagcgguauuacauacagcugaagcaggcggcagagcuuauaaucacgcccucagugagcugccggagacauuagaaacgcuuuuacuccuaacuuuauuagcaacgguuacugguggaauauuuuuguuccucaugucugguaaggguauagggaaaaugacucucgguauguguugcaucauaacggcaucaauauugcugugguaugcccagauacagccacacuggaucgcugcauccauaauacuggaguucuuccuuauuguacuauuaauaccugagcccgaaaaacaaaggacaccucaggauaaccaauuaacuuaugucguuauagcuauuuugacuguaguugcagcaacgauggcaaacgaaaugggguuuuuggagaaaaccaagaaggacuucggucuaggaaguauuacaacgcaacaaccugaaaguaacauauuagauauugaucuccgccccgcaagugcauggacuuuauacgcaguggccacaacauucaucacgccaaugcuccgacauagcauugaaaauucgaguguaaauguuagcuugacugcgauagccaaucaagcuacuguguuaaugggccugggaaaaggauggccauuauccaaaauggacaucggaguuccucuccuagcaauugguuguuauagccaaguuaauccaauuacccuuacugcagcguuguuacuauuaguugcucauuaugcuauaaucgguccgggguuacaagcaaaagcaaccagggaagcgcagaaaagagcugcagccggaauaaugaaaaacccgacaguagacggaaugacgguaauagauuuagauccuauacccuacgacccaaaauuugaaaaacaacuaggucaaguaaugcuucugguuuuauguguaacacaaguacuuaugaugcgaacaacaugggccuuaugcgaagcucuaaccuuagccacuggaccaaucagcacucuaugggagggaaauccaggaagauuuuggaauacgacuaucgcagucagcauggccaacauuuuucggggguccuauuuagccggagccggucugcuauuuuccauaaugaaaaauacagcaaacacccggaggggcaccggaaauaccggagaaacguuaggggagaaguggaaaaaccgcuugaacgcguuagguaaaagcgaauuucaaauauacaaaaaguccggaauacaagaaguagauagaacauuagccaaagaaggaaucaagagaggugaaacagaccaucaugcaguaucuagagggucagccaaguuacgaugguuuguagaaagaaaccuaguuacgccagagggcaagguaguugaccuuggcugcggaagaggcggauggaguuauuauugcggaggacucaaaaaugugaaggagguaaaagguuugaccaagggaggaccaggccaugaggaacccauaccaaugaguacauauggauggaaccuagugcguuuacaaaguggaguugacguguucuuuacacccccugagaaaugcgacacccugcugugugacauaggugaauccucuccaaauccaaccgucgaagcaggaagaacucugagaguacuuaaccuggucgaaaacuggcugaacaauaauacccaguuuuguauaaagguucugaauccguacaugcccagcguaaucgagaaaauggaggcguuacaaagaaaauacggcggggcucuggugcgaaaccccuuaucaagaaauucuacgcaugaaauguacugggucaguaacgcuuccggaaauauaguuaguagcguaaacaugauaagucggaugcuaaucaaccguuuuaccaugcgacacaagaaagcgacauaugagccagauguugaccuagggucaggaacaaggaacaucggcauugaauccgaaacgccuaauuuggacauuaucggaaagcgcauugagaaaauuaaacaagagcaugaaacaucuuggcauuaugaucaagaucauccauauaagacuugggcauaucaugggucguaugaaacaaaacagacgggaucagcaagcaguauggugaauggaguaguacgacuacucacuaaaccgugggacguaauuccaaugguaacccaaauggccaugaccgauacuacgccauucggacaacaacgagucuucaaggaaaagguugauacgcguacacaagaaccaaaagaagguaccaagaaacugaugaaaauaacagcugaaugguuauggaaagaacugggaaagaagaagacaccaaggauguguacaagagaagaauuuacuagaaagguccggagcaaugcagccuuaggcgcgauauuuacagacgaaaauaaauggaaaucagcaagagaagccguagaagacuccggauuuugggaguuaguugauaaagaaagaaauuuacaucuagaagguaaaugcgaaacguguguguauaacaugaugggcaaaagagaaaagaaacuaggagaguuuggaaaggcaaaaggaaguagagcuauaugguauaugugguuaggagcgagauuccuggaguuugaagccuuagguuucuuaaaugaggaucauugguuuucucgugaaaauucucucucugggguagaaggugaaggauuacacaaacuaggguauauauuacgggacgugucuaagaaagaaggaggugcgauguaugcagaugacaccgcaggcugggacacaagaauuacuuuagaagaucuuaaaaacgaagaaaugguaacuaaccauauggaaggagaacauaagaaacuagcugaggcaaucuucaagcuaacauaccaaaauaaagucguacgcguacaaagaccaacuccaagaggaacaguaauggauauaauaaguagaagagaccaacgaggauccggccaggugguaacuuauggcuuaaauacauuuacuaacauggaggcacaauuaauacgucaaauggagggcgaagguguauuuaaaaguauacagcagcuaaccguuaaagaagagauugcugucaaaaauuggcuaaucagaguggggcgugaaagguuaucaagaauggcuauuaguggcgaugauugcgucguaaaaccguuggacgauagauuugcgagugcauugacagcuuuaaacgauauggggaagguacgcaaagauauacaacaaugggagccguccagaggauggaaugauuggacccagguaccauuuugcucacaucauuuucaugagcuaauaaugaaagacgguagagucuuaguugugccaugucgaaaucaagacgaauuaauagggcgagcacgcaucagucaaggagcuggauggaguuuacgugaaacagcuugccuuggaaaaucauaugcacaaauguggagccucauguacuuccaccgacgcgacuuaaggcuagcugcuaacgcaaucugcucagcagugccgagucacuggauuccuacgucgagaacaacauggaguauucaugcgacacaugaauggaugacuacagaggacauguuaacuguuuggaacagaguauggauucaggaaaauccauggauggaagauaagacauuaguggaaucaugggaggaaauuccauaucuaggaaaaagggaagaucagugguguggaucauuaauagggcucacuucacgggcuacaugggcgaagaauauacaaacggcuaucaaccaaguacgaucucuuauaggaaaugaagaauacacugacuauaugccgaguaugaaacgcuuuagacgagaagaagaggaagcaggaguuuuaugguag

SEQ ID NO: 22253 - RNA, 9876 nt, Artificial Sequence
  derived and/or modified CDS sequence (opt6) from DENV-2__KM279549__SS-prME
acagcagguaucauaaucaugaugauucccacuguuauggcauuccaccuaacaacaagaaauggagaaccucauaugauuguuagcagacaagaaaaaggaaaaucgcugcuuuucaaaacggaaaauggggugaacauguguacauuaauggcgauggaccuaggcgaauuaugugaagacacuauaacguauaacuguccauuacuucgucaaaacgaaccagaagauauagacuguugguguaauaguacaaguacaugggugacauacggaacauguacagcgacaggcgaacauagacgagagaaacgcucgguagcgcuaguaccccacguuggcaugggacuagagacaagaacagaaacauggaugaguucagagggggcuuggaaacacgcucaaagaauagagacauggauucuacgacauccaggauucacaauuauggcagcgaucuuagcuuauacuaucgggacaacauacuuucaacgaguacuaauuuucaucuuacugacagcaguaacuccaagcauggcuaugcgauguauagguauauccaaucgagauuuugucgaaggcguaucuggugguaguuggguugauauuguacuagaacacggaagcuguguaacuacgauggcuaaaaacaaacccacuuuagauuuugaacuaauaaaaaccgaggcaaaacauuuagcaaccuugcguaaauauugugucgaggcaaaacuuacuaauacaacaaccgcaagucguuguccaacacaaggagaaccuucucugaacgaggagcaagacaaaagauucguuuguaaacacuccaugguggacagaggcuggggcaacggauguggguuauuugggaaaggagguaucguuacaugugcuauguuuacguguaagaaaaacauggaaggaaaagugguacaaccugaaaaccucgaauacaccauaguuauaacaccucacagcggcgaagaaaaugcaguaggcaacgauacaggaaaacaugguaaagaaauaaaaguaacaccacaaucgagcauuacugaggcagaacucacagguuaugguaccguuaccauggaauguaguccccgaacuggauuagauuuuaacgaaauggugcuucuucaaauggaaaauaaagcaugguuggugcaccgucaaugguucuuagaucuaccccuuccauggcuuccaggggcugauacucagggcuccaauuggauacagaaagagaccuuaguuacauuuaaaaacccgcacgcaaagaaacaagauguagugguauugggcucacaagaaggggcgaugcacacagcucuaacuggagcaacggaaauucaaauguccucaggcaauuuacucuuuacgggccauuuaaaaugccgacugcgaauggauaaauuacaacuuaaaggaaugagcuauaguaugugcacaggcaaauuuaagguggucaaagaaaucgccgaaacacaacauggcacaauaguaauccgcgugcaauacgagggagacgguucaccaugcaaaauacccuuugaaauaauggaccucgagaaaagacauguacugggaaggcuuaucacaguaaacccaauaguuacagaaaaagauuccccggucaauaucgaagcagagccgccauuuggggauagcuacauaauuaucggaguugaaccaggccaauugaaguugaguugguuuaagaaaggcucaucaauuggacaaauguuugaaacaaccaugagaggcgcgaaacgaauggccauuuugggagauaccgcaugggauuuugggagucugggagggguuuucacaucaauuggaaaagcauuacaucaagucuuuggcgcuauauauggagcagcauuuagugguguaagcuggaccaugaaaauacuaauaggaguaguaauaacguggaucggaaugaacagucgaucuacgucauugucgguaagccuugucuuaguaggcguaguaacucucuaccuuggcgucaugguacaagcugacaguggauguguaguaucguggaagaauaaagaacuaaagugugggagcggcauauucauaacugacaauguucacacauggaccgaacaguacaaguuccagccugaaagccccucgaaacucgcaucugcaauacaaaaagcacaugaagagggaaucuguggcaucagauccguaaccagacucgagaauuugauguggaaacaaauaacaccugaacuuaaucacauucuaacugagaacgaaguuaaauuaacaauaaugacaggagacauuaagggaauaaugcaagcaggaaagaggagcuuaagaccucaaccaacggaacuuaaauauaguuggaaagcauggggcaaagcgaagaugcuaucaacagaacuacacaaucacaccuucuuaauugauggacccgaaacugcagaaugcccuaacaccaauagggccuggaacagccuagagguagaagauuauggcuuuggagucuuuacuaccaauauuuggcuaaaauuaaaagaacgucaggauguauuuugcgacaguaaacuaaugagugcggcaauaaaggauaauagggccguacacgccgacaugggauauuggaucgaaagugcgcuuaacgauacuuggaaaauugaaaaagcuagcuuuaucgaggucaagucuugccauuggccaaagucacauacacuauggucgaauggaguguuggaaucagaaaugaucauccccaaaaauuucgcaggacccguuucacagcacaacuacaggccgggguaccauacacaaacagcaggaccguggcaccugggaagauuagaaauggacuuugacuuuugugaagggacgacggucguaguuacagaggacugcggaaaucgaggaccgagcuuaagaacaacgacugcgucaggaaaguuaauaacagaauggugcugucgauccuguaccuuaccgccguugcgauauaggggagaggauggcugcugguauggaauggaaauuaggccucugaaagaaaaagaagaaaaccuuguaaacucuuugguuacugcuggucauggccaaauagauaauuucucccuagguguacuagguauggcguuguuuuuagaagaaauguugcgcacuagagugggaacaaaacacgcaauacuguuaguagcgguauccuucguaacuuuaaucaccggaaauaugucuuucagggaucuaggcagagugaugguaaugguaggagcuacuaugacggaugauauaggaaugggcguuaccuacuuagcauuacuagcugccuuuaaaguacgaccaacauuugcugccggguugcuucuaagaaaauuaacgaguaaagaacucaugaugacgacuauugguauaguauugcuuucacaaucgacuauaccugaaagcauucuagaguugaccgaugcccucgcacuugguaugaugguacuuaagauuguaagaaauauggaaaaauaccaacuagcuguaaccaucauggcuauccuaugcgugccaaacgcaguaauucuacagaaugcuuggaaaguaucuugcacuacucucgcuguggucucuguuuccccauuauuacuaacaucuagccaacaaaaagcggacuggauaccauuagcauugacuauaaaaggccugaauccaacugcuauauuuuuaacuacgcuaucucgcaccucaaagaaaagaucauggccguuaaaugaagcaauuauggcaguagggauggugucaauccuagcgucuucacugcucaaaaacgauauacccaugaccggaccauugguagcuggcggccucuugacaguaugcuaugucuuaacagguagaagugcggaccuagaguuagaacgugcggcagauguucgaugggaagaacaggccgaaauaucaggcucaucacccaucuugaguauaacaauaagugaagacgggagcaugucaauuaaaaaugaggaagaagaacagacauuaacuauacuaauaaggacuggacuauuaguaauaucuggguuauuccccgugagcauaccaauaacggcggcggcuugguaccuaugggaagucaagaaacagagagcaggcguuuugugggaugucccaucaccacccccgguugggaaagccgaacuagaagauggugcauaccgcaucaaacagaagggaauacuaggguacucacagauuggagccgguguauauaaagaaggaacguuucauaccauguggcacguaacuagaggcgcgguguuaaugcauaaggguaaacguaucgagccaucgugggcugacgugaaaaaggaucuaaucuccuauggcggcggauggaaauuagaaggcgaauggaaagaaggugaagaaguucagguacuagcacucgaaccaggcaaaaacccccgagcaguccaaacaaagccaggcuuguuuaaaacaaauacuggaaccauuggugcggugagucuagauuuuaguccgggcacaagugggucacccauaguggauaagaaaggcaaaguaguaggucuauacggaaauggugucguaacacguagugggacuuaugugagugcuauagcgcaaaccgaaaaaucaauagaagacaaucccgaaaucgaagaugauauuuuccgcaaaaagagacuuaccauaauggaucuucacccaggagcagguaagacuaaaagauaucuacccgcgauagucagagaagcaauaaaacgugggcugagaacccuuauauuagcaccuacuaggguuguggcagcagaaauggaggaggcccuaagggggcuaccuauacgguaccagacaccagcgauccgcgcugaacauacaggaagagaaaucguagaccuuaugugucaugcuacauuuaccaugagacuacuuucuccaauucggguuccaaauuacaacuuaauuauaauggaugaggcacacuucaccgaucccgcaagcauugccgcaagaggauacauaucaacaagaguugagaugggagaagcagcgggaauauuuaugaccgcuacaccaccuggaucgagggauccauucccacaaucgaacgccccaauuauggaugaggagagagaaaucccggaacgaagcuggaauagcggucaugaauggguuacugauuucaaaggaaaaacgguaugguuugugcccaguauaaaggcgggaaaugauauagcggcuugcuuaaggaaaaacggaaagaaaguuauccaacuaucuagaaaaaccuucgauagugaauauauaaaaacaagaacaaacgacugggauuuuguaguuaccacggauauauccgaaaugggugcuaacuuuaaagcagagcgagugaucgacccaagaagguguaugaaacccguuauacuaacugauggggaagaacgaguaauucucgcaggaccgaugccggucacccacagcagugcagcucaacgacgaggaagaguggguagaaaucccaaaaaugaaaacgaucaauacauuuacaugggugaaccacuugagaacgacgaagacugcgcccacuggaaagaggcgaagaugcuucuagacaacauuaauacgccugaaggaaucauaccaucgauguucgaaccagaacgugaaaagguugaugcaaucgauggcgaauaccgauuaaggggagaagcuagaaaaacauucguugacuuaaugaggagaggagacuuacccguuuggcucgcauauagaguggcugccgagggcauaaacuacguagauagacgcugguguuucgauggaguuaaaaacaaucaaauacuugaagaaaauguagaaguugaaauauggacaaaggagggugaaaggaagaaacuaaagccucguugguuagaugcgagaauuuacucagauccgcuugcauuaaaagaauuuaaagaguuugcagccggacgcaagucccuuacacuuaauuuaauuacggaaaugggaagauugccaacuuucaugacacaaaaggcuaaaaaugcacuagauaaucuggcaguacuacacacagcugaggcaggcggcagagcauauaaccacgcacuaagcgaauuaccugaaacauuggaaacuuuauuauuacuaacguuacuagccacuguaacgggaggaauauuucuauuuuuaaugagcggaaaagguauugggaaaaugacuuuggguauguguugcaucauaacagcauccauauuacuaugguaugcacagauucaaccacacuggauugcugcuucaauuauuuuggaauuuuuccucaucgucuuacuaauucccgaaccagaaaaacagagaaccccucaagacaaucaacucacauacguagugauugccauauugaccguugucgcugcuacaauggcuaacgaaaugggauuucuagagaagaccaagaaagacuucggauuaggaucaauaacaacacaacaaccagaaaguaauauccucgauauagacuuacgaccagcaucagcguggacccuauaugcaguagccacaacauucauuacgccgauguuacgacacaguauagaaaacagcagcgugaaugucucuuugacugcuaucgcaaaucaagcaacuguacugaugggauuaggaaaggguuggccacugagcaagauggauauaggaguaccacuguuagcaauaggcuguuacagccagguaaaccccauaacauuaaccgcagcuuuacuauuauuaguagcgcauuaugcaauaauagggccaggauuacaagcaaaagcgacacgagaggcacaaaagcgugcagcugccggaauaaugaaaaauccaacgguagauggaaugacaguuauugacuuggauccgauaccguaugauccaaaguucgaaaaacagcuaggucaaguuauguuacugguccuuugugugacgcaaguauugaugaugaggacaaccugggcguugugcgaagcccuuacacuagcaacuggacccauaaguacacuuugggaagguaaucccgguagguucuggaauacgacuauugcagugucaauggccaauauauuuagggggucguaucucgcuggugcggggcucuuauucagcauaaugaaaaacacagcuaacaccaggcgagggaccgguaauacaggcgaaacucuaggugagaaguggaaaaauagauuaaacgcacuugguaaaucagaguuccaaauuuacaaaaagagugguauccaagaaguagauagaacuuuggcaaaagaaggaauuaaaagaggggagacugaucaccaugcgguuucacguggaagcgcaaaguuacguugguucguugaaaggaaccugguuacaccggagggaaaagugguagaccucggaugcgguagaggagguuggucguauuauugcgguggguugaaaaacgucaaagaaguaaaaggacuaacaaaaggaggaccaggucaugaggagcccauuccaaugucaacauacgguuggaauuuagugagguugcagucagguguagauguauuuuucacucccccagaaaaaugugacacauuacuaugugauauaggugaaucuucccccaauccaacaguagaagcggguagaacauugaggguauuaaauuuagucgaaaacugguuaaauaacaauacacaauuuuguauaaaaguguuaaacccuuauaugccaucagucauagagaaaauggaagcguuacagagaaaauaugguggugcauuaguaagaaauccuuuaucacgcaacucaacacaugaaauguauuggguuucuaacgcuucaggaaacauaguuucaagugucaacaugauaagccggaugcucauaaaccgcuuuacaaugcgucacaagaaagccaccuacgagcccgacguugauuugggaaguggaacaagaaauaucggaaucgaaucagaaacacccaaucuugauauaauaggaaaaagaauugaaaagaucaaacaagagcacgaaacaucuuggcauuaugaucaggaucauccguauaaaacuugggcauaccauggaucauaugaaacuaaacaaaccgguagcgcuucuucaauggugaaugguguagugaggcuguuaacgaagcccugggaugugauacccaugguaacucagauggcaaugacggacaccacuccuuuuggacaacaacguguguuuaaagagaagguagacacaagaacacaagaaccaaaagaaggaaccaagaaacuuaugaaaauuacggcagaaugguuauggaaagagcuuggaaagaagaaaacaccacgaauguguacccgcgaagaauuuacaagaaaaguacgaucaaaugcggccuugggugcaauuuucacggacgaaaacaaauggaaaagcgcaagggaggccguugaggacagcggauucugggaacuuguugacaaggaacguaacuugcaccucgagggcaaaugcgagacguguguauauaauaugauggggaaacgagagaagaaauugggugaauuuggaaaagcaaaaggaucgcgcgccauuugguauauguggcugggcgcacgauuucuugaauuugaggcucugggcuuccuaaaugaagaccacugguucucaagagaaaauucccucucugguguugaaggugaaggucuacacaaacugggauacauucugagggauguauccaagaaagaaggaggggcgauguaugcagaugauacagccggaugggauacgcgcauaacccuagaggauuugaaaaaugaagaaaugguuacaaaucauauggaaggagagcauaaaaagcuagcagaagcgaucuucaaacugacuuaucaaaacaaagucguucggguucagagaccgacgccccgagguacggucauggacauaaucucacgacgcgaucaacguggguccggacaaguuguaacauauggccuuaacacauucacgaacauggaggcccaauuaauccgacaaauggaaggcgaaggagucuuuaagaguauccagcaacuuacaguaaaagaggaaauagcagucaaaaauuggcuaauacgcguaggccgagaaagauuaucacgaauggcuauaucuggggacgauugcguugugaaaccacuugacgauagauucgcaucugcacuaaccgcauuaaacgauauggguaaaguccguaaggacauacagcaaugggaaccaaguaggggauggaaugacuggacucaaguaccauucugcagccaucauuuccacgaguugaucaugaaagacggaagagucuuaguaguaccauguagaaaccaagacgaacuuaucgggagggcucguauaucccaaggcgcuggauggagucuaagagaaacagcuugucucggaaagaguuacgcacaaauguggagucugauguacuuucaccgcagagaucuccgucuugcagcaaacgcuauuugcagcgccguaccaucucauuggauaccaaccucaaggacuacuuggaguauacaugcaacucacgaauggaugaccaccgaagauauguuaacuguguggaauagaguguggauacaagaaaauccauggauggaagacaaaacaccaguugaaagcugggaagaaauuccauauuugggaaagagagaagaucaguggugcggcagucugaucggauuaacgucaagggcuacaugggccaaaaauauccaaacugcuauaaaccagguuagaaguuuaaucgggaaugaggaauauacagacuauaugccaucgaugaaaagauuccgcagagaggaagaagaagccgguguauugugguaa

SEQ ID NO: 22254 - RNA, 9876 nt, Artificial Sequence
  derived and/or modified CDS sequence (opt6) from DENV-2__KM279552__SS-prME
acagccgggauaaucauuaugaugaucccaacagucauggcauuucaccugacuacaagaaacggagagccucauaugauaguuagcagacaagaaaaagguaaaucacucuuauuuaaaacagagaaugguguaaauauguguaccuugauggcaauggacuuaggagaacuaugcgaggacaccaucacuuacaacugcccgcucuuaagacaaaacgaaccagaagauauagauuguuggugcaauucgacaaguaccuggguaacauaugguacuugcacagcaacuggugaacacagaagagaaaaacgaagcguggcucuggugccacauguagggaugggcuuagaaacgcgaacggaaacauggaugaguuccgaaggagcuuggaaacaugcacaaagaaucgaaacauggauuuuacggcauccagguuucacaauaauggccgccauucucgccuacacaauagggacaacuuacuuucaaaggguccugauauucauuuugcuuacagcaguaacaccaaguauggcuaugcgcugcaucgggauaucuaaccgagauuuuguagaaggaguguccggugguaguuggguggauauuguucuagagcacgguucaugcgugacaacaauggcaaaaaacaaaccaacacucgauuuugaauuaauuaaaacagaggcaaaacauuuagcuacacuccguaaauauuguguagaggcaaagcuaacuaauacaacgaccgcaagcagaugcccgacucaaggugaaccaaguuuaaacgaagaacaagauaaacgauuuguaugcaaacauuccaugguagaccgagguuggggaaauggauguggccuauuuggaaaagguggaauaguaacgugugcaauguucacuuguaaaaagaauauggaagguaagguaguucagccugaaaauuuagaguacacaauaguaauuacuccacauaguggugaagaaaacgcaguaggcaacgauaccgguaagcacggaaaagaaauaaaaguaacaccccagucauccauuacagaagcugaacuuacggguuaugggacuguaacuauggaaugcucgccucgaacuggauuagacuuuaaugaaaugguacuauuacaaauggaaaacaaggccugguuaguccacaggcaaugguucuuagaucuaccauugccaugguuaccaggugcugacacgcaggggagcaauuggauucagaaggagacgcuugugacguuuaaaaacccucacgccaaaaaacaagauguaguugugcuaggcucacaagaaggugcuaugcauacagcccucacaggggccacugagauucagaugaguucggguaaucuucuguuuaccggucaucuaaagugcagauugagaauggauaagcuacaacuaaaagggaugagcuauucaauguguacaggaaaauucaaaguuguuaaagaaauugcagaaacacaacaugguacaaucguaaucagagugcaauaugagggagaugggagcccauguaaaauacccuucgaaauaauggaccuagagaaacgacacguacugggacgccuuauaacugucaauccuaucguuacagagaaagauucaccagugaacauagaagcugaaccaccauuuggagauuccuauauaauaauuggaguugaaccuggucaguuaaagcuuagcugguuuaaaaagggaaguucuauugggcagauguucgaaacaacuaugagaggagcaaaacggauggccauuuuaggcgauacugcaugggauuuugggagcuuaggaggaguauuuacgucgauagggaaagcguugcaucagguauucggagcuauauauggcgcugcuuuuuccgguguuagcuggacaaugaaaauacuaauaggugucguaaucacauggauaggcaugaacucuagaucaacuuccuugucaguaucacuaguccuugugggagucguaacacuauaccuaggagucaugguacaggcagauaguggauguguuguuuccuggaaaaacaaggaacuuaaauguggaagcggaauauuuauuacggauaacgugcacacauggacagaacaauauaaauuucaaccagaaucuccgagcaagcuagcuuccgccauccaaaaagcgcacgaggaggggauuugcggaauccgaaguguaacuaggcuagagaacuuaauguggaaacaaauuaccccugaacugaaucauauacuaacggaaaaugaaguuaaauugacaauaaugaccggugacauuaagggaauuaugcaagcggguaagaggucccuccgaccacagccgacggaacuaaaauacaguuggaaagcauggggaaaagcaaaaauguuaaguaccgaauuacauaaucauacauuccuaauagacgggccagagaccgcugaauguccaaauaccaauagggcuuggaauucauuagagguggaggacuauggcuuugguguguuuacaacuaauauauggcuaaaacuaaaagaaagacaggauguuuuuugcgacucuaaacugaugucagccgcaauaaaagacaauagagccguacacgcugacaugggauauuggauagagagcgcguugaaugauacuuggaaaaucgaaaaagcaagcuucauagaaguuaaaucgugucacuggccuaaaagccacacacuauggagcaacggaguucuugaaagugaaaugauaauuccgaagaauuuugcggggccagucucacaacauaacuaucguccuggguaccacacacaaaccgcuggacccuggcaccuggguaggcuagaaauggacuucgauuuuugcgaaggaacaacaguagucguaacagaagauugugggaaucgcgguccaucacugaggacgacaacggcaucaggcaaacucaucacagaguggugcugucggaguuguacacuaccuccacuuagauacaggggugaggaugguuguugguaugggauggagauaagaccgcuuaaggaaaaagaagaaaaccuaguaaauucauuaguaaccgcgggacauggucaaauagauaauuuuuccuuggggguacugggcauggcuuuauuccuugaggaaaugcuaagaacaaggguugggaccaagcaugcuauucuacuaguagcggucaguuuugucacauugauuacugggaacaugucauuucgagaucuugggcgugucaugguaaugguaggagcuaccaugacagacgacauaggaaugggaguaaccuaccuugcacuucuagcugcauuuaaaguucguccaaccuuugcagcuggacuuuuguuacggaaauugacaucuaaggagcuuaugaugacaaccauaggaauuguacuauuaucacauucaacaauuccugaauccauucuugaacuuacagaugcauuagcgcuagguaugaugguacucaaaauaguaagaaauauggagaaguaucaguuagccgucacaauaauggcaauauugugcguacccaaugccgugauauuacagaacgcguggaaggucagcugcacuacacuagcaguuguaaguguaucuccacuauuacuaacaaguagucaacagaaagcugauuggauucccuuagcguugacaauuaaaggacuaaacccgacagcaauauucuugacaacauugagccgaacaagcaaaaaacggucauggccacuuaaugaagcgauaauggcagucgguaugguaaguauuuuagcaagcuccuuauuaaaaaaugauaucccaaugaccggcccacugguugcuggggggcuucuuacagucuguuauguccuuacuggacggagugcagacuuagaacucgaacgagccgccgacguucgaugggaagaacaagcugagauaaguggaaguaguccaauacuaucgauaacaauaagcgaagauggcucgaugagcaucaaaaaugaagaggaagaacaaacgcuaacuauauugauacguacuggccuccuaguaauuuccgguuuauucccagugaguauuccuaucacugccgcugcaugguacuuaugggaaguaaaaaagcaaagagcgggcguguugugggacguuccuucaccaccacccguaggcaaagcggaauuggaagauggagcuuauagaauuaagcaaaaaggaauccuggguuauucccaaauaggugccgggguguacaaagaggggacauuucacacgauguggcacguaacgagaggugcgguauuaaugcauaagggcaaacgaauugaaccaaguugggcggacguaaaaaaagacuugauaucuuauggaggaggcuggaaguuggaaggagaauggaaagaaggcgaagaaguucaaguauuggccuuggagccgggaaaaaauccaagagcaguacaaacaaaaccagguuuauuuaaaacaaauacggggacaaucggagcaguaucauuagacuuuucuccugggacaucuggaagucccauaguggauaagaaggguaaaguagucggcuuauacggaaauggcguaguaacaagauccggaacguauguaucagcaauagcccaaacggaaaaaaguaucgaggauaaucccgaaauugaagaugauaucuuucgaaaaaaaagguuaacaauaauggaucuucaucccggugccgguaagaccaaaagauacuuaccagccauagucagagaagcgauaaagcgagggcuaagaacuuugaucuuagcaccgacgaggguuguugcugcugaaauggaagaagcccuucguggcuuacccauuagguaucaaaccccagcuaucagggcugagcauacugggcgagaaauagucgauuuaaugugucaugcaacauuuacaaugcgauuguuaaguccaauaaggguaccuaauuacaacuuaauaauuauggaugaagcucauuucacagacccagcaucuauugccgccagagguuauauuuccacacggguagagaugggcgaagcugcaggcauauuuaugaccgcuacgccuccaggaucgcgugaucccuuuccacagucaaaugcaccaaucauggaugaagagagagaaauaccagagagaucuuggaacucaggucaugaauggguaacagacuucaaaggaaaaaccgucugguucguacccaguauuaaagccggaaaugauaucgcagcaugccugcgaaaaaacggcaaaaaaguuauucaauuaagucgaaaaacauuugacucugaauauauaaaaacaaggacaaaugauugggacuuuguugugacuacugacauaagcgaaaugggugcaaacuuuaaagcagaaagagucaucgaucccaggagauguaugaaaccagugauacuaacugacggugaagagcgaguuauuuuagcgggucccaugccaguaacacauucuagugccgcacagagaagagggagaguaggacgaaauccaaagaaugaaaaugaucaauacaucuauaugggugaaccacucgaaaaugaugaagauugcgcccacuggaaggaagcgaaaauguuacuggacaacauuaauacaccugagggaauaauuccaucaauguucgagccagaaagagaaaaaguugacgcaauagauggugaguauagacuaagaggagaagcucgaaaaacuuuuguagaucucaugcggcgaggagaucuuccgguauggcuagcuuacaggguagcagccgaagggaucaauuaugcagacagacgaugguguuuugauggcgucaaaaacaaccagaucuuagaagaaaacgucgaaguugaaauuuggacgaaggagggugaacgaaaaaagcuaaaaccccgcuggcuagaugcuaggauauacuccgacccucuggcuuuaaaagaauuuaaggaauucgccgcuggacgaaaaagucuaacacucaacuugauuacagaaaugggacgacuucccaccuuuaugacgcagaaggcgaaaaacgcuuuggauaaccuugcgguauuacacacagccgaagcgggcgguagggcuuauaaccacgcacuaagugaacuccccgaaacgcucgaaacucuguuacuguugacauuacuggcaacugucacgggggguauuuuucuuuuucucauguccggcaaagguauugggaaaaugacuuuaggcauguguugcauuauaacugcuucaauacuucugugguacgcucaaauacaaccacacuggauugcggccaguaucauuuuagaguuuuuuuuaauaguacuucugauuccggaaccggagaaacaaagaacuccccaagauaaucaacuaacauacgucgugauagcaauauugacuguggucgccgcaacaauggccaaugagaugggauuccucgaaaaaacuaaaaaagauuucggccucgguaguauaaccacccaacaaccggaaucuaauauauuagacauagauuuacguccggcuucagcauggacacucuacgccgucgcaacaacuuuuauuaccccaaugcuaaggcauaguauagaaaacucaucaguaaaugucucucugacagcuauagcaaaucaagccaccguccuaaugggguugggaaaaggguggcccuuaucgaaaauggauauaggaguccccuuauuagcuauuggcuguuauagccagguaaauccaauuacguuaaccgcugcguuacuuuugcugguugcucauuaugccauaauagguccgggccuccaagcgaaggcuaccagagaagcucaaaagcgagcagcugcuggaauaaugaaaaacccaacagucgauggcaugacuguaaucgaccuggaccccauaccuuaugauccaaaguucgaaaaacagcuaggacagguuaugcuacucgugcuuugcgugacgcaaguauugaugaugcgaacgacuugggcauugugugaagcacuuacuuuagcaaccggaccgauaagcacucuuugggaagggaauccaggcagguuuuggaacacaaccauagcuguuucgauggcaaauaucuuuagaggaaguuaccuugcaggggcggguuuacucuuuuccauaaugaagaacacagcuaacacuaggagggggacgggaaauacgggagaaacacuuggagagaaauggaaaaauaggcuaaaugcguugggaaaaagugaguuucaaauauauaaaaaaaguggaauucaggaagucgaccgaacgcuagcuaaagaagggauuaaaagaggggaaacagaccaucaugcaguaucaagaggaucagcuaaacuacgcugguuuguugagcgcaaccuagugaccccagaaggaaaagucguagaucuaggaugcggccgugguggcuggucauauuacugcggagggcuuaaaaauguaaaagaagugaaaggcuugacaaagggcggcccuggacaugaagagcccauaccaauguccacauacggauggaauuuaguacguuuacagucugggguggauguuuucuucaccccaccagaaaaaugugacacacuauuaugugauauuggggagucaaguccgaacccaacaguagaagcgggccggacucuuagaguuuuaaaucucguagaaaauugguuaaacaauaauacccaauuuugcauaaagguauuaaauccuuacaugccaucuguaauagaaaagauggaagcgcuccaaagaaaguaugguggagcauuaguacguaauccacuuucgaggaauucaacgcacgaaauguauuggguaucgaaugcauccgguaauaucguuagcagcgugaauaugauaagucguaugcugauaaaccguuuuacgaugcgucacaagaaagcaaccuacgagccugaugucgauuuaggaucagguacgagaaacauuggaauagaaucagaaaccccgaaccuagauauuauaggaaaacggauagaaaaaauaaaacaggaacacgaaacaucauggcauuacgaucaagaccauccuuauaaaacgugggcauaccauggcaguuaugaaacaaaacaaaccggaagugcuaguaguauggugaacggaguugucaggcuuuugacaaaaccuugggacguuauaccaaugguuacucaaauggcaaugacugauacuacacccuuuggucaacaaagagucuuuaaagaaaaaguagauacgagaacgcaagagcccaaagaagggacaaaaaagcuuaugaaaauuacagcggaaugguuauggaaggaacuaggaaagaaaaaaacaccaagaauguguacgcgagaggaauucaccaggaaaguuagaucuaaugcugcauugggagcaauuuuuaccgacgaaaacaaauggaaaagcgcaagggaagccguggaggauucgggguuuugggaguugguagacaaagaacguaaucuacaucuggaaggcaaaugugaaaccugcguguacaacaugauggggaaacgagaaaagaaauugggagaauucggaaaagccaaaggaagccgagcgaucugguauauguggcuuggagcaagauuccuugaauuugaggcucuaggauuccuuaacgaagaucauugguucagcagagagaauucccuuucagggguggaaggagaaggccuacauaaacugggauacauauugagagacguuagcaaaaaagaaggaggggcaauguaugccgacgacacggccgggugggauacaagaauuacauuagaggaccuaaaaaaugaagaaaugguaacaaaucacauggaaggugagcauaagaaacucgcggaggcuauauucaaauugacauaccaaaacaaaguagugagaguacaacggccgacaccacgaggaacuguuauggacauaauaagcagaagggaccaacgugggaguggucaggugguaacauauggauuaaauacauuuacuaacauggaagcacaacuaauuaggcaaauggagggugaggguguauuuaaaagcauacagcaauuaacuguaaaagaagaaaucgcaguuaagaauugguuaauaagagugggucgcgagagacuuagccgaauggcaauaucuggggacgacugugugguuaaaccccuugacgaccgauucgcgucggccuuaacggcgcuaaaugauaugggaaaggugaggaaggacauacaacaaugggagcccagcagaggauggaaugacuggacgcaaguaccauuuuguucucaccacuuucaugaauuaauuaugaaggauggacguguuuuaguugugccauguagaaaccaagaugaacuaauagggcgagcacguauuucccaaggugcuggguggagcuuacgugaaacggccugucucggcaagucauacgcucaaauguggaguuugauguauuuucaccgacgggauuugcgucuagccgcgaaugcaaucugcucagcaguuccuucccauuggauaccgacuucaagaacaacuuggucuauacaugccacacaugaauggaugaccaccgaagauaugcucacaguuuggaauagggucuggauacaagaaaaccccuggauggaagacaagacaccagucgaaucaugggaagaaauacccuaucuugggaaacgcgaagaccaauggugugguucucuuaucgggcugaccucacgggcaacaugggcuaagaacauacaaacagcgauaaaccaagucaggucucuuauagguaaugaagaguauacagauuauaugccgagcaugaaaagguucagacgggaagaagaagaagcagguguuuuaugguaa

SEQ ID NO: 22255 - RNA, 9876 nt, Artificial Sequence
  derived and/or modified CDS sequence (opt6) from DENV-2__KM279557__SS-prME
acugcuggcauaauaauaaugaugauaccuacaguaauggcauuucaccuuacaacgcgaaauggcgaaccacauaugauagucagccgucaagaaaaaggcaaaucucuacuuuuuaaaacugaaaacggugucaacauguguacccuaauggcuauggauuuaggugaacuaugugaagacacuaucacguacaauuguccauuauugcggcaaaaugaaccugaagauauagauugcuggugcaauucgacaaguacguggguuacguaugggaccuguacggcuacaggcgaacauagacgagaaaaacgaaguguggcauuaguaccacauguaggaaugggacucgaaacgaggacagaaacauggaugucaucugaaggugcauggaaacaugcacaaagaauagaaacauggauacuucgucauccaggauuuacaauuauggcagcaauauuagcguauaccauaggcacaacauacuuucaaagaguucuuauauucauccuuuuaacagcugucacuccaaguauggcaaugagguguauagguauaucaaacagagauuucgucgaagggguauccggaggcucuuggguagauauaguuuuagaacacgggucauguguaaccacuauggcuaaaaauaaaccaaccuuggacuuugaacugauuaaaaccgaagcaaaacaucuugccacauuacgaaaauauugcguugaagcaaaacuaacaaauacgacaacagcgagcagauguccaacccaaggggaaccguccuuaaacgaagaacaagauaaaagauuuguuuguaaacauaguauggucgaccgaggaugggguaacgguugcggacuuuuuggaaaaggaggcauagugacuugugcgauguuuacaugcaagaaaaacauggaagguaaaguaguccagccggaaaacuuggaguauaccauaguuauaaccccacauucgggggaggagaaugcggugggaaaugauaccggaaaacaugggaaagaaauuaaagucacaccgcaaaguucaauuacagaggccgaauuaacggguuacggaaccguaacaauggaaugcaguccaagaacaggcuuggauuuuaacgagauggugcuguuacagauggaaaacaaagcguggcuaguacauagacaaugguucuuagacuuaccguuacccuggcuuccuggagcugauacacaaggaucgaacuggauucaaaaggagacacugguaacguuuaaaaauccacaugccaagaaacaagauguaguaguucuaggaagccaagagggagcgaugcacacagcuuugacaggagccaccgaaauacagaugucgaguggaaaucuauuauuuacuggacaccuuaaaugccgccuaagaauggauaagcugcaacuuaaagggaugagcuauuccauguguacaggaaaguucaaaguaguaaaagaaauugcagaaacacaacauggcacgauagugaucagaguacaguacgagggugauggcaguccaugcaaaauaccauuugagauuauggacuuagaaaaacgacauguuuugggacgucuuauaacaguaaauccaauuguaacagaaaaagacucaccgguuaacauagaagcggaaccgccauucggagauuccuauauaauuauagguguagaaccaggacaacugaaauuaaguugguuuaagaaagguagcucaauaggacaaauguuugaaacaacaaugcggggcgccaaaagaauggccauacuuggcgacacagcaugggacuucgggucucuuggcggugucuuuacaagcauuggaaaagcauugcaucaaguguucggagcaauauacggggcagccuuuaguggcguaucauggacaaugaaaauacuaauaggcguagucaucacguggaucggaaugaacucacguucuacaagucugucagucucauuagugcucgucgggguuguuacacuauauuugggggugauggugcaggccgauucuggcuguguaguaagcuggaaaaacaaggaacuuaaaugcggaucaggaauuuuuaucacagauaaugugcauacuuggaccgagcaguauaaauuccagccagaaucaccaucuaaacuugcaucagcaauucaaaaagcacaugaggagggaauuugcgguauuaggucagugacgagacuugaaaaucugauguggaaacaaauaacgccugaauuaaaccauauuuuaacggaaaaugagguuaaauuaacgauaaugaccggcgacauuaaaggcaucaugcaggcaggcaaaagaucgcuacggccucaaccaacggaauuaaaauauucguggaaggcuuggggaaaggcgaaaaugcuguccacagaacuacauaaccauacguuuuuaauagauggaccugaaacagcagaaugcccgaauaccaauagagccuggaacucguuggaaguagaggauuauggauuuggaguuuucacgacuaauauuuggcugaaacugaaagaaaggcaagacguguucugcgauuccaaacuuaugucagccgcaauuaaagacaauagagcgguacaugcggauauggguuacuggauagaaagcgcauuaaacgauacauggaaaaucgagaaagccucauuuauagaaguaaaaagcugccacuggccaaaaucucauacauuguggucuaauggcguucuugaaucagaaaugauaauaccuaaaaauuuugcaggaccuguaucacaacacaauuaccgaccggguuaucacacacaaacugcagggccauggcacuuaggacgccuagagauggauuucgacuuuugcgaaggcacgacugugguagucacggaagauuguggcaaucgcgguccguccuuacgcacaacaacggccucaggaaaguuaauaacagagugguguugccgaucauguacucuacccccacuuagauacagaggugaagauggaugcugguacgggauggaaauacggccgcuaaaagaaaaagaagaaaauuuaguuaauagcuugguaacggcgggucacggacaaauagauaacuucagccucggagucuuaggaauggcuuuauuuuuagaagaaauguugcguacacgagugggaacuaaacaugcuaucuuauuaguagcagugagcuuuguaacacugauuacaggaaacaugucguuuagggaucugggucgaguaauggucaugguaggagcaacgaugacggacgauauuggaaugggcgucaccuaccuagcguugcuugcagcguuuaagguuagaccaacuuuugccgcaggacuucucuugcguaaauuaacgucaaaggaacuaaugaugacaacaauaggaauaguuuuacucagucaaucuacuauuccggaaucaauuuuagaauugacugaugcguuggcgcuuggaaugaugguccuaaaaauugugaggaacauggaaaaauaucaacuagcagucacaauaauggcgaucuugugcgucccaaacgcaguuauacuacagaaugcauggaaaguuaguugcacaacuuuggccgugguaaguguaucuccacuauuacuaacaaguagucaacagaaagcagauuggauaccccuagcuuuaacaauaaagggauuaaauccuaccgcaauauuucuuacgacucuaucuaggacgucgaagaaacggucuuggccgcugaaugaagcaauuauggcuguggggauggucucgauauuagcaagcucauugcuuaagaaugauauaccgaugacgggaccauugguggcuggaggcuuauugacagucugcuacguauuaacugggagauccgcggaucuugaauuggaacgcgcagcggauguaaggugggaagaacaagcugaaauauccggaucgucucccauacuuuccauuaccauaagcgaagacggcucuaugagcaucaaaaaugaagaagaagaacaaacacuuacaauacuuauacgcacuggguuauuaguaauaagcggacuauuucccguaagcauuccgauaacggcggcagcaugguaucucugggaaguuaagaagcaaagggcgggcgugcugugggauguuccgaguccuccacccguuggaaaagcagaauuagaagauggagccuaccguaucaaacaaaaagguauacuaggguauagucaaaucggugcaggaguauauaaagaagguacauuucacaccauguggcauguuacccguggagcuguauuaaugcacaagggcaagaggauugaaccaagcugggccgauguuaagaaagaccuuaucaguuacggaggaggcuggaaacuagaaggcgaauggaaggaaggugaagaaguacaaguccuagcucuagaaccggggaaaaauccaagagcaguacaaacaaaaccaggauuauucaagacgaauacggguacuauaggugcgguaucauuagauuuuucacccgggacaucagguaguccaauaguagauaagaaaggcaaaguuguugggcuauacggaaaugggguugugaccaggucugguacguauguaucggcuauagcacaaacggaaaagagcauagaggauaauccggaaauugaagacgacaucuuuagaaagaagcggcuuacuauuauggaucuacauccuggagccgguaaaaccaagcguuaccucccagcaauaguucgggaagccauuaaaagaggacucaggacacucauucuggcgccaacuagggugguugcugcggaaauggaagaagcguuacguggucucccaaucagguaccaaacuccugcgaucagagccgagcacacaggucgcgaaaucguugaccuuaugugucacgcaaccuucaccaugagacuacuuucaccaauacgaguuccuaauuauaaccucauaauaauggaugaagcacauuuuacggauccagcaagcauugccgcccguggauauauauccacgcguguugaaaugggugaagccgccggcaucuucaugacagcgacaccaccaggcagcagagauccuuucccucaaucaaaugcgccuauaauggaugaagaaagggagaucccagaaagaaguuggaacucggggcacgaauggguuacagacuucaaggguaagacuguaugguucguuccaagcauaaaagcggggaaugacauugcagcgugcuugcguaaaaaugggaagaaggucauacaacuuuccaggaagacguucgauagugaauacaucaaaacccgcacgaacgacugggauuucgucgugacgaccgacauuagcgaaaugggugccaauuucaaagcagaacggguaauagauccucgucguugcaugaaaccgguaauauuaacagauggcgaagaacgagucauauuggcagguccaaugccugugacgcauucauccgcagcacaacggagaggacgcguaggucgaaaucccaaaaaugaaaacgaccaauacauauauaugggugaaccacuggaaaacgacgaagauugugcacauuggaaagaagcgaagaugcuauuagauaacauaaauacuccggaaggaaucauaccaaguauguucgaaccugagcgagagaaagucgaugcaauugacggagaauacagauuaagaggagaagcuagaaaaacauuuguugaccuuaugagacgcggugaucuacccguauggcuagcuuauaggguugcggccgagggaaucaauuaugcagauagaaggugguguuuugacggcgugaaaaauaaucaaauacuagaagaaaauguggaaguugaaauauggaccaaagaaggagaacggaagaaacucaagccgcgaugguuagaugcuagaauauauucagacccacuagcacucaaagaauuuaaggaguucgcggcugggagaaaaucguugacauuaaaucuuauaacagaaauggggaggcucccaacauucaugacacagaaagccaaaaaugcccucgauaaccuagcgguacuucauacagcugaagcagggggacgagcuuacaaucaugcucucagcgaacuacccgaaacguuagaaacccuauuauuacuaacauuacuagcgacagugacaggagguaucuuuuuguuuuugaugagugguaaaggaauagguaaaaugacguuggguauguguuguauuaucacugccucaauccucuuaugguacgcacaaauucaaccacauuggauagcggcaagcauaauauuagaguucuucuuaauuguuuuauuaaucccggaaccggaaaagcaacggacaccgcaagacaaucaacuaacauauguaguuauugccauauuaacaguaguggcggcaacaauggccaaugaaaugggauuucuugaaaagacuaagaaagauuucggacugggaucaaucacaacacaacaaccugagaguaauaucuuagauauugacuugcguccagcaucggcauggacguuauacgcuguagcuacuacguuuauaacccccauguuacgacacucgauugaaaacucgucuguaaauguaucauuaacagcuauagcuaaucaagcaacugugcuaaugggguuggggaagggauggccgcuuuccaagauggauauagguguuccguuauuagccaucgguugcuauucgcaagucaacccgauaacucucacagccgcacuccuccuauuaguugcccauuaugcuauaauuggcccaggucuucaagccaaagcaacgcgcgaggcucagaagagagcagcagccgguaucaugaaaaacccuaccguagacggcaugacagucauugaucuagauccaauaccauaugauccgaaauuugaaaaacaauuaggacaaguuaugcuuuuggugcuauguguuacacaagucuuaaugaugagaacaacuugggcgcuaugugaggcuuuaacccuagcaaccggaccuauuucuacccuaugggagggcaauccagguagauuuuggaauacuaccaucgcaguuucuauggcaaauauauucagagggucauaucuggccggugccggauuacuuuuuaguauaaugaagaauacugccaauacucggcgugguacaggaaacaccggagaaacccuaggagaaaaauggaagaaucgguuaaaugcacuaggaaagucugaguuccaaauauacaagaagaguggaauacaggaaguagaucguacgcuagccaaggaaggaauuaagaggggagaaacagaccaucaugcuguaagcagggggagugcaaaacucagaugguucgucgaacgcaauuuagucacaccggagggaaaaguaguugacuuggguugugggcguggaggauggucauauuauugcgguggauugaaaaaugucaaagaaguaaagggccuuacuaaaggaggcccugggcaugaagaaccuauuccaaugaguacauacgguuggaacuuaguaagauuacaaaguggaguagacgucuucuuuacaccaccugaaaagugugauacuuugcucugugauauaggagaauccucgccaaaccccacgguagaagcaggaagaacccuuagaguccuuaauuuaguagagaacuggcuuaacaacaauacgcaauuuugcauuaaaguauuaaaccccuacaugccaagugugauagagaaaauggaagcacugcaacgaaaguaugguggagcauuaguuagaaauccacucagcagaaauucgacgcaugaaauguacuggguuucgaaugcaucaggcaauauaguaagcaguguaaacaugauaucccggaugcuaaucaacagguucacgaugaggcacaaaaaggcaacuuacgagcccgauguagaucucggaucgggcacuagaaauauugguauagaaucggaaacaccgaaucuagauauuauaggaaaacguauagagaaaauuaaacaagaacacgaaacuucauggcacuacgaucaagaccauccuuauaaaaccugggccuaccacggaagcuaugaaacaaagcaaacaggaucugccucaaguaugguaaacggugugguaagguuacuaacgaagccuugggaugucauaccaauggucacucagauggccaugacugacaccacaccauuuggacaacagaggguuuuuaaagaaaaaguagacaccagaacacaggaacccaaagaagguaccaagaaauuaaugaaaauaacagcagaauggcuuuggaaagaacucgguaagaagaagacaccccgcaugugcacaagagaggaguucacaaggaaagugcgaaguaaugcggcauuaggagcuauauucacagacgagaacaaauggaaaucagcgcgagaagcuguagaggauucuggauuuugggagcuuguagacaaagaaagaaacuugcauuuagaggguaaaugugaaacaugcgucuacaauaugauggggaagagagagaagaaauuaggagaauuuggaaaggcuaaggguaguagagcaauaugguauauguggcuaggugcucgguuccuagaauuugaagcccuaggauuuuugaacgaagaucauugguuuucacgugagaacagccuaucaggaguugaaggagaaggucugcacaaguuaggguacauucuacgagacguauccaagaaagaaggaggggcaauguaugcugacgacacagcaggaugggauacucgcauaacacuugaagacuugaaaaaugaggagauggucacaaaucauauggaaggagaacauaagaaacucgcugaagcuauuuuuaagcuaacguaucaaaauaaggugguuagaguucaacggcccaccccacgaggcacaguaauggacauaauuuccagaagagaccaaagaggcuccggacagguaguaacauauggguugaauaccuucacgaacauggaagcacaacuuauaaggcaaauggaaggugagggaguguuuaagagcauacagcaauuaacaguaaaagaagagaucgcuguuaagaauugguugauucgagucggaagagaaagauuaucuagaauggcaauaaguggugacgauugcguaguuaaaccauuggaugacagauucgcauccgccuuaacggcucuuaaugauaugggaaaggugcggaaagauauccagcagugggaaccaucaagagguuggaaugauuggacgcaaguaccguucugcagucaccauuuccacgaauugauuaugaaggauggccgagugcuugugguaccaugcagaaaucaagaugagcuaauuggacgagccagaauuagccaaggugccgguuggucucugagagaaacugcaugcuugggaaaauccuacgcgcagauguggaguuugauguacuuucacagacgagauuuaagguuagcugcaaauucaauaugcagcgcugucccuagucacuggauaccgacgucuagaacuacauggucuauucacgcuacucacgaauggaugacaacugaggauaugcuaaccguuuggaauagggucuggauucaagaaaacccauggauggaagacaaaacaccgguugaaucuugggaagaaauaccauaccuaggaaaaagggaagaucaguggugugggagccuaauuggauuaaccucuagagcaaccugggccaaaaauauacaaacagcaauaaaucaaguaagaagucuaaucgguaacgaagaguauacagauuauaugccuaguaugaaaagguuccgacgagaagaggaagaagcuggaguguugugguaa

SEQ ID NO: 22256 - RNA, 9876 nt, Artificial Sequence
  derived and/or modified CDS sequence (opt6) from DENV-2__KM279591__SS-prME
acugcuggaauaauuauaaugaugauaccaacaguuauggccuuucaucucacuaccagaaauggcgaaccucauaugauaguuagccgccaggaaaaagggaaaucauuguuguucaaaacugaaaacggcguaaacaugugcacucuaauggccauggauuuaggagaguugugcgaagauacuauaacguacaacuguccacuacuaaggcaaaaugaaccggaagacauagauuguugguguaauucaacaagcacuugggugacauauggaacaugcacagccacaggcgaacauagacgagaaaaaaggucugucgcccuagugccacauguaggaaugggacucgagacucguacagaaacuuggaugaguagugaaggcgcguggaagcaugcgcagaggaucgaaacauggauauuaagacacccgggauucacuauaauggcggcuauuuuggcauauacaauuggaacuacguauuuucaaagaguuuugaucuuuauauuacuuacagcaguuaccccuaguauggcuaugcgguguaucggaauaucgaauagagacuuuguagagggaguuucaggaggaaguuggguggauaucguccuggaacacggauccuguguaacgaccauggcaaagaauaaaccaacacuugauuucgaacuaauaaaaacagaagcaaaacauuuagcaacgcuaagaaaguauugcguugaagcuaaacugacuaacacuacgacagccagccgaugucccacccagggagaaccgucgcuaaacgaagaacaagacaaaagguuuguuuguaaacauucaaugguggaucgugguuggggaaauggauguggccuuuuuggcaagggcgguaucgugacaugugcgauguuuacuugcaaaaaaaacauggaagguaaagugguacaaccagaaaaucucgaauacacaauagucauaacaccgcacagcggugaagaaaaugcuguaggaaaugacacugguaagcaugggaaagaaaucaaagucacgccacagaguucgauaaccgaggccgaacucacaggauauggcacaguaacgauggagugcucaccacguaccggguuggauuucaaugagaugguccuccuacagauggaaaauaaagcuuggcucguucaucggcagugguuccuugauuuaccauuaccaugguuaccaggagcagauacacaaggaucaaauuggauucagaaagagacccuuguuacauucaaaaauccacacgcaaaaaagcaggauguaguuguauuaggaucgcaagaaggugcuaugcauacugcuuugacaggugcgacggagauacaaaugagcucagguaaucuuuuauuuacuggucaucuuaaaugccggcuacgaauggauaaacuccagcuaaaaggaaugagcuacaguauguguacuggcaaauuuaagguaguuaaggaaauagcagaaacgcaacacggcacgaucguaauccguguccaauaugaaggcgauggaucaccguguaaaauaccuuucgaaaucauggaucuggaaaaaaggcacguacuggggcgacuaauuacaguaaauccaauuguaacugaaaaagauagcccuguaaacauugaagcugaaccaccguuuggugauucauacauaaucauaggggucgaaccuggucaacuuaaguugaguugguucaaaaaaggaucaaguauuggccaaauguuugagacaacaaugagaggugcuaaaaggauggcgauacugggggauacugcgugggauuuugguucacuuggcggaguuuuuacaaguauagggaaagcacuacaccaaguguuuggugcgauuuacggugcagccuucaguggcguaucauggacgaugaaaauauugauaggagucgucauuacauggauuggaaugaacucacgaaguacuagucucucugugagucuuguucuuguugguguaguaacuuuauacuugggugugaugguccaggcagauucgggcugcgucguaucuuggaagaacaaagaauugaaaugcgguagcgguaucuuuaucacagauaauguucauacuuggaccgaacaguacaaguuucaacccgaaucuccaucaaaacucgcgucagccauucaaaaagcucaugaagaggggauuuguggaauucgaucgguaacacgucuggagaauuuaauguggaagcaaauaacgcccgaacucaaccauauacugaccgaaaaugaagucaaguuaacaauuaugacaggggacaucaaaggaauuaugcaagcgggaaaacggacuuuacgcccccaacccacagaauugaaauauucguggaaagcauggggaaaggcuaaaaugcuuucuacugaacuccauaaucauacauuuuuaauagauggacccgaaacggccgaaugcccuaauacaaaccgugcauggaauucacucgaaguagaagauuaugguuucggaguauuuacaaccaacauaugguuaaaauuaaaagaacgucaggauguuuucugugauaguaaauuaauguccgcugcuauaaaagauaauagagcaguacaugcagauaugggcuauuggaucgaaucugcguugaaugacaccuggaaaauugagaaggcaucuuuuauagagguaaagaguugccacuggcccaagucacacacuuuauggucaaaugggguacucgaaagcgaaaugauaauaccaaaaaauuuugcagguccuguaucacaacauaacuaucguccagguuaccacacacaaacagcgggaccauggcauuuagggagguuagaaauggauuuugauuuuugugaagguaccacggugguagucaccgaggauugugggaacagagggccgagccuuagaacuacaacagcuuccggaaagcuaaucacagaauggugcugucguucauguacacuaccuccccugcgguauaggggugaagaugggugcugguacggaauggaaauaaggccauugaaggaaaaggaagagaauuuagucaauucacugguaacagcaggacacggucaaauagacaacuuuagcuuagggguguuaggcauggcauuauucuuggaagaaaugcuccguacacgugugggaaccaaacaugcaauccuuuuaguagcaguuucauuuguuacacugaucacuggcaauaugagcuuuagggauuuaggcagaguaauggugauggucggcgcgacuaugacagaugauauaggaaugggagucacauacuuagcauuauuagccgccuuuaaaguaagaccgaccuuugccgcaggccucuugcuaagaaaacuaaccucaaaagaacugaugaugacuaccauagguauaguauuacugucucaaucaacaauaccugaauccauauuagagcuuacggacgcacuugcucuuggaaugaugguauuaaaaauuguucgaaauauggaaaaguaucaguuagcuguaacgauaauggcgauauuauguguaccaaacgcuguaaucuugcagaacgcguggaaagucucauguacgacccucgcggugguaaguguuagcccauuauuguuaacaucuucacaacaaaaagcagacuggaucccacuagccuuaacuaucaaaggccuaaacccaacggccauuuucuuaaccacauuaagucgaacgucaaagaaacgcagcuggccccugaaugaggcaauaauggcagugggaaugguaucuaucuuagcaagcuccuuacugaagaacgauauaccaaugacgggaccauuagucgcuggaggacuguuaacaguuuguuauguauuaaccggaagaucagccgaucucgaacuugaacgcgcagcggauguaagaugggaggaacaagccgaaauaagcggaucgucuccuauauuauccauaacgauaagcgaggacggaaguaugucgauaaaaaacgaggaggaggaacaaacacucacaauacugauccgaacagggcuacuuguuauaagcggauuauuuccuguuuccauucccauuaccgcagcagcuugguaucuuugggaagugaaaaaacagcgugcuggcguguugugggauguucccagcccaccaccggucggaaaggcugaacuugaagauggagcauauagaauuaaacaaaaagguauuuuaggauauucccaaauaggagcagguguauauaaagaggguacauuccacacuauguggcacguaacgagaggugcuguacugaugcauaagggaaagaggaucgaaccaagcugggcggacguuaaaaaagacuuaauuucuuacggcgguggauggaaacuagaaggcgaauggaaggaaggugaagagguacaaguucuagccuuagagccugggaaaaauccaagagcuguucaaaccaaaccgggccuuuuuaaaacaaauacugggacaaucggagcgguaucauuagauuucaguccagguaccagcgggagcccaaucguagauaaaaaagguaaggugguuggccuauauggaaauggaguggucacaagaucagguaccuauguuucagcaauugcucagacagagaaaaguaucgaggauaaucccgaaauagaagacgacauuuuuagaaaaaaaagauuaacaauaauggaucuacacccuggagcaggcaaaacaaaaagguaucuuccagcgaucguaagggaagcuaucaagcgcgggcuccgcacucuuauucuagcaccuacaagaguuguagcugcagaaauggaggaagcguuacgaggucuuccgauaagauaucaaacuccagccauacgcgcggaacauacugguagagagauagucgaccuaaugugccacgcaaccuucacaaugcgauuacuuucccccauaaggguaccaaauuacaaucuaauuauuauggaugaagcccauuuuacagauccagcaagcauugcggcgcguggcuauauuaguacgagaguugaaaugggugaagcugcuggcauauuuaugacggcaacuccaccagguucaagagauccuuuuccucaaagcaaugcgcccauuauggacgaagagcgggaaauaccugaaagaaguuggaauucgggucaugaauggguuacagauuuuaaaggcaaaaccguuugguuuguaccgaguauuaaagcaggcaaugacauagcggcaugcuugagaaaaaauggcaaaaaaguuauucaacugucaaggaagaccuuugauagcgaauauauaaaaacuagaacuaaugauugggacuucguagugacaaccgauauuuccgagaugggggcaaacuuuaaagcagaacgggucauagauccaaggcgguguaugaaacccguuauccuaaccgacggcgaagagagagugauauuagcagguccaaugccugucacgcacucuagcgcagcgcaaaggagaggacgcguuggccgaaauccuaagaacgaaaaugaccaguacauauauaugggcgaaccacuagaaaacgaugaggacugcgcacauuggaaagaagcgaagauguuguuggauaacaucaacacuccugaagggauaauacccaguauguucgagccagagcgcgaaaaaguugaugcgaucgacggagaauacagauuacgaggagaagcgcguaagacuuuuguagaucuuaugagaagaggagaucuaccaguaugguuagcauaucgaguugccgccgaaggcauaaauuacguugacagacggugguguuucgacggaguuaaaaauaaccagauuuuagaagagaauguagaaguagagauauggacaaaagagggcgagcgcaagaagcuaaagcccagauggcuagaugccagaauauacucagauccacuagcauugaaagaauucaaggaauuugcagcuggacgcaaaagucuuacccucaacuuaauaaccgaaaugggcagauugccuaccuucaugacacaaaaggcuaaaaacgcgcuagauaaccuggcaguccuacauacugcggaggcuggggggcgggcguauaaucaugcacuaucugaacuaccugagacauuagagaccuuacuauuauugacacuuuuagcaacggucacaggagggauuuuucucuuucucaugucagguaaaggaaucggaaaaaugacuuugggaauguguugcauaaucacugcaaguauauuacugugguaugcgcagauacaaccccauuggaucgcugccaguauaauuuuagaauucuucuuaauuguacuacugauuccagaaccugaaaaacaacgaacaccucaagauaaucaauuaacuuaugugguaauagcgauccuaacggugguugcagccacgauggcuaaugaaaugggauuccuugaaaaaacaaaaaaagacuuuggcuuagguaguauaacuacacaacaacccgaguccaacauacuugauauagauuuacgaccugcauccgcauggacuuuauacgccgucgcgaccacauuuauuacaccaauguuacgccauucaauagaaaauucgaguguaaacguuucccuuacggccaucgcuaaucaagcaacaguuuugaugggauuagguaagggguggccuuuaaguaaaauggauauuggggugccauuacuagcuauaggaugcuacagccagguaaauccaaucacauuaacggcagcacugcuccuacugguagcccauuacgccauuaucgguccaggcuuacaggcuaaagcaacucgagaagcacagaaaagggcagcugcuggaauaaugaaaaacccgaccguggauggcaugacuguaaucgacuuagauccuaucccauaugauccaaaauucgagaaacaacuuggccaagucauguuauuaguccuauguguaacccagguauuaaugaugcguacaacaugggcguugugugaagcccucacgcuagcgaccggaccgaucucgaccuuaugggaagggaauccaggacgauuuuggaacacaacaauagccguaaguauggcuaacaucuuuagaggaucuuaucuagcuggagcuggauuauuauuuucgauaaugaaaaacacggcgaauacacgacgagggacagggaacacaggagagacuuuaggagaaaaauggaagaacagacuuaaugcauuaggaaaaagcgaauuccagaucuacaaaaaaucgggaauacaagaaguugacagaaccuuagcaaaagaaggaauaaaacguggugagacugaucaccacgcuguaucacgcgguucggcgaaacucagaugguuuguagaacguaaucucgugacuccagaaggaaaaguagucgauuuaggaugcgggagaggaggauggucauauuauugcggcgggcuaaaaaacguuaaagaagugaaaggacuuacuaaaggagguccaggucaugaagaacccauuccuaugucaacuuauggguggaacuugguucggcuacaauccggaguggauguauucuucacaccaccugaaaaaugcgauacccuguugugcgauaucggugaaaguagcccuaauccgacuguugaagcuggacgcacucuaagagugcugaauuugguugagaauuggcuuaacaacaauacacaguuuuguauuaaaguauugaauccauauaugccuaguguuaucgaaaaaauggaagcacugcaacgaaaauaugguggagcgcuagugcguaacccccuaucaaggaauucgacccaugagauguacugggucuccaaugcaucaggcaauauagugucaaguguaaauaugaucucuagaaugcucauuaaucgauuuacgaugagacauaagaaagcuaccuacgaaccggacguugaccugggcagugguacucguaauauagggaucgaaucagaaacacccaacuuagauauaauagguaaaagaauagagaaaauuaaacaagagcaugaaacuaguuggcauuaugaccaagaccauccauauaaaaccugggcauaucacggaaguuaugaaacaaaacaaaccggaagcgcaucuucaaugguaaacgggguaguaagguugcucacuaaaccaugggauguuauccccauggugacgcaaauggcaaugacugauacuacucccuuuggccagcaacgggucuuuaaggaaaagguagacacaagaacgcaggaacccaaagaaggaacgaaaaaacuaaugaaaaucacagcagaaugguuauggaaagaauuaggaaagaagaagacaccgcgaauguguacgagggaggaauucacaagaaaaguucguucaaaugcagcauuaggggcgauauuuaccgacgaaaauaaauggaaaucggcgagggaagcuguggaagauagugguuuuugggaacucguggacaaggaacggaauuuacaucuugaaggcaagugugaaacaugugucuauaauaugaugggaaaaagagaaaaaaaauuaggggaauuuggaaaagcaaagggcagucgggcaauaugguauauguggcuaggagcaagauuucuagaguuugaagcccuuggauuccucaaugaagaucauugguuuucaagagaaaauaguuugucuggaguugagggugagggcuuacacaaacuggguuacauucuucgagacguaucgaagaaagaagguggcgcuauguacgcugaugauacggccggaugggauaccagaauuacauuagaagauuuaaaaaacgaagagaugguuaccaaucauauggagggcgaacauaagaaacuagcugaggcuauauucaaguuaacauaucaaaacaaaguaguaagaguacaacggccaacuccuagaggaacugucauggauaucauaagccggcgagaccagcgagguuccggccaaguugugaccuauggcuuaaauacauuuacaaacauggaggcacaauugauucgucaaauggaaggagaaggaguguuuaagaguauacagcaguuaaccguaaaagaagaaauugcagucaagaauuggcuuauaagaguaggacgugaaaggcugucucgaauggcgauaucuggugacgauugcguaguaaaaccauuggaugauagguucgcaucagcucuaacugcguugaaugacaugggaaaaguucggaaagacauacaacagugggaaccaucaagaggauggaaugauuggacacagguuccguucugcucgcaccauuuccacgaauuaauaaugaaagauggaagaguauuagugguaccaugccguaaucaagacgaacugauuggacgugcgagaauuagccagggugcgggauggucuuugcgcgaaacagcuugucuagguaaaaguuacgcgcagauguggaguuuaauguauuuucaccggagagaucugcgcuuagcugcaaaugcgaucuguagugcgguaccaucucauuggaucccaacaucccggacaacuuggaguauacaugcaacucacgaauggaugacaacggaagacaugcucacaguauggaaucgcguguggauacaggaaaaccccuggauggaagauaaaacacccguugaaucaugggaagaaauaccauaucuaggaaaaagggaagaucaguggugcgggucacuaauaggucugacuucucgggccacuugggcuaaaaacauucaaacagcaaucaaccaaguuagaagccuaaucggaaaugaagaguacacggacuauaugccaucgaugaagcguuucagacgagaagaagaagaagcaggaguacuaugguaa

SEQ ID NO: 22257 - RNA, 9876 nt, Artificial Sequence
  derived and/or modified CDS sequence (opt6) from DENV-2__KM279558__SS-prME
accgcugggauaauuauuaugaugauaccaaccguuauggcguuccaucugacaacacgcaauggugaaccucacaugauaguaucaagacaggaaaaagggaaaagccuuuuauuuaaaacggaaaacggagucaauauguguacauuaauggcaauggacuuaggugagcuaugugaagauacgaucacauauaacuguccuuuacuuagacaaaaugaaccagaagacauagauugcugguguaauucuacuucuacuuggguaacguacgguacaugcaccgcaacuggagaacaucgcagagagaaaagaucuguggcacucguuccccauguagggaugggucucgagacuagaacagaaacguggauguccagugaaggagcauggaaacacgcacagagaauugagaccuggaucuuacgucauccaggcuucacgauaauggccgccauuuuggcuuauacaauuggaacuacauacuuucaaagaguguuaauauuuauacucuuaacagccguaacaccuuccauggcuaugaggugcauugguauaagcaauagagacuucguagaggguguaaguggcggaucauggguagauauaguguuagagcauggcagcugcgugacaacaauggcgaaaaacaaaccuacacuagauuuugaacuuaucaaaacggaggcaaaacaccuugcaaccuuaagaaaauacugcguagaagcuaaauugacuaacacuacuacggcuucgcggugcccgacacagggugaaccgagcuuaaaugaagaacaagauaaaagauuuguaugcaaacauucaaugguugaccgaggauggggaaauggauguggauuguuuggaaaaggaggcauuguuacaugugcgauguuuacauguaagaaaaauauggagggaaaaguaguacagcccgaaaauuuagaauacaccauagugauuacgccucauucuggagaggaaaaugcaguuggaaacgauacuggaaaacacggaaaagaaauuaaaauaaccccacagucuucgauaacagaggcggaguuaacaggauauggcacagucacuauggaaugcagcccgcgaacuggacucgacuucaacgaaaugguacuucuacagauggagaauaaagcguggcuaguccauagacaaugguuucuagaucugccucucccaugguuaccaggagcugacacgcaagggagcaacuggauacaaaaagagacucuugucacauuuaaaaauccucaugccaagaaacaagacgugguaguauuaggaagucaggagggggcaaugcauacagcccuuacuggagcaacagaaauccagaugucaucuggcaaccuacuguuuacagggcaccuaaaaugccgccuucgaauggauaaacuucaacuaaaaggaaugucuuauucaaugugcacagguaaauucaaaguaguaaaagaaauagcggaaacucaacacggaacaauaguaauaagagugcaauacgagggugauggaagcccauguaaaauaccauuugaaauaauggaucuggagaaaagacaugugcuaggucgcuugauaacaguaaauccgauaguuacagagaaagacucgccagucaacauagaggcggagccgccguucggugacagcuauauaauaauaggcguagagccaggacaacuaaaacuaucaugguucaagaaaggcucaagcauaggccaaauguucgaaacaacaaugagaggagcaaaacguauggcgauauugggugacacugcaugggauuucgguucuuugggugguguauucacaaguauagggaaagcacuacaccagguguucggggccaucuauggagcagcuuuuuccggaguuucuuggacaaugaaaauuuugauagggguagugauaacuuggaucgggaugaacagucgaucuacaagccuaaguguaucacugguacucgucgguguagucacacuguauuuaggugucaugguccaagccgauucgggaugugucgucagcuggaaaaauaaagaauugaaaugcgguaguggcauauucauuaccgauaacguucauacauggacggaacaauauaaauuccaaccugagucuccaucgaaauuggcgucugccauccaaaaagcucaugaagaaggcauauguggcauaagaucgguuacaagacucgaaaaccugauguggaaacagauaaccccggaauugaaccacauucuaacggagaaugaaguuaaguuaacuaucaugacgggcgauaucaaaggcaucaugcaagccgguaagagaagucuucguccucaaccaacagaauugaaauauagcuggaaagcauggggcaaagccaaaauguuaucgacugaacuacacaaccacaccuuccuaauugacgggcccgagacugcugaguguccuaauacgaaucgugccuggaacucacuggagguugaagauuauggauucggaguauucacaacaaauauuugguugaaacuuaaagagaggcaggacgucuuuugcgacuccaaacuaaugucagcggccauuaaagacaaucgugcaguucaugcagacauggguuauuggauagagucugcccuaaacgauacuuggaaaauagaaaaagcgaguuucauugaaguaaagaguugucacuggccgaagucgcacacgcuauggucaaaugggguucuugaaagugagaugauaaucccuaaaaacuuugccggcccugucucccaacacaauuacaggccaggauaccauacacagacugcugguccguggcaccuaggaagguuggaaauggauuuugauuuuugcgaggguacaacuguaguaguuacugaggacuguggcaauaggggaccaagucucagaacuacuacagcauccggaaaauuaauaacggagugguguugccggucuuguacucuaccuccauuaagguauaggggagaagacggaugcugguacgguauggagauucguccccuaaaagaaaaagaagagaauuuaguuaauagcuugguuacagcuggacacgggcagauugauaacuuuucauuagguguucuaggaauggcacuauuccuagaagaaauguugaggacuagaguaggaacaaagcacgcaauacuucucguagcaguaucauuugugacccuaaucacgggaaauaugucuuuucgcgaccugggucggguaauggucauggugggagcaacaaugaccgaugacauaggaauggguguaacuuaccuugcuuuauuagcagcuuuuaaagucagaccuacauuugccgcaggauuauuacuucguaaauugaccucuaaagaacugaugaugacuacgauugggauaguacuacuaucacaguccacgaucccggaaucuauacucgaacugacggacgccuuagcccucggaaugaugguccuuaaaauagucaggaauauggagaaauaccaacuugcagugacaauaauggcaauuaguuguguaccgaaugcagugauacuacaaaaugcuuggaaaguuagcuguacgacccuagcuguaguaucagugagcccccuacuucuuaccaguagucaacaaaaagccgauuggauaccacuagccuugacaaucaaaggccuuaauccaacggcuauauuuuuaacaacacuaaguagaacaucuaagaaaagauccuggccacucaaugaagcgaucauggcgguaggaaugguuucuauucucgcauccagccuucugaaaaaugacauaccaaugaccgguccguuaguagcaggagggcuacuuacaguuuguuacguguugaccgggcgaagcgcagauuuagaauuagaaagagccgccgacguaagaugggaagaacaagcggaaaucagugggaguucuccuauuuuaagcauaaccauaucugaggaugguucuaugucgaucaaaaaugaagaagaagaacagacgcucacaauacucauucguaccgguuuauuaguaauuagugggcuguucccaguaagcauuccaauaacagcagccgcaugguaucuaugggaaguaaagaaacaaagggcaggagucuuaugggaugugccuucaccuccuccuguaggaaaggcugaguuagaagauggcgcauaccguauaaaacaaaaagguauacucggauauagucagauaggagcuggcguuuauaaagaggguacuuuccauaccauguggcacguaacccgaggugcuguccuaaugcauaaaggaaaacguauugaaccgaguugggccgauguuaagaaagaccuaauaucguauggagggggauggaaauuagaaggugaauggaaagagggcgaagaaguucaaguguuagcacuagagccagggaaaaacccgagagcuguacaaacaaaaccaggacuauuuaaaacaaauacuggaacuauuggcgcugucagccuugauuuuaguccaggaacgucaggaucaccgaucguugauaagaagggaaaaguaguuggcuuauacggcaaugguguagugacacguucaggcaccuaugugagcgcgaucgcucaaacagaaaaaucaauagaagacaauccagaaauagaggaugauauuuuuaggaagaaaagauugacuauaauggauuuacacccuggagcaggaaaaacuaaacgauaccucccugcuauaguaagagaggccauaaaaagaggccugcgcacccugauucuagcgccaaccagaguagucgcugcugagauggaagaggcccucagaggacuaccaauucgguaucaaacuccugcaauacgagcagaacauacuggacgugaaauugucgaucuaaugugccaugcgacuuucacuaugagacuccucagcccaauaagaguaccgaacuacaaucuuauaauaauggaugaggcucacuuuacggauccggcgagcauagcagcaagagguuacauaagcacacggguugaaaugggcgaagcagcagguaucuucaugacagcaacaccaccuggauccagagauccauuuccacaaucaaaugcaccuauuauggacgaggagcgagaaauuccagagagaucuuggaacucaggacaugagugggugacagauuuuaaaggcaaaacaguuugguucguccccagcauaaaagccgggaaugauauugcagccuguuuaaggaaaaaugguaaaaaggugauacaacuaucacgcaagacauuugauucggaauacauaaaaacgagaacgaaugauugggacuuuguaguuacuaccgacauauccgaaaugggagcuaauuuuaaggcggaaagagucauagaccccagaagaugcaugaaaccuguuauacugaccgacggagaagaacgagucauacuggcggggccuaugccaguaacgcauaguucagcagcgcaaagacgggggcgaguuggucggaaucccaaaaaugaaaaugaccaauauaucuacaugggagaacccuuagagaacgaugaagauugugcucauuggaaagaggcgaagaugcuccuugauaacauaaauacacccgaggggauuauaccaucgauguucgaaccagagcgagaaaaagucgaugcuaucgacggggaguaccgacuacgcggugaagcucguaaaacauuuguugauuuaaugcgucguggagauuuaccggucuggcucgccuacagaguagcggcggaaggaauaaauuacgccgacagaagauggugcuuugacggcguaaagaacaaucaaauuuuagaggaaaauguugaaguagagauuuggacaaaagaaggagaacguaaaaaguuaaaacccagguggcuggaugccagaauauauucagaucccuuagcucuaaaagaguucaaagaauuugcugcuggaaggaaaucucucacguuaaaucucauaacugagauggguagauuaccaaccuucaugacacagaaagcgaaaaacgcucuggauaauuuagcaguacuacacacggcagaagcaggagggcgggcauauaaccacgcguuauccgaauugccugaaacacuagaaacacugcuucuacuuacauugcucgcuacggucacgggaggaauauuuuuauuccuuaugagcggaaaaggaauagguaagaugacucugggaaugugcugcauaauuacugcuagcauacuucugugguaugcacaaauacaaccacauuggauagcagcgucgauaaucuuggaguucuuuuuaauaguauuacuaaucccugaaccugaaaaacaaagaacuccucaggauaaucaacuuacauacguagucauagccauucuuaccgucguggcagcgacgauggcuaaugaaauggguuuucuggagaaaaccaagaaagauuuuggauuaggaucuauaacaacacaacagcccgaaaguaacauucuggauauagaucucagaccggcaucagcauggacucuauaugcaguggcgacaaccuuuauaacaccaaugcuaaggcauucgauugaaaauucaagugucaaugucaguuuaacugcuauagcaaaucaggcgacaguacuuaugggauuagguaaaggauggccgcuaucaaaaauggauauaggagugccucuauuagcuauaggaugcuauagucaagugaauccaauaacauugacugcagcacuuuuacucuuaguggcucacuaugcuauuaucgggccaggauugcaagcaaaagcuacacgagaagcacaaaagagagccgcagcaggaauaaugaaaaaucccacaguggaugguaugaccguuauagacuuagauccaauuccauaugacccuaaguuugaaaaacaauuaggccaaguuauguugcuaguacuuugugugacacaagucuuaaugaugcggacgacaugggcccugugugaagcguuaacauuagcuacaggcccaauuucaacgcugugggagggcaacccaggcagauucuggaacaccacaauagcuguuagcauggcgaauauuuucaggggaagcuaucuagcgggugcuggacuacuguucaguaucaugaagaauacggcuaauacaagaagggguacagguaacacgggagagacacugggggagaaauggaaaaaccgauuaaacgcucuaggcaaaagcgaauuucaaauuuauaagaaaagugggauucaagaaguugaucggaccuuagccaaagaggggauaaagagaggagaaacggaccaucacgcgguaucaagagguucugcuaaacuuaggugguuuguggaaagaaacuuagugacaccagaagguaaaguaguggaucuaggaugcggccgugggggauggucauacuacuguggugguuugaaaaacguuaaagaaguaaaaggucuaacaaagggaggcccgggacaugaagaaccaauuccuaugaguacauacgguuggaaccuagugaggcuacaaucuggaguagacguauucuuuacaccgcccgaaaaaugcgauacauuacucugugauaucggagaaucuucuccaaacccuaccguugaagcugggcgaaccuugagaguuuuaaacuuaguggaaaauuggcuaaacaauaauacucaauuuugcaucaaaguacuuaauccauauaugccaucagucauagaaaagauggaagcauugcaacgaaaauacgguggcgcauugguccgcaauccccuuagcagaaacucaacucaugaaauguauuggguaagcaacgccucaggcaauauaguaucgucgguuaauaugauuucgagaaugcuaauaaacagguucacaaugcgccauaagaaagcaacuuaugagccugacguggacuugggaucagguacgcgaaacauaggcauugaaucagaaacgccgaaccuagacaucauagguaaaagaauagagaagauaaaacaagaacaugaaaccagcuggcauuacgaucaggaucacccauauaaaacaugggccuaucaugguucguacgaaacgaaacaaacggggagugcuucaaguauggucaauggaguuguacgauuacucacuaaaccuugggacguaauaccuaugguuacacaaauggcuaugaccgauaccacaccauucggacaacagcgaguuuucaaggagaaaguagacacgcggacacaagagccaaaagagggcacuaagaaacuuaugaaaauuacagcagaaugguuguggaaagaauuaggaaagaagaaaacgcccagaauguguaccagggaagaguucacaagaaaagugcgaucaaacgcagcccugggcgcaauauuuacugacgaaaacaaguggaaguccgcgcgagaagcuguggaggacucgggguuuugggaauugguagauaaagaacgaaauuuacaucucgaaggaaaaugugaaacgugcguuuauaacaugaugggaaaaagggagaagaaacugggugaauuugguaaagcgaaaggaucacgggcaauuugguauaugugguugggcgcgagauuuuuagaguucgaagcacucggcuuucuaaaugaagaucauugguuuaguagagaaaauucauugucggggguagagggugaaggacuacauaaauuaggcuacauccugagggauguaagcaagaaagagggcggagcgauguaugcugacgauacagcgggaugggauacucgcauaacacuagaagaccucaagaaugaagaaaugguuacaaaucauauggaaggagaacacaagaaauuggcggaggcaaucuuuaaacucacauaucaaaauaaaguaguaaggguucaaagacccacuccgcgcgggacagucauggauauaauaaguaggcgcgaucaaaggggaaguggucaaguuguaacauacggguuaaacacuuucacuaauauggaagcacaacuuauuaggcagauggaaggagaaggaguauuuaaaucgauacagcaacuaaccgucaaagaagaaauagccgucaagaauugguuaauaagaguuggaagagaaagauuaagccgaauggccauuaguggggaugauugcguaguaaaaccacucgaugauagguuugcuagugcucuuacugcacuuaacgauaugggaaaaguaaggaaggauauucaacagugggaaccgagucggggcuggaaugauuggacgcaaguuccauucuguucacaucacuuccaugaauugauaaugaaagauggccgcgucuuaguuguuccauguagaaaucaagaugagcuaauuggacgagcccgcauuucucagggagcugguuggucccucagagaaacugccuguuuagguaaaaguuacgcacaaauguggucgcuaauguacuuucauagacgagacuuaagauuagcggcaaacgcaauuuguucggcgguacccucacauuggauaccuacuucaagaacaacguggagcauacaugcgacccaugaauggaugacaaccgaagauaugcuuacaguuuggaacaggguauggauccaagagaaucccuggauggaagacaaaacaccgguagagaguugggaagagauaccuuacuuggguaagcgggaggaccaauggugcgggaguuuaauaggccuaacgagucgcgcuacaugggcuaaaaauauccaaacagcuauaaaccaaguaaggucgcucauaggcaacgaagaauauacagauuacaugccaucaaugaaacgcuuuagaagagaagaggaagaagccgguguuuuaugguga

SEQ ID NO: 22258 - RNA, 9876 nt, Artificial Sequence
  derived and/or modified CDS sequence (opt6) from DENV-2__KM279564__SS-prME
acagcaggaauaauaaucaugaugaucccaacagucauggcauuucaucugacuacacggaacggagaaccccauaugauuguuucgcgacaagaaaaagggaaaagucugcuauuuaaaacagaaaacggagugaacaugugcacgcuaauggcaauggaucuaggggaauuaugcgaagacacaauuacauauaauugucccuuguuacgacaaaaugaaccggaagauauagacugcuggugcaacaguacaaguacuugggucacguaugguacuuguacugcaaccggugaacaccgacgagaaaaacgcaguguugccuuaguaccucauguaggaaugggucuagaaacccgcacagaaacuuggaugucaagugaaggagcauggaaacaugcacaaaggauagaaacguggauacuaagacacccgggguuuacaauuauggcagcaauccuagccuacacaauaggaacuacauacuuucaacggguauuaauauucauuuuacuuacagccguuacgccaaguauggcaaugcgauguaucgggauuaguaacagggauuucguagaaggcgucaguggcggaaguuggguagauaucguacuagaacacggauccuguguuacaaccauggccaaaaauaaaccaacacucgacuucgaacugauaaaaacagaagcaaaacaccuugcaacgcuuaggaaauauuguguggaagcaaaauuaacuaacacgacaacugcaagucguuguccgacacaaggugagccaucauuaaaugaggagcaagauaaaagauuuguaugcaaacauucaaugguggauagaggauggggaaacggauguggccucuuuggaaaagguggaauaguaacaugcgcaauguuuacauguaagaaaaauauggaaggaaaaguaguccaaccagaaaaucuggaauauaccauagucauuacgccacacucaggugaagagaaugccguaggaaaugacacgggaaagcauggcaaagaaauuaagauaacaccccagucuucaauaacugaagcugaacuaacuggcuauggaacaguuacuauggaauguucaccuagaacgggauuagauuuuaacgagauggugcuucuacaaauggaaaauaaagcguggcuuguacacagacaaugguuucuagaucucccacuccccugguugccaggagcugauacacagggcucuaacuggauacaaaaagaaacgcuaguuacuuucaaaaacccgcaugcaaagaagcaagacguaguaguguuaggcucacaggaaggagcuaugcauacagcauuaacgggagcuaccgaaauacaaaugucgucggggaaucuccuuuuuacaggacacuugaaaugucgauuaaggauggauaaauuacaauugaaaggaaugucauauuccaugugcacaggaaaguucaaaguaguaaaggaaauagccgaaacacaacaugguacaaucgugauaaggguacaguaugaaggugacggcaguccuugcaaaauuccguuugaaauuauggaccuggagaaaaggcauguccuagggagacuuauaacagugaacccaaucgugacagaaaaggauucaccaguuaauaucgaagccgaaccuccauuuggggacucauauaucauaauugggguagaaccaggucaauugaaguuaagcugguucaagaaagggucaucaauaggacaaauguuugagacaaccaugcguggggcaaaacgaauggcuauccuaggagacacugcaugggauuucgggagucuuggagggguauucacgagcauuggaaaagcacuucaucaaguauuuggagccauauauggggcggccuucucaggagugaguuggacaaugaaaauauuaaucggcguaguuaucacuuggauuggaaugaauagccgcaguacaagccucucagugagcuuaguucugguuggcguaguuacucuauaucuuggggucauggugcaagcugauaguggcuguguuguaucguggaaaaauaaagaacucaaaugcgguucugguaucuuuauaacagacaacguacacacuuggaccgagcaauacaaauuucagccagaauccccgaguaaguuagcgucagcaauucaaaaagcccaugaggaaggcauuugcggaauacgaagcgucacgagauuagaaaacuugauguggaaacaaauaacccccgaacuaaaucacauccuaaccgaaaaugaaguaaaacuaacaauaaugaccggugacauaaaagguauaaugcaagcaggcaaaaggagcuuaagaccacaaccaacagaacuuaaguauucauggaaggcuugggguaaagcgaaaauguuauccacagagcugcauaaucauaccuucuuaauagauggaccagaaacagcugaauguccaaauacgaacagggcauggaacagucucgaaguggaagauuacgguuuugguguuuucacuacaaauauaugguuaaaacuuaaagaaagacaagacguauucugugauaguaaauugaugagcgcugccauaaaagacaauagagccguccaugccgacaugggauacuggauugaaucugcauuaaacgauacuuggaaaauagagaaagcaucguuuauugagguaaagaguugucauuggcccaaaucucacacccuauggucaaauggaguucuagagucagaaaugauaauacccaaaaacuucgcaggcccuguaucccagcauaacuaucguccaggcuaucauacucaaacugccgguccauggcaccuuggucgacucgaaauggauuucgauuuuugugaggggacgacaguuguuguaacggaggauuguggcaaucggggaccgucuuuaaggacaacaacggccuccggaaaacucauaacagaaugguguuguagaagcuguacucucccaccgcuuagauauagaggugaagacggcugcugguauggcauggaaauaagaccacuuaaagaaaaagaagaaaaucuggucaacucacugguaacggcaggacauggacagauagacaacuuuucguugggagugcucgguauggccuuauuucuugaagagaugcuaagaacaaggguagguacaaaacaugcuauucucuuaguggcaguaucauuugucacacuaaucacagguaacaugagcuuuagagacuuagggaggguuauggucauggucggugcaacgaugacugacgacaucggcaugggcgugacauaccuagcuuuacuugcggcauuuaaaguaagaccuacauuugcagcuggacugcuacugaggaaacuuacaaguaaagaguuaaugaugacaacgauaggcaucguauuacuuucgcaauccacuaucccagaaucgaucuuggaauuaaccgaugcccuggcauugggaaugaugguauuaaagauuguaagaaauauggaaaaauaccaauuagccguuaccauaauggcuauaagcuguguaccuaaugcagucauccuacaaaacgcauggaaaguuucauguacuacacucgcaguggucaguguuagcccauuacucuuaacaucuagucagcaaaaagcagauuggauuccauuagcauuaacaauaaagggccucaacccaacugcaauauuccuaacuacacuaucacgaacaaguaagaagcgaagcuggccacuuaaugaagcuauaauggcuguaggcaugguaucgauauuagcaucaagucuucucaaaaaugauaucccuaugacaggcccauuaguagccgggggucuacugacaguuuguuacguccucaccgguaggucagccgaucuagaacuugagagagcagcugauguacgaugggaagaacaagccgaaauaaguggaucaagcccaauacuaaguauaacuauauccgaagauggcagcaugucgauaaagaacgaagaagaggaacaaacucuaacgauucuaauaaggacuggacuccuagucauaucgggauuauuuccugugucaauuccaauuacugccgcagcaugguauuuaugggaagucaagaaacagagagccgguguacucugggauguaccuucgccgccaccuguuggaaaggcagagcuagaagauggugcauaccgcauaaaacaaaaggggauacuuggauauagccaaauuggcgcuggcguuuacaaggagggaacauuucauacuauguggcacguuacccggggugcaguccuuaugcacaaagguaaaagaauagaaccaucaugggcagauguuaaaaaggaucuaauaucguauggcggaggcuggaaacuagaaggagaauggaaggaaggggaggaaguacagguauuggccuuagagccuggcaagaauccuagagcuguucagaccaaaccuggacuuuucaaaaccaacacgggaacuaucggcgcggucagccuagacuuuagcccaggaaccuccggaagcccaaucguggacaagaaaggcaaaguugucggacuuuacggaaauggcguugucaccagaucaggcaccuauguuucugcuauagcccaaacagagaaaucaauagaggauaauccggaaauugaagacgacauauuccgcaaaaagagacucaccauaauggaucugcaccccggagcgggaaagacaaagagauaccuuccagcaaucguccgagaagccaucaagcguggacugcgaacguugaucuuagcuccaacuagaguagucgcagcagagauggaagaagcccuaagaggacuaccaauaagauaucaaacuccugcaaucagagcugaacacacaggucgcgaaauuguagaccuaaugugccaugcaacuuuuacuaugagauuacuaagcccgauaagagucccgaacuacaaucugauuauaauggaugaagcccacuuuacggauccggcuucuauugcugcuagaggcuacaucaguacacgaguggaaaugggcgaagccgcaggaaucuuuaugacagcuacuccacccgggagucgagacccguuuccucaauccaaugcaccgaucauggacgaagagagggagauuccagagagaucauggaauagugggcacgagugggugaccgauuuuaaaggaaaaacuguuugguuuguacccucuauuaaagcugggaacgauauugccgcauguuugcguaaaaaugguaagaaagugauacaauugagcagaaaaacauuugauagcgaauauaucaagacacggacaaaugacugggauuucguagucacaacugacauaucagaaaugggggcgaauuucaaagcugagagaguaaucgaucccagaagaugcaugaaacccgucauuuugacggauggggaggagagaguuauauuagccggaccuaugcccgugacgcauucgucagcagcucaaagaagaggacguguaggccgaaaccccaaaaaugaaaacgaucaguacauauacaugggagaaccgcuagagaaugaugaggacugugcacauuggaaagaggcaaaaaugcucuuagauaacaucaauacaccagaaggaauuauaccuucgauguuugaaccggaaagagaaaaaguagaugcaauagacggagaauacagacuacgaggagaggcgagaaaaacuuucguugaucucaugagacgaggugacuugccaguauggcuggccuacagaguggcugcagaaggcauuaacuaugcagaccgaagauggugcuucgaugggguuaaaaauaaccaaauucuggaagaaaacguagagguugagauauggacuaaggagggagaaagaaagaaacuaaaaccucguugguuagaugcaaggauauacuccgauccgcuugcacuaaaagaauuuaaagaguucgcugcaggcagaaaaucauuaacccugaaccucauaacagagaugggcagacuccccacauucaugacucaaaaagcaaagaaugcuuuggacaacuuagcuguacuacauacugcagaagcgggaggcagagcguacaaucacgcauuaucggaauuaccagaaacacuagagacucuauugcuacuaacccugcuagcaacuguaacaggggguauauuucuuuucuugaugagcggaaagggaaucggaaaaaugacguuagguauguguugcaucauuacagcaucgauacuuuuaugguaugcacaaauacaaccccauuggauagcagcgucaaucauuuuagaguucuuuuuaauuguacuauugauuccggagccggaaaaacaaagaacuccgcaggauaaccaauuaacuuauguagugauagcuauauugacuguaguugcagccaccauggcgaaugagaugggguuuuuggagaaaacgaaaaaggauuuuggacuagggucuaucaccacgcaacaacccgaaaguaacauauuagacauagaucugagaccggcaagugcauggacucuuuaugcuguugcgacgacguuuauuacgccgaugcuucggcauaguauugaaaacagcuccguaaacguaaguuuaacagcuaucgcgaaucaagcaacugugcugauggggcuaggaaaaggguggccuuuaucgaaaauggacauagguguuccacuauuagcuauagguugcuacagccaaguuaaucccaucacacuaacagcugcauuacuacuauuggucgcucauuacgcuauuauuggaccgggcuuacaagcuaaagcaacucgcgaagcacaaaaacgagccgcggcaggaauuaugaaaaacccuacuguagaugguaugacuguuaucgaucuagauccgaucccauaugacccgaaauucgaaaaacaguuaggucaagucaugcuauuagugcuaugugucacacaagucuuaaugaugcgaaccacgugggcauugugcgaagcauuaacauuggcaacaggaccaauaucuacacucugggagggaaauccaggucgguuuuggaacacgacuauugcgguuucuauggcaaacauuuuuagagguagcuaccucgcaggggcgggcuuacuauuuucgaucaugaaaaauacugccaacacaaggagagggacagguaauaccggagaaacucuaggagaaaaauggaaaaaucgucuuaacgcccucggaaaaucugaauuucaaaucuauaagaaaucgggaauacaagagguagaccgcacguuagccaaagagggaauaaaacgaggugagacugaucaccaugcuguaagucggggcuccgcaaagcugcgcugguuuguugaacgaaaucuaguaacgcccgaggguaaagugguggauuuaggaugcggaagggguggauggucauauuacugcgggggucucaagaauguaaaagaaguaaaaggacuaacaaaaggcggaccgggacacgaagaaccaauuccgaugucgacauacggauggaacuugguccgauuacaaucgggaguagacguauucuuuacuccacccgaaaagugcgauaccuugcuaugugacaucggggagagcuccccaaacccuaccguugaagcugggaggacucugagaguacuuaauuugguagagaauuggcuaaacaacaacacgcaguuuuguauaaaagugcuuaaucccuacaugccuucaguaaucgagaaaauggaagccuuacagcgaaaguaugggggugcucugguacgaaacccuuuaucaagaaauucuacccacgagauguauuggguuucuaaugccucaggaaacauaguaucgucaguaaauaugauuaguagaaugcuaauaaaucgcuucaccaugagacauaaaaaggcaacauacgagccagauguugauuugggaucaggcaccagaaauauagggauagaaagcgaaacuccuaaccuagauauaaucgggaaacguauagaaaagauaaaacaggaacacgagacuucuuggcacuacgaucaagaccacccuuauaagacgugggcuuaccaugggucauaugaaaccaagcaaacaggaagugcuucgucaaugguaaauggcguggugagauuacuuacgaaaccgugggauguuaucccuauggucacacagauggcuaugacagacacaacaccauuuggucaacagcgcgucuucaaagaaaaggucgacaccagaacucaagaaccaaaagaggguaccaagaaauuaaugaaaauaacggcugaaugguuauggaaagaacuugggaagaagaaaacuccgagaauguguacgcgugaagaauuuacuagaaaggugcgcuccaaugcggcgcuaggugcaaucuucacagaugaaaauaaauggaaaucagcaagagaagcgguugaagauucgggauucugggaauuaguagacaaagaacguaaucuacauuuagagggaaaaugugagacaugcguuuacaacaugauggggaagcgcgagaagaaacugggcgaauuuggaaaagcaaaaggauccagagccauaugguacaugugguuaggggcgcgauuuuuagaauuugaggcacuaggauuuuugaaugaagaccauugguucaguagggaaaauucgcuuagcggcguagaaggugaaggacuccacaaacucggauacauucugcgugacguuagcaagaaagaaggaggugcgauguaugcagaugauacugccggcugggacacaaggauaacauuggaagaucucaaaaaugaagaaauggugacgaaucauauggagggagagcauaagaaacuagcagaagccauauuuaaacuuacauaccaaaacaaaguugugcgaguacaacggccaacaccuaggggaacgguuauggacauaaucagucgucgggaucaaagaggaucaggacagguuguaacuuacggucucaacacauucacuaauauggaagcacagcuuauacgacaaauggaaggggaaggaguauuuaaaucuauucagcaauuaacagucaaagaggaaauagcagugaaaaauuggcucaucagaguaggacgggaacgacugucgagaauggcuauauccggggacgauuguguugugaagccacuagacgaccgcuuugccucugcccuuacugcacugaaugacauggguaagguccgcaaagacauccaacaaugggagcccagcagaggguggaaugacuggacccagguacccuucugcucgcaccauuuucaugaauugauaaugaaagaugggcguguauuaguaguaccaugucgcaaucaagaugaauuaaucgggcgugcaagaauuucucagggugcuggauggucuuuaagagaaacagcaugucuggguaaaucauaugcucaaauguggucacuaauguacuuucaccgucgcgaucugcgguuggcggcuaaugcaauuuguagugccguaccuagucacuggauaccuacuucgcgaacaaccugguccauacaugcgacucacgaauggaugacgacugaagacauguuaacagucuggaaccgcguauggauccaagaaaacccauggauggaagauaaaacucccguagaauccugggaagaaauuccguaccuuggcaaaagagaagaucaauggugcggaagucuaauuggacucacaaguagagcaacaugggccaagaauauacaaacugcuauuaaucaaguaagaucacuaauugggaaugaagaguacacagauuauaugccuagcaugaaacguuuccgaauagaagaagaagaagcugguguauuaugguaa

SEQ ID NO: 22259 - RNA, 9876 nt, Artificial Sequence
  derived and/or modified CDS sequence (opt6) from DENV-2__KM279595__SS-prME
acugcggggaucauuauuaugaugauaccgacagugauggcauuucaucuaacaacgagaaauggagaaccgcauaugauagugucccgucaagaaaaagggaaaaguuugcuauuuaaaacggaaaauggugugaauaugugcacacuuauggcgauggaucugggagaacuaugcgaagauacaaucacauacaauuguccuuuauuacgacaaaaugaaccugaagauauugauugcugguguaauaguacaaguacauggguaacauauggcacuuguacugcaacaggcgaacauagaagagagaaaagguccguugcgcuugucccacauguaggaaugggucuggaaacuaggacagaaacauggaugucaucagaaggggcauggaaacacgcucagagaauagaaaccuggauauuaagacacccagguuucacaauuauggcagcaauauuggcuuauacuauuggcaccaccuacuuccaaagaguccuuauuuuuauuuuacugacagcaguaacgccaucaauggcaaugagauguauuggaauauccaaucgugauuuuguagaaggaguaaguggggguucuugggucgauauuguacuggaacacggaaguugcguaacuacaauggcgaaaaacaaaccuacuuuagauuucgaacuuaucaaaacagaagcgaaacauuuagcaacacuacgaaaauauugugucgaagcuaaauuaacaaacacgacaaccgcaaguagaugcccuacacaaggagaaccuucacuuaaugaagaacaagauaaaagauuuguauguaaacauucaauggucgaccguggaugggguaaugguugcggacuuuucgguaaaggaggcauugugacaugcgcgauguucacauguaaaaagaauauggaaggaaaagucguccaaccagagaauuuggaguauacuaucguuauuacuccgcacucaggugaagaaaacgcaguaggaaacgacacugggaaacaugggaaagaaauuaaaguaacaccacaaucgucaauaacagaggcggagcuuacaggauacggaacgguaacuauggaguguucuccuaggacagguuuagacuuuaaugaaaugguguugcuacagauggaaaauaaggcuugguugguacacagacagugguuuuuagauuuaccauuaccaugguugccaggcgcagauacucagggaucgaauuggauacaaaaagaaacauugguaaccuuuaaaaauccucaugcaaagaaacaagauguaguaguauugggcagucaagaaggugcaaugcauacagcauuaacaggcgcgacagagauccaaaugucaucugggaauuuacuuuucacgggacacuugaaaugccgacugcgaauggauaaauuacaacuuaaaggaaugucuuauucgauguguacaggcaaauucaaaguagugaaagaaauagcagaaacacaacacggaacuaucguuauaagagugcaauacgaaggugacggaucaccguguaaaauaccauucgaaauaauggaccuagagaaaagacaugugcugggcagacugauuacaguaaaccccauagucacugaaaaagacaguccuguaaauaucgaagcggaaccaccauucggagauucguauauaauaauagguguugaaccagggcagcuuaaacuuaguugguuuaagaaaggauccucgauuggucagauguucgaaacaaccaugcguggagcaaaacgaauggcaauacuaggggauacggcuugggacuuuggaucauugggaggaguauuuacaaguauaggaaaagcacuucaccaaguauucggcgcaaucuauggugccgcguuuucaggagugagcuggacgaugaaaauccugauaggaguaguaauuacuuggauugguaugaacucacgcagcacaucguuaucagucucuuuaguccuagugggugucguaacgcuguaccuuggcguaaugguacaagccgauucuggguguguaguaagcuggaaaaacaaagaacuaaaauguggcucggguauuuucauaacugacaacguacauacguggacggaacaauauaaauuucagcccgagaguccgucaaaacuagcuucggcuauacaaaaagcacaugaagaagggauaugugguauaagaucagucacuagacuagagaaccucauguggaaacagauaacaccagaacuuaaucauauccucacagaaaaugaggucaaacuaacuaucaugacuggggauauaaaaggaaucaugcaggcaggaaagagaacacuaagaccacaacccacggaacuaaaauacucuuggaaggcguggggaaaagcaaaaauguuaucuacugaauuacauaaucacacguuccuuauagauggaccagaaaccgcagaguguccuaauacuaauagagcauggaacucgcuagagguugaagauuacggguuuggcguguuuacaacaaacauuugguugaaacugaaagaaagacaggaugucuuuugugacaguaaguugaugagcgcagcuauaaaagacaauagagcaguacaugcagauauggguuauuggauugagucagcacuuaacgacaccuggaaaauagaaaaagcguccuucauagagguuaaaaguugccauuggccuaaaagccacacgcuuuggucaaauggaguauuggaaucagaaaugauuauacccaaaaauuucgccggccccgucagccaacauaauuaucgucccggguaccacacacaaaccgcggggccuuggcaccuaggucgguuagaaauggauuucgauuuuugugaagguacuacuguggucguaacugaagacugcggaaacagaggcccaucauugaggaccacgaccgcauccggaaaauuaaucacugaauggugcugucgaucaugcacucuacccccauugcgguaucggggagaagacggcugcugguauggaauggagaucagaccauuaaaagaaaaagaggagaauuuaguaaacuccuuaguaacggcgggacacggacagaucgauaacuucagcuuggguguauuaggaauggcuuuauucuuagaggaaauguuaagaaccagggucggaacaaagcaugccauacuccuagucgcagugaguuuuguaacacugauaacaggaaauaugucauuuagggaucuaggacgagucauggugauggugggggcuacaaugaccgaugacaucggaauggggguuacauaucuggcucucuuggcagcguucaaaguucgucccacuuuugcagcuggguuacuacuucgaaaacuaaccucaaaagagcuaaugaugacaacuauaggaauaguuuuacuuucacaaaguacuaucccugaaucgauacucgaauuaaccgacgcauuagcccuggggaugaugguauuaaaaaucgucagaaauauggagaaauaucaauuggcgguaacaauaauggcgauuuuaugcguuccgaaugcaguaauccuccaaaaugcguggaaaguuucaugcacuacauuggccguagugucugucaguccgcugcuacuaacuagcucccaacaaaaagcagauuggauuccgcuagcucugacuauaaagggauuaaacccaacagcuauuuuccucacaacauugaguaggacaucaaagaagcgaucuuggccccuaaaugaagcuauuauggcaguaggcaugguguccauauuggcaucuagccuacuuaaaaaugacauuccuaugacgggcccccucguugcuggagguuuguuaacuguauguuauguucuuacaggucguucggcagauuuagaauuagaaagagcugcagaugugagaugggaagaacaagcagagaucucaggaaguucgccgauauuaucaaucacaaucuccgaggaugguaguaugucaauuaaaaacgaggaagaagaacaaaccuuaacgauauugaucaggacaggccuguuaguaauuaguggucuuuuucccgucagcauuccaauaacggccgcugcaugguauuuaugggaaguuaagaaacaaagagcuggcguacugugggaugugccuagucccccaccaguaggaaaagcagagcuagaagacggagcauaucgaauuaaacaaaaagggauacuagguuacucgcagauaggugcuggagucuacaaggaaggcacuuuccacacgauguggcaugucacaagaggagcaguacuaaugcauaaagggaagcggauagaaccuagcugggcagauguuaagaaagaucuaaucagcuaugguggggguuggaagcucgagggagaauggaaagaaggcgaagaaguacaggugcuagcacuagaaccugguaaaaauccacgugcgguacaaacgaaaccuggauuguuuaaaacaaauaccgggacuaucggggccgugagccuagacuuuaguccaggaaccaguggauccccgauaguugacaagaaaggaaaaguaguuggcuuguauggaaaugguguaguuacaagaagcgggacguacgucucugcgauagcccaaacagaaaagaacauugaagacaauccggaaauagaagaugauauauuccguaagaaacgauuaacgauaauggaucuacauccuggagccggaaaaacaaaaagauauuuaccagcaauuguaagagaagcuauaaaacgggggcuuaggacauuaauacuugccccuacacguguagucgcugcugaaauggaggaagcacuuagaggauuaccuaucagguaucaaaccccagcuaucagagcagaacacacugguagagaaauuguugaccuuaugugccaugccacauucacaaugcgauugcugucaccaauaaggguuccuaauuacaauuuaauaauuauggaugaggcucacuuuacagauccagcuucaauagcugcucguggauacauuaguacacgaguugaaaugggugaggcugcaggaauuuuuaugacagcaacgccucccggaagucgugauccauuuccgcagagcaaugcaccuauaauggaugaggagaaagaaaucccagagcgaucguggaacuccggucacgaauggguaacggacuuuaaagguaaaacggucugguuuguaccauccauaaaggcagguaaugacauagcugcauguuuacguaaaaauggaaagaaaguaauacagcuaucgagaaaaacuuuugauagcgaauacauaaaaacaagaacaaaugacugggacuuuguaguuaccacagauauuagugaaaugggugcaaauuucaaagcagagagaguaauagauccaaggcgaugcaugaagccagucauacuuacggauggagaggagcggguuauauuagcuggcccgaugcccguuacucauuccuccgcggcacaaaggcgaggacgaguaggucgaaaucccaaaaaugaaaaugaccaguauauauacaugggagaaccucuggaaaacgaugaagauugcgcacauuggaaagaagcaaaaauguuacuagauaauauuaacacaccagagggaauuauuccaaguauguucgaaccagaaagagaaaaaguggaugcuauugauggcgaauauagauugcgcggagaagcuagaaagaccuucguugaucuaaugagaaggggagauuuaccagugugguuagcauauaggguagcugcagaagguauuaauuaugcagacaggcggugguguuucgaugggguaaagaacaaccagauucuugaagaaaauguggaaguugagauauggacuaaagagggggaaaggaagaaauugaagccaagauggcuggaugcaaggauauauucagacccucuagcguuaaaagaguucaaagaauuugcagccgguagaaagucccuaacuuuaaauuugaucacugaaaugggaagauuaccaacguucaugacgcaaaaagccaaaaaugcuuuggacaaucuggcuguauuacacacagcagaagccgguggucgcgccuacaaucacgcacuuagugagcugccggagaccuuagaaacacuacuauuacuuacacuacuggcgacuguuacuggugggauauucuuauuccucaugucagguaaaggcauaggaaagaugacuuuaggaauguguuguauuauaacugcuaguaucuuacuaugguacgcacaaauacaaccgcauuggauugcugcuucaauaauuuuagaguucuuuuuaauaguguuauugaucccugagccagaaaaacagaggacaccgcaagacaaucaacuaacauaugugguaaucgccauccuaacaguaguugcugcuacgauggcaaaugaaaugggauuuuuagagaaaacgaagaaagacuuuggccucgggucuauuacuacacaacaacccgaaucaaacauauuggauauugaccuaagaccagcaucugccuggacguuguaugcuguagcaacgacauuuauaacaccuauguuaagacauagcauagaaaauagcucgguaaacgugucauuaacagcaauagccaaccaagcaacaguauuaauggggcuuggaaaagguuggccccuaaguaagauggacauaggagugccauugcucgccauugggugcuacucacaggugaaucccauuacuuugacagcagcacuauuauuguuagucgcccacuaugccauaaucgggccagggcuccaagcaaaagccacaagagaagcacaaaaacgagcugcggcugguaucaugaaaaacccaacaguagacgguaugacggugauugauuuagauccaauaccauacgacccaaaauuugagaaacagcuuggccaaguuauguuauugguauuauguguaacccaaguucuuaugaugagaaccacgugggcauuaugugaagcacugacauuggcgacaggaccgaucaguacguugugggaagguaacccaggucguuucuggaauacaacaauagcaguaaguauggcgaauaucuuucguggaagcuaucuagcgggcgcggguuugcuguuuucaauaaugaagaacacagcuaacacuaggaggggaacagguaauaccggugaaacacuaggggagaaauggaaaaaccgacuuaacgcgcucggaaaaagugaauuucagauauauaaaaagagugggauccaagaggucgauaggacucuagcaaaagaaggcauaaagagaggugaaacugaucaucaugcaguaucacgugggagcgcgaaacuucgaugguucgucgaaagaaaucuagugacuccagagggaaaagugguagaucuaggcuguggacgagguggauggucauauuauugcgguggccucaaaaauguuaaagagguaaaaggucucacuaaagggggacccggacaugaagaaccuauaccaaugucaacuuacggauggaaccugguuaggcuucaaucgggaguggauguguucuuuaccccaccugaaaagugugauacguuacuuugugauauaggugagaguucaccaaacccuacgguagaagcagguagaacauuacgcguacuaaaucuuguugaaaauugguugaauaauaauacccaauucugcauuaaaguccuaaauccauauaugccaagcguaauagagaaaauggaagcgcuucagaggaaauacgggggugcucuuguacgaaauccacuauccagaaauucgacgcacgaaauguacugggugucaaacgccuccggcaauaucguuagcaguguaaauaugauaaguagaaugcugauuaauagauucaccaugcgccacaagaaggcaaccuacgaaccagauguggaccuaggauccgguacucggaacaucggcauugaaagugaaaccccuaaccuagauauuauagggaaacguauagagaaaauuaaacaagagcaugaaaccuccuggcauuaugaucaagaucacccuuauaaaacuugggcauaccaugggucauacgaaacaaaacagacaggcucagcaucuaguaugguuaaugguguugugcgacuucuuaccaagccuugggacguaauaccaaugguaacacaaauggccaugacagacacgacaccuuuuggacaacaaaggguauucaaggaaaaaguagacacuagaacccaagagccuaaagaggguacuaagaagcuaaugaaaauuaccgccgaauggcuguggaaggaacuagguaagaagaaaacuccaaggaugugcacuagggaagaauuuacgagaaaaguucgaucuaaugcagcgcuaggcgcaauauucacugacgaaaacaaguggaagagugcucgugaggccguggaggacuccggauucugggaauuaguugauaaggaacggaauuugcauuuagagggaaaaugugaaacgugcguauauaauaugaugggaaaaagagagaagaaauuaggcgaguuuggaaaagcaaaagguaguagagcaauaugguacaugugguuaggagcacguuuccuagaguucgaagcauuggguuuucucaacgaggaccauugguuuuccagggaaaauagucugucggggguugagggagaaggguuacauaaauugggcuacauccuucgggacgucagcaagaaagaaggcggagcaauguaugccgaugauacggcuggcugggauacuagaauuacccuagaagaucucaaaaaugaagaaaugguaacgaaucacauggagggggaacauaagaaauuagcagaggcgaucuuuaaacugacguaucaaaacaaaguuguuagaguacagcgaccuacaccuagaggaacugucauggauauuauaagccgaagagaucaacgggggagcggacaaguaguuaccuacgggcuuaacacguuuacgaacauggaagcucaauugaucagacaaauggaaggagaagguguauucaaaaguauacaacaacuaacuguaaaggaagaaauagcgguuaaggauuggcucauaagggucggaagagaacgacuaucaagaauggccauuucgggagaugauugcguaguuaagccauuagacgacagauucgcuagugcacuaaccgcauugaaugacaugggaaaaguucgaaaggacauacagcaaugggaaccuagcagagguuggaaugauuggacucaaguuccguuuugcucacaucacuuucacgaauuaauaaugaaagacgggagaguacuugugguuccaugucggaaucaagacgaacugauaggacgagccaggauaucucaaggagcuggauggucucugagagaaacggcaugucuagggaaaucguaugcucagauguggagucucauguauuuucaucgaagagauuuacgacuugcggcuaacgcuauuugcuccgcagugccaagccauuggauuccaacaaguaggacgaccuggucaauacacgccacgcacgaauggaugacgaccgaagacaugcucacaguguggaauagggucuggauccaagaaaauccauggauggaagacaagacuccaguggaaucaugggaggaaauaccauauuuaggcaaacgagaagaccaauggugcggcucuuuaaucgguuuaaccagucgagccacgugggcuaagaacauucaaacagcuaucaaccaaguuagaucuuuaaucggaaaugaagaauauacagauuacaugcccucuaugaagagguuccgccgagaagaagaggaggcuggugugcugugguaa

SEQ ID NO: 22260 - RNA, 9876 nt, Artificial Sequence
  derived and/or modified CDS sequence (opt6) from DENV-2__KM279566__SS-prME
acagcagguauaaucauaaugaugauacccacugugauggcguuucauuugacaacacggaauggagaaccccacaugauaguauccagacaggaaaaaggaaaaaguuuacuauuuaaaaccgagaauggaguuaauaugugcacauuaauggcuauggacuuaggugaacuuugugaagauacaauuacauacaacugcccccuccuucgacaaaacgaaccagaagauauugauugcuggugcaacucaaccaguacauggguaacguauggaacaugcacagcaacuggagaacauagacgagaaaaacgaucaguugcauuaguaccacauguaggaaugggucuagaaacacgcacggaaaccuggaugucaucagaaggagcuuggaaacaugcccaaaggaucgaaaccuggauacuacgacauccaggcuuuacuaucauggcggcaauucuagcauauacaauagggaccacuuacuuucaacgcguacugaucuuuauucuacuuacagcagucacaccuagcauggcaaugagauguauugguaucaguaaucgagauuuuguagaaggaguuagcgguggcuccuggguagacaucguauuagaacauggaucgugugugacaaccauggcuaaaaacaaaccaacacuagauuuugaacucauuaaaacagaagcuaaacaucuagccacauuaagaaaauauugcguagaggccaaacuuacuaacacaaccaccgccucgcgaugcccuacacaaggagaaccaucguuaaaugaagaacaagacaaaagguuuguuuguaaacauucuaugguagaucguggauggggaaaugguugcggucuuuuuggaaaaggcggaauuguaacaugcgcaauguuuacaugcaagaaaaacauggaaggaaaaguaguacaaccugaaaaucuggaauauacaaucguuauaaccccacacucaggagaagagaacgccguagguaaugauaccgguaagcaugguaaggagauaaaagucacgccccaguccuccaucacagaagcggaacucaccggauauggaacaguuacgauggaaugcagcccaaggacaggccuggauuuuaacgagaugguucuuuuacagauggaaaauaaggccugguuagugcaucgucaaugguuucuugacuuaccucuccccuggcuuccuggggccgacacccaaggaucuaauuggauccaaaaggagacccuaguaacguucaagaauccucaugcuaagaaacaagauguuguaguacuaggaagucaagaaggagcuaugcauacggcccuaacuggagcaacggagauacaaaugucaaguggaaauuuacuauucacuggccaucuuaagugucgauugagaauggauaaacuucaauuaaagggcaugucauacucuaugugcacaggaaaauuuaaaguggucaaagaaaucgcugaaacacaacauggcaccauuguaauucguguccaguacgaaggagacggauccccuuguaagauaccauucgagaucauggaucuagagaagaggcacguucuuggaagacuuaucacuguuaauccaauaguuacggagaaagauucaccuguaaauauugaagcagaaccgccauucggagauucauauauaaucauaggaguugaaccaggccagcugaaauuaucuugguucaagaaaggaucauccaucggacagauguuugaaacaacuaugcgaggcgcuaaaagaauggccauuuugggugauaccgccugggauuucgguagccuaggaggcguauuuacaaguaucggcaaggcuuuacaccaaguguucggagcuaucuacggugcugccuuuagcggaguaaguuggaccaugaaaauacuaaucggugugguuauaacauggaucgguaugaacucaaggucaacuucucuaucuguuucucuaguccuaguaggugugguaacacuuuaucuggguguaaugguccaagcugacucaggcugcguuguaucuuggaaaaauaaagaacugaaauguggaucaggcauuuucauaacagauaacguacauacauggacggagcaguauaaguuucagccugaauccccuaguaaacuugcauccgcgauacaaaaggcucaugaggaaggaauauguggaauacgcucaguaacaagacuggaaaaucuaauguggaaacagaucacaccugagcugaaucacauauuaacagagaaugaaguuaagcuaaccaucaugaccggagauauuaaaggaauaaugcaagcugguaaacgaacacuacgcccccaaccaacagaacuaaaauacagcuggaaggcauggggaaaagcaaaaauguuaucgacugaauuacauaaccacacuuuccuaauagauggcccagagacagcugaguguccgaauacuaauagagcauggaacucguuagagguugaggacuacgguuucgggguauuuacgacaaauauuugguuaaaacuuaaagagcgacaagacguguucugcgacucaaaacuaaugagcgcagcuauaaaagauaaucgggcuguucacgcagacauggguuacuggauagaaucagcauuaaacgauacuuggaaaauagagaaggcuucguucaucgagguaaaaucaugucauuggcccaagagucauacacuauggaguaaugguguacuagaaucggagaugauuaucccgaaaaauuuugcuggaccuguaucccaacauaacuaccgaccaggcuaccauacacagacagccgggccuuggcacuuagggagauuagagauggacuuugacuucugcgaggguaccacuguuguuguaacagaagauugcggcaaucguggcccaucacuccgcacgaccacagcgagugguaaauuaaucaccgagugguguugccguagcuguacucuacccccgcuacguuauagaggcgaagacgguugcugguauggaauggaaauuagaccacugaaagaaaaagaagagaaccuugucaauucuuuagugacagcaggucauggacaaaucgacaacuuuagucuuggugugcuuggcauggcauuguuuuuagaggaaauguuacgaacaaggguuggaacgaaacacgcuauauuauuaguagcuguuaguuucguaacauugauuacagguaauaugucauuuagggauuuagggagagugaugguaaugguuggcgcuaccaugacggaugauauaggcaugggcgugacauauuuagcgcuacuagcugcguucaagguaagaccaacauucgcagcaggucuauugcugaggaaauuaaccagcaaagaacuaaugaugacuacaauugguauuguguuacucucucaaucuaccauaccggagucaauacuggaacugacagaugcguuagcacuaggaaugaugguucucaaaauaguucgaaauauggaaaaauaucaacuagcaguuacaauuauggcaauucugugcguaccaaaugcuguaauacugcaaaacgcguggaaaguuucaugcaccacuuuggcagucgucagcguaagcccacugcugcuaacgagcagccagcaaaaagcagacuggauuccucuugcacuaaccauuaaaggacugaauccaacggcaauauuucucacuacuuuaagucgaacaagcaaaaagcguucauggccguuaaaugaagcaauaauggcaguugguaugguauccauauuagcaucuagucuauugaaaaacgauaucccuaugacugguccucugguggccggaggauuauuaaccguuugcuauguuuuaacugggcgauccgccgauuuggaauuggagcgcgcugcggacguccguugggaagaacaagcagagaucuccggcuccucaccgauucuuucaauaacgauuucagaagauggcuccaugucuaucaaaaaugaagaagaggaacaaacccugaccauuuuaauuaggacagguuuguuagucauaaguggccucuuuccuguaagcauccccauaacagcggcggcaugguaccucugggaagucaagaaacaacgagcagggguacuaugggaugugccaucaccuccuccugugggaaaagcggaauuggaggauggagcauaucggauuaagcaaaagggcauacuaggauacucccaaauaggagcaggcgucuauaaagaagguaccuuccacacuauguggcacguaacucguggugcgguguuaaugcacaaagggaaaagaauugagccuucaugggcugacgucaagaaagaccuaauaucguaugguggcgguuggaaauuagaaggggaauggaaagaaggugaagagguucagguccucgcccuagaaccaggaaagaauccaagagcaguacagacgaagccaggcuuauucaagacuaacacggguacuauaggagcagugagccuugauuucuccccaggaacuucaggaucuccaauuguagauaaaaaggguaagguagugggcuuauacgguaauggagugguaacacggucagguacauauguaucugcaaucgcccagaccgagaaguccauugaagacaacccagaaauugaggaugacauuuucagaaagaaacgauugaccauuauggauuuacacccuggagcugggaaaacaaaaagauaucuucccgccauaguacgggaagcgaucaaacgcggacuuagaacacuaauccuagcuccaacaagaguaguagcugcggaaauggaagaagcccuaagaggguugcccauaagauaccaaacaccagcuauaagggcggaacauacaggacgagaaauuguggaucuuaugugccaugcuacauucacgaugagacuauuaucuccaauaagagucccuaauuauaauuuaauaaucauggacgaagcccacuuuacugauccagcaucgauagcagcacgaggauauauaaguacacgaguugaaaugggagaggcggcaggcauauucaugaccgcaacaccucccggaucccgggauccauuuccccaaucuaaugccccgauaauggaugaagaaaaagaaauaccugagagaagcuggaauagugggcacgaaugggucacggacuuuaaagggaaaacaguuugguucgugccauccauuaaagcagguaacgauauugccgcaugcuuacguaaaaaugguaagaaaguaauucaacucucaagaaaaacuuuugacagcgaguauauaaagacuagaacaaaugacugggauuucgugguaacuacagauauaagugaaaugggugcgaacuuuaaagcagaacguguaaucgauccucgacgauguaugaaaccagucauucuaacagauggcgaggagagagugauacuugcaggaccaaugccugucacccacaguuccgcagcacagcgaagagguagaguuggccgcaacccuaaaaaugagaacgaucaauauauuuacaugggagaaccguuggaaaaugaugaagauugcgcucacuggaaagaggccaaaaugcuuuuagacaacauaaauaccccggaaggcauuauaccgucgauguuugagccagaaagagaaaagguagaugcgaucgauggagaauauagauugagaggugaggcaagaaaaacauucguagauuuaaugcgaagaggugaccucccagucuggcuagccuaucgaguagcggcagaaggaauuaacuacgcggaccgaagauggugcuuugauggcgugaagaacaaccaaauucuggaagaaaacgucgaaguugagauuuggacaaaagaaggggaaaggaaaaaguugaaaccacgaugguuagaugcacgaauuuauucugacccuuuagcucucaaggaauuuaaagaauuugcagccgggcgaaaaagucuaacacuaaaccuaaucaccgaaaugggaagacuaccaacauuuaugacacagaaggccaaaaaugcgcuagauaauuuagcuguccuacacacugcggaggcugggggaagggcauacaaucacgcacuaagcgaacuaccugagacccuagaaacauuauuacuuuugacacuuuuagcgacagugacagggggaauuuuucuguuucuaaugucaggaaaagggauuggaaaaaugacgcuuggaauguguuguauaauuaccgcuucuauauuguuaugguaugcacaaauucaaccacauuggauagcugcaaguauaauucucgaguucuuuuuaauaguucuacuuauacccgaaccggaaaagcaaagaacaccccaagacaaucaauugaccuauguaguuauugcaauuuugacggucguggcugccacaauggcaaaugaaauggguuuucuugagaaaacuaagaaagauuucggacuuggguccauaacaacgcaacaaccagaaucaaauauuuuagacaucgaucuucgucccgcuagugcauggacguuauaugcuguugcuacgacuuucauaacgccgaugcuccgccauucaauugaaaauagcagugucaacguuucgcuuacagcaaucgccaaccaagccaccguauuaaugggucucggaaaaggauggccucuuagcaagauggacaucggaguuccccuuuuagcaauaggaugcuacagccaagugaacccgauaacguugacagcggcuuuacuacucuugguagcucacuacgcuaucauaggcccuggucugcaagcuaaagcaacaagagaagcgcaaaaacgagcagcggcaggaauuaugaaaaauccaacgguggaugguaugacuguaauugacuuagauccuauuccuuaugauccaaaauuugaaaaacaacuaggacagguaaugcuucuuguacuuuguguaacgcaaguucucaugaugagaacaacgugggccuuaugugaagcacucacacuagccacuggaccgaucucuacacucugggaagggaauccugguagauuuuggaacacuaccauugcugugucaauggcaaauauauuucgagguaguuaucuugccggagcugggcuucuuuucucuaucaugaagaauacggcuaauacacguaggggaacaggaaauacaggagaaacacucggugaaaaguggaaaaauagacuuaaugcacuaggaaaaucagaguuccaaaucuauaagaagagugguauccaagagguugaccgcaccuuagcaaaagagggaauaaaacgaggugaaacagaucaucaugcaguaucaagagguucggcaaaauuacgaugguuuguugaacggaauuuaguaacacccgaaggcaaaguaguggacuuagguuguggaagaggaggauggucuuacuacuguggcggucugaaaaacguuaaggaaguuaaaggauuaacuaaaggaggcccugggcaugaagaaccaauaccaaugucuaccuacgguuggaauuugguccgauuacaaucagguguagacguauucuuuacgcccccugaaaaaugcgauacacuccuuugugauaucggagaaaguagcccaaauccaacaguagaggcggggcgcacauuaagaguuuuaaaucuaguagagaacugguuaaacaauaauacacaauucugcauaaaaguacuuaacccguacaugccaaguguaauagaaaagauggaagcauuacaaaggaaguauggaggagccuugguacgaaauccacugaguagaaauucuacacacgaaauguauuggguaucuaacgcuagcggaaauauagucucgaguguaaauaugauaucucgaaugcuaauuaacagguuuaccaugagacacaaaaaggcgacuuaugaaccugacguagauuuggguucuggaacuagaaacaucgggauugaaagugaaacaccuaaccuagauauaauaggcaaaaggauagagaaaauaaaacaggaacaugagacaaguuggcauuaugaccaagaucacccguacaaaaccugggccuaccacggcucauaugagacaaaacaaaccggaucagcaucgucaauggugaauggcguuguacguuuauuaaccaaaccaugggauguaauaccaaugguaacucagauggcuaugacagauacuacaccuuucggucagcagcggguguucaaagaaaaaguugacacucgaacucaagaaccgaaggaaggaacaaagaaacuaaugaaaauaacagcagaauggcucuggaaagaacuagguaaaaagaaaacaccuagaaugugcacucgagaggaguucacaagaaaaguucgaucuaaugcagcauuaggugcuauauuuacagaugagaacaaguggaaaucagcaagggaagcuguugaagauucuggcuuuugggaauuaguagacaaggagcgaaaucuucaucuagaagggaagugugagacuugcguauauaacaugaugggaaaacgugagaagaaauuaggcgaauuuggaaaggcuaagggaucccgagcaaucugguacauguggcucggagcuagguuucuugaauuugaagccuuaggauuuuuaaacgaagaucauugguucucaagagagaauaguuugagugggguugagggagaaggauuacauaaacuuggguauauucugagggaugucucuaaaaaggagggcggcgcaauguacgcggacgacacugcaggaugggauacaagaauuacacuggaagaccuaaagaaugaggaaaugguuacuaaucacauggaaggagaacacaagaaacuugcagaagccauauucaaacuaacauaccaaaacaaagucguccgcguccaaagaccaacaccacgggggacagugauggauaucauaucacgccgugaccaacguggaucgggccagguggugacuuacggauugaauacauuuacuaacauggaggcgcaauuaauacgucagauggaaggagaaggaguuuucaagucuauacaacaauuaacaguaaaagaagagauagccguuaaaaauuggcuuauaagaguugguagagagcgauugucuagaauggcuauaucaggcgaugacuguguuguaaaaccauuagaugaucguuucgcaucggccuuaaccgcccugaacgauaugggaaagguaagaaaagauauacaacagugggaaccaucacgcggauggaaugauuggacacaaguaccguuuugcucucaucauuuucaugaauuaauaaugaaagauggucgggugcucguaguaccaugcagaaaccaggaugaacuaaucggacgagcacgaauuucacaaggugccggcuggucauugcgugaaaccgcaugucucgguaaaaguuaugcucagauguggucacuaauguauuuucauagacgagaucuccguuuggcugcuaacgcgauaugcucagcuguacccagccauuggauaccaaccagucgaacuacuuggucuauucacgcuacucaugaauggaugacaaccgaggacauguuaacugucuggaacagggucuggauccaagaaaauccauggauggaggacaagacaccgguugaauccugggaagagauuccauauuuagggaagcgugaggaccaauggugugggucacugauagggcuaacuucaagagcaacaugggcgaaaaauauacaaacugcgaucaaucagguaagaucacucauuggcaaugaggaguacacugacuauaugccuagcaugaaacguuuuagaagagaagaagaggaagcuggaguacuaugguaa

SEQ ID NO: 22261 - RNA, 9876 nt, Artificial Sequence
  derived and/or modified CDS sequence (opt6) from DENV-2__KM279574__SS-prME
accgcaggaaucauaaucaugaugauaccaaccgugauggcauuccaucucaccacuagaaauggggaaccucauaugauaguuuccagacaagaaaaagguaaaaguuuauuguuuaaaacugaaaauggggucaauauguguacccuuauggcaauggaccugggggaacuaugugaagacacuauaaccuacaauuguccccuguuaagacagaacgaaccugaagauauagacuguugguguaauucaacuucuacuugggucacauacggaacuugcaccgcgacaggagaacacagacgugagaaacgaaguguugcguuaguuccgcauguuggaaugggacuagaaacacgaacagaaacguggaugucuucugaaggugcauggaaacaugcacaaaggauagaaacauggauuuugaggcauccgggauucacgauaauggcagcgauacuagcuuauacaauagguaccacguauuuccaacguguacuuauuuuuauuuuauuaacagcaguuaccccuuccauggcaaugagaugcauugggauaucuaacagagacuucguagaaggaguuucuggagguucauggguagauauuguccuugaacacggcucauguguuacgacaauggcgaaaaacaaaccaacucuagacuucgaacuaauaaaaacagaagccaaacaucuggcuacacuuaggaaauauugcgucgaagcgaaacuaacaaauacuacaaccgcuucaagauguccuacacagggggaaccuucucucaacgaagaacaggauaaaagauuuguaugcaaacacucgaugguagauagaggauggggaaacggauguggacuauuuggaaaaggggguaucgucacuugugcaauguuuacaugcaagaaaaacauggaggguaaaguaguucaaccugaaaaucuagaauauacaauuguuauuacaccacacucaggugaagaaaaugcuguugguaacgacacggguaagcauggcaaggaaaucaaaguaacaccccaaucgucaaucacagaagcugaauuaacggguuauggaaccgucacaauggaaugcaguccucggaccggccuagauuuuaacgaaaugguacuucuacagauggaaaauaaggcaugguuagugcauaggcagugguucuuagaucugccguuaccuuggcucccgggugcugauacgcagggaucaaacuggauacagaaagaaacacuugugacuuucaaaaauccucaugcaaagaaacaagauguaguaguuuuaggaucucaagaaggagccaugcauacugcacuuacgggugcgacagaaauccagaugucgucagguaauuugcuauuuacaggacaccugaagugcagauuacgaauggauaagcuacaacuuaaagguaugucguauaguauguguacaggaaaguucaaagugguaaaagaaauagcagaaacacaacacgggacgauaguuauacgcguacaauaugagggagaugggucaccuugcaaaaucccguuugaaaucauggaucuagagaaaaggcacguauuggggcgacuaauaacaguaaauccaauaguaacugaaaaggacagcccaguaaauaucgaagcagaaccaccguuuggagauucguauauuauuauuggaguagagccaggucaauugaaauugucaugguuuaagaaaggaucauccaucggccagauguuugaaacuacgaugagaggggcaaaaagaauggccauacugggagauacagcgugggacuuuggcaguuugggcggagucuuuacaucaauagguaaggcauuacaccagguguucggagcaauauauggugcggcauucaguggggucagcuggacuaugaagauuuuaauugguguuguaauaacuuggauuggcaugaacucuagaucaacaucauugucugugagcuuaguauuaguggguguuguaacucuauauuuagguguaaugguacaagcagacagcggcugcgucguaucauggaaaaauaaggaacucaaaugugguucaggaauuuuuauaacagauaauguccacacauggacagaacaauacaaauuucaaccagaaucuccgucuaaauuggcaagugcuauacaaaaagcacaugaagaagggauuuguggaaucagauccguuaccagacuagaaaacuuaauguggaagcaaauuacgcccgaacuaaaccauauucuaacggaaaacgaaguaaagcugacuauaaugacuggagauauaaaaggaauaaugcaggcaggaaaaagaacauuaagaccacaacccacagagcuaaaauauucguggaaggcaugggguaaagcuaagaugcuuuccacggaacuacauaaccacacauucuuaauagaugggccagaaacagcugaaugcccuaacacaaaccgagcauggaacucgcuugaaguugaagacuacgguuuuggaguauuuacgacaaauauaugguuaaaacucaaagaaaggcaggauguauucugcgacucaaaauuaaugucagccgcgaucaaagauaauagagcuguccaugccgauaugggauacuggauagagagcgcacuaaaugacacguggaaaauugaaaaagcuagcuuuauagaaguuaaaucuugucauuggccaaaaagucacacacugugguccaauggcguuuuggagucagagaugauaauuccgaaaaacuucgcaggccccguaucacagcauaauuauagacccggauaucauacgcaaacagcagguccuuggcacuuaggcagacuugaaauggauuuugauuucugcgaagggacuaccgucguagugacugaagacugcggaaauaggggccccagcuugcgaaccacaacugcaucuggaaaauuaauaacagaaugguguugccguucuuguacuuuaccgccacuucgauauagaggcgaggacggcuguugguaugggauggaaauacgcccguuaaaagagaaagaggagaauuuaguaaauucacuuguaacggccggacauggacaaauugacaacuuuucgcugggcguucuugguauggcuuuauucuuggaagaaauguuaagaacucgcgucgggaccaaacacgcaauacuccucguagcggugucauuugucacauuaauaacggggaauaugucauuuagagaucuaggaagaguaaugguaauggugggugcgacgaugacugacgauauagguaugggaguaacuuacuuagcauuacuagcagcuuucaagauaagaccuaccuuugcagcgggauugcuuuuaagaaaacuuacaaguaaagaguuaaugaugacaacuauaggaauuguuuuguugagccaaagcaccauaccggagucaaucuuagaacuaacggaugcucuagcacucgggaugaugguacuaaaaauuguccgaaauauggaaaaauaccaguuagcuguaacgauaauggcaauucucugugucccaaaugcaguaauauuacaaaacgcguggaaaguaucguguacuacacuagccguugucaguguaucaccucuucugcuuacaaguucacaacaaaaagcugauuggauuccucucgcauuaacuauaaaagguuugaauccgacagccaucuuuuuaacgacacucagccgaacaaguaagaaacgaucauggccacugaaugaagcaauuauggcaguugguaugguuucuauccuugcaucgucgcucuugaaaaaugauauuccgaugacaggcccacucguagcgggaggcuuauuaacaguauguuaugugcuaaccggaaggucagcagaccucgaauuagagagggcagcagacguaaggugggaagaacaagcagaaauaagugggucauccccgauacuauccauaacuauuucagaggacggaagcauguccauuaaaaacgaggaagaggaacaaacacuaaccauauuaauuaggacgggcuuguuaguuauaaguggucucuuucccgugaguauccccauaacugccgcagcgugguacuuaugggaagugaagaaacaaagagccgguguuuuaugggacguacccuccccuccuccaguuggaaaggcggagcuggaagauggagccuauagaauaaaacaaaaaggcauuuuaggauacucgcaaauaggcgcggguguauauaaggaaggaacguuccauaccauguggcacguaacucgaggagcaguacuaaugcauaagggcaaaagaauagagccaucaugggcagaugucaagaaagaucuaauauccuacggagguggauggaaacuugaaggugaauggaaggagggcgaagaaguacagguccuugcacuggagccaggcaaaaauccucgagcuguacaaacaaaaccaggacuauucaaaacgaauacaggaacgauaggggcagucagucucgacuucaguccuggaaccucggggucaccgauaguagauaaaaaggguaaaguaguaggucuguaugguaauggaguaguuacacgaagcggcacauaugugagugcaauugcccagacagaaaagaguaucgaggauaacccggaaaucgaagaugauauuuuccgcaaaaagcgcuuaacuaucauggaucuccaucccggugcaggcaaaacaaagagauaucuaccugccaucgugagagaggcaauaaaacgcggccuccgaacacuuauacuagcaccuacacgaguagucgcugcagaaauggaggaggcuuuacguggucuaccgauacguuaccaaacaccagcuauucgagcugaacacacagggcgcgaaaucguagaccugaugugucacgcgacauucacgaugagacuuuuaucucccauaagggucccuaacuauaaccugauaauaauggaugaagcacauuuuacagauccagcgaguauagcagcgcgaggauacauaaguacucgaguagagaugggagaagcggccggaauuuuuaugacggcgacuccgccgggaucacgugauccauucccucaaucaaacgcuccaaucauggaugaagaaaaagagauaccugaacguucauggaacucuggucacgaguggguaacagauuuuaaaggaaaaacaguaugguucguuccuaguauaaaggccggaaaugacauugcagccuguuuacggaaaaaugggaagaaagucauucaacuaagcagaaaaacauuugauagugaauacauaaaaacaagaacaaaugauugggauuucguuguaacaacagauauaagcgaaaugggugcuaauuucaaagcagaaagagucaucgauccaagacguuguaugaaaccuguaauacuaacugacggcgaggaacguguaaucuuagccggaccaaugccuguaacucacagcucugcagcgcaaagacguggaagaguaggucgaaacccuaaaaaugaaaaugaucaauacauuuauaugggugagccccuggaaaacgaugaagauugcgcucacuggaaagaggcuaagauguuacuggacaacauaaauacucccgaaggaauaauccccaguauguuugagcccgagcgagaaaagguugaugcgauagacggagaguauagacucagaggggaagcucguaaaacauuugucgaucucaugagacgaggcgacuugccuguguggcuagcuuaccgcguagcugcagaggguauuaacuaugccgaccgacgauggugcuuugauggaguuaaaaacaaccaaauccuagaggaaaacguugaaguugagauauggaccaaagaaggagaacguaagaaacuaaaaccuaggugguuagaugcaagaaucuauucugacccacuagcauuaaaggaguucaaagaguucgcagcaggacgaaaauccuuaacacugaaucucauaacagaaauggguaggcugccaacguucaugacacaaaaagccaaaaaugcacucgacaaucuagcuguacuucauacagcggaagccggaggccgugcauacaaucacgcacuuucagaacucccagagacuuuagaaacccuguuauuacuuacauuauuggcaacuguuacaggugguaucuuucucuuuuuaaugucuggaaaaggcaucgguaagaugacacuaggaauguguuguauaauaacugccucuauccucuuaugguaugcacagauucagccucacuggaucgcagcuagcauaauacuagaguucuuuuuaauaguacuauugaucccagagccagaaaaacagcgcacaccacaagacaaccaauuaacuuaugugguaauagcuauauuaacagugguugccgcaacaauggcaaaugaaaugggauuucucgagaaaaccaaaaaggauuucgguuuagguaguauaacgacacaacagccagaaaguaauauuuuagauauagaccuaagaccggcuucagcguggacauuauacgcuguugcgacgacguuuaucacaccaauguugcggcauuccauugaaaacucaucagucaaugugucauuaacugcaauugcaaaucaagcaacaguguugauggggcuugguaaagguuggccuuugucgaagauggacauaggugugccauuguuagcaauuggaugcuauagucaaguaaauccgauuacauugacagccgcacuauugcugcuuguugcacacuaugcuauaauagguccuggacuacaagcuaaggccacaagagaggcgcagaaaagagcggccgcuggaauuaugaagaacccaacugucgaugguaugacgguaauugaccuggauccaaucccuuacgaucccaaguuugaaaaacaacucggacaaguaaugcuauuagugcuuugugugacccagguauuaaugaugaggacgacgugggcguugugugaagcacuaacucuagcuacuggaccgauaagcacucuaugggaagguaacccgggacgauuuuggaauacaaccauugcuguuucaauggcuaauauuuuuagaggcagcuaucuugccggagcagguuuacuauuuuccaucaugaaaaacaccgcuaauacgagaagaggaacuggaaauacaggagagacacugggagaaaaguggaaaaaucgacuaaacgcucuugguaaaucugaguuccaaauauauaaaaaguccggaauacaggaaguagaucgaaccuuagcuaaggaaggaauaaaaagaggagagacugaucaccaugcaguaucaaggggaucagcaaaacuccgcugguuuguagaaagaaaucuuguaacaccugaaggcaaagugguggauuugggaugugguagaggcggauggagcuauuacugcgguggacuaaagaaugugaaagaggucaaagguuuaacuaaaggagggccaggucaugaagaaccaauaccgaugucaaccuacggauggaaucucguuaggcuacagagcgggguggauguauucuuuacgagcccagagaaaugugauacauuacuuugcgauauuggcgaaagcucuccaaacccgaccgucgaggcugggcguacucugaggguacuaaauuugguugaaaauuggcucaauaauaauacacaguuuugcauuaaagugcuuaacccauauaugccgagugugauugagaaaauggaagcgcuacagaggaaauauggcggagcuuuaguuaggaauccgcuuucgagaaauuccacgcacgaaauguauuggguaucaaaugcgucagggaacauaguuuccagcgugaacaugaucagccgcaugcuuauaaacagauuuacaaugagacacaagaaagcaacuuaugaacccgaugucgaucuagggucgggaacgagaaacauagguauagaaucugaaacuccuaaucucgauauaauagggaagcgcauugaaaagauaaagcaagaacaugaaaccaguuggcauuacgaccaagaccauccuuacaagacaugggcauaccacggaaguuaugagacuaagcaaaccggaagugcaucuucaaugguaaacggcguaguuagguugcuuacgaaacccugggauguaaucccuauggucacacagauggcaaugacagauacgacgccauucggacagcaaaggguuuucaaggagaaaguugauacgcgaacgcaagaaccuaaggaaggcacuaagaaauuaaugaagauuacagcagaauggcuuuggaaggaacuaggcaagaagaaaacuccgagaaugugcaccagagaagaguucacacggaaaguacgaucuaacgcugcgcuaggugccauauucacugaugaaaauaaauggaaaucagcaagagaagcaguugaggauucggguuucugggaauugguagauaaagaaagaaaucuucauuuagaaggaaaaugugaaaccugugucuacaauaugaugggaaaacgugagaagaaacucggggaauuugguaaagcaaaaggaucgagagccauaugguauauguggcuaggcgcaagauucuuagaguucgaggcuuuaggauucuuaaaugaagaccacugguuuagccgggagaacucacucucgggaguagaaggugaaggguugcauaaauugggauauaucuugagagauguuucgaagaaagaaggaggugcuauguacgcagaugacacagccggcugggauacgaggauuacacuagaggaccucgaaaaugaggaaauggugacgaaccacauggagggagaacauaagaaauuagcagaagccauauuuaaguuaacauaucaaaacaaaguagugcguguacaaaggccuacgccacguggcacuguaauggauauaauaucccgaagggaucaacguggcucaggacagguugugaccuauggacuaaauacuuuuacaaacauggaagcccaauuaauaagacaaauggaaggggaggguguguucaaaucaauacaacaguuaacuguaaaagaagaaauagcaguuaaaaauugguugacgagaguugggcgagaacgauuauccagaauggcaauauccggagaugauuguguaguuaaaccauuagaugaucgguuugcaagcgcacuaacggcauuaaaugauauggguaaaguacgcaaggacauucagcagugggaaccaucgcggggauggaacgacuggacacaaguuccguucuguagucaucacuuucaugaauuaauaaugaaggacgguagagugcuaguagucccguguagaaaccaagacgagcuaauugggcgagcaaggauuucucaaggcgcagguuggaguuuaagagaaacugccugucucggaaaaaguuaugcccaaauguggucguuaauguacuuucaucguagagauuuaagacuagcggcaaacgccauauguagcgcaguaccaagucacuggauacccaccucucggacuaccuggagcauucacgcaacacaugaguggaugacgacagaggauaugcucacuguauggaaccgaguauggauucaagaaaauccauggauggaagauaaaacuccuguagagucaugggaggaaaucccauacuuagggaagagggaggaccaauggugugguucacuaauaggacugacaucucgagcgacuugggccaaaaauauacaaacggcaauaaaucaaguaaggagucuuauuggaaaugaagaauauacugacuacaugccuaguaugaaaagguuuagaagagaagaggaagaggcaggcgugcucugguaa

SEQ ID NO: 22262 - RNA, 9876 nt, Artificial Sequence
  derived and/or modified CDS sequence (opt6) from DENV-2__KM279568__SS-prME
acugcagggauaaucauaaugaugauuccaacuguaauggcguuccaucucacuacuaggaacggugaaccgcacaugauuguaagcagacaagaaaaagguaaaucauuacucuuuaaaacagaaaacgggguaaacaugugcacucucauggcuauggauuuaggagaacuuugugaagauacuauaacuuauaauugcccuuuguuacgucaaaaugaaccagaagauaucgacuguugguguaauucgacaucgacaugggugacguauggaaccugcaccgcgacaggagaacauagacgugaaaaacgaaguguggcacugguaccucauguuggcaugggacuagaaacucggaccgaaacauggaugagcagcgaaggcgcauggaaacaugcacagagaaucgagacuuggauuuugagacauccuggauuuacgauuauggcagcaauccucgcauauaccaucgguacgacauacuuccaaagaguauugauauuuauauuguugacagcaguaacacccuccauggcuaugagauguaucgggauaucaaauagagauuucguggagggcguaucuggagguucaugggucgacauaguacuagaacauggcaguugcguaaccaccauggcuaaaaacaaaccgacacuggauuucgaguugauaaaaacagaagcuaaacaucuagccaccuuacgaaaauacugcguagaagcaaaauugacuaauacaacuacagccaguagauguccuacucaaggcgaaccgagucugaacgaagaacaagacaaaagauucguuugcaagcauucuaugguugacagaggauggggaaacgguuguggacucuuuggaaaaggagguauaguuacaugugccauguuuacguguaagaaaaauauggaagguaaaguaguccaaccugaaaauuuagaauauaccauaguuaucacuccacauucgggagaggaaaacgcuguggggaacgauacugguaaacacgguaaagaaaucaaaauaaccccucaaucaucgauaacagaggcugaauugacaggguaugguaccguuacaauggaauguucaccaaggaccgguuuagauuucaacgagauggugcuccuacaaauggaaaauaaagcguggcugguucacagacagugguuucucgauuugccguugccaugguugccuggggcagauacccaaggcucaaauuggauucaaaaagaaacguuggucacauuuaaaaauccucacgcuaagaaacaggauauagugguauugggaucacaagaaggagcuaugcauaccgccuugaccggcgcgaccgaaauacaaaugagcuccggaaacuuguuauuuacaggucacuuaaaaugucgguuacgaauggauaaacuucaacucaaaggcauguccuauuccaugugcacugguaaauucaaaguagucaaagaaauagcagaaacacaacacgguacaauugucauacgaguucaguacgagggugacggaucaccuugcaaaauuccuuucgaaauaauggaucuugagaaaagacauguauuaggacguuuaauaacuguuaauccgaucgucacagaaaaagauucaccaguaaacaucgaggcugagccaccauucggagauucguauauaauaaucgguguagagccuggacaauuaaaacuuucgugguuuaagaaaggaaguucgauaggacaaauguucgagacaacaaugaggggagcgaaacggauggccauccuaggagacacagccugggauuuuggaaguuuggguggaguauuuacaucaauugggaaagcacugcaccaaguauuuggggccauauauggcgccgcguuuaguggaguaagcuggacuaugaaaauacuuauuggaguaguuauaacauggaucggaaugaacagccguaguacaagucuaucuguaucauugguucuaguuggagugguaacacuauauuuaggaguuauggugcaggcugauaguggcugugucguauccuggaaaaauaaagaacugaaaugugggucgggaauauucauaacagacaacguccacacauggacugaacaauauaaauuucaaccugaaucgccguccaaauuagcuagcgcgauucagaaagcacaugaagaagggauaugugguauaaggagugucacuagauuagaaaaucucauguggaaacagauaacgcccgaguuaaaccauauucuuacagagaaugaagugaaauuaacaauaaugacaggagacauuaaaggaauaaugcaagccggaaaaagaucuuuacggccacaaccuaccgaguuaaaauacucuuggaaagcaugggguaaagccaaaauguuaagcaccgaacuucauaaucauacauucuugaucgauggacccgaaacugccgaaugcccaaauaccaauagagccuggaacucccuugagguagaagacuacggguucggagucuuuacaacuaauaucuggcuuaaacugaaagagaggcaggauguauuuugugauucuaagcuaaugagugccgccauuaaagacaauagagcaguucacgccgauauggguuacuggauugagagugcguuaaaugacaccuggaaaauugaaaaggcaucauuuaucgaaguaaaaucgugccauuggcccaaaucacacacucucugguccaauggaguuuuagaaagugaaaugauaauacccaaaaacuuugccggacccgucagccaacacaacuaccgaccuggcuaccacacacaaacagcagggccauggcacuugggacguuuagaaauggacuuugauuucugcgaagguacaacaguagucguaacggaagauugugguaauaggggcccuucccuacgcacuacgacagcaucaggaaaacucauuacugagugguguugucgaucauguacuuugcccccguuaagauacagaggugaagauggguguugguauggaauggaaauacgucccuuaaaggaaaaggaagagaauuugguaaacagccuggugacagccggacacggacaaauugacaacuucaguuuaggaguucuuggcauggcucuauucuuagaggagauguuacgcacacgcgugggcacaaaacacgccaucuugcuggucgcgguaaguuucguaacccucaucacagguaauaugucuuuucgcgaucuugggcguguuaugguaaugguaggcgcaaccaugacagaugauauagguauggggguuacguauuuagcauuacuagcggcauucaaagucaggccaacauuugcagcgggguuauuacuuaggaaacuaaccucuaaggaauuaaugaugaccaccauagggauaguucucuuaucccaaucuacuauucccgaaucaauauuagagcugacggacgcgcuugcguuagguaugaugguauugaaaaucgugcgaaauauggagaaguaucaacuggcugucacaauuauggcaauuucauguguaccaaacgcaguaauuuuacaaaacgcauggaaaguuagcugcacaacguuagcgguugucucuguaucuccucuccucuugacuuccagccaacaaaaagcagacuggaucccuuuagcauuaacuauuaaggguuugaauccaacagcaaucuuccuaacuacacuuaguagaacaaguaagaaacgguccuggccucuaaacgaagcuauuauggcgguggggaugguaucaauacuggcgagcaguuuacuaaagaaugauauaccgaugaccggaccacuggucgcaggaggacuuuugacaguuuguuacgucuuaacgggucgcagugcggaccuugaacuagaaagggccgcugacguaaggugggaggaacaggccgaaauaucagggaguucaccaauucuaucgauaacaauaagugaagacggaucgaugaguaucaaaaaugaggaagaagaacaaacgcuaacaauauuaauaagaacaggucuguuaguaauauccggucuauuuccaguaucgauccccauuacugcagcagcuugguauuuaugggaaguaaagaaacaacgugccgggguacuuugggauguuccauccccgcccccuguugguaaggcggaauuagaagauggugcuuaccggaucaaacagaaaggaauccuaggcuauucgcaaaucggcgcaggagucuacaaagaagguacguuccauaccauguggcacguuacaaggggagcaguauuaaugcauaaagguaaacgcauagaaccaucuugggcagauguaaagaaagauuuaauuagcuaugggggagguuggaaauuagaaggcgaauggaaagagggugaagaaguacagguuuuagcucuagaaccaggaaagaauccuagagcaguucaaaccaaacccggacuauucaagacuaauacaggcacaaucggugcaguaucucucgauuucucaccgggaacaagcggaagcccgauagucgacaagaaaggaaaaguaguaggccuguacgguaauggaguagucacacgaucggguacauacguaucugcgauugcacaaacagaaaaaucgaucgaagauaacccagagaucgaagaugacauuuuuagaaagaaacgacugacgauaauggauuugcauccuggugcagguaagacaaaaagauaccucccugcuauuguaagggaggcaauuaaacguggacuacgaacacucauccuugcaccaaccagaguaguagccgcagaaauggaagaagcacugagaggauugccaauacgauaucaaacgcccgcuauccgagccgaacacacggguagagaaauaguagaccuuaugugccaugccacuuucacuaugagauuauugaguccgauaagaguuccaaacuauaacuugaucaucauggacgaagcccauuuuacugauccagcaaguauagccgcaagaggcuauauuagcacgcggguagaaaugggugaagcugcugguauauucaugacagcaacaccucccggaucucgugacccauuuccucaaucuaacgcaccaauaauggaugaagaacgcgaaauaccugagcgcucuuggaacucuggucaugagugggucacugacuucaaagguaaaacaguaugguucguccccucgauuaaggcugguaaugacauugcugcgugccuucguaaaaaugguaaaaagguaauacagcuuucuagaaagacuuuugauucagaauacauuaaaacuagaacgaacgacugggauuucguagugacuacagacauaagugaaaugggcgcaaauuuuaaagcagaaagaguuauagacccgagaagauguaugaagccugucauucucacugauggggaagaaagagucauacuagcuggcccaaugccgguaacacacagcucagcugcacagcgaagaggacgcgugggaagaaauccuaaaaaugaaaaugaccaguauaucuauaugggugagccgcuugaaaacgacgaagacugugcacauuggaaagaagccaaaauguuauuggauaauaucaauacucccgaagguauaauaccuuccauguuugaaccagagagagaaaaaguugacgcgauagauggagaauaucgauugagaggugaagcaagaaaaacauucgucgaucuaaugcgcagaggggaccucccaguauggcuagccuaccgaguugcugcagaaggaauaaauuaugccgaucgaagaugguguuuugauggcgucaaaaacaaccaaauuuuggaagaaaauguggagguagaaauauggacuaaagaaggagaaagaaagaaacucaaaccaagauggcuugacgcacgaauuuauucugauccccuggcgcugaaagaguucaaggaguucgcagccgguaggaaauccuuaacucucaaucucauuacugaaauggguaggcuaccuacguuuaugacgcaaaaggccaaaaacgcguuagauaauuuggcggugcuacacacagcagaagcuggaggccgagcauauaaucaugcacuaucagaacucccagaaacauuggaaacucuacuauugcucacacuuuuagcuacuguaacaggagggauuuuucuguuucuaaugucggggaaggguaucgggaaaaugacguuagguaugugcugcauuauuacugcgaguauccuccucugguaugcacaaauucaaccacacuggaucgccgcguccauaauucuggaauuuuuccucauugugcuauuaauaccagaaccugaaaaacaaagaacaccacaagacaaucaacuaacguauguugucauugcuauccucaccgugguggcagcgacaauggcaaaugagaugggguuccucgagaaaacgaagaaagacuucggauuaggcucgaucacaacucaacagccagaaaguaauauauuagacaucgaucuucgccccgcaagugcuuggacgcuguaugcggucgcgacaacauucauaaccccuaugcuacgacauaguauagaaaacaguaguguaaacgucucacuaacggccauagccaaucaagcaacaguccugaugggauuagguaaaggauggccacuaucaaagauggauaucggagucccguuauuagcaaucggcuguuacucgcaagucaacccuauuaccuuaacagcugccuuacuacuccuagucgcacacuaugccauaauuggaccaggccuucaagcaaaagcaacucgagaggcacagaaaagagcagccgcagggauuaugaaaaacccaaccgucgauggcaugacuguuauagaucuugacccaaucccauaugaucccaaauucgaaaaacaacuaggacaaguuauguuacucguccucuguguuacacaagugcuaaugaugcguaccacaugggcguuaugugaagcacugacuuuagcaacgggaccaauuucaacguuaugggaagggaauccuggacgguuuuggaauaccacuauugcaguuaguauggcaaacauuuuucgggguucguauuuagcuggggcgggacuguuauucagcauaaugaaaaacacagcaaacacgagaagaggaacuggcaacaccggggaaacacuaggagaaaaguggaaaaacagacuaaaugcauuagguaagucugaauuucagauauacaagaaaagugggauacaagaagucgaccgcacccuagccaaagaaggaauaaagcggggagaaacggaucaccaugcaguaaguagggguucagcaaaauuaagaugguucguggaacguaauuuaguaacaccagagggaaaaguuguugaucuagguuguggucgaggggguuggucauacuauuguggaggucuuaaaaacguaaaagaaguaaaaggauuaacaaaagggggaccgggacacgaagaaccuauaccuauguccacuuauggcuggaauuuaguuagacuacaaagcgggguugauguauucuuuacaccgccugagaaaugugauacacuucuaugugauauaggcgaaaguucgccuaaucccacaguagaggccgggagaacuuugagagucuuaaauuuaguagaaaacuggcugaacaauaacacccaauuuuguaucaaggugcuaaaccccuacaugccuucaguaauagagaaaauggaggccuugcaacgaaaauaugggggagcauuaguaagaaacccacucagccgaaauagcacccacgagauguacuggguaaguaacgccucagguaauauuguaaguucagucaauaugauuucacggaugcuaauaaaccgauucacuaugcgucacaagaaagcgacauaugaaccugacguagaucuaggcucagggacuagaaacauagggauagaaucagaaacacccaacuuggacauaauagguaaaagaauagaaaagaucaagcaggagcacgaaacaaguuggcacuaugaucaagaccauccauauaaaacaugggccuaccauggaucguaugagacuaaacaaacaggaucagcaucuagcaugguaaacggaguugucagacuucuaacuaaaccuugggauguaauaccaaugguaacgcaaauggcaaugacagauacaacuccuuucggacagcagcgaguauuuaaagaaaagguugauacgcggacacaagaaccaaaagaggggaccaagaaauuaaugaaaauaacugcugaauggcuguggaaagagcucggcaagaagaaaacaccaagaaugugcacuagggaagaauuuacucgaaaaguaagaaguaacgcagcucugggcgccauauucacagaugagaacaaauggaaauccgcacgcgaagcaguugaagacucaggauuuugggaguuaguugauaaagaacggaaucugcaucucgaaggaaaaugcgaaacgugcguauauaacaugaugggaaagagagagaagaaauuaggagaguucgguaaagcaaaaggaucgagagcgauaugguacaugugguuaggugccagguuucuagaguucgaagcauugggauuucugaaugaagaucacugguuuagccgagaaaacucuuuaagcgguguggaaggggaaggauuacacaaauuaggcuauauacuuagggauguaucuaagaaagaagggggagcgauguacgccgaugauaccgccggaugggauacacguaucacuuuagaagaccugaaaaaugaagaaaugguaacgaaccauauggaaggugagcacaagaaacuugcagaagccauuuucaagcuaacuuaccagaacaagguuguuaggguucaacgaccgaccccgcgcgguaccgucauggauauaauuucaagacgagaccaacgggggucaggucaagugguuacguacggacuaaauacguuuacgaacauggaagcucaauuaauucgccaaauggaaggugaagggguuuuuaaaucaauucagcaacucaccgucaaagaggaaauagcuguaaagaauugguuaauuagaguaggacgagaacgacuaagcaggauggcgauuucaggagaugauuguguggugaaaccgcuagacgauagauucgccagugcccuaacagcauuaaacgacauggggaaggugcgaaaagauauucaacaaugggaaccauccagaggauggaaugauuggacacaaguaccauuuuguagucaucauuuucacgaguuaauuaugaaagauggaaggguucucgucguuccguguagaaaucaagacgaguugauagguagagccaggaucucccaaggugcuggauggagcuuacgugaaacagcgugccugggaaaaucuuacgcacaaauguggucccuuauguacuuucaucgacgugacuuaagauuggcagcaaaugcaaucugcagugcuguuccaagucacuggauacccaccucaagaacaacauggaguauccacgcuacgcacgaauggaugacuacugaagauauguuaacuguuuggaauagaguauggauucaagaaaauccuuggauggaagauaagacaccggucgaaucaugggaagaaauaccauauuugggaaaaagagaggaucaaugguguggcucguugauuggauuaacuagcagagcaaccugggccaaaaacauccagaccgcaauaaaucaaguaagaucauugaucggaaaugaagaauauaccgauuauaugcccaguaugaaaagauuucgucgagaagaagaagaagcaggcguucuuugguag

SEQ ID NO: 22263 - RNA, 9876 nt, Artificial Sequence
  derived and/or modified CDS sequence (opt6) from DENV-2__KM279569__SS-prME
acagcaggaauaaucauuaugaugauuccaacaguuauggcauuucaucugacaacacgaaauggugaaccacacaugauuguaagcagacaagaaaaaggaaaaaguuuacuuuuuaaaacugaaaauggugugaauauguguacacuaauggcaauggauuuaggggaacugugugaagauacaauaacguauaacugcccguuauuacgccaaaacgaaccugaagacauagacuguugguguaacucaacauccacauggguaacguaugguacauguaccgcaacgggagaacaucgacgggaaaaacggucaguugcuuuaguuccacacguuggaaugggucuugaaacacgaacggaaacuuggaugucgucagaaggugcauggaaacaugcacaaagaauugaaacauggauacuuagacaccccggauucacaaucauggcagcuauauuagcauacacaaucggaaccacuuacuuccaaagaguucugauuuucauacuacugaccgcaguaacucccucaauggcgaugagaugcauaggaauuagcaacagagacuuuguggaaggaguuagcggaggauccuggguugacauuguacuagaacaugggucaugcgucacuacaauggcuaaaaauaaaccuacucuggacuuugaacuuauaaaaacggaagcaaaacaucuagcuacacuuaggaaauauuguguagaagcaaaacuuacaaauacaacuacugcuucgcgcugccccacccaaggugaaccaagucuuaacgaagaacaagacaaaagguuuguuuguaaacauagcaugguagaccgaggauggggaaaugguuguggauuauuuggcaagggaggcauugugacaugugcuauguucacuugcaagaaaaauauggaggguaaaguuguucaaccagaaaaccuagaauauacaauagugauuacaccacauucgggagaagaaaacgcugugggaaacgauacugggaaacaugguaaagaaauaaagguuacaccacaaagcucaauaaccgaagcagaauuaacaggauauggaacgguuacgauggaaugcucgccgagaacgggccuagacuucaaugagaugguuuuauuacaaauggaaaacaaggcuuggcucguccacagacaaugguuccuagaucucccacuaccaugguuaccaggagcggauacucaagggucgaacuggauacaaaaggaaacccuaguuacauucaagaacccccacgcuaagaaacaagauguaguaguacucgguucgcaagaaggcgcuaugcacaccgcgcugacaggugcaacagagauacaaaugucgaguggaaauuugcuuuuuaccggacaucuuaaauguaggcuuaggauggacaaguugcaauuaaaggguauguccuacagcauguguacggguaaauuuaaaguaguaaaggaaauugcagagacucaacacggaacaauuguuaucagaguacaauaugaaggagaugggagcccaugcaaaauacccuuugaaauaauggaucuagagaaaagacaugugcuugguagacuaauaacaguaaacccuauuguuacagaaaaagauagcccaguuaauauagaagcagagccaccguucggagauucuuauauaauaauugguguugagccgggacagcucaaacuuucaugguucaagaaggguaguucaauaggccaaauguuugaaaccacaaugaggggagcaaaaagaauggcgauuuuaggagacacugcaugggauuucggaucacugggaggaguauuuacaagcauagguaaggcacuucaucaaguuuucggcgccauauauggagcugcauucuccggugucucauggacuaugaaaauuuuaauugguguaguaaucacuuggauaggaaugaacucaagauccacgucauuguccgucucauugguauugguaggaguaguuaccuuauaucuaggcguaauggugcaagcugacaguggaugugugguaucuuggaaaaauaaagaacugaaguguggcucuggaaucuuuauaaccgauaacgugcauacauggacggaacaauacaaauuccaacccgaaaguccuucuaaauuagcaucagcgauacaaaaggcacacgaggaaggaauuugcgggauaagaucagugacucgguuagaaaaucuaauguggaaacaaaucacaccagaauugaaccacaucuuaacagaaaaugaaguaaaacuuacaauaaugacuggcgauauaaaagggauuaugcaagcagggaagcgaacauugcggccacagccgacagaauuaaaauauagcuggaaggcuuggggaaaggcaaaaauguuaaguacagaauuacacaaucacacauuucuuauagacgggccagagacagcugagugcccuaauacaaaucgagcuuggaacucauuagaaguagaagacuacgguuuuggcguuuucacgacaaauauauggcugaaauugaaagaacgacaggauguauuuugugauucaaaacuaaugucagcagccauuaaagacaauagggcagugcacgcagacaugggauauuggauugagagcgcucuaaaugauacauggaaaaucgaaaaagcaaguuuuauugaagugaaaucuugccauuggccgaaaucacacacauuguggucaaauggaguccuagaaucggagaugauaauuccgaaaaauuuugcaggaccggucagucagcauaacuauagaccuggauaucacacacagacagcagguccuuggcaccuugguagauuggaaauggauuucgauuuuugugagggaaccacaguggugguuacagaagauugcgggaaccgcggcccuagucuacgcacaaccaccgcaucgggaaaauuaauaacagaguggugcugccgaucguguacucuacccccuuuaagauauagaggugaggacggguguugguacggaauggaaauacgacccuuaaaagaaaaggaagaaaaccuaguaaauagucuggugacagcggggcauggacaaauagauaauuuuucacuaggaguacugggaauggcacuuuuccucgaagagauguuacgaacaagagucgggacuaagcaugcaauauuauuaguugcggucuccuucguaacguuaauaacaggaaauauguccuucagagacuugggcagagugauggugaugguuggagcaacaaugacugaugauauugguaugggagugacuuaucuggcacuauuagccgccuuuaaaguacggccgacguuugcggcaggacuccuacugcgaaagcuaaccucaaaagaacuuaugaugacuaccauugguauugugcugcucagccaaucgacgaucccagaaaguauauuggagcuaacagaugcauuagcguuaggaaugaugguguuaaaaauagugaggaauauggaaaaauaccaauuagcuguaacuauuauggccauacuuugcgugccaaacgcaguaaucuugcaaaacgcauggaagguaucauguacaacucuugcuguugugucuguaucaccccuccuucuaaccagcagccagcaaaaagcugauuggauaccauuagcgcuaacaauuaaaggauuaaacccaacugcgauauuuuugaccacauuauccaggacuagcaagaaacgaucuuggccuuugaaugaggcuauuauggcagugggaauggucaguauacuagcaaguaguuugcuuaaaaacgauauaccuaugacuggcccauugguagccgguggguuacuaacagucugcuauguucuaacugguaggucagcagauuuagagcucgagagggccgcggauguacguugggaggaacaggcggaaauaucagguucaucuccaaucuuaaguauaacgauaucggaggauggaucgaugagcaucaaaaaugaagaagaagaacagacccuaacaaucuugauaagaacaggucuauugguaauaaguggacuguucccaguaucaauuccaauaacugcagccgcaugguaucuaugggaggucaagaaacagcgagcggggguacucugggaugugccgaguccaccuccaguggggaaagcagaauuagaagauggugcuuacagaauuaaacaaaaagguauauuagguuauucgcaaauuggagcagggguguacaaggaagggaccuuccacacgauguggcacguaacuagaggugccguccuaaugcauaaggguaaacgaauugagccgucaugggcagacgucaagaaagauuuaauaucuuauggcggagguuggaaguuagagggagaauggaaagaaggagaagaaguucaaguguuagcauuagaaccaggcaaaaauccuagagcggugcaaacuaagccagguuuauucaaaacgaauacaggaacaauaggagcgguaucguuagacuucagcccaggcacaucaggcucuccuauaguagacaaaaagggaaagguagucgggcuuuacgggaauggaguggugacaagaucagguacguaugugagugcaauugcacagacagaaaaaucgaucgaggacaaucccgaaaucgaagaugauauauucaggaaaaagcgacuaacaauaauggaccuucacccgggagcagggaaaacaaaaagguaccucccugccauaguacgugaagccauaaaaagaggccuuaggaccuuaaucuuagcaccaacucgaguugucgcugcugagauggaggaagcccugagaggcuuaccgaucagauaucaaacuccagcaauaagagcagaacacacaggaagagagauuguugacuuaaugugucaugcaaccuucacuaugagacuucuuucacccauacgcguucccaauuacaacuuaaucaucauggaugaagcccauuuuacagauccagcgucaauugcagcacggggauacaucagcacaagaguagaaaugggagaggcugcaggcaucuucaugacagcuacuccaccgggaucaagagauccuuucccacagucgaacgccccuauaauggaugaggagaaagaaauaccugagcgaucuuggaacucgggccaugaauggguaacagauuuuaagggcaaaacagugugguuuguuccuagcauaaaagccggcaaugacauugcggccugccuuaggaagaauggcaagaaaguaauacaauugucaagaaagacauuugacucagaauauauaaagacgagaaccaaugauugggauuucguuguaacgacggacauaagcgaaaugggggccaacuuuaaagcugaaagagucauugacccacgaagauguaugaaaccgguaauauuaaccgauggcgaagagaggguuauccuagcaggaccaaugccugucacgcacagcucagcagcccaaagaagggguagaguggguagaaauccuaaaaacgagaaugaucaguacauuuacaugggggaaccgcuagagaacgaugaagauugugcacacuggaaagaagccaaaauguuguuagacaacauuaacacaccagaaggaauaaucccaucaauguucgaaccagaacgugaaaaagucgacgcaauugacggcgaauauaggcugagaggagaagcgagaaaaacguucguagaccucaugcggcgaggagaccuaccuguuuggcuagcuuauagagucgcagcagaaggcauaaacuacgcagacaggagaugguguuucgauggcgucaagaacaaccaaauacuugaagaaaauguugagguggagaucuggaccaaggaaggggaaagaaagaaguuaaaaccacguugguuagaugccaggaucuauagugacccucuagcucugaaagaauuuaaggaauuugcagcaggaagaaaaagucuaacuuugaacuugaucacagaaauggguagguuaccuacuuuuaugacccaaaaagcaaagaaugcucuagacaaccuagcggugcugcauacugcggaagcagggggacgagcauacaaucaugcacuauccgaauuaccggaaacgcuugaaacauuacuucuacucacucuuuuagcaacagugacuggaggaaucuucuuauuucuaaugagcggaaaagguauagguaagaugacgcuagggauguguuguauuauaaccgcaagcauacucuuaugguacgcucaaauacaaccacacuggauagcagccucuauuauccuagaguucuuucuuauagugcuacuaauucccgaacccgaaaaacaaagaacuccucaagauaaucaauuaacauacguaguaauagcuauauugacuguaguugcagccacgauggccaacgaaaugggauucuuagagaaaaccaagaaagacuuuggacuuggcuccauaacaacucaacaaccagaaucaaauauacuggacauagaccugaggcccgcgucggcauggacacucuaugcaguugcaacuacauucauaacgccgauguuaaggcacaguauagaaaauucaucugucaaugugagccuuacggcaauugcuaaccaagcaacuguauugauggguuuaggaaaaggcuggccucuuucaaagauggauauaggaguaccucuacuggcaauaggaugcuauucacaaguuaacccuauaacauugacggcagcucuacuacuauuggucgcacacuaugcaauaauugguccuggauugcaggcgaaagcuacuagagaggcacaaaaacgagcggcagcugggauuaugaaaaacccuacuguagauggaaugacaguaauagauuuggaccccauucccuacgauccgaaguuugaaaagcagcucggacaaguuaugcuauuaguacucugcguuacucagguauugaugaugcgcacaaccugggcacuaugugaggccuuaacccuugcuacagggccaauuucgacucuaugggaagggaaccccgguagguuuuggaacacuacaauagcggugaguauggcgaacauuuuuaggggaagcuauuuagccggugcagguuuacucuuuuccauuaugaagaauacagcuaacacacgaagaggaacagguaacacuggggaaacuuuaggugagaaauggaagaaccgauuaaaugcucuaggaaaaagcgaauuucaaaucuauaagaaauccggcauucaggaaguggaucgaacgcuagccaaagaggguauaaaaaggggugagaccgaccaccacgcaguaucgcgaggcucagccaaacuuagaugguuuguugaaaggaacuugguuacaccugaaggcaaagugguagaucuggguugcgggagagguggcuggagcuacuacugugggggucucaaaaacguaaaagaagucaaaggucuaacgaaagguggcccuggucacgaagaaccgauaccaaugagcaccuauggauggaaucuuguacgacugcagucgggaguugauguuuucuuuacaccaccagaaaaaugugauacguuacuaugugacauaggagaaucgucgccuaacccaacaguugaagcagggaggacauuaaggguuuuaaacuuaguggaaaauugguuaaacaauaauacgcaguuuuguaucaaagugcuaaacccguacaugcccucagugauagagaaaauggaagcucuacaacguaaguacgguggugcguuagucagaaaucccuuaagucgaaacaguacacacgaaauguacuggguaagcaaugcaucuggaaauaucguuagcagcguuaacaugauuucaaggaugcucauuaacagguuuaccaugagacauaagaaagcgacguacgaaccggaugucgaucucggaucaggaacaaggaacauaggaauagaaagcgaaacgccaaauuuagacauaauagguaaaagaauagagaaaauaaaacaagaacaugaaacgucuuggcauuaugaccaggaucauccguauaaaacaugggccuaucacggaucauaugaaaccaaacaaacaggaucugcuucaaguaugguaaauggagugguacgauuguugaccaagccaugggauguuauacccaugguuacccagauggcgaugacagacacaacacccuucggccaacaacgagucuuuaaagaaaaaguagacacgcguacacaggaaccuaaagaaggaacaaagaaauuaaugaaaauaaccgcggaauggcuguggaaagaacugggcaagaagaaaacaccacgcauguguacucgcgaagaguucacgagaaaaguaagaucgaacgccgcucucggagcuauauuuacagaugagaauaaauggaaaagcgcuagggaagccguugaggauucuggauuuugggaauuaguagauaaggaacgaaaccuacaccuagaagguaagugcgaaacauguguuuacaacaugauggggaaaagagaaaagaaacuaggugaguucgggaaggccaaggggagcagggcaaucugguauaugugguugggcgcucgauucuuggaguuugaggcccugggauucuuaaacgaggaucauugguuuucuagagaaaacagucuaucuggaguagagggggaaggauugcacaaacuuggauauauacuaagggaugugagcaagaaggaaggaggugcaauguaugcagaugauacugcaggaugggacacaagaaucacauuagaagacuugaaaaaugaagaaaugguaacaaaccauauggaaggagaacauaaaaagcuagcggaagcaaucuuuaaguugacguaucaaaauaaagugguucggguccagagaccaacacccagaggaacaguuauggacauaauaaguagacgagaucaaagaggguccgggcaaguuguuaccuauggauuaaacacguucaccaauauggaagcacaacugauacggcagauggaaggagaaggaguguucaaaagcauccaacaguuaaccgucaaagaagagauagcaguaaaagacuggcuaauucgcguuggaagagaacggcucagucguauggccauuuccggugacgacugcguaguaaaaccucuggacgacagguucgcaagcgcguuaacugcacuuaaugauauggguaaaguaagaaaagauauacaacaaugggaacccucccgaggcuggaaugacuggacgcaagugccuuuuugcagccaucauuuccacgagcuaaucaugaaagauggucgaguacugguaguaccaugucguaaccaagacgagcugauuggcagagcaagaauuucacagggugccggauggagccuaagggagacggcgugcuuaggaaaaucuuaugcgcaaauguggucuuuaauguacuuucaucgaagagacuugagauuagcggcgaacgcaauuuguagugcaguuccaucgcauuggauacccacaucgagaacaacguggagcauucacgcuacacaugaguggaugacgaccgaagacauguugaccguguggaacagaguauggauccaagaaaaucccuggauggaagacaaaacgccuguagaaaguugggaggagauaccauaccuaggcaaaagagaagaucaauggugcggcagccucauugggcucacaucuagagcgaccugggcuaagaauauacaaaccgcgauaaaucaaguuaggagcuugaucgguaacgaagaauauaccgacuacaugcccagcaugaagcguuucagaagggaagaggaggaagccgguguuuugugguaa

SEQ ID NO: 22264 - RNA, 9876 nt, Artificial Sequence
  derived and/or modified CDS sequence (opt6) from DENV-2__KM279570__SS-prME
acagcagguauaauuaucaugaugauacccacgguaauggcauuucauuuaacuaccagaaacggugaaccacauaugaucgucucucgacaagaaaaagguaaaaguuuguuauuuaaaaccgaaaaugguguaaacauguguacacuuauggcaauggaucuuggugaacuaugugaagauaccauaacauacaacuguccacuuuuacgucaaaacgaaccagaagacauagauugcugguguaauucgacgucaacuuggguuaccuaugggaccugcacagcaacuggcgaacacagacgugaaaaacguagcgucgcgcuagucccgcauguagguaugggucuugaaacgagaaccgaaaccuggaugucuagugaaggugcauggaaacaugcacagcguauugaaacauggauauugcgccauccggguuuuacaauuauggcugccauacuugcuuauacgauaggaacaacauauuuucaaaggguauuaauauuuauacuucuaacugcaguaacaccuaguauggcaaugagaugcauugguaucucgaacagagauuuuguggaaggggugaguggagggucauggguggauaucguacuagaacauggcucgugcguaacaacaauggcuaaaaauaaaccaacacuggacuucgaauuaauaaaaacagaagcaaaacacuuggcgacacuacguaaauacugugucgaagcaaaauugacaaacacuacuacagcuucaagguguccaacacagggagaacccucauugaaugaagaacaagauaaacguuuugucuguaaacacaguaugguugauaggggcuggggaaaugguuguggccuuuucggcaaaggagggauagugacaugcgcgauguuuacauguaagaaaaauauggaagguaaagucguacaaccggagaauuuagaauacacuauuguaauaacgccacacuccggugaagaaaacgcuguugggaacgacacugguaaacaugguaaagaaauaaaaguuacuccucaaagcaguaucacagaagcugaacuaaccggauaugguacaguaacaauggaguguucaccaagaaccggacuugacuucaacgaaaugguuuuguuacaaauggaaaauaaagcgugguugguccacagacagugguuuuuggacuugccccugccaugguuacccggggcagacacccaaggcucaaauuggauacaaaaagaaacgcuggugacauucaaaaacccacaugccaagaaacaagaugucguuguauugggaucucaagaaggggcaaugcauacugcucuaaccggugcuacagagauccaaaugucgagcggcaaccucuuauucacuggucacuuaaaauguagacugcgcauggauaaacuacaauuaaaagggaugagcuacucaaugugcaccggaaaauuuaaaguugugaaagagaucgcggaaacgcaacacgggacaauagugauaagagugcaguaugagggagaugguucaccaugcaaaauacccuuugaaaucauggaucuagaaaaacgucauguacuuggccgccuuaucacagucaauccaaucgucacggaaaaagauaguccuguaaauaucgaagccgaaccaccuuucggagauucauauauuauaauaggaguagaaccaggucaacuuaaacuaucgugguuuaaaaagggcagcucaauuggacaaauguucgagaccacgaugagaggggcgaaaagaauggcuauauugggagacacggcuugggauuuuggcagccuuggugguguauuuacgucgaucgggaaggcucuacaccagguguuuggggcaaucuauggagcagcauucaguggaguaucguggacuaugaaaauccuuauaggaguuguaauaaccuggauuggaaugaacuccagaaguacaagucuaucgguaaguuugguucuaguugggguaguuacccuauaucuaggugucaugguacaagcggacucaggcuguguaguuucauggaaaaauaaagaguugaaauguggaagcggaauuuuuauuaccgacaacgugcauacauggacagaacaauacaaauuccaaccugagagcccgucgaaacucgccucggcuauacagaaagcacaugaagaagguauuugugguauaagaucaguaacgcgccuagaaaaccuuauguggaaacagauaacuccagaauuaaaucauauacuuacagaaaacgagguuaaacucacaaucaugacaggagauauuaaaggaauaaugcaggcugggaaaagaaguuuacgcccacagccuacggaguuaaaauacaguuggaaagcguggggaaaagcaaagauguuaagcacggaguuacacaaucacacauuucuuauagauggccccgaaacagcagaguguccuaacacaaaccgggcauggaacucuuuggaagucgaagauuauggguuuggaguguuuacuacaaauauauggcuuaaacucaaggaacgucaagauguauucugcgauagcaaacuaaugagugcugcgaucaaagauaacagagcagugcaugcugauaugggauacuggauagaaucugcguuaaacgauacuuggaaaauugaaaaagcuaguuuuaucgaaguuaaaaguugucauuggcccaagagccacacacuguggucuaacggaguccuugaaagcgaaaugauaaucccuaaaaacuucgcagggccugucagccaacauaacuauaggccugguuaccauacccaaacugccggaccauggcaccuagguagacuggaaauggacuucgauuuuugugaaggaaccaccguugcaguuacggaagacuguggaaauagaggccccagucuaaggacuacaaccgcauccggcaaguuaauuacagagugguguugccgcaguuguacccuuccuccguuaagauacagaggagaggauggaugcugguaugguauggagauacgaccacuaaaagagaaagaagaaaaucuaguaaacagucuugucacggcaggucaugggcaaauagauaacuucaguuuaggaguguuaggaauggcauuauuucuugaagaaaugcuaagaacgcgaguaggcacaaagcaugccauccuauuaguagcagugucuuucgugacacugauuacagggaacaugucguuccgcgaucuuggaagagucauggugaugguuggcgcuaccaugaccgacgacauagguaugggugucaccuacuuagccuuacuugcagcguuuaaaguaagaccaacauuugcggcggguuugcuacuaagaaaacuaacaucaaaagaguuaaugaugacuacaauaggaauaguguuguuaagucaaucuacaauuccggaaucaauucuugaauuaacggaugcuuuagcauugggaaugaugguacugaagauaguaagaaauauggagaaauaucagcuugcaguuacaauaauggcgauuuuaugcguaccuaacgcagucauuuuacagaaugcauggaaaguuucuuguacaacuuuagcugucgucagugucagcccacuacuacuaacuucuagccaacaaaaagccgacuggaucccgcucgccuuaacuauuaaaggccuuaauccaacagcaaucuuccuuacaacacuuucucgaacauccaagaaaagaaguuggccuuuaaaugaagcaauaauggcaguaggaaugguaagcauacuagcgagcucccuacucaaaaacgauauccccaugacaggaccccuaguggccgguggacuccucaccguauguuauguguuaacaggccggucugcagaccuugaacuagaacgagcagcagacguccggugggaggaacaagcagaaauaaguggaaguucaccgauacuuuccauuaccaucucagaagaugggucaaugucuauuaagaacgaagaggaagaacaaacuuugacaauauuaauacgaacagguuuauuaguaauaagugggcuauuuccgguuucaaucccuauaacggcagcggcaugguaucugugggaaguaaagaaacagcgcgcggguguauuaugggacguacccuccccuccaccgguugguaaagccgaauuagaagauggugcauauagaauaaaacagaaaggaauacuagguuauucgcagauaggagccggaguuuauaaagaaggcacuuuccauacaauguggcauguaacuagaggggcggugcuaaugcacaaaggcaaaagaauagaacccuccugggcagaugucaagaaagauuuaaucucuuaugguggaggauggaaacuagagggggaauggaaagaaggagaagaaguacaaguacuggcgcuugagccugggaaaaacccacgagcagugcaaaccaaaccuggacuguuuaaaaccaauacggggacuaucggugcuguuucacucgauuuuaguccagguacaagugggucaccuaucguagauaagaaaggcaaaguuguugggcuguaugguaauggggucgugacccggagugggacauauguguccgcuauugcacagacagaaaaaucgauagaagauaacccagaaaucgaagacgauauuuuccggaagaaaagauugacaauaauggaccuucacccgggggccggaaaaacgaagagauaccuccccgcuauaguuagagaagcaauuaaacguggacuaagaacauuaauacuagccccuaccagaguuguagcagcugaaauggaagaagcauuacgaggauuaccaauacgauaucaaaccccugcgauccgagccgaacauacugguagagaaauaguugacuuaaugugccacgcgacguucacuaugagauuguuaucgcccauucguguaccuaacuacaaucucaucauaauggacgaagcucacuuuacugauccggcaagcauagcagcgcggggguacauaucaacaagaguagaaaugggagaagcagcaggaauauucaugacagcuacaccaccagggagucgggauccuuuuccucaaaguaaugcuccgauaauggaugaggagagagaaauaccggaaaggucguggaauagcggccaugaauggguuaccgauuucaaaggaaagaccguuugguucguaccuucaauaaaagcagggaaugauauugcagcgugccucaggaaaaaugggaagaaaguaauucaacucagccgaaaaacauucgacucagaauacauaaaaacgcguacuaacgauugggauuuuguaguuacuacagacauaagugaaaugggggccaauuucaaggccgagagagugauagauccaaggcgauguaugaaaccggucauuuuaacugacggagaagaacguguaauacuagcugggcccaugccggucacgcauucuagcgcagcacaaagacggggucgcguaggaaggaaccccaaaaacgagaaugaucaauacauuuauaugggcgagccguuagaaaaugacgaggacugugcucauuggaaagaagcaaagaugcuauuagacaacauuaacacaccggaagggauuauacccucgauguucgagccugagagagagaaaguagaugcaauagacggagaauauagacucagaggcgaggcaagaaagacauucguugaccuaaugcgaagaggagaccuacccgucugguuagcguaucgcguagcugcagaaggcauuaacuaugcagauagaagaugguguuucgauggagucaaaaauaaccaaauauuagaggaaaacguugaaguagaaauauggacaaaagaaggggagcguaagaaacuuaaaccgagauggcuagaugcaagaaucuauagugacccauuagcacuuaaggaauuuaaagaguuugcagcgggaagaaagagcuuaacacuaaacuugauaacggaaaugggaagacuuccaacauucaugacacaaaaagcuaaaaaugcucuagauaaucuugccguccuucauacugccgaagcaggcggccgcgccuauaaucaugcuuuaagcgaacucccugaaacauuagaaacauuacuacuuuugacguuauuggcuacggugacuggagguauuuucuuauuuuuaaugagcggaaaaggaaucgguaaaaugacuuuaggaauguguugcauuauaacagcaucaauacuacuaugguacgcccaaauacaaccacauuggauagcagcaucgauaauucuugaguucuucuuaauugucuuauuaauaccugagccagagaaacaaaggacaccacaagacaaccaguuaacuuauguaguaauugcuaucuugacugucguagcagcuacaauggcuaacgagauggguuuccuugagaaaacuaaaaaggacuuuggguuaggcuccauaacaacgcaacaaccugagucaaauaucuuagacaucgauuuaagaccagcaucggccuggaccuuauacgcaguagccacuacauuuauaacaccuauguuaagacauaguauagaaaauagcaguguuaaugugagcuuaacagcgaucgcuaaucaggcuaccguucuaaugggccuugguaagggguggccgcuaagcaaaauggauauuggaguaccucuccuggcaaucggguguuauucucaaguuaacccuaucacauuaacugccgcauuacuacuauuaguugcacacuacgcuauaaucgguccaggucuucaagcuaaggcgacaagagaagcgcagaaaagggccgcagcaggaauuaugaagaaucccacuguugaugggaugacuguuaucgaccucgauccgauacccuaugauccaaaguucgaaaaacaguuagggcaggucauguuauugguucuuuguguaacgcaaguauugaugaugagaacaacaugggcucuuugcgaggcgcuuacauuagcaacaggaccgauuucaacccuuugggaaggaaaucccggucguuuuuggaauacuacuaucgcaguguccauggcuaauauuuuuagggguagcuaucucgcuggggcuggcuuauuguuuaguauuaugaaaaauacagcuaauacacguagaggcacugguaauacaggggaaacucuaggagaaaaguggaaaaauagguuaaaugcauugggcaaaucagaguuucaaauauauaagaaaagcggaauacaagagguggaccgcacucuggcuaaggaagguauaaaacgaggagaaacggaucaucaugccguaagcagagguucagccaaguugcgaugguuuguagagagaaaucuuguuacuccagaagggaagguuguugaucucggauguggacguggaggguggucuuauuauugcggaggccucaaaaacguuaaagaaguaaaaggguuaacaaaagggggacccgggcacgaggagcccauacccaugaguaccuaugguuggaaccuggugcgauuacaaucugggguugauguauucuuuacaccucccgaaaaaugugauacacuacuaugcgacaucggugaaucuucgcccaauccuacugucgaagcaggucgcacacuccgcgucuuaaaucuuguugagaauuggcuaaauaauaauacacaauuuugcauaaaaguacuuaauccguacaugcccucugugaucgagaagauggaggcgcuacaaaggaaguauggcggagcucucguaaggaauccccuaucaaggaacucaacccacgaaauguauuggguuucaaacgcuucaggcaacauaguauccaguguuaacaugauuucgagaaugcuaauaaaccguuucacaaugcgacauaagaaagcgaccuacgaacccgauguagacuuaggaaguggaacacguaacauuggaauagaaucugaaacucccaacuuagauauaauagggaaacgcauagaaaagauuaagcaggaacacgaaaccucauggcauuacgaucaagaucauccauacaaaacgugggcauaccaugguagcuaugaaacuaagcaaaccggaucugcuucauccaugguaaaugggguaguaagauugcuaacgaaaccgugggacgugauuccaauggucacacaaauggcuaugaccgacacuacgccauuuggacaacaaagaguauuuaaagagaaaguagacacacgaacccaggagccuaaagaaggcacgaaaaagcuaaugaagauuacagcagaauggcuauggaaagaauuggguaagaagaaaaccccuaggaugugcacacgugaagaauuuacacgcaaaguccguagcaacgccgcucuuggagcuauauucacagacgagaacaaauggaaaucugcccgggaagcuguagaggauagcgguuuuugggagcugguagauaaagaaagaaaccuucaucuggaaggaaaaugugagacuugugucuauaauaugauggggaaaagagagaagaaauuaggagaguucgggaaggcaaaagguaguagggcuaucugguauauguggcuaggugcaagauuucuugaguucgaggcuuuaggauuucuaaaugaagaucacugguuuucgagagaaaauuccuugaguggcguugagggugaagguuuacauaaacuuggauauauuuuaagagaugugagcaagaaagaagggggagccauguacgcugaugacacugcagguugggauacgcgaauaacauuagaggaccugaaaaaugaggaaaugguuacuaaucacauggaaggagaacacaagaaauuagcagaagcaaucuuuaaauuaacuuaucagaauaaaguuguacgaguacaacgaccuacucccagagguacaguaauggauauaauauccagacgagaucaaagaggaucuggccaaguaguaacauauggacuaaacacuuucaccaauauggaagcucagcuuauacgacaaauggagggugaagguguauuuaaaucaauccaacaauuaacuguaaaggaggaaauagcaguuaaaaacugguuaauuagaguuggucgggaacgauugagcaggauggcaauaucgggagaugauuguguaguaaaaccguuagaugacagauucgcgucagcauuaacagcacuuaacgacauggguaaaguacguaaagauauucaacaaugggagccaagcagaggauggaaugauuggacacaaguaccauucugcucucaccauuuccacgaauuaaucaugaaagauggucggguccuaguaguuccaugucggaaucaagaugagcuuauaggccgagcgcguauaucccagggcgcaggauggucacugcgggagacagcaugccuugguaaaagcuaugcacaaauguggucauuaauguauuuucacaggcgugauuugaggcuggcagccaaugcaauuuguagugcgguaccaucucauuggauaccgacaagcagaaccacauggucaauacacgcuacacaugaauggaugacuacagaggauauguuaacuguuuggaaccgaguguggauacaagaaaauccauggauggaagacaaaacgccuguagaaucaugggaagaaauaccauaccucgguaagagagaggaccaaugguguggaucucuuauaggccucacauccagggccaccugggccaagaacauacagacagcuauaaaccaaguacguaguuugauaggaaaugaagaauacacagauuauaugccaucaaugaaacgauuuaggcgugaagaagaagaagcaggcguauuaugguaa

SEQ ID NO: 22265 - RNA, 9876 nt, Artificial Sequence
  derived and/or modified CDS sequence (opt6) from DENV-2__KM279596__SS-prME
acggcuggaauuauaauuaugaugauaccaacaguaauggcauuucaccuaaccacuagaaauggagaaccgcauaugauagugucacgucaagaaaaagguaaaucauuacucuuuaaaacugaaaacgggguaaacauguguacacucauggcuauggacuuaggagaauuaugugaagauacuauaacuuauaauuguccccuacuuagacaaaaugaaccagaagacauagacuguuggugcaauucgaccagcacguggguuacauauggaacuugcacggcuacuggagagcacaggcgugagaaaaggucuguggcucugguuccacauguggguaugggacuagaaacaagaaccgaaacguggaugucaucugaaggagcauggaaacacgcgcagcgaauagaaacauggauccucagacauccagguuucacuauaauggcagcgaucuuagcauacacaauagggacaacauacuuucaaaggguguuaauuuuuauccuauuaacggcggugacaccgaguauggcaaugagguguauaggaauuuccaacagagacuuuguagaagguguaucugggggaucauggguagauauuguacuugagcaugguuccugugugacgaccauggccaaaaauaaaccaacacuugacuucgaguuaaucaaaaccgaggcgaaacacuuagcuacauuacguaaauacuguguagaggcgaaauugacaaauaccacgaccgcuaguagaugcccuacgcaaggagaaccaagucuaaaugaagaacaagacaaaagguuuguaugcaaacauagcaugguagauagaggcuggggaaauggauguggauuauuuggcaaaggcgggauagugacgugugcaauguuuacaugcaagaaaaacauggaagguaaaguaguacaaccugaaaauuuagaauauacgauaguaaucacgccucauucaggggaagaaaaugcaguaggaaaugacacuggaaaacauggaaaagaaauuaaaguaacaccgcaaagcaguauaacagaagcagaacuaacaggauaugguacagucaccauggaauguucuccacgaacgggucuagauuucaacgaaaugguacuuuuacaaauggaaaacaaagccuggcuaguucaucgucaaugguucuuagaccuaccgcuaccaugguuaccuggagcggauacacaagggagcaacuggauucaaaaagagacgcuuguuacuuuuaaaaauccacaugcgaagaaacaggauguaguaguacuaggaucacaggagggugcgaugcacacggcuuuaacuggggcaacagaaauacagaugaguagugguaaucugcuuuuuacggggcaucuuaaaugucgucuaagaauggacaaacuucaguugaaaggaaugagcuacaguaugugcaccgggaaauuuaaaguuguaaaagaaauagcugaaacgcaacacggaacaauuguuauucgaguucaguaugagggagaugguucaccuuguaaaauucccuucgaaauaauggaccuagaaaaacgacacguguuagguagacuaauuaccgucaacccgauagugacggaaaaagauagcccggucaacauagaggcggaaccaccuuuuggcgacagcuacauuauuauaggcgucgagcccggacaauuaaaauugagcugguucaagaaagguucuucaauaggccaaauguuugaaaccacgaugcgaggugcgaaaagaauggccauauuaggagacacggcaugggacuuuggaucacugggagggguauuuaccucuauugguaaagccuugcaccaaguauucggugcuaucuacggagcagcauucaguggaguuuccuggacaaugaaaauacucauaggcguaguuauaaccuggaucggcaugaacucaagaagcacaaguuugucaguuucucuaguuuuaguuggaguagugacauuguaucuaggcguaauggugcaggcggacucaggguguguaguuucuuggaaaaacaaagaauugaaauguggcucugguauauuuauaacagacaauguacacacuuggacagagcaguacaaauuccagccugagucuccgucgaaauuagcaagcgcgauacaaaaagcccaugaagaagguauauguggaauaagaucaguaaccagacucgaaaaccuaauguggaaacaaaucacucccgagcucaaccauaucuuaacagaaaacgaaguaaaacuaacuauaaugacuggagacauaaaaggaauuaugcaagcuggaaaaagaucguuaaggccccagccuacagaauuaaaauacucauggaaagcaugggggaaagccaaaauguuaagcacagaauuacacaaccacacauuuuuaauugaugggccagagacagcagaguguccgaauacuaaccgagccuggaacucgcuagaaguagaggauuauggauucgguguauuuacgacaaacauuuggcugaaacuaaaagaaagacaagacguauuuugugauucaaaacuuauguccgcugcgauaaaagauaauagagcaguucaugccgacaugggauacuggaucgaauccgcccuaaaugacacuuggaaaaucgaaaaggcuucauucaucgaagucaaauccugccauuggccuaaaucacauaccuuauggagcaauggaguauuggaaagugaaaugauaauuccaaagaauuuugcaggaccaguuagucaacauaauuacagaccaggauaccauacucagacagcaggaccauggcacuuagggcgacuggaaauggacuuugacuuuugcgaaggaacuaccguugcaguaaccgaggacuguggaaauaggggcccgucauuaaggacaacgacagccucugguaaauuaauaacugaaugguguugucggucgugcacacuuccaccccuuagauacaggggagaagacggcuguugguacggaauggagauuagaccauuaaaagaaaaagaagagaacuuaguaaacucacuugugacugcagggcacgggcaaauagacaauuuuucguuaggcguguuaggaauggccuuauuucuggaagaaaugcuacggacuagagucggaaccaagcacgcaauacucuuaguggcaguauccuuuguuacccugauuacugggaauaugucauuccgagaccuggguagggucaugguaaugguaggagccacaaugacugaugauauugggaugggagucacuuacuuggccuuacuugcugcguucaaaguccggccgaccuucgcugccggacuuuuauugagaaaacuaacaagcaaggagcuaaugaugaccacaaucgggauaguauuauuaucacaaucaacuauccccgaaagcauacucgaacuaacagaugccuuagccuuagggaugaugguucugaaaauuguccgaaauauggagaaauaccaacuggcuguaacuaucauggcuauucugugcgucccuaacgcuguaauauuacaaaaugcuuggaaagucagcuguacgacauuagcaguaguaucuguaucgccuuuauuauuaacaucaucccaacaaaaagcggacuggauaccuuuggcacucacaauuaagggauuaaauccaacagcaauauuuuuaacgacucugaguaggacaucaaagaagagauccuggccccuuaacgaagcaauaauggcaguuggaauggugucuauacuggcaucaagucuccuaaagaaugacauaccgaugacaggacccuuaguggcuggaggacuccuuacagucuguuacguguugacgggaagaucggcagauuuagaacuagagcgugcggcugaugucaggugggaagaacaagcugaaauaaguggaaguaguccuauucuuaguauaaccauuucagaagaugggaguaugucaaucaaaaaugaagaggaagaacaaacacuaacuauauugauccgcacaggauugcugguuauaagcggccuuuucccuguaagcauaccaauaacggcggcagcuugguaucuaugggaagucaagaaacaaagagcaggcgugcuuugggaugucccaaguccaccaccuguuggaaaagcggagcuugaagauggugccuaccgaaucaagcaaaagggaauuuuaggauauagucaaauuggggccggaguauauaaagaaggcacauuucauacaauguggcacgucacccggggugcgguacugaugcacaaagguaaacguaucgagccuaguugggccgauguaaagaaagacuuaauaucguacggugggggcuggaaauuagaaggagaauggaaagaaggggaagaggugcaaguacuagcgcuagaaccugguaagaauccacgugcaguucaaacaaaacccggacuguuuaaaacuaauacugguaccauaggagccguuucacuggauuucucacccggaacuucggggucuccuaucguugauaaaaaggguaaaguagugggucuuuauggaaaugguguagugacucgcaguggcacauauguuagcgcuauugcgcagacugagaaaaguauagaagacaacccagagauagaagacgauauauucagaaagaaaaggcugaccauaauggaccugcacccaggagcaggcaaaacaaaacgcuauuugccagcaauaguaagagaagcaauuaaacgcggauugcgaacuuuaaucuuagccccaacaaggguugucgcagccgaaauggaagaggccuuaagaggucuaccgauucgauaucaaacaccggcgauacgcgcggagcauacgggacgagaaauaguagaucucaugugucaugccacauuuacuaugagacuauuaaguccuauucgaguaccaaauuacaauuuaauuauaauggacgaagcacacuucacugauccggcgagcauagccgcgaggggcuacauaucaacaagaguagaaaugggagaagccgcuggcauuuuuaugacggcaacgccgccuggaagccgugacccuuuuccucagucgaaugcuccuauaauggaugaagaaagagagauaccagagagaaguuggaacuccggacaugaaugggucaccgauuucaaaggaaaaaccgucugguucgugcccagcauaaaagcgggaaaugacauugcugcauguuuaagaaagaacgguaagaaagugauucagcuaagccgaaagacguucgauagugaauacauaaaaacaagaacgaacgauugggauuucguagugacuacugauauauccgaaaugggcgccaauuuuaaagcggagagaguaauagauccuagaagaugcaugaaaccagucauuuugacggacggggaggaaagaguaauauuagccggaccaaugccuguaacucauucaucagcagcacaacgucgaggacgagucggucgcaacccuaaaaaugaaaacgaucaauacauauauaugggagagccacuugaaaaugaugaagacugcgcacauuggaaggaagccaaaaugcuauuagacaauaucaauacaccagaaggcaucauaccaaguauguucgaaccagaaagagaaaaaguugaugcuauugacggcgaauauagacuuaggggugaagcucggaaaacuuuuguagacuuaaugagacgcggggaccucccaguuuggcuggccuaccggguagcagccgaagguauaaauuaugcggacagaagaugguguuucgauggugucaaaaauaaccaaauauuggaagaaaacguagaaguugagauauggacuaaagaaggcgaacguaaaaagcuaaaaccacgaugguuagaugcucguaucuauagugacccauuagcauugaaagaauuuaaagaauuugccgcaggucguaagucuuuaacacucaaucuuaucacagaaauggguagacugccaacauuuaugacucaaaaagcuaaaaacgcauuagacaacuuagccguguuacauaccgcagaagcgggagguagagcguacaaucacgcuuuaagcgaacucccggaaacucuagaaacccuacuguuacugacacuacuugcgacaguuacagguggcauauuccuauuuuuaauguccgguaaagguaucggcaagaugacgcugggaaugugcugcauaauuacugcaucuauacuacuaugguacgcucaaauacagccacacuggauugcagccagcauaauacuagaguucuuuuugauaguacuuuugauuccugagccagaaaaacaacgaacaccacaggauaaucaacuaaccuacgucguaauagcaauacuuacugucguggccgcaacuauggcuaaugaaaugggguuucuugagaaaaccaagaaagauuucggacuuggaucaaucgcuacacaacaaccagaaucaaauauauuagacauagacuuacggccggcgagcgcuuggaccuuauaugccguagcuacuacuuucauaacgccuaugcucagacauucaaucgaaaacucaucggucaaugucucguuaacggcgaucgcuaaccaagcuacuguauuaauggguuuagggaaaggauggccacuuaguaaaauggacauuggcgugccacucuuagcuauuggauguuauucucaaguuaaucccaucacauuaacagcagcacuucuucuccuaguagcucacuacgcaaucauagguccuggucuucaggcgaaagcaacacgagaagcgcaaaaacgagcagcagcuggaauaaugaagaacccaacuguggacggaaugacugucauagaucuagauccaauaccauacgauccaaaauuugagaaacaguuaggacaaguaaugcuguugguucuguguguaacacagguucuaaugaugcguacaacaugggcguuaugugaagcauuaacacuggcaaccggacccaucuccacccuuugggaagggaauccagguagauuuuggaauacuacaauagcaguaucaauggccaauauuuuucgcggaucguaucuugcuggcgcaggucuucuauuuucuauaaugaagaauacugcuaauacaagaaggggaacugggaacacuggugaaacccugggggaaaaauggaaaaauaggcuuaaugcuuuagguaaaagugaauuucagauauacaaaaagucuggaauacaagagguugaccgaacauuagcuaaagagggaaucaagagaggcgagacugaccaccaugcgguaagucgugguagugcgaaacuuaggugguuugucgaaagaaauuuaguuacaccagaaggaaaaguuguagaccuagguugcggacgaggagguuggucguauuacugcggcggucuuaaaaacguuaaagaggugaaaggacuaacaaaagggggaccgggucaugaagaaccaauaccuaugucgacauauggauggaauuuagucagauuacaaagugguguagauguauucuuuaccccaccggagaaaugcgauacccuauuaugcgacauuggggaaucauccccgaacccaaccguugaggcugguagaacccugagaguuuuaaaucuaguagaaaauuggcucaauaauaacacacaguucuguaucaaaguucuaaauccauacaugccgagcguuauagaaaagauggaagccuuacaaagaaaauauggcggagcauuaguuagaaacccccuuagcagaaauucgacacacgagauguauuggguuucgaaugcaaguggaaacaucguaucuucugugaauaugauaagucguaugcuaauuaaccgauucacgaugcgccacaagaaagcgaccuacgaaccagacguugaucuaggaucaggaacucgaaauauuggaaucgaaucugaaacaccaaacuuagacauaaucgguaaaagaauagagaaaauaaaacaagaacacgaaacaagcuggcacuacgaucaggaucauccauacaagacaugggcuuaucacggaagcuaugaaacuaagcagaccgguucugccaguaguauggugaacggcguuguccgacuacucacgaaaccuugggauguaauucccaugguaacccaaauggcgaugacagacacaacaccuuuuggucaacaaagaguauucaaagaaaaaguggauacgagaacucaagaaccuaaagaaggcacgaagaaacuuaugaaaauaaccgccgaauggcuauggaaggaacucgguaagaagaaaacaccaaggauguguacacgagaagaauuuacccgcaaaguaagaucaaacgcggcauuaggagcuauauuuaccgacgaaaacaaauggaaaagugcucgugaagcaguggaagacucaggguuuugggaguuagucgacaaggaacgaaaucuucaucuagaaggcaagugcgaaacaugcguauacaauaugaugggcaaaagagagaagaaacucggcgaauuuggaaaagcuaaggggucuagagcaaucugguacaugugguugggugcuagguuucuugaguucgaagcucuuggauuuuugaaugaagaccauugguucucaagggaaaauagucuuucggguguagaaggugaaggauuacauaaacugggauacaucuugcgagacgugucuaagaaagaagguggugccauguacgcagacgauaccgcaggcugggauacucgcauaacguuagaggaucuuaaaaacgaagagaugguaacaaaucauauggagggcgaacacaagaaauuagcggaagccauuuuuaaacugacauaccaaaacaagguuguccguguccagagaccaacaccaagaggaacuguuauggacauaaucucacguagagaucaaagggggaguggacaaguagugacauauggguugaauacauuuaccaacauggaggcacaauuaauaagacaaauggagggggagggugucuuuaaaagcauucaacaauuaacgguuaaggaggaaauagcaguaaagaauugguuaauaagaguaggacgagagcgguugaguagaauggcaauuagcggcgaugauugcguagugaaaccccuagaugacagauucgccuccgcacucacagcuuugaacgauaugggaaaggucagaaaggacauacagcagugggaacccagccgagguuggaacgacuggacacaagucccuuucuguucacaucauuuccacgaacuaauaaugaaagaugguagaguccuuguuguaccaugccguaaccaagacgaauugaucggacgagcacgaaucucucaaggcgcaggauggagccuaagagaaacugcuuguuuaggaaaaaguuacgcacaaauguggagcuuaauguauuuccauaggcgugaucugagacuagcggcgaaugcgauuuguucagcugucccaucacauuggauaccaaccucuaggacaacauggaguauucacgcuacccaugaguggaugacuacggaggauaugcuaacggucuggaaccguguguggauacaagaaaauccuuggauggaagacaaaacaccaguugaaucaugggaagaaauacccuaccucgguaagcgagaagaucaguggugcggaucccuuauuggauugacaucgagagcuacuugggccaaaaauauucaaacagcaauaaaccaaguuaggucucuuauaggaaaugaagaguauacagacuauaugccaucaaugaaacguuuccgaagagaagaagaggaggcgggcguauuaugguga

SEQ ID NO: 22266 - RNA, 9876 nt, Artificial Sequence
  derived and/or modified CDS sequence (opt6) from DENV-2__FJ850072__SS-prME
acggcagggguuauaauuaugcuuaucccgacagcgauggcauuucauuuaaccacacgaaauggagaaccucacaugauuguaggaaggcaagaaaaaggaaaaucauuauuguuuaaaacagaagacgggguaaacaugugcacucugauggcaauggaucuaggugaauuaugugaagacacaauuacauacaaaugcccauuacuaaggcaaaaugaaccggaagacauugacugcugguguaauucgaccucaacuugggucacuuauggaacgugcacaacuaccggugaacauaggagagagaaaagaucaguagcguuaguaccccaugucgguauggguuuggaaacgagaacugaaacguggaugucaagcgaaggagcuuggaaacacguacaacgaaucgaaaccuggauuuuacggcacccuggauuugcuauuauggcagcaaucuuagcauauacaauagggacaacucauuuucaaagagcgcuuauauuuauauugcuuacugccguagcuccguccaugacgaugagauguauaggaauaucaaauagagauuucgucgaaggagugagcgguggaaguuggguugauauaguccuggaacaugguaguugugucacaacaauggcuaaaaacaaaccaacguuagacuucgaacucauuaaaacugaagcaaaacaaccugcuacacuucguaaauacugcauagaggcgaaauuaacaaauacuaccacagaaagcagauguccuacgcaaggugaaccauccuugaaugaggaacaagacaaaagguuuauuugcaaacauucaaugguagauagaggaugggguaauggguguggacucuucggaaaagguggaauagucacaugugcgauguucacaugcaagaaaaauauggaagggaaggucgugcuaccggaaaacuuagaauacaccauuguuauaacaccacauucaggugaggaacaugcuguagggaaugauacagggaaacacggugaggaaauaaaaaucacaccacaauccucaauaacagaagcagaauuaacagguuacgggacgguaacuauggaauguucucccagaaccggcuuggauuucaaugagauggucuuacuucaaauggaagaaaaagcaugguuaguacaucggcaaugguuuuuagacuuaccauuaccauggcugccaggagccgauacucagggaucgaauuggauacaaaaagaaacucuaguaacauuuaaaaauccucaugcaaagaaacaggacguuguaguauuaggaucacaagaaggcgcaaugcauaccgcauuaaccggagcaacugaaauacaaaugucuucugggaaccucuuauucaccggacaccuaaaauguagacuacgaauggauaaauugcagcuuaaagguauguccuauagcaugugcacaggaaaauucaaaaucguaaaagagauugccgaaacucaacauggaacaaucguuauacgaguacaauacgaaggugacggcucaccaugcaaaauacccuuugaaauuauggaccuugagaaaagacacgcauuaggacguuuaauaaccgugaaucccauuguuacagaaaaagacucgccgguaaacauagaagcagagccuccauuuggagacaguuacauuaucauagguguagaaccaggacagcuaaaauuaaauugguuuaagaaaggcagcucuauuggccaaauguucgagaccacaaugagaggagcuaaaagaauggcaauucuaggcgauaccgcaugggacuucggaucuuuagguggcguguuuacuucuauagguaaggcuuuacaucaaguauuuggagcaauauauggagcagcuuuuagcggaguuucguggaccaugaaaauauuaauuggcguaauaauaacuuggauagguaugaauaguaggaguaccagccuguccguaagucucguacuuguaggaguugucacucuguauuuaggugccaugguucaggcagauagcggcuguguuguaaguuggaaaaauaaggagcuaaaauguggaucugggauuuuuauaacagacaauguucauaccuggacagagcaauauaaauuucaaccugaauccccgucuaaguuagcaucagcuauucaaaaggcucaugaagaagggaucugugggauacguuccgucacuagacucgagaauuuaauguggaaacaaauuacgccggaauuaaaucauauucuuucagaaaaugagguaaaguuaacaaucaugacaggcgacauaaaaggcauaaugcaagcugggaaaaggucauuacggccacagccaacggaauuaaaguauagcuggaaaacuugggguaaggcgaaaaugcuaucaaccgaaucccauaaucaaacguuccucaucgauggaccugaaacagcugaaugucccaauacuaacagagcguggaacucguuagagguugaagauuaugguuuuggcguauuuacuaccaauauaugguuaaaacuaagggaaaagcaagacguuuucugcgauucaaaauuaaugucagcggcgauuaaagacaacagagcaguucaugcagacaugggauauuggauagagucagcgcuaaacgacaccuggaaaauggaaaaggcuucguuuauagagguaaaaaguugucauuggccaaaaucacauacccuauggucaaacggaguauuggaaucggagaugauuauccccaaaaauuuugcggggccaguuucucagcauaacuaucgcccagguuaucacacccaaacagcagguccguggcaccuugguaagcuagaaauggacuucgacuucugcgaagggacuacaguggucgucacagaagauugcgguaauaggggcccaucucuaagaacaaccacagccaguggaaaacuuauaacagagugguguugcagaucaugcacauuaccgccauuacgcuauagaggggaagauggcuguugguacggaauggaaauaagacccuuaaaggaaaaagaagaaaauuuggucaacaguuuggugacagcagggcauggucaaauagauaauuuuaguuuagguguacuagguauggcacuuuucuuagaagaaaugcuuaggacgagagucggaacuaaacacgcaauacuuuuaguugcuguaaguuuugucacccuuauuacugguaauaugucauuuagagauuugggacguguuauggugaugguagguguggcuaugacugaugauauuggcaugggcguaacguaucuugcgcucuuggccgcguuuaaagugagaccaacauucgcggccggucuucuauuaagaaaacuaacuucuaaagaacuuaugauggcgacaauaggaauuacacuuuuaagccaaaguacuauaccagaaacaauauuagagcucacugaugcauuagcauugggaaugaugguccuaaaaauugugcgaaauauggagaaauaucaacuagcuguuacaauuaugaccauaagcuguguuccgaaugcaaugauuuugcugaaugcuuggaaagucaguuguacaauucucgccguagucagcguaaguccacuacuauuaacauccucucaacagaaaacugauuggauaccacuugcccuaacgaucaagggacuaaauccaacagcaaucuuucucacaacgcuuuccagaacaucgaaaaagcgcucguggccguugaaugaagcaguaauggcgguugguauggucucaauacuagcuaguucauuacugaaaaacgacauucccaugacuggaccgcuuguagccggagggcuuuugacagugugcuacguacucaccgggagaucugccgaucuggaacuggagagagcaacagauguuaaaugggaagaccaagcugaaauaagcgguaguagccccaucuuaucgauaacuaucagcgaagauggaucaaugagcaucaaaaacgaagaagaggaacaaacacuaaccauucuaauuaggacgggacuguuaguaauuagugguguauuuccagugaguauuccaauuacggcggcugccugguaccucugggaggugaagaaacagcgagcgggaguacugugggauguaccgaguccuccaccuguugaaaaagcagaauuagaagauggagcauacagaauaaaacaaagggguauauuaggcuauagucagauuggcgcugguguauacaaagaagggacauuccauacuauguggcacguuacuaggggugcgguucugaugcacagagggaagcggauagaaccuaguugggcagacguaaagaaggauuugauuagcuacgguggaggauggaaacucgaaggugaauggaaggaaggcgaagagguacaggucuuagccuuggaaccaggcaaaaauccaagagcgguacaaacuaaaccuggauuauuuaagacgaauacuggaacaauuggggcaguaucucuugauuucaguccgggaacguccggauccccgauuguagacagaaaaggaaaaguuguuggacuauauggaaacggaguaguaacucgcucuggagccuaugugagugcgauagcccaaacagaaaaaucaaucgaagauaacccagagauagaagaugauauuuuccgcaagaaacgccucacaauuauggaucuucauccuggugcuggaaaaacaaaacgauaucuuccagcuauuguuagagaggcgaucaaacgggggcuaagaacauuaauccuagcacccacaagagucguugcugcagagauggaagaagcucuacgaggguuaccaauucgauaucaaacacccgcuauaagagcggaacauacagguagagaaauuguagaucuuaugugucacgccacauucacaaugcgucuacuaucaccaguuagggucccaaauuacaaccuaauaauuauggaugaggcucacuuuacggauccugcaaguaucgcggcgcgugguuauauaagcacaaggguagaaaugggggaagcggccggaauauuuaugaccgcgaccccuccuggaagcagagacccauucccucaaucuaaugcgccuauaauggacgaagaacgcgaaauaccagaacgaucguggaacucuggacacgaauggguuaccgauuucaaaggcaaaacaguaugguuugucccaagcauuaaagcugguaaugauauugcagcaugcuuaaggaaaaacgguaagaaaguaauacaguuaucccggaagacauucgauuccgaguacgucaaaacaagggccaaugauugggacuucguuguuacaacagauauaagcgaaaugggugccaacuuccgugcagagcguguaauugacccacgacgauguaugaaacccguaauacuaaccgacggagaagaacgagucauacuagcaggaccuaugccuguaacucauaguagugcagcccaaagacguggaagagucgggcgaaauccuaaaaacgagaaugaccaauacauauacaugggugaaccacuugaaaacgacgaggauugcgcccacuggaaggaagccaagauguuacuugacaacauaaacacaccagagggaauuaucccuucaauguuugaaccggaacgagaaaaaguagaugcaauugauggagaauacagauuacguggugaagcaagaaaaacauuuguagaucuaaugagaaggggugaccuaccaguuuggcuagcauaucgcguugcugcugaaggaauuaacuacgcagauagaaggugguguuuugauggaauaaagaacaaccaaauacuugaagaaaacguagagguagaaauuuggacgaaggagggugagaggaagaaauugaaaccacguugguuagaugcacgcaucuauucggacccacuagcauuaaaagaguucaaggaauuugcugcaggaaggaaaaguuuaacacucaauuuaauaacagaaauggggaggcucccaacuuucaugacccagaaagcuaggaaugcucuugauaaccuagccguacuucauacagcggaagcaggaggcagagcuuauaaucacgcucuuucagaacuccccgaaacucucgagacgcuacuuuuacucacccuacuggcuacaguaacugguggcauuuuucuauuucucaugucaggaaagggaauugggaaaaugacacuugguauguguugcaucaucacugcgucuauacuguuaugguaugcucaaauccaaccacauuggauagccgcauccaucaucuuagaguuuuucuugauaguauuauuaauaccggaaccugaaaaacaaaggacuccgcaagacaaccaauuaacguacguggugauagcaauacuaaccgucguugcugcgacgauggcuaaugaaauggguuuucuggagaaaaccaagaaagauuugggauuagggucuaucacgacacaggagagugaaucaaauauacuagauauagacuugaggccugcuagugcauggaccuuauaugcgguagcaaccacuuuuauuacuccaauguuaagacauucgauagaaaauaguucgguaaauguaucacugacugcuauagccaaccaagcaaccguucucaugggauuagguaaaggguggccucuaagcaaaauggacauaggaguaccacuucuagcgauugggugcuacucucaaguuaauccuauaacccuaaccgcugcauuauugucgcugguagcccauuaugccauaauuggacccggauuacaagcaaaagcaacaagagaagcacagaaaagggcagcagcagggauaaugaaaaaccccacaguggacgguauaacuguuauagauuuggagccaauaccguacgacccaaaauuugagaaacaacuaggacaagugauguuauuaauauugugugugacucaggugcuuaugaugcguacaaccugggcauugugugaagcccuaacacuagccacuggcccuaucucuacacucugggaggggaacccaggacgguuuuggaacaccacgauagcugugagcauggcaaauauuuuuagagggucauacuuggccggugcaggcuuguuauuuaguauuaugaagaacacuacgaacacgcgaagaggaacagguaacauuggggaaacauuaggggaaaaauggaaaucacgauuaaacgcauugggcaaguccgaauuucaaauauacaaaagaagcgguauucaggaaguugacagaacucucgcaaaggaagggaucaaacguggggaaaccgaucaucaugcaguaucaaggggcagcgcgaaauuacgcugguucgucgagcgcaauaugguaaccccagaaggaaaagucguggacuuaggaugcggaagggguggauggucuuauuacugugggggcuugaaaaacguccgagagguuaaaggucuaacgaaagguggaccaggacacgaagaaccaauaccaaugucuacuuaugguuggaaccuagugagauuacagagcgguguagacguauucuuuacaccucccgaaaagugcgauaccuuguuaugugacauaggagagucgucaccaaaucccacaauagaagccgggcgaacauugcgugucuuaaaucuaguagaaaauugguuaaauaauaacacacaguuuuguauuaaaguacuaaauccuuauaugccaucaguuauagagaaaauggagacacuucaaagaaaauacgguggugcacucguaagaaauccucuaagccgaaacucaacucaugagauguauuggguaucaaacgcaaccggcaauaucguaaguagugucaacaugauaaguagaaugcugaucaacagauucacuaugaaacauaagaaagccacuuacgaaccagauguagacuugggaagcgguacccgcaauauaggaauagaaucugagauuccgaaccuggauaucauaggaaaacgaauagagaaaaucaaacaggaacaugaaaccucauggcacuaugaucaggaucaucccuacaaaacaugggccuaucaugguaguuacgaaacuaagcaaacgggcagugcgaguucaauggucaaugggguggugcgccuacugaccaagccaugggaugugguaccaauggucacucaaauggcgaugacagauacaacaccauucggucagcaaagaguguucaaagagaaaguggauacacguacacaagaaccaaaagaggggaccaaaaaguuaaugcgaauuacagcugaauggcucuggaaagaguuaggcaagaagaaaacaccgcguauguguacgagagaggaauuuaccaggaaaguacguaguaacgcugcauuaggcgccauuuuuacugacgaaaauaaguggaaaucugcgagagaagcaguagaagauucaagguucugggaguuaguagauagagaaaggaaucuccaccucgaggggaaaugugagacuugcguauacaauaugaugggaaagcgugagaagaaauuaggugaauuuggaaaagcuaaaggcagucgcgcuauaugguacauguggcuaggagcucgcuuucuagaauuugaagcauuaggguuccuuaaugaagaccauugguuuagcagaggaaauagcuuauccgggguagagggagagggacugcauaggcuuggauauauacuacgugauguaucuaagaaagaagguggugcgauguacgcugacgacaccgcggggugggacacaaggaucacguuagaagauuugaaaaaugaggaaaugguuacaaaccauaugaaaggagaacauaagaaacuagcugaagccguuuucaaauuaacuuaccaaaacaaaguagucaggguacagaggccaaccccucgugguacuguuauggacaucauauccagaagagaucaaagaggaucuggucaagugggaacuuacggauuaaauacuuucacaaacauggaagcucaauugauaagacaaauggaaggggaaggcauauuuaaauccauacaacauuugacagucacagaagaaauagcgguacagaauuggcuagcucgagucggacgcgaaagguuaagcaggauggccaucucuggagaugauugcguaguaaaacccuuagaugaccgauuugcuucagcacuuacagcacucaaugauauggguaaagucaggaaagauauacaacaaugggaaccaucacguggguggaaugacuggacccaaguccccuucugcagucaucauuuucaugagcuugugaugaaggacggccgaaugcucguuguuccauguagaaaucaagaugaacuaauuggccgcgcuagaauuucacaaggggcugguuggaguuugaaagagacagcuugccuuggaaaaucauaugcacagauguggaccuuaauguauuuccaucgaagagaccuaagauuagcagcuaaugcuauauguucugccguaccaucacauugggucccaacaucacguacuacauggucuauacaugcuaaacaugaauggaugacaaccgaagauaugcucgcagucuggaauagaguuuggauacaagagaauccguggauggaggauaagacaccaguggaaucgugggaagaagugcccuacuuagguaaaagagaggaccagugguguggcucacucauagguuugacaucaagagcaaccugggcuaaaaauauucaaacggcuauaaaccaaguuagaaguuugauagggaaugaagaauauaccgacuauaugccaaguaugaaacgguucagaagagaggaagaagaggcaggaguccucugguaa

SEQ ID NO: 22267 - RNA, 9876 nt, Artificial Sequence
  derived and/or modified CDS sequence (opt6) from DENV-2__JN819419__SS-prME
acagcggguguaauaguaauguugauaccuacagcgauggcauuucacuuaacgacccggaauggugaaccacauaugauagucggaagacaagaaaaagguaaaagucuuuuauucaaaacugaagauggagucaauauguguacauugauggcuauugacuuaggagaauuaugcgaagauacgauuacauacaaauguccacuuuuaagacagaaugaaccagaagacauugauugcugguguaauucgacauccacauggguaaccuauggaacauguacuacuacuggcgaacaucgaagagagaaaagguccguugcacuugucccucacgucgguaugggccuugaaacuagaacggaaacauggauguccuccgaaggcgcauggaaacauguacaacgaauugaaacauggauuuuaagacauccugguuucaccaucauggcagcaauauuagcauauacaauuggaaccacccauuuucaacgagcgcugauauucauucuacugacagcaguugcgccaaguaugaccaugcggugcauaggaauaagcaauagagauuuuguagaaggaguaaguggaggauccugggucgauauaguguuagaacauggauccuguguaacaacaauggcuaaaaacaaaccaacuuuagauuuugagcugaucaaaacagaagccaaacaaccagccacucuaagaaaauauugcguugaagcaaaacuaacgaacacuacaacagaaagucgaugcccgacucaaggagaaccaaguuuaaaugaagaacaggacaaaagauuuauaugcaaacacuccaugguugaucguggaugggguaacggauguggcuuguucggcaaaggcggcaucguuacgugugcgauguuuacauguaagaaaaauauggaaggaaaagucguucagcccgaaaauuuagaauacacgaucgucauaacuccacauucuggggaagaacaugcgguagguaaugauacggguaaacauggaaaagaaauaaaaauaacaccacaaucgagcauuacagaagcagagcucacaggcuauggaacugucaccauggaauguucuccgcggacagggcuagauuuuaacgaaaugguacuacuacagauggaagauaaagcauggcugguacacagacaaugguucuuagauuugccauuaccauggcuuccaggcgcugauacacaaggaucaaauuggauucaaaaagaaacucuagugacauucaaaaauccccaugcgaagaaacaagaugucguggugcuaggaagucaggaaggcgcuaugcacacagccuuaacuggugcuaccgaaauacaaaugucaucaggaaacuuauuauucacaggacaucuuaaaugcagacuacgaauggauaaacugcaauugaaagggaugucuuacucaauguguaccgggaaauucaaaauaguuaaagagauagcugagacgcaacacgguacuaucguuauaagaguucaauaugagggagacggcaguccuugcaaaauuccauuugaaauaauggaccuugaaaaacgccaugucuuagggagacuuauuacagugaacccaaucgucaccgagaaagauucaccaguaaauaucgaagcugaaccuccguucggugauucauauauuauuaucggugucgaacccggucaguuaaaacuuaacugguucaagaaagguuccuccaucggacaaauguuugaaacgacuaugcgaggugcaaaaaggauggcuauuuuaggagacaccgcaugggauuucggcucucuagguggaguuuuuacgaguauugguaaagcacugcaccaaguauuuggagcgaucuauggcgccgcauucaguggcguuagcuggacaaugaaaauuuugauuggagucauaauuacuuggauuggcaugaacucucgcucaacaaguuugagugucagcuuagucuuagucgguguagucacgcuauauuuaggggcaaugguccaagccgauagcggaugcguagugucauggaaaaacaaagaacuaaaaugugggagugguaucuuuauaaccgauaacguacauacauggacagaacaauacaaauuccaacccgagucuccaucaaaauuggcgagcgcuauacaaaaagcacaugaggagggcauaugugguauaaggucuguaacacgacuugagaaucuaauguggaaacagaucacuccagagcugaaucauauccuaucagagaaugaaguaaaacuuaccauaaugacaggcgacaucaaaggcauuaugcaagcaggaaaacguaguuuaaggccacaacccaccgaacugaaauauagcuggaaaacgugggguaaagcaaaaaugcucagcacugagucgcauaaucaaaccuuucuaaucgauggcccugaaacagcugaaugcccaaauacaaaucgcgccuggaauaguuuagaaguagaggauuauggauuuggagucuuuacaacuaauauaugguugaaacuuagggagaaacaagacguauuuugugauucgaaauugaugagcgcagcuaucaaagauaauagagcaguucaugcugauaugggauauuggauagaaucagcguugaaugacacauggaaaauggaaaaagcaaguuuuaucgaagugaagucgugucauuggccgaagucacauacuuuauggagcaaugguguauuggaaucggaaaugauaauaccuaaaaacuucgccggcccgguuagccaacacaauuacagaccaggauaccacacgcaaacagcaggaccauggcaucuagggaaauuagagauggauuucgacuucugcgaaggaacaacuguuguuguaaccgaagacuguggaaacagaggaccaucacuucguacaacuacggccaguggaaaacuaauaacagaauggugcugcagaaguuguacacugccaccucuaagauauaggggugaggacggcugcugguaugguauggaaauacggccuuuaaaagaaaaagaagaaaaucuuguaaacuccuuaguuaccgcuggccauggccagaucgauaauuucucauuaggcguauuaggcauggcucucuucuuagaagaaauguuacgaacacgggugggaacuaaacaugcaauuuuacucguugcgguaaguuuuguaacauuaauuacuggaaauaugucguuccgugacuugggacgcguaaugguuauggucggcgcuacuaugacagacgacauugguauggguguaacauacuuagcuuuacuugcggcguuuaaaguaagacccaccuucgcagccggucuuuuauugagaaaacucacauccaaagaauugaugauggcgacaauuggagucgcuuuacucucucaaucgacaauacccgaaacaauauuagaacuaaccgacgcgcuagcgcuagguaugauggcauuaaaaaucguuaaaaauauggaaaaauaccaacuagcgguaacuaucauggcaauuaguugcguaccuaaugcuguaauacuacaaaaugcuuggaaaguuaguuguacaauccuagcugcaguaucuguaucuccucucuuauugacuagcagccaacaaaaagcagacuggauuccacuggccuuaacuauaaaaggccuaaaucccacagcaauauuuuuaaccacucucucgagaacgucaaagaaaagaaguuggccacuaaaugaagcgauaauggcggucgguaugguuaguauucucgcaucaaguuuguugaaaaacgauauuccaaugaccggaccauuaguugcugguggacuacuuacgguauguuaugugcuaaccgguagaucagcagauuuggaauuagaaagagcggcugauguaaaaugggaagaucaggcugagauaucagguucauccccaauucuaucaauaacaauuagcgaggauggauccaugucuaucaaaaacgaggaagaagaacaaacuuuaacuauauugauccggacuggguuacucguaauaucuggaguauuuccuguauccauaccaaucacagcugccgcaugguaucugugggaggucaagaaacaaagggccgggguacuaugggauguuccuaguccuccaccaguugguaaagcggaacuggaagauggugcauaccgaauaaaacaaagagggaucuuaggguauagucaaauuggugcuggcguauauaaagaaggcaccuuucacacgauguggcaugucacucgcggcgcaguuuuaaugcaucgaggaaaaaggauagaaccuagcugggccgacgugaagaaagauuuagugaguuacggagguggcuggaaauuggaaggggaauggaaggaaggcgaggaaguucaaguccuagcucuugaacccgguaaaaacccucgcgcuguccaaacaaaaccgggaaucuucaagacuaauacugggaacauaggugcggucucucucgauuuuagcccaggcaccucaggcucaccaauaguugaccgaaaaggaaaagucgucggacucuauggcaauggaguaguaacgcgaagcggggccuaugucucagcaauugcgcagacagagaaaucaauugaggauaacccugaaauagaggacgacauauucaggaagaaacguuuaacgauaauggauuuacacccaggugccggaaaaacuaaaagguaccuacccgccauaguucgggaggccauaaagagaggauuaagaaccuuaauucuugcuccuaccagagucguagcugccgaaauggaagaagcacugaggggacuacccauccguuaucagacgccagccauacgagccgagcacacuggacgcgaaaucguagaucuaaugugccaugcuacauucaccaugcgauuauuaaguccagugcgcguuccaaacuauaaucuaauaauaauggacgaagcucacuuuacggauccugcuagcauugcugcaagaggguauaucucuacgaggguggaaaugggagaagcugcagguauauuuaugacugccacucccccuggaucucgagaccccuuuccacagagcaacgcgcccauuauggacgaagaaagagagauuccugaacgaagcuggaacucgggacaugaauggguaacagacuuuaaaggaaagacuguaugguuugugccuucgauuaaagcaggcaaugauauagcugcaugcuuacggaaaaauggaaagaaagugauacaauuaucccgaaaaacguuugacagcgaauacguaaaaacuagagccaacgacugggacuuuguaguaacaacggacaucuccgaaaugggugcaaacuuuaaagcggaacgugugauagaucccagaagauguaugaagcccguaaucuuaacagacggagaagaacgaguaauccuggcaggaccgaugcccguaacucacagcucagcagcacagcgcagagguagaauaggaagaaaucccaagaaugagaaugaccaauacauauacaugggugagccacuagagaaugaugaagacugcgcacauuggaaagaagcgaaaauguuacuugacaacauuaauacaccagaaggaauaauacccagcauguucgaacccgaaagagagaaaguagacgcaauugacggcgaauauagacuuagaggggaggcuaggaagaccuuuguagaucucaugcguagaggggacuuaccagugugguuggcauacaaaguagcagcagaaggaauaaacuacgcggaucggagguggugcuucgacgggauaaagaacaaucaaauacuagaagaaaauguggagguugaaauuuggacaaaggaaggugagaggaagaaacuuaaaccuagauggcuagaugcuagaauauacucagauccucuugcacuaaaagaauuuaaggaguucgcggccggccgaaaaaguuuaacacuaaauuuaauuacugaaaugggaagacucccgaccuucaugacccaaaaagcgcgcaacgcgcuugauaacuuagcaguccuucacacggcagaagccggcggcaaggcuuauaaucaugcccucagugaacuuccugaaacuuuagagacauugcuuuugcuaaccuuauuagcaacagugacaggcgggauuuuccucuuucuaaugaguggaaaaggaauagguaaaaugacauuggggaugugcuguauaauaacagcuucaauacuauugugguacgcucagauccaaccacacuggauagccgcuucuauaauucuggaauuuuucuuaauaguacuuuugauuccagaaccagaaaagcaaagaacaccucaagacaaccaauuaacauauguagugauugccauccuaaccguaguagcugcuacaauggcaaaugagauggguuuucuagagaagacaaagaaggaucuaggcuuaggaucaauaacuacucaggagagcgaaucaaacauauuagauauagaucucagaccagcaucugcguggacacuauaugccguggcuacgaccuucgugaccccaaugcucagacauagcauugaaaacucuagugucaauguaucuuuaaccgcuauagcaaaccaagccacagugcuaaugggccugggaaaaggauggccauuaagcaaaauggauauaggggcuccguuauuggcaauuggcugcuauagccaaguuaauccgauaacguuaacugcggcguuacuauuauugguugcacauuacgcgauaauagguccagggcuacaagcgaaagcaacaagagaagcccagaaacgagccgcagcagggauaaugaagaacccuaccguagacggaauuacugugauagauuuagaaccaaucccauacgauccuaaauucgagaagcaguuaggucagguuauguuacucauccuaugcgugacgcaaguuuuaaugaugagaaccacuugggcacuuugugaagcauuaacacuagcaacgggaccuaucaguacauugugggaagggaaucccggacgguuuuggaacacaacuaucgcggucucaauggcaaacauauuccgggguagcuaccuugccggggcaggcuuguuguuuagcauaaugaaaaauacgacaaauacucgccggggcacgggcaauauuggugaaaccuuaggagagaaauggaagucgcggcugaacgcucuaggaaaaucugaguuucaaaucuacaagaaaagugguauccaggaaguugacagaacuuuagcuaaagaggguauaaagagaggugaaacagaccaccaugcagugagccguggaagcgcaaaacuuagaugguuuguagagagaaacaugguuacccccgaagguaaaguagucgacuugggaugugggagggguggauggaguuauuauugcgguggucuuaaaaauguucgcgagguaaagggccuaaccaagggagggcccggccaugaagaaccuauaccgaugucaacauauggcuggaauuuaguucgcuuacaaucgggaguagacguuuucuucacgccgccggaaaaaugugauacccugcugugugacaucggugaaucuucacccaaucccaccauagaagcaggcaggacucuacgaguucuaaauuuggucgaaaauugguuaaacaauaauacgcaauucuguauuaagguacuaaacccauauaugccgagcguaauagaaaagauggaaacuuuacagaggaaguacggcggggccuuggugcggaaucccuuaagucgcaacucaacacacgagauguauuggguuucaaaugcaacagguaauauaguuucaucaguaaauaugauaucaagaauguuaaucaacagguuuacuaugaaacauaagaaagcgacauaugaaccagauguagauuuaggcucaggaacuaggaacauugguauugaauccgaaauaccaaaccuagauauaauaggcaaaagaauugagaaaauuaaacaggaacacgaaacaucauggcauuaugaucaagaucauccuuauaaaaccugggccuaucauggaagcuaugaaacaaaacaaaccgggagugcgucauccauggugaauggaguaguaagacuacuuacaaaaccuugggacguuguuccaaugguaacgcaaauggcaaugacagacacuacaccuuuuggacagcaacgcguuuucaaggaaaagguagauacaaggacgcaggaaccaaaagaaggaacuaagaaacuaaugaaaauaacggcugaguggcuuuggaaggaacuggggaagaagaaaauaccuagaauguguaccagagaagaguucacaagaaaaguaagaagcaacgcugcccuuggggccauauucacggaugaaaauaaauggaaauccgccagagaagcuguggaagacggacguuuuugggagcucgucgaucgagagaggaaucuccaccuugaaggaaaaugcgaaaccuguguauauaauaugauggguaaaagagagaagaaacuaggagaauuuggaaaagcuaaaggaucgcgagcgaucugguauauguggcugggagcaagauuucuagaauuugaggcuuuaggguuccugaaugaggaccacugguuuagucguggcaacucucuuagcggaguugaaggcgaaggacuacaccgacucgguuauauccuaagagauguaagcaagaaagaaggcggcgccauguaugcagaugacacugcgggaugggauacaagaauuacucuagaagaucuaaagaaugaagaaauggugacaaaucacaugaaaggagaacauaagaaauuagccgaagcuauuuucaaguuaacguaccagaauaagguagucagaguacaacguccaacaccaagagguacuguaauggauauuauaucaaggcgagaucaacgagggucaggacagguuggcacguauggucucaacacguuuacgaauauggaagcucaguuaauaaggcagauggaaggugaaggaauuuuuaaauccauacaacaucuaacaguaacagaagagauugcgguacagaauugguuagcgagaguagggcgagaaagauuaacaagaauggcaauaaguggugacgauuguguaguuaaacccauagacgauagguucgcaaacgcucugacggcucucaaugauaugggaaaaguccgaaaagacauacagcaaugggaaccaucacggggauggaacgacuggacacagguaccuuuuugcucucaccacuuucacgagcucguaaugaaagauggaagaguguuagugguaccuuguaggaaccaggaugaacuaaucggucgagcaagaauaucccagggcgcaggcuggagccugaaagaaacagcauguuuaggaaaguccuaugcccaaauguggacacuaauguauuuccauagaagagaccuaagauuagccgcgaaugccaucuguucagccguaccgucucauugggucccgaccucaagaacaacauggucaauccaugcaaaacacgaguggaugacaacagaagauaugcuugcaguuuggaacaggguauggauucaggaaaauccguggauggaagauaaaacgccaguagaaucuugggaggagguuccguaccuagguaagcgugaggaccaguggugcggaucuuugauuggcuuaacaagucgggcgaccugggccaaaaacauucaaacugcaauuaaucaaguacgcaguuugaucggaaaugaagaauauacagauuacaugccgucuaugaagagauuuagaagagaagaagaagaagcaggcguucuaugguaa

SEQ ID NO: 22268 - RNA, 9876 nt, Artificial Sequence
  derived and/or modified CDS sequence (opt6) from DENV-2__FJ850074__SS-prME
acagcgggagugauaguaauguuaauuccaacgguaauggcauuucacuugacaacuagaaauggagagccacauaugauagugggacggcaagaaaaaggaaaaucuuuacuauucaaaacagaagaugguguaaauaugugcacacuuauggccauugaucucggggaacuaugugaagauacaauaacguauaaaugcccauuguuaaggcaaaaugaaccagaagacauagauugcuggugcaauucaaccagcacuuggguuacuuacgggacuugcacuacaacaggagaacacagaagagagaaaagaucaguugcgcuaguaccucacguagggaugggacuggagacacgaacugaaacguggaugucaagugaaggagcauggaaacaugugcaaaggauagaaacauggauucugaggcacccaggcuucaccaugauggcugccauucuagcguauaccauaggaacaacacauuuccaaagggcguugauuuucauauuacuaacugcggucgcgccaagcaugacuaugaggugcauugggauaagcaaucgagauuuuguggaaggaguaagcggggguaguuggguagauauaguauuagaacaugggucgugugucacaacaauggcuaaaaauaaaccuaccuuagauuuugaacucauaaaaaccgaagcaaaacaaccugccacguuaaggaaguauuguguugaagcuaaauuaacaaacacuacuaccgagucaagaugcccgacacagggggaacccagccucaacgaagaacaagauaaaagguuuauauguaagcauaguaugguagaucguggguggggaaacggcuguggucucuucggaaagggaggaauuguaacgugugcuauguuuacgugcaagaaaaacauggaagguaaagucguucagccugaaaaucuagaauacacuaucgugauaacaccacauucuggagaagaacacgcaguaggaaacgauacaggcaaacaugguaaagaaauaaaaauuacuccacaaagcuccauuacagaagcugaauuaacagguuauggaacagucaccauggaauguucgccaaggacaggauuagauuuuaaugaaaugguucucuuacaaauggaagauaaggcauggcuuguccaucgccagugguuucuggaucucccuuugccauggcucccaggggcugauacucaaggcucaaauuggauacaaaaagaaacacucgucacuuuuaagaauccacacgccaagaaacaggauguuguaguguuagggagccaagaaggggcgaugcacacggcacuaacaggugcaacggaaauccaaaugucuagcgguaaccucuuauuuacaggacacuuaaagugcagacucagaauggauaaacuccaacuuaaaggaaugaguuacucuauguguacgggaaaguucaagaucgugaaagaaauagcagagacacagcauggcacaauagugauacgugugcaauacgaaggugauggcaguccuuguaaaaucccauucgagauaauggauuuagaaaagagacacgugcuaggucggcuaauaacggucaauccaauaguaacggaaaaagauaguccggucaacauagaagcugaacccccauuuggugacaguuauauuauaauagguguagaacccgggcaacuuaaguuaaacugguuuaagaagggaagcucuauuggacaaauguuugaaacuaccaugagaggagcgaaaaggauggcgauacuaggagauacugcaugggauuuugggaguuugggagguguauucaccucaauaggaaaagcauuacaucagguauuuggagcaauauacggugcugcuuucucgggagugaguuggacaaugaaaauuuuaauuggaguuauuauaacuuggauugggaugaauaguagaagcacaucccugaguguuagcuugguauuagucggaguaguaacucucuaccuaggggcuauggugcaagccgauuccggcuguguagucaguuggaaaaauaaagaauugaaaugugguucagguauauuuauuacagauaacguccacaccuggacagaacaguauaaauuucagccugaaagccccagcaaacuugcaagugcaauacaaaaagcucaugaagaaggcauauguggcauacguagugucacaagacuugaaaaucuaauguggaaacagauaacacccgaacuuaaucauauucucuccgaaaacgaaguuaaauuaacaaucaugacuggggacauaaaagguauaaugcaagcugguaaacgcucucucagaccucaaccuacagaauuaaaauauucauggaaaaccuggggcaaggccaagaugcuucccacggaaucacacaaccaaacuuucuuaauugaugggccagaaacugcggaaugcccuaauacaaaccgagcguggaauagucuagaaguggaagacuauggguuuggaguuuuuacaacaaauauuuggcuaaaacuaagagagaagcaagacguauuuugugacagcaaguuaaugagugcagcuaucaaagauaaucgagcuguucacgcggauauggguuacuggauagaaucagcgcuaaaugauacuuggaaaauggaaaaggcaucauucauugaaguuaaauccugucacuggccaaaaucucacacucuuuggucuaaugguguacuugaaucagaaaugauaaucccgaagaauuuugcaggcccaguuucccaacauaauuacagaccaggauaccauacccagacagccgguccauggcaccugggcaaacuggagauggauuucgauuuuugcgaaggaacaacuguaguuguaacggaagauugcggaaauagagguccuucauugagaacaacaacagcuagugggaaacuuauaacugaaugguguugcaggagcuguacucuacccccacugagauacagaggggaagauggaugcugguacggaauggaaauacgcccacugaaggaaaaagaagaaaauuuaguaaacucccuagucacagcaggucacggacaaauugacaacuuuucauuaggaguguuaggcauggcuuuauuuuuagaagaaauguuaagaacucggguaggaacaaagcaugcgauacuccuaguugccguuagcuuuguaacauuaaucacgggcaacaugucuuuucgagaucucggacgcguaaugguaaugguuggagccacuaugacugaugauauagguaugggaguuaccuaccuagcuuuacuugcugcauucaaagugagaccaaccuuugccgcaggacuucuacugaggaaauuaacauccaaagagcugaugauggcuacgauagggguagcccuucucagccaaagcaccauaccagaaacuauacuugaacuaacugacgcccuagcacuugggaugauggcucugaagauuguuaaaaacauggaaaaguaucaacuagcaguuacuauaauggcuauuaguugcguuccaaacgcagugauacuacaaaacgcuuggaagguuagcuguaccauucuagcagcaguuucuguauccccacuucuucuaacauccagccagcaaaaagcagauuggauaccacuugcacucacgauaaaaggucuaaauccaacggcuauuuucuugacuacacucucucgaacaaguaagaaacgaucuuggccacuuaaugaagcaauuauggccguugguaugguaucaauacuugccucuucuuuacugaaaaaugauauuccaaugacagggccacuuguagcugguggauuauuaacuguuuguuauguguugacaggacguucugcagauuuggaguuggaacgagcggcugaugugaaaugggaagaucaagcugaaauauccggcucaaguccgaucuugucgauuacgauaucggaagauggcucaaugucuaucaaaaacgaggaagaggaacaaacuuuaacaauccuuauacgaacagggcuucuaguaauaucugguguguuuccggucucaauaccaauaacugccgccgcaugguaccuaugggaagucaagaaacagcgcgcagggguauugugggaugucccuucgccacccccaguaggaaaagcugagcucgaagauggagcauauagaaucaaacaaagaggaauacuuggcuauucacaaauaggcgcuggaguauauaaggagggaacauuccacacaauguggcaugugacuagaggcgcaguauuaaugcacagaggcaaaaggaucgaacccuccugggccgacguuaagaaagacuuaguuucauacgguggagguuggaagcucgagggagaauggaaagaaggugaagaggugcaaguguuagcccuggaaccaggaaagaacccuagagcaguacaaacuaaaccggguauauuuaagacaaauacaggaacaauuggagccguaucgcucgacuuuagcccagguacaucugggucaccgauaguagacaggaagggcaaaguaguaggucucuacggcaauggaguuguaacacgaucaggagcguacgugucagcuauagcgcaaaccgaaaaaucaauagaagauaaccccgaaauagaagaugacauauuuagaaagaaacgauugacuaucauggauuugcauccuggcgcuggaaaaacaaagcgguaucucccugcuauaguuagagaagcgauaaagaggggguuacgaacauuaauauuagcacccacacgggucguagcugcagaaauggaagaagcucuuagaggacuacccauucgauaucagacgccagcuauccgggccgaacauacuggcagagaaauuguagauuugaugugccacgcaacauucaccaugagauugcuuucaccaguucguguaccaaauuacaaucuuauaauuauggacgaggcucacuucacugauccugcgucaauagcugcaagaggauauauaaguacaagaguugaaaugggugaagccgcgggaauauuuaugacagcgacaccgcccggaucuagagacccuuucccucaaucaaaugcuccuauaauggacgaagaacgugaaauaccggaacgaucuuggaacagcggacaugaguggguaacagauuuuaagggaaagacagucugguuuguaccuucuaucaaagcuggcaacgacauugcggcuugccuuaggaaaaacggcaaaaaggugauacaacuuucuagaaaaacguucgauucugaguacguuaagacgcgcagcaaugauugggauuucgucguaaccacggacauaucagagaugggcgccaauuuuaaagcugagaggguuaucgauccgaggcgcuguaugaaaccaguaauauuaacugauggagaagaaagagugauauuggcgggaccaaugcccguuacacacucauccgcagcacaacguagggggagaaucggcagaaaccccaaaaaugaaaaugaccaauauauuuacaugggugagccgcuugaaaacgaugaggauugcgcacauuggaaagaggcaaaaaugcuacuugauaacauaaauacgccggaagguauaauuccaaguauguuugaaccagaaagggaaaaaguugacgcaauugauggggaauaucgacuuagaggggaggcuagaaaaacauuugucgacuugaugagacgaggugaucuuccuguauggcuugcauauaaaguagcagcugaaggcauuaauuaugcugaucgucggugguguuuugacggaaucaaaaauaaucaaauauuagaagagaaugucgagguagaaauuuggacaaaagaaggagaacgcaagaaacuuaagccacgaugguuggacgcaagaauauacucagacccauuagcccucaaagaguucaaggaauuugcagcgggacgaaaaagccuuacguuaaauuugauaacugaaauggggcgcuugccaacauuuaugacgcaaaaggcgagaaaugcauuagauaaccuagcaguauuacauacagcagaagcaggaggaaaggcuuauaaccaugcucuaagcgaacuaccggaaacauuagaaacucuucuucuucugacacuacuugcaacugugacaggcgguauuuuucuuuuucuaaugucuggcaagggaauagguaagaugacacuagguauguguuguauaaucacggccucaaucuuauuaugguacgcccagauacaaccucauuggaucgcggcgagcauaauucucgaguucuuuuuaauaguacucuugauaccagaacccgaaaaacaaagaacuccccaagauaaccagcucaccuaugucguaauagcaauucugacgguaguagcugccaccauggcaaaugagaugggauuuuuagagaaaacuaagaaagacuuaggucuuggaucuauaacuacacaggaaagugaaucaaauauauuagacaucgauuuaagaccugcgucugcguggaccuuguacgcaguugcaacuacauuuguuacaccuauguuaaggcauucaauugaaaacagcucaguuaauguaucauuaacugcaauagcgaaucaggcaacaguauugaugggguuaggcaaggguuggccauuaucaaagauggacauugggguaccgcugcucgcaauaggaugcuauucccaaguaaacccuauuacguuaacagcagcccuauugcuucuaguagcucacuacgcuauaauugguccgggacuacaagcaaaggcgaccagggaggcgcagaaaagagcugcagcagguauaaugaaaaauccaacuguugacgggauaacagugaucgaucuugaaccaaucccuuacgacccaaaauucgaaaaacaauuaggccaaguaauguuauugauacuauguguaacccagguccuaaugaugagaacaacgugggcacuaugugaggcauuaacucuugcaacgggaccgauuuccacuuuaugggaagguaauccgggucgguucuggaauacgacgauugcaguaagcauggcaaauauauuccgggguucauauuuagccggggccggauuauuguucaguaucaugaaaaacaccacgaauaccagacgcgggacuggcaacaucggggaaacacuuggagagaaauggaagucgagacuuaaugcauuagguaaaagugaguuucaaauauauaagaagucuggcauucaagagguagaccgaacauuagcuaaggaaggcauaaagagaggggagacugaucaucaugcaguaagccgagguucugcaaaguuaagaugguuuguugagagaaacaugguuacgccggaaggcaaaguaguagaucuugguugugguagaggaggauggagcuauuacugcgggggacuaaagaacgugagggaaguaaaaggccuaacgaaaggggguccuggucaugaagaaccaauucccaugucgacguauggauggaaucuuguucgucuucaaucgggaguagauguauucuuuacuccucccgaaaaaugugacacgcuacuaugugacauaggugaaagcaguccuaauccuacuauagaggcuggacggacacugcgaguauugaauuuagucgaaaauugguugaauaauaauacacaauucuguauuaaaguguuaaacccuuauaugccaucuguaauagaaaagauggaaacccuucagagaaaguauggaggcgccuuaguacggaauccgcugagcagaaauaguacccacgaaauguauuggguuucaaacgcuacgggaaacaucguaucaaguguuaauaugauaagucguaugcuaauuaacagauucaccaugaaacauaagaaagcuaccuacgagccagauguagaucuuggaucagggacuaggaacauagggaucgaaagcgagauaccuaaucuagacauaauagggaaaaggaucgagaaaauuaagcaggaacaugaaacaucauggcauuacgaccaagaccauccauacaaaacuugggccuaucauggauccuacgaaacaaaacaaacaggcucggcuuccucaauggucaauggaguugucaggcuguuaacaaaaccuugggauguaguacccauggugacacaaauggcuaugacggauaccacuccuuuuggacaacaacgggucuuuaaggaaaaaguagacacaagaacacaagaaccaaaagaagggaccaagaaacuuaugaaaauaacagcagaauggcuauggaaagaacuagggaaaaagaaaacaccacggauguguacaagagaagaguucacccguaaagugagaagcaacgcagcacuaggugcaaucuuuaccgaugagaauaaauggaaaucagcuagagaggcgguugaagauggacgcuucugggagcuaguugaccgggaaagaaauuugcauuuggaaggcaaaugcgaaacaugugucuauaacaugaugggaaaacgagagaagaaauugggggaguucggaaaagcaaaaggaagucgggcgauaugguacauguggcucggugcgagguuuuuggaguucgaagcauugggauuucugaacgaggaccacugguucagccggggaaacagucucagcggaguugaaggcgaaggcuuacaccgccuaggguauauacuuagagauguaucaaagaaagaaggaggagcuauguaugcugaugacaccgcgggaugggauacaaggauaaccuuagaggaccuuaaaaacgaggagaugguaacaaaucauaugaaaggggaacacaagaaauuagccgaggcuauuuucaaauuaacguaucaaaauaaagucguacgagugcaacgcccgacgccgagaggaaccguuauggacaucauuucucgaagagaucagcggggaaguggucaagucggaacauauggccucaauacguuuaccaacauggaagcacaacugauaagacaaauggaaggugaggguauauucaaaagcauucaacaucuuacaguaacggaggaaauagcaguccaaaauuggcuagcucgcguaggacgagagagguugacucgaauggcuaucucaggcgaugauuguguaguaaaaccaauagacgacagguuugcaaaugccuugacggcucuuaacgauaugggcaaaguucggaaagacauccaacaaugggagccaucucguggauggaaugacuggacacaaguaccguucuguucgcaccauuuucacgaacuugucaugaaagacgggaggguccuagugguuccaugcaggaaucaagacgagcugauagggagggcacguauuagucagggggcugguuggagcuugaaagagacagcauguuuaggcaaaucauacgcucaaauguggacucucauguauuuucauagacgugacuuacgucuugcagcaaaugccauauguucagcugucccaucucacuggguacccacaagcagaacaacauggucuauccacgccaaacaugaauggaugacaacagaagacaugcuggcuguauggaauagaguauggauacaggaaaacccguggauggaagauaagaccccaguggaaucaugggaggaagugccauauuuaggaaagcgggaagaucaauggugugggagcuugauagguuuaacguccagagcuacaugggcuaaaaacauucaaaccgccauuaaccaagugagaucucuaauuggaaaugaagaauauacggauuauaugccaucuaugaaaagguuuagaagagaggaagaggaagcugguguauuaugguag

SEQ ID NO: 22269 - RNA, 9876 nt, Artificial Sequence
  derived and/or modified CDS sequence (opt6) from DENV-2__FJ850076__SS-prME
accgcaggagcaauagugaugcuaauuccaaccguaauggcauuucaucugacaacacgaaacggugaaccacauaugauuguagguaggcaagaaaaagguaaaucacuuuuguuuaaaaccgaagacgguguuaauaugugcacauuaauggcaauagaucuuggggaauuaugugaagauacaauuaccuacaaauguccccuauuaagacagaaugaaccagaagauauugauuguugguguaauaguacuucuacgugggucacauauggaacauguacaacgacgggagaacacagaagagagaaaagauccguggcauuaguaccgcacgucgguauggguuuagaaacuagaacagaaacguggaugaguagugaaggagcauggaaacauguacaaaggauagaaacauggauauugcgccaccccggguuuacgaugauggccgcaauauuggcguauaccauaggaacaacacauuuucaacgggcacuaauuuuuauacugcuaacugcugucgcucccucuaugacaaugagaugcauugggauuucaaauagggacuucguugaaggaguaucugggggaucauggguagacaucgugcuugaacauggaucuugugugaccacaauggcuaaaaacaaaccuacccuagauuuugaacucaucaaaacagaagcgaaacaaccagcuacacuucgcaaauauugcguugaagcaaaacuaacgaacaccacaacugaaucaaggugucccacacaaggagagcccucuuuaaaugaagaacaagauaaaagguuuauuugcaaacauucaaugguagaucguggauggggaaaugguugcggcuuauucgggaaaggagguauaguaacaugugcaauguucacauguaaaaagaauauggaggguaagguaguacaaccugaaaaccuagaauauaccauaguuauuacuccucauucaggagaagaacacgcaguaggaaacgacacgggaaaacacgggaaagagauuaaaaucacaccacaaucaucaauuacugaggcugagcuuacaggauauggaacaguuacuauggaauguucacccagaacagggcuggauuucaaugaaaugguacuacuacagauggaagauaaagcauggcuaguacacagacagugguuccuugaccuaccacugccaugguuacccggggcagauacucaaggcucuaauuggauucagaaagaaaccuuagucaccuucaaaaauccgcaugcaaagaaacaagauguagugguucucgguucacaggagggcgcuaugcauacagcuuuaacaggagcaacagaaauacaaaugaguucgggcaacuugcuauucacaggacacuugaaaugcaggcuacgaauggauaaauuacaacucaaaggaaugaguuauucgaugugcacagguaaauucaaaaucgugaaagaaaucgcugagacccaacaugggaccauagugauaagaguacaauaugaaggggacgguucaccuuguaagauaccauucgagauuauggaccuagagaaaagacacguuuuagguagauuaauaacaguuaauccuauuguaacugaaaaggauucaccaguaaauaucgaagcugaaccaccauuuggcgauuccuauauuauaaucggaguugaaccaggacaauugaaacugaauugguucaagaaaggaucaaguauaggccaaauguucgaaacaacgaugcgaggugcaaaacgaauggcaauacuaggugauacagcgugggacuuugggaguuuaggaggcguauucacgaguaucggcaaggcacuacaccaagucuuuggggccauuuauggcgcagccuuuucuggcgucucauggacgaugaaaauacugauuggcguaauaauaaccuggauaggaaugaacagccguucaacgucacuaucgguaagucuaguacugguagggguaguuacacuguacuuaggugcaaugguacaggcagauucagguugcguaguaaguuggaaaaacaaagaguuaaagugcggcucaggcauuuucauaaccgauaacguucauacauggacagaacaauauaaguuucaacccgaaucaccaucuaaauuggcaucagcaauacaaaaagcacaugaggagggcauaugcggaauaagaaguguaacuagauuagaaaaucugauguggaaacagauaacaccugaacuaaaucacauauuauccgaaaacgaaguaaaguuaaccauuaugacaggugacauuaaagguauaaugcaggcaggaaaaagaaguuuacggccccagccaacggaauugaaauacucauggaagacuuggggcaaagcaaaaaugcugccaacggaaagccacaaccaaacauuccuaaucgacggcccggagaccgcagaaugcccaaauacgaaucgugccuggaacucacuugaaguagaagauuauggauuuggugucuuuacuacuaacauuugguuaaaacuccgcgaaaaacaagacguuuucugugauucaaaauugaugucugcagccaucaaggauaauagagcuguacacgcugacauggguuacuggauugaaucagcauuaaaugauacauggaaaauggaaaaagccucauuuauugagguaaaauccugucacuggcccaaaucgcauacauuauggaguaauggaguuuuagaauccgaaaugauaauacccaaaaacuucgcugggccuguaucucaacacaauuacagaccaggcuaccauacacaaacagcaggaccauggcaucugggaaagcuggaaauggauuuugauuuuugcgaagggacuacugucguaguuaccgaagacuguggaaauagggggccuucucuuaggacaacuaccgcaucagguaaguuaauuacugaaugguguugccgaucaugcacauuacccccacucagauaucggggcgaagauggcuguugguauggaauggagauuaggccucugaaagagaaagaggagaauuuaguuaauagccugguuaccgcaggacacggucaaaucgauaauuuuagucuuggaguuuuagggauggcuuuauuucuugaagagauguuaagaacaagagucgggacgaagcaugcuauucuauuaguugcuguaucguuuguaacgcucauaacggguaacaugucauuuagagaccugggucgagugaugguuaugguuggugccacaaugacagaugauauagguauggguguuacguacuuagccuuauuggccgccuucaaaguacgcccaacauuugcugccggguuacuucuuagaaaguuaacgucaaaggaacugaugauggccacaauuggaguagcauuacucagccaaagcacuauaccugagacaauucucgaacugacggacgcacucgcucucgguaugauggcacuuaaaauuguaaagaacauggaaaaguaucaacuggccguuacaauaauggcgauaagcuguguaccuaaugcgguaauacuucagaacgccuggaagguuucauguaccaucuuggcagcuguaucaguaaguccguuguuacuaacaagcagucaacaaaaagcugacuggauuccauuagccuuaacaauaaaggggcuaaauccaacggccaucuuucucacgacacugaguagaacgagcaagaaaagaucguggccacuuaacgaagcaaucauggcagugggaaugguauccaucuuagcuaguaguuuacucaaaaacgacguucccaugacaggaccacugguagcgggcgguuuacuaacaguauguuaugucuuaacuggacgcucagcagaccuagagcuggaacgugcugccgauguaaaaugggaggaucaagcugaaauuucgggaaguaguccgauauuauccaucacaauuucggaagacggaucaauguccaucaaaaaugaagaggaagaacaaacacuaaccauucugauuaggacgggauugcuaguaauaagcggaguauuuccaguuaguaucccuauaacugcggccgcaugguacuugugggaaguuaagaagcaaagagccgguguacuaugggaugugcccaguccuccuccugucggcaaagcugaguuggaagauggcgcguauagaauuaaacaaagggggauacucggcuacagccaaauaggcgcgggaguguacaaagaagguacauuccauacaauguggcauguuacucgcggugcaguuuuaaugcauagggggaaacgaauagaaccauccugggcugacguaaagaaggaccuggucagcuaugguggaggguggaaacuagaaggagaauggaaagagggcgaagagguccaagugcuggcacucgagcccggcaaaaacccccgugcagugcagacaaaaccagguauuuucaaaacaaacacaggaacaauuggugccguaagucucgacuuuagcccuggaacaucuggcaguccgauaguagauaggaaaggcaaaguaguaggacuauauggaaaugguguggucacacgaucgggugccuauguaagugcaaucgcacagacggaaaaaucaauagaagacaaucccgagauagaagacgacauauuuaggaagaaacgccuuaccaucauggauuugcacccaggugcaggaaaaacuaaaagauaucugccagcgauuguccgagaagccauuaaaaggggacugcguacauugauacucgcccccacuagaguugucgcagcugaaauggaagaagcccuucgcggguugccuauacguuaccaaacuccagcaauucgcgccgaacauacaggacgagaaaucguugacuuaaugugucaugcaacauuuacaaugcgccuauuaagcccaguacguguaccgaacuauaauuugauaaucauggacgaagcgcacuuuacagauccagcaucuauagcagcaaggggguauauaucuacacgaguagaaaugggcgaggcagcaggaauauucaugacggcaacacccccgggcucacgugaccccuuuccccaaucuaaugcuccaauaauggaugaagaacgugagauccccgaaagaaguuggaacucuggccacgaauggguaacggauuuuaagggaaaaacaguaugguuuguuccuagcaucaaagcaggcaaugacauagcagcuugucuaaggaagaauggcaagaagguaauccaacuaagcagaaagacauucgacucagaauauguaaagacaaggucgaaugauugggauuuuguagucacaacggauauuucagaaaugggcgcaaauuuuaaagcagaaaggguuauagacccucggcgauguaugaagcccguaauauuaacagacggggaagaacgagugauuuuagcaggcccaaugccaguaacacauagcucggcagcccaacgaagggggagaauuggucgaaacccgaaaaaugagaaugaccaguauaucuauaugggagaaccauuagagaaugacgaagauugugcccauuggaaagaagcaaagaugcuauuggauaauaucaacacuccggaaggaauaauuccgaguauguuugaaccagaaagagaaaagguggaugcaaucgacggcgaauaccgauugagaggcgaagcgagaaaaacuuucguugaucuuaugcgaagaggagaucuaccaguaugguuagcauacaagguagcagcggagggaauaaauuaugcugaucgucguugguguuucgauggaaucaaaaacaaucaaauauuagaagaaaacguugaagucgaaaucuggacaaaggagggcgagaggaagaaacuaaagccucguugguuagaugcacggaucuacucagacccauuggccuugaaagaauuuaaagaguuugcagcugggcgaaaaucacucacucuuaaucuaauaacagagaugggacgcuuaccaacauucaugacacaaaaagcuagaaacgcgcuggacaaucuggcaguacuacacacagccgaggccggugggaaggcuuacaaccaugcuuugucagaauuacccgagacucucgaaacguuacuguuauuaaccuuauuagcaacuguaacaggagggauauuuuuguuucuuaugucaggaaagggaaucgguaagaugacccuaggcauguguugcaucauaaccgcauccauauugcucugguaugcacaaauacaaccccacuggaucgcugcaagcauaauacuagaguucuuuuugauaguauugcucauaccagagccggaaaaacaacgaacaccgcaagauaaccaguuaacguaugucguaauagccauauugacaguaguagcagcaacaauggcuaaugaaaugggcuuuuuggagaaaaccaagaaagacuugggacuaggcuccauaacaacucaggagucagaauccaauaucuuagacauagacuugcgcccagcaagcgcauggacgcuauacgcugucgcaaccacauucguuacaccaauguuaaggcacagcauagaaaacuccagcgucaacguaaguuugaccgcaaucgcuaaucaagccacgguucucaugggauugggaaaaggcuggccccuaucaaagauggauauugguguaccgcuauuagcaauaggcuguuacagucaaguuaauccaauuacguuaacagcagcuuuguuacuucucguugcccauuaugcuauaaucgguccaggucuucaagccaaggcuacaagagaagcacagaaacgagcggcugcaggaauaaugaaaaaccccacgguagacgguaucacaguaaucgaccuggaaccuauaccauaugaucccaaauuugaaaaacaacuaggacaaguaaugcuucucauauugugugugacccagguuuugaugaugagaacaaccugggcauugugugaggcguugacucuagcaacaggucccauauccacacuuugggaagggaacccagguagauuuuggaauacgacuauagccguaaguauggcuaauauuuuucgggggaguuacuuagccggagcuggucucuuguuuucuauaaugaaaaauacgacaaauacuagaagaggaaccggaaacauuggagaaaccuugggggaaaaguggaaaagucgccuuaaugccuugggaaaaucagaguuucagauuuauaagaaaaguggcauacaagaaguugaccguacacuagcaaaggagggcauaaagcgcggcgagacagaccaccacgcuguuagucgaggcucagcaaaacuacguugguuuguagaacgaaacauggugacuccagaagggaaaguaguggaccuagguugcgggaggggcggauggucguacuauuguggagggcucaagaauguaagggaaguaaaaggauuaacaaagggagguccaggucaugaagaaccgauaccgaugagcacguacggauggaauuuaguccgccuccaaagcggugucgacguguucuuuaccccaccagaaaaaugugauacgcuacuaugcgacauaggggaaucaucgccuaauccaaccauagaagcagguagaacuuuaaggguacugaaccuaguggaaaauugguuaaauaacaacacacaauucugcauaaaaguauuaaacccauacaugccuaguguaaucgagaagauggaaacuuuacaaagaaaauauggaggagccuuaguucguaacccuuuaucccggaacucuacacaugagauguauugggugucuaaugccacaggaaauaucguuucuucgguaaacaugauaaguagaaugcuaaucaacagauuuaccaugaagcauaagaaagcaacauaugaaccggacguagauuuaggcucagguacaagaaauauugggauugaaucugaaauuccgaauuuggauauaauagguaaaagaaucgaaaagaucaaacaggaacaugagacgagcuggcauuaugaucaagaucacccauacaaaacaugggcauaucacgguucuuaugaaacaaaacagaccgggagugccuccaguaugguuaauggcguaguacgccuauuaacaaagccaugggauguaguuccaaugguuacccagauggcgaugacagauacaacuccauucgggcaacagcgaguguucaaggaaaaaguagauacucgaacucaagagcccaaagaaggcacuaagaaauuaaugaaaauaacggcagaguggcuauggaaagagcuggguaagaagaaaacuccuaggauguguacaagggaggaguuuacgcguaaagucaggaguaacgccgcacuaggagcaauuuucaccgaugagaacaaguggaaguccgcucgugaagccguugaggacgggcgauuuugggaguuaguugauagagaacgaaaucuucaucuagagggcaagugugagacauguguauauaacaugauggguaagagagagaagaaauugggugaguucgguaaagcaaaagggagcagggcuauuugguacauguggcuaggugcaagguuccuagaguuugaagcgcuuggauuucuaaaugaggaccacugguuuagccgagguaauagucuaagcgguguggaaggagaggggcuacaccgauuaggguauauacuaagagauguaucuaaaaaggaaggaggggccauguacgcagacgacacugcagggugggacacaaggauaacauuagaggaccuuaaaaacgaagaaauggugacuaaucacaugaagggugaacacaagaaacuagcugaggccauuuucaaacuaacuuaucaaaacaaagucguaagaguccagagaccaacuccacgcgguacaguuauggacauaaucucuaggagagaucagagaggaucaggucagguuggaacguauggauugaacacuuucacgaauauggaagcccaguuaauaaggcaaauggaaggagaggggauauuuaaauccauccagcauuuaacagugacagaggaaaucgcugugcagaauuggcuggcuagaguuggccgagagagguugacccgaauggccauuucaggugaugauuguguugucaagccuauugaugauagauucgcaaaugcucuaacugcccuaaacgauaugggaaagguaaggaaagacauucaacaaugggagccgaguagaggguggaacgacuggacgcaaguuccauuuuguucucaucauuuccaugaauuagucaugaaagauggaagagugcuagucguacccuguagaaaucaagaugaacugauuggcagagcgaggauaucccagggagcaggaugguccuugaaggaaacagcaugucuagguaaaucuuacgcacagauguggacacuaauguacuuccauagacgugauuuacgcuuagcagcaaaugcaauaugcagugcaguaccaucacacuggguucccacguccagaacuaccuggucgauacacgcaaaacaugaauggaugacuacagaagauaugcuagcgguguggaaccgaguguggauccaagaaaacccauggauggaagauaagacaccagucgaaucuugggaagagguaccuuacuuaggcaagagagaagaucaaugguguggaucacuaauuggauuaacaagucgugccacgugggccaaaaacauucagacggcuauaaaccagguaagaucuuuaauaggaaaugaagaauauacagauuacaugccuuccaugaaaagauuucguagagaagaggaagaagcgggaguuuuaugguaa

SEQ ID NO: 22270 - RNA, 9876 nt, Artificial Sequence
  derived and/or modified CDS sequence (opt6) from DENV-2__GQ868640__SS-prME
acagcaggagcgauaguaaugcuaauuccgacuguaauggccuuucaucucacgacaagaaacggggaaccacauaugaucguaggaagacaagaaaaaggaaaaagccuguuguuuaaaacagaggacggaguaaauauguguacacugauggcuauugauuuaggugaacucugugaagauacgauaacguacaaauguccauuacuaagacagaaugaacccgaggauauagauuguuggugcaauaguacuucaacauggguaacauacgggacgugcacuacuacuggagagcaccggagagaaaaacgcucuguagcacucguaccucauguuggaaugggacuugaaacgcgaacugaaaccuggaugaguucagaaggcgcuuggaaacauguccaaagaauugaaacauggauauuacgacauccgggauucacuaugauggcggcuauuuuagcauauacuauugguacgacccauuuccagagggcucugauauuuauccuacucacagccguagcacccucuaugaccaugagauguauaggcauaaguaaucgugauuuuguagaaggagucaguggagggucuuggguagacauaguacuugaacauggauccugcguaacaacaauggcaaaaaauaaaccaacauuagacuuugaguuaaucaaaacugaggcuaaacaaccugccacauuaagaaaauauugcguagaggcgaaacucacaaauacgacgacugaaagucgaugcccaacacagggugaaccaucacuaaacgaggaacaagacaaacgauucauuuguaaacacucaaugguggauagaggaugggggaaugguuguggccucuucggaaaagggggaauaguaacgugugccauguucacgugcaaaaaaaacauggaggguaaaguaguacagccugaaaaucuagaauacacaaucgucauaaccccucacucaggugaagaacaugcaguugggaaugacacuggaaaacauggaaaagagauaaagauaacaccccaaaguucgauuaccgaagcagagcuaacgggguacgggacuguuacaauggaaugcuccccgcgaacuggauuagauuucaacgaaaugguauuguuacaaauggaagacaaagcauggcuuguccaccgacaaugguuuuuggacuuaccucuaccuugguuacccggagcagauacacaagguaguaauuggauacagaaagagacgcuggucacauucaaaaauccccacgcgaaaaagcaagacguaguaguucuagguagccaagagggagcaaugcacaccgcguuaacaggugcgaccgaaauucaaaugaguagugggaauuuguuguucacaggccauuugaaaugcaggcuucgaauggauaaacuccaacuuaaaggaaugaguuacucaaugugcacaggcaaguucaagauuguaaaagaaauagcugaaacucaacauggaacaauaguaauuaggguacaauacgaaggagaugguucuccauguaaaaucccauuugagauaauggacuuagaaaaaagacacgucuuaggacgucuuaucaccguaaacccaauaguaacggaaaaagauucaccugucaacauagaagccgagccaccuuuuggagacucuuauaucauuauugguguagagccuggacaauuaaaauuaaacugguucaagaaagguucaaguauaggccaaauguucgaaacuaccaugagaggugccaaacgcauggcgauucuaggugacacugcaugggauuuuggaucacugggugguguauucaccagcauagggaaggcuuuacaucagguuuuuggcgcaauauacggagcagcauuuaguggugucaguuggaccaugaaaauacucauuggaguaaucaucacauggauagggaugaauucaagaagcacaucguuaucugucaguuuaguacuaguaggggucgugacuuuguacuuaggcgcaaugguucaagcugauucuggcuguguaguuucuuggaagaacaaagaacuuaagugcggaagcggcauauucauaacagacaauguucacacauggaccgagcaauacaaauuucaaccagagucuccgagcaaacucgcuagugccauacaaaaagcacacgaggaagggauuuguggaauacggaguguuaccagguuggaaaacuuaauguggaaacaaauaacuccugaauuaaaucauauucuuagugagaaugagguaaaacuaacgauaaugacaggagauauuaaagguauaaugcaggcgggaaagagaagucuacgaccacaaccuacugaacuaaaauauagcuggaaaacuuggggaaaagccaaaauguuacccaccgagucacauaaccaaacauuucuaaucgauggcccggaaaccgcugaaugcccuaauaccaauagggcguggaauucguuggaaguggaagauuauggauucggagucuucacaaccaacaucuggcucaaguuaagagagaaacaagauguauuuugcgacucaaaacuaaugucagccgcuauaaaagacaacagagccguccaugcagauaugggauacuggauugagagugcccuuaacgacacauggaaaauggaaaaagcaucuuucauugaaguuaaguccugucacuggccuaaaucccauacccuauggucuaauggcguacuagaaucagaaaugauaaucccaaaaaauuucgcagggccugucucucaacauaacuaccgcccuggauaucacacgcaaacugcuggucccuggcaucugggaaaacuagaaauggauuuugacuuuugugaaggaacgacuguuguaguuacagaagacuguggcaauagagggcccaguuugaggaccaccacugcuucaggaaagcuuauuacugaguggugcugccgaucauguacauuaccacccuuacgguauaggggagaagauggcugcugguacgguauggagauaagaccuuugaaggagaaagaagaaaacuuaguuaacucacuugugacagcaggacauggucagaucgauaauuuuucccuaggaguuuuaggaauggcguuguuucuggaggagauguugagaacgcgaguaggaacaaaacaugcuauuuugcuaguugcagucaguuuuguaacucuuauaacaggaaacaugucuuuccgggaucuuggacgcguuauggucaugguaggcgcaacaauuacagaugacauuggcauggggguaacauaucuugcccuacuggcagcguuuaaaguccguccaacauuugcagcgggucucuuacuucggaaauugacgagcaaggaacuuaugauggcaaccauaggaguugcucuauugucacaaagcacgauaccggaaacaauacuugaacuuacagacgcgcuugcguuggggaugauggcacuaaaaauaguaaaaaauauggaaaaguaucaacuggcaguuacgauaauggcuauaucauguguaccaaacgccguuauauuacaaaaugcauggaaaguaucaugcacaauacuagcugcaguuaguguauccccacuacuacuuacuucaagucaacaaaaagcugacuggauaccgcuagcauugacaaucaaaggguugaacccgacugcaauauuccuaacuacgcuaucgagaacuaguaagaaacguucguggccauuaaaugaagcgauaauggccguugguaugguaucgauccuagccaguaguuuguuaaaaaaugauguaccaaugacagguccgcuuguagcgggcggacuacuaaccgucuguuacguauuaacagguaggagugcagaucuggagcuagagagagccgccgauguaaaaugggaagaccaggcugagaucucaggaucaucaccaauucuaaguauaacgauuucugaggauggaucuaugucaauuaaaaacgaagaagaagagcaaacgcuuacaauauuaauaagaacaggcuugcuuguaauuaguggaguauucccgguaucaauaccaauuacugccgccgcaugguaucuuugggaaguuaaaaaacagagggcagguguauugugggaugucccgagccccccacccguggguaaggcagagcucgaagacggggcuuauagaauuaaacaaaggggaauauuaggauauucacaaauuggugcaggaguauauaaagaagguacuuuucauacuauguggcauguaacuaggggagcaguauuaaugcacagagguaagcgaauugaaccuucaugggcagauguaaaaaaagacuuggucucauaugggggaggauggaaacuugaaggcgaauggaaagagggugaagaaguccaaguacuugcguuagagccgggaaaaaacccacgugcaguacaaacaaaacccggcauuuuuaaaacaaauacaggaaccauaggagcaguaagccuagacuucucaccgggcacuagcggcucacccaucguugauagaaaaggaaaaguugugggccuuuacggaaauggagugguaaccagaagcggugcuuacgugagugcgauagcucagacugaaaaaagcauagaagauaauccagaaaucgaagacgacaucuuucggaagaaacgauugacgaucauggauuugcauccaggcgccgggaaaacuaaacgauaucuaccugcgauuguacgcgaagccaucaagcggggcuuaaggacccuaauuuuagcaccuacuagaguuguugcugcagagauggaagaagcucuacggggacuaccaauacgguaccaaacacccgcaauacgggcugaacauacaggaagggaaaucguagaucuaaugugucacgcaacauuuacaaugagauuacuaaguccuguaagaguuccaaauuacaaucucauaauaauggaugaagcacauuuuacugauccagcgucaauagcugcaagaggguauaucagcacucguguagagaugggagaggcagcaggaauauucaugacagccacacccccggguuccagggaucccuuuccccaaucaaaugcccccauaauggacgaagagcgagaaauaccugaacguucuuggaauucaggacacgaauggguaacagauuuuaaaggcaagacaguaugguucguucccucaaucaaggcugguaacgauauugcugcuuguuuacgaaaaaacgggaaaaaaguaauacaacugagucgaaaaacuuuugauagugaguacguuaaaacucgcaguaaugauugggacuuuguuguuacuaccgacauaucggaaaugggagcaaacuuuaaggccgaaagagucauagacccgaggaggugcaugaagccaguaauucuaacugauggcgaagagcgaguaauucuugcagggccaaugccggugacccacagcuccgcagcacaaaggcgcggccguauagggcggaauccuaaaaaugaaaaugaccaguacauuuauaugggggaaccgcuagaaaaugacgaggauugcgcucacuggaaggaggccaagauguuacuagauaauauaaacaccccagaaggaauuauaccaucaauguuugagcccgaacgagagaagguugacgcgaucgauggagaauacagguuacggggagaagcgaggaaaacauucguagaccuaaugcgucguggugaccuaccugugugguuagcguacaaaguugcagcagaaggaauaaauuacgcggacagaaggugguguuucgaugguauuaaaaauaaucaaauauuagaggaaaaugucgaaguagaaauauggaccaaggaaggugaaaggaaaaaacuaaagccaaggugguuagacgcaagaauauauucugauccauuagcacuaaaggaguuuaaagaauuugcugcuggaaggaagagucucacucuuaaccuaauaacagaaaugggacgccuaccuacguuuaugacccaaaaggccagaaaugcgcucgacaaucuagccguacuacauacggcugaggccggaggaaaagcguacaaccacgcgcuuagugaguugccagaaacauuggaaacauuacugcuucugacacuacuagcaacaguaacuggcggaauauucuuguucuuaaugagcggcaaaggcauuggaaaaaugacccuuggcaugugcuguaucaucacugcgaguauacucuuaugguaugcucaaauacaaccacauuggaucgccgcaucuaucauucuugaguuuuucuugauaguacuuuuaauuccggaaccagaaaaacaaagaacaccgcaggacaaucaauuaacauacguagugaucgccauacucacuguuguagcggcaacuauggcgaaugaaaugggauuucuagaaaaaacaaaaaaagaccuuggacuaggcuccaucacuacucaggagucugaaucuaauauucuagauauagauuuacggccugcuucagcauggacacucuacgcaguagcaacuaccuuugugacaccuauguuacgccacucgauagaaaauaguagcguuaauguaaguuugacugcuaucgcaaaucaagcgacaguucuaaugggacugggcaaagguuggcccuuguccaaaauggauauaggaguuccauuacuagccauaggaugcuauagucaaguuaauccgaucacccuaacugcagcauuauugcugcuaguggcacauuaugcaauuaucggacccggcuuacaggcaaaagcaacgcgagaggcacaaaagcgggcagcugccggcaucaugaaaaacccaacaguagauggaauaaccgucauagacuuagaaccuauaccguaugacccuaaauuugaaaagcaacuaggucaaguaauguuacucauacuaugugugacccaggucuugaugaugagaaccacuugggcauuaugugaggcauugacuuuagcgacuggaccaauuaguaccuuaugggaaggcaacccagguagguuuuggaauacuacgauagcaguaucaauggcaaacaucuuucgaggcucauaucuagcaggcgcugggcuguuauuuucaauuaugaaaaacaccacaaacacacgaaggggcacugguaauaucggagaaacacuaggagaaaaauggaaauccagauuaaaugccuugggcaaaagugaauuucaaaucuauaaaaaaagugguauucaggagguugauagaacauuggcaaaagaggguauaaaaagaggggagacagaucaucaugcaguuucuaggggaagugcgaaguugagaugguucguggaaagaaacaugguuacaccggaagguaaagugguugacuuaggguguggaagaggaggcuggagcuacuacuguggaggucucaaaaacguaagggaaguaaaaggccuuacaaaagguggaccagggcacgaagagcccauaccaaugaguacauacggcuggaacuuggucagauugcaaagcgguguagauguguuuuuuaccccuccagaaaagugcgacacacuauuaugugauauaggagaaaguaguccaaauccgacaauagaggccggccggaccuugaggguacuuaaucucguggaaaacuggcuaaauaacaauacccaauuuugcauuaaagugcucaauccuuauaugccaucgguaauugaaaaaauggaaacacugcaaaggaaauacggcggugcccuagugagaaacccacucagccggaacucuacccacgaaauguauuggguauccaaugcaacggggaacauaguguccucagucaauaugaucagucgaauguuaauuaaucgauucacgaugaaacauaagaaggcaaccuacgaaccagauguagaucuugguucgggaacacgcaauauagguauagaaucagaaauaccuaauuuagauaucauagguaaacgcauagagaaaaucaagcaggaacaugaaacaucauggcauuacgaucaggaucauccauacaaaacgugggcguaucaugguucuuaugagacuaaacaaacagguagugcaaguucuaugguaaauggugugguacgacuucucacuaaacccugggauguagucccuaugguaacacagauggcuaugacagauacgacgccguucggacaacaaagaguauucaaagaaaaaguugauacgagaacucaagaaccgaaggaaggaacuaaaaaacuaaugaaaauaacggcugagugguuauggaaagaacucgguaaaaaaaagacaccgagaaugugcacccgugaggaguucacacgaaaaguacgaagcaaugcagcauuaggagcuauuuucacagaugaaaacaaguggaaaagcgccagagaagcaguagaagauggaagauucugggagcucgucgauagagaacggaauuugcauuuagaaggcaaaugugaaacuugcguauauaauaugauggggaaacgagaaaaaaaacuuggugaguuugggaaagcuaaaggaucgagagcaauuugguauaugugguuaggagcuagguuccuagaguucgaggcauuagguuuucuuaaugaagaucauugguuuucuagaggaaauucauuaucuggugucgaaggagaaggacuucaucgauuaggauacauuuuaagagacguuucgaaaaaggaagguggugcgauguacgcagaugacacagccgggugggauaccagaauaacccucgaagaccuuaaaaaugaagagauggugaccaaucauaugaagggagagcacaaaaaacucgcagaagcaauauuuaaauugaccuaucaaaauaaaguaguacgcguacaacggccaacaccucguggaaccguuauggacauaauuagccgaagagaccaaagagggucagggcaaguaggcacauauggacucaacacauuuacgaacauggaagcacaguuaauaagacaaauggaaggugaaggcauauuuaaaagcauccaacacuugacugucacagaagaaauugcgguucaaaauuggcuugcacguguaggccgugaaaggcugacgagaauggcaauuucgggugacgacugcguugucaaaccaauugacgauagauucgcaaaugcucuaaccgcccuaaaugacaugggcaaagucagaaaagauauucaacaaugggaaccuucuagaggguggaaugauuggacccaaguaccauucuguucacaucacuuccaugaacugguaaugaaggauggaagggucuuaguaguaccuuguagaaaccaagacgaauugauugguagagcccgcauuagucaaggcgccggauggucacuaaaagaaacagcuugucuaggaaaauccuacgcacaaauguggacgcuaauguauuuucauagacgugauuuacguuuagcggcaaacgcgauuugcucugcuguaccaagccauugggucccaaccagccgaaccaccuggucaauacacgcuaaacaugaauggaugacgaccgaggacauguuagccguauggaaccgaguauggauacaagaaaauccauggauggaagacaagacgcccguagaauccugggaagaaguucccuaucuuggaaaaagagaagaucaaugguguggcucucuaauaggacuaacuagccgagcgacaugggcaaaaaauauacaaacugcaauuaaucaggucaggucuuugauuggaaacgaggaauacacugacuacaugccuucaaugaaacguuuccguagagaagaggaggaagcagguguacuaugguaa

SEQ ID NO: 22271 - RNA, 9876 nt, Artificial Sequence
  derived and/or modified CDS sequence (opt6) from DENV-2__FJ850078__SS-prME
acugcgggagucauuguuauguuaauuccaacgguuauggcuuuccaccuaacgaccagaaacggggaaccacacaugauaguagggagacaagaaaaagguaaaaguuugcuauucaagacugaagaugguguaaauaugugcaccuuaauggcaauugaucuaggugaacuaugcgaagauacaauaacauauaaaugcccucuacuucgucaaaaugaacccgaagauauagauugcugguguaacucuacauccaccuggguuacguaugggacgugcacgacaacaggagaacauagaagagagaaaagaucagucgccuuaguaccacacgucgguaugggauuggaaacucguacugaaacauggaugucuucugaaggggcauggaaacauguucaacggauugaaacauggauccuccgucauccagguuuuacgaugauggcagcaauacuugcuuacacaauaggaacuacacacuuccaaagagcuuugauauuuauuuuacuaacagcagucgcuccgucaaugacaaugcguugcauagguauuagcaaucgagauuuugucgaagguguaucuggagguuccuggguagauaucguauuagaacauggaucuugcguuacuacuauggcuaagaauaagccaacacuagacuuugaacucauaaagacagaggcaaaacagccagcuacguuaagaaaauauuguguugaagcuaaacuuacaaacaccaccacggagaguagauguccuacccaaggggagccgucacugaacgaagaacaagauaaaagguuuaucugcaaacauagcauggucgaucguggauggggaaaugguuguggucuauuugguaaaggaggaauuguuacgugcgcaauguucacaugcaagaaaaauauggaagguaaggucguucaaccugagaaucuggaauacacuauaguaauuacgccacacaguggagaggaacaugcaguaggaaacgauacggggaagcauggaaaagaaauuaagauaacgccucaaucaaguauuacagaggcagaacuaacgggguacggaacuguaacaauggaauguucuccuagaacaggauuggauuuuaaugaaaugguguuauugcaaauggaagauaaggcgugguuaguucauagacagugguucuuagaccuaccauugcccugguuaccaggugcggauacacagggauccaauuggauucaaaaagaaacucuaguaacauuuaaaaauccacaugccaagaaacaggaugucgugguucuaggcagucaagaaggggcaaugcacacugcacugacuggagcaacagagauacaaaugaguagcggaaacuuauuauucacuggacaucugaaauguagauuacggauggacaagcugcaauugaaaggcaugaguuauaguaugugcaccgggaaauuuaagauugugaaggaaauagccgaaacucaacacggaaccauaguuauaagagugcaguacgaaggagauggcagcccuuguaaaauuccguuugagauaauggacuuagaaaagagacauguauugggcagacuuauuacggucaauccuaucguaacugaaaaagauaguccagugaauaucgaggcugaacccccauuuggggacucguacaucauagucggcguagaaccagggcaacuaaaacuuaauugguucaagaaagguaguagcauaggucaaauguuugaaacuacaaugcgaggagcuaaaaggauggcuaucuuaggcgauacggccugggacuuuggcucgcuuggaggugucuuuacaucaauuggaaaggcauuacaucagguuuucggggccauuuauggagcagccuuuaauggcguguccuggacgaugaaaauuuuaauuggagucauaauaaccuggauaggaaugaacucuaggucaacaucuuuaucuguaucauugguacugguagguguagugacgcucuauuuaggagcgaugguacaggcggacuccgggugcgucgucucguggaagaauaaagaauuaaaaugcggaucgggcauauucauuacagauaacguucacacauggaccgaacaauauaaauuucaaccagaguccccgaguaaacucgcuagugcuauacaaaaagcucacgaagaagguaucugcggaauacgcaguguaacacgccuugaaaauuugauguggaaacaaauaaccccugaauuaaaucauauccugucagaaaaugaaguaaaacucacuauaaugacgggagacaucaaagguaucaugcaagccgguaagcgaagccuucgcccucaaccaacugaauuaaaauauagcuggaagacaugggggaaagcaaagaugcugccaacggaaagccacaaccagacauuucuaauugacgggcccgaaacagcugaaugcccgaaugcuaauagggcauggaacucucuugagguagaagauuauggauuuggaguuuuuacgacaaauauuugguuaaaauuacgcgaaaaacaagacgucuuuugugacaguaaacuuaugagcgcagcaauaaaggacaacagagcaguccaugccgauauggguuauuggaucgaaucagcacuuaaugacacauggaagauggaaaaagcgucguuuauugagguaaaaucgugucauuggccaaagagucauacucuauggucuaaugggguguuagaaucagaaaugaucauucccaaaaauuuugcaggaccggugucucaacacaacuacaggccaggauaucauacccagacggccggaccuuggcauuuagggaaauuagagauggacuucgauuuuugugaggguacaacagucguggucacagaagauuguggaaaccgaggucccagcuuacgaaccacgaccgcgucaggcaaacugauaaccgaauggugcugcagaucgugcacacuuccuccuuuaagauaucgaggagaagauggauguugguacggaauggagauuagaccgcugaaagaaaaagaagagaaucucguaaacucacucguaacagcaggacacggucaaauagacaacuuuaguuuagguguauuagguauggcauuauuucuugaggaaauguuaagaacaagaguuggcaccaaacaugcaauacuccugguggcuguuaguuucguuacgcugauuacgggaaauaugaguuuuagagaucugggccgggucaugguaaugguaggagcuacaaugacagacgacauuggcaugggagucacuuaccuugcucucuuagccgcauuuaaaguaagaccaaccuuugcggcaggucuauuauuaagaaaacucaccucuaaagaauugaugauggcgacgauuggugucgcucuauugagucaaagcacuauacccgagacuauuuuagaauuaacagaugcauuagcacuagguaugauggcguuaaaaauaguaaagaauauggagaaauaccaauuggccguaacaaucauggcuauuucuuguguuccaaacgcaguuauauuacaaaacgcauggaaaguaaguugcacuauauuggcagccgugucaguuucuccacuacuuuuaacaaguagucagcagaaagcagauuggaucccgcucgcacucacuauaaaaggucuaaauccuacugcuauuuuccuuaccacacuauccagaacuagcaagaaaagaagcuggccuuuaaaugaagccguaauggcaguagggauggucucuauccuugcaaguucauuacuuaaaaaugauauuccgaugacgggaccuuuaguggccgguggauuacuaacuguauguuacgucuugaccgggcgcucagccgaucucgaacuugaacgagcugcagauguaaaaugggaagaccaagccgaaauaagugguuccagucccauacugagcauuacaauaucugaagacgguaguaugucuauuaaaaaugaggaggaagaacagacccuuacuauauugauaagaacaggucuauuagucauaucuggugucuucccgguguccauaccgauaacggccgccgcgugguaucuaugggaggucaagaaacaacgagcgggcguucuuugggauguuccuucaccuccaccaguagagaaagcagaacucgaggauggagcauaucguauuaaacaacgagggauucuaggauauagccagauuggagcuggaguuuauaaagagggaaccuuucauacuauguggcaugucacaagaggggcaguacugaugcacagaggcaagagaauagagcccaguugggcagauguaaagaaagacuuggucucauauggagguggauggaaacucgaaggagaguggaaagaaggugaagagguacagguacuggcacuugaaccaggcaaaaauccacgagcugugcagacgaaacccgguauauuuaaaacaaauacggguacgauaggugccguuagucuagauuucuccccaggaaccucagggucgccgauaguagacagaaaggguaagguaguaggucuauaugguaacggaguugucacaagaaguggugccuacgucucggcuauagcacaaacagaaaaaucaaucgaagauaauccugaaauagaggaugauauuuucagaaagaaacgauuaacgaucauggauuuacauccgggggcagguaaaacaaaaagguaucuaccagcuauaguacgugaagcuauaaaaagaggacuacggacacuaaucuuagcaccaacccgagucgucgcagcagagauggaggaggccuuaagaggguuaccuauuagguaucaaacuccugccauacgagcagaacacacugggcgugaaauagucgacuugaugugccacgccacauuuacaaugcgucuccuaucacccguacgagugcccaacuauaaccuaaucauaauggacgaggcccacuucacagaccccgccuccaucgcugcaagagguuacauuucgacucgggucgaaaugggugaagcugcaggaauauuuaugacugccacaccaccgggcagucgggacccguucccgcaaucaaaugcuccaauaauggacgaggagagggaaauuccggagcguucuuggaauaguggacacgaguggguuacugauuucaaaggcaaaacaguaugguucguaccuaguauuaaagcagguaacgauauagccgcaugccucaggaagaaugggaagaaagucauacaacuaucacguaaaacuuucgauagcgaauaugucaaaacuaggucaaacgacugggauuuuguuguaacuacagauauaucggaaaugggagcgaauuuuaaagcagagagagugauagacccccguagguguaugaagccaguaauucuuacugauggagaggagcgaguaauccucgcagggccgaugccagugacacacaguagcgcugcccagagacgugguaggauagggcgaaaucccaaaaaugaaaaugaucaauauauauacaugggugagccauuagaaaaugaugaggacugcgcacauuggaaagaagcuaagaugcuucucgacaacauaaauacaccagaaggaaucauaccgucaauguuugaaccagaacgagagaaagucgacgcuauagauggagaguauagauuacggggagaagcgagaaaaaccuuuguugaucuuaugcgacgcggagauuuaccagucuggcuugccuacaaaguggcagcagaagguauuaauuacgccgaucgacgaugguguuuugacggaauuaaaaacaaucagauauuagaagaaaacguggaaguagaaauauggaccaaggaaggagaacgaaagaaguuaaagccucgauggcuagaugcaagaauauacagcgaucccuuagcgcuuaaagaguuuaaagaguuugcggccggucgaaaaucacuuacauugaauuuaauaacugaaaugggaagacucccaacuuuuaugacacaaaaagcaaggaaugcacuugacaauuuagccgucuugcacacugcggaggccggaggaaaggcguacaaccaugcacuaagcgaguuacccgaaacacuagagacccuacuguuguugacuuuauuagcuacgguaacaggcgguauuuuccuauucuugaugaguggaaagggaauagguaaaaugacuuuagguaugugcugcaucaucacugcaaguauacuucuaugguaugcacagauccaaccgcauuggauugcagcaucaaucauauuagaauuuuucuuaaucguauuguuaaucccugaaccagaaaaacaaagaacaccccaagacaaccaauugaccuaugugguuauagccauacuaacagucguugcagcuacaauggccaaugagaugggauuccucgagaaaacuaagaaagauuuaggauuaggaaguauaacuacccaagaaucagaaucgaauauccuggauauagaucuacggccagcuucggcauggacccucuaugcgguugcgacaacguucgucacgccaauguuaagacacucaaucgaaaacucuucgguaaauguaagucuaacugcaauagcuaaucaggcgacagugcuaaugggcuuaggaaaaggcuggccauuaaguaaaauggauauaggaguaccacuacuagcaauaggcugcuauucgcagguaaauccaaucacgcuaacagcggcgcuguuauugcucguggcacacuaugcaaucaucggaccaggguuacaagcuaaagccaccagagaggcccagaaacgugcagcugcgggaaucaugaaaaaccccacuguagaugguaucacgguuaucgaucuugaaccuauacccuaugacccuaaauuugaaaaacaguuaggacaaguaaugcuuuuaauauuaugugucacgcaaguuuuaaugaugagaacaacuugggcgcuuugcgaagcucuaacguuagcaacaggucccauuucuacguuaugggaagguaauccagggagauuuuggaauacuacgauagccguaucaauggcgaauauauuccgugggaguuaccuugcgggggcgggcuuacuuuuuagcaucaugaaaaacacaacuaacacccgucgagggacaggcaauaucggcgagacccuaggagaaaaauggaaaucacgacuaaacgcacuggggaaaagugaauuucaaauauauaagaaaucugggauacaagaaguagaucgaacacuagccaaagagggaauuaaacgaggagaaaccgaccaccaugcaguaucaaggggauccgcuaaacugaggugguucguugagcgaaauauggucacaccagaaggaaaaguuguagaccugggaugcggucgagguggcuggaguuauuauugcggaggucugaaaaauguaagagaagucaaaggucuaacacguggcgguccaggacacgaagaaccuauaccuauguccacauacgguuggaaucuagucagauuacaaaguggcguugacguauucuuuacucccccagaaaaaugugacacguuguuaugcgauauaggagaaagcagcccaaaccccacuauugaagcagggagaacccuaagaguauuaaauuuagucgagaauugguuaaauaauaacacucaauuuuguauaaaaguccuuaauccauauaugccaucaguuauagagaaaauggaaacguugcagaggaaauauggaggagcucuugugcggaauccccuuuccaggaauagcacucaugaaauguauuggguauccaacgcaaccgguaacaucguaucguccgucaacaugauuaguagaauguugaucaacagauuuacaaugaaacacaaaaaggccaccuacgagcccgauguagacuuaggaucuggcacaagaaacaucgguauagagucagagauaccaaaccuagauauuaucggcaagagaauugagaaaauaaagcaagagcaugaaacuucguggcauuacgaucaagaccaucccuauaaaacaugggcuuaccauggcaguuacgaaacuaagcaaacaggaucagccucuagcaugguaaauggaguggucagacucuugacuaaaccuugggacguugucccaaugguuacacaaauggcgaugacggauacaacaccuuuuggucaacaacgagucuucaaagagaaaguagauacucgaacucaggaaccuaaagaagggacgaagaaauugaugaaaauuacagcugaauggcuauggaaagaauuaggcaaaaagaaaacaccuagaauguguacuagagaagaguucacaagaaaaguaaggagcaacgcagcucuaggagcaauauucacagacgaaaacaaauggaagagugcgagagaggcugucgaggauggacgauuuugggaauuaguagacagagaacgaaacuugcaucuugaagguaaaugugagacauguguuuacaauaugauggguaaacgagagaagaaacuaggugaauuuggcaaagcgaaaggauccagggcaauuugguacauguggcucggagcccgauuucuagaguuugaagcccugggauuucuaaaugaagaccauugguucucaaggggaaauucucuuagcggcguugaaggagaaggucuacaucgguugggauauauauuaagggacguuucuaagaaagagggaggagcaauguacgccgaugauacagcgggaugggauacuagaauaacucucgaagaucuuaaaaaugaggaaaugguuacaaaucacaugaaaggugaacacaagaaauuggcugaagcaauuuucaaauugacauaccaaaacaaaguaguaagaguccaacgaccaacgccaagggguacagugauggauaucauaucuagaagggaucaaagagguagugggcagguugggacauaugguuuaaacacuuuuacuaacauggaagcucaacucauuagacaaauggaaggggaaggaauauucaaaucaauccaacauuuaacagugacggaagagauagcaguucaaaauuggcuagcaagagugggacgagagcgucugacgagaauggcaauuaguggagacgauugugucguaaaaccaauagaugauagguucgccaacgcauugaccgcccucaacgacauggguaaaguucgcaaagacauccaacagugggaaccgucacggggauggaacgauuggacacaagucccauucuguagucaccauuuucaugaauuggugaugaaagauggccgcgugcuggucguaccuugucgcaaucaagaugaauuaauugggcgcgcacgaaucagccaaggugccggauggagucucaaggagacggcuuguuuggguaaaucauaugcacagauguggacacuaauguauuuccauagaagagacuuacgacuugcugcaaaugcaaucuguagugcaguaccaucucacuggguaccuacgucuagaacgacuuggucuauacaugcaaaacaugaauggaugaccacugaagauauguuggccguauggaaucguguauggauacaagagaauccauggauggaagacaaaacaccagucgaaucaugggaggaagucccguaccuaggaaagcgagaagaucaaugguguggaagucuuauaggcuuaacuucacgggcaacuugggcaaagaauauacaaacugcuauaaaucaagugaggagcuuaauaggaaacgaagaauauacagacuacaugcccucaaugaaacgauuuagaagagaagaagaagaagccgguguauuaugguaa

SEQ ID NO: 22272 - RNA, 9876 nt, Artificial Sequence
  derived and/or modified CDS sequence (opt6) from DENV-2__FJ850082__SS-prME
accguaggaguuauuguuaugcuuauacccacugcuauggcuuuccaucucacuacaagaaacggagaaccacauaugaucguuggaagacaagaaaaaggaaaaaguuugcuauuuaaaacagagaauggagugaacaugugcacacuaauggcuauagacuuaggggaacuaugugaagacacaauuacauacaaaugucccuuguuaagacaaaacgagccggaagacauugauugcugguguaauagcaccucuaccuggguaacauacgguaccuguaccacaacaggagagcauaggcgagaaaaacgcagcguugcuuuaguuccccacguagggaugggacuugaaacuaggaccgaaacauggauguccucugaaggagcuuggaaacauguacagaggauugagacauggauacuucgacauccugguuuuacaaucauggcagcgauauuagcauauacgauagguacaacacacuuucagagagcauuaauuuuuauucuacucacagcaguagcuccuaguaugacaaugagaugcauaggaauaucaaacagagacuuuguugagggaguuagcggggguucuuggguagacaucguuuuagaacacgguucaugugucacaacaauggccaaaaauaaaccaacauuagauuucgaacuuauaaaaacagaagcaaaacaaccagcaacauugcguaaauauuguguugaagccaaacuaacgaacacaacaacagaaaguagaugcccuacucagggcgagccuucgcuaaaugaggaacaagauaaacguuuuauuugcaaacauucaaugguagauagaggguggggaaauggaugcggguuauuuggaaaaggagguauaguaacaugugcuauguuuacauguaagaaaaacauggagggaaaagucguucaaccugaaaacuuagaauacacuauugugauaaccccacacucaggcgaagaacacgcaguaggcaaugauacaggaaaacaugguaaagaaauaaaaauaacgccacaaaguucaauaacggaagcggaacuuacaggcuaugguacggucacuauggagugcucaccacguacugguuuagacuuuaacgaaaugguauuacuccagauggaagacaaagcauggcucguacauagacagugguuccuagauuuaccacuacccuggcucccaggagcugauacccaaggaucaaacuggauacaaaaagaaacgcuaguaacauuuaaaaacccacacgcuaagaaacaagacguggucguacucggaagucaagaaggagcaaugcacacagcucucacaggugcuacugaaauccaaaugaguucuggaaaccucuuauucacuggucauuugaaaugcagguugaggauggacaaacuacaauuaaaaggaauguccuacaguaugugcacugguaaauucaaaauuguaaaagaaauagcagagacacaacauggaaccauuguaauucgaguccaguaugaaggagacgguaguccguguaaaauaccguucgaaauaauggaccucgagaaaagacacgugcuggggcgacucauaacuguaaacccaauaguaacugaaaaagacucuccuguaaacauugaagcggaaccuccguuuggcgauucauauauuaucauaggagucgaaccaggucagcugaaacucaauugguucaagaaagggaguaguauuggacaaauguuugaaacaacaaugcggggagcuaaacgaauggcaauacuaggggauacggccugggauuucgguagucuuggcggaguuuuuacaucuauaggaaaggcuuuacaccaagucuucggagcaaucuacggagcagccuuuucaggugugucauggacgaugaaaauuuuaauuggcgucaucauuacuuggauuggaaugaauagccguucuacaucccugucuguaucuuuagugcugguagggguugugacguuguaccucggagcaaugguccaggcagauucagggugcguagucagcuggaaaaauaaagaacuuaaauguggcucggguauauucauuacggacaacguccacaccuggacggaacaguauaaguuccaaccugagaguccgaguaaacuagcauccgcuauacaaaaagcgcaugaggaggggauuuguggaauuagaucuguaacucgucuggagaauuuaauguggaaacagaucacgccggagcucaaucauauacugagcgaaaacgaaguaaaauuaacaauuaugacaggugauauaaaaggaauuaugcaagcugguaaaagaucauuaagaccacaaccuacagaauuaaaauauucauggaaaacguggggcaaagcaaagauguuaucaacggaaagccauaaucaaacauuccugauagauggcccugaaaccgcagaaugcccgaacacaaauagagcauggaacucacuugagguugaagauuauggauuugggguuuuuacaacuaauaucugguugaaauuaagagaaaagcaagauguauuuugugauuccaaacuaaugagugcggcgguaaaagauaauagagcgguacaugcugauaugggauauuggauagaaucggccuugaaugauacuuggaagauggaaaaggccucauuuauagaaguuaagaguugucacuggccaaagucacauacccuauggucuaacggaguauuagaaagcgaaaugauaauaccuaaaaacuucgcugggccugugucacaacacaacuaccgaccagguuaccacacucagacagcagggccuuggcaucuagggaagcuggaaauggacuuugauuucugcgaggguacuacaguuguuguuacugaagauuguggaaauagagggccuagucugcgaacaacaacugcaagcggaaaauugauaacagaaugguguugucguagcugcacauugccaccucuaagauauagaggcgaggauggguguugguaugggauggaaauaaggccguuaaaagagaaagaggaaaaucucgucaauagucugguuaccgcggggcauggucaaauugacaauuuuagccuaggaguacugggaauggcauuguuucuagaagagauguuaagaacuagaguaggaaccaagcaugcuauucuauuaguugcgguuucguuuguaacguuaaucacugguaauaugucauuucgcgauuuaggccgcguaaugguaaugguuggggcuacaaugacagacgauauagggaugggugugacuuaccucgcguuauuagccgcauuuaaagugagaccaacguuugcugcuggguuacuucucagaaaauuaacaucaaaagaacuaaugauggcaacuauuggugucgcucuacucucccaaaguaccauaccagagacaauccuugaacuaacagaugcccuugcacuagggaugauggcauuaaaaauagucaaaaauauggaaaaauaccaacuugcgguaaccauaauggccauuaguuguguaccaaaugcaguaauauuacaaaacgcauggaagguuucuugcacaauacuagcagcaguaucaguuucaccguuguuauugacaaguucccaacaaaaagcagacuggaucccacuggcuuugacaaucaaaggccugaauccgacggcaauauuuuuaacaacacucucaagaacuuccaagaaaagaagcuggccguugaacgaagcuauaauggcggucgguaugguaucgauuuuggcuucaaguuuacucaagaacgauaucccaaugacagguccauuaguugcaggggguuuauuaaccguuuguuauguuuuaacgggacgaucagcugaucuggaacuagagagagccgcagacgucaaaugggaagaccaagccgaaaucagugguucuaguccuauacugucgauaaccaucucggaagacgguucuaugagcaucaaaaacgaggaggaagaacaaacauugacaauauugauacgaacaggacuauuagucauaucagguguguucccaguaucgauaccgauaacugcagcugcuugguaucugugggaggucaagaaacaacgugcuggaguacucugggauguaccgagcccaccgccagucggcaaagcggaauuagaggaaggugcauaucgaauuaagcagcgcggcauacugggguauagucaaaucggugcaggaguuuauaaggaaggaaccuuccauacuauguggcacguaacccgaggcgcaguccuuaugcacagagguaaaagaauugaaccaucaugggcagacguuaagaaagaucuaguaucuuacggugguggguggaaguuagaaggagaguggaaagaaggagaagaagugcaaguacuagcucuugagccaggcaaaaauccucgugccguacaaacuaaaccaggaauauuuaaaacaaauaccggaacgauaggcgcagucagccuugacuuuucaccagguacgucagguucgcccauaguugaucguaaagggaaagucgugggacuauaugguaauggaguuguaacaagaucuggugcauacguaagugcgauagcgcagacggacaaaucaauagaagauaacccugaaauagaagaugacauauuccguaagaaacgucuuaccauaauggaucugcacccgggcgcaggaaaaacuaaacgguaccuuccagccaucguuagagaagcaaucaaacgaggguuaagaacuuuaauacuagcuccgaccaggguuguagcagccgaaauggaagaggcuuuacgagggcuaccuauuagauaucaaacaccggcuauaagggcagaacauacagguagagaaaucguugauuugaugugccacgcaacguucacgaugagauugcuuaguccaguaagagucccuaauuauaaucuaauuauaauggaugaggcacacuucacagauccggccaguauagcggcccgcggguacaucucaaccagaguugaaaugggagaggcugcugguauuuucaugacugcuaccccaccaggcucaagagacccauucccacaauccaacgcaccgaucauggaugaagaacgcgagauaccagagcguucuuggaacucaggacacgaauggguaaccgauuucaaagggaaaacagugugguuuguaccuuccauaaaagcgggcaacgacauagcagcauguuuaaggaaaaacgggaagaaaguaauucaacuaagcagaaaaacguuugauagcgaguauguuaaaacucgggcaaaugauugggacuuuguaguaaccacugacaucucugaaaugggagcaaauuucaaagcagaacgcgugaucgauccaagacgauguaugaaaccgguaaucuuaaccgauggugaagaacgaguuauuuuagcaggacccaugccgguuacucauaguagugcagcacaaagacgaggaaggauuggacgcaauccgaaaaaugaaaaugaccaauauauuuauaugggugaaccauuagaaaaugaugaggacugcgcacauuggaaagaagcaaagaugcuauuggauaauaucaauaccccagaaggaauaauaccuagcauguuugagccugagcgagaaaaaguagacgcuauugauggcgaguaccgauuacguggugaggcacgcaaaacauuuguagauuuaaugagacgcggagauuuaccgguauggcuggcuuauaaaguagcagcagaggguauuaacuacgcggauagaagaugguguuuugauggcauuaagaauaaucagauauuagaagaaaauguggaggucgaaaucuggacaaaggaaggggaacguaagaaacuuaaaccaagaugguuagacgcccgaauuuauuccgacccauuagcucuuaaagaguucaaagaauuugcugcuggcaggaaaucguuaacccugaaucuaauuacugaaauggguagacugcccacuuuuaugacgcaaaaagcaaggaacgcacuugauaauuuagccguauugcauaccgcagaagcuggcgguaaggcuuauaaucaugcacuaagugaacuaccggaaacauuagaaacacuuuuauuacuaacauuauuagccacaguaacagguggcauuuuccucuuuuuaaugaguggaaaaggaauugggaaaaugacacuaggcaugugcuguauaaucaccgcgucaauacuacuuugguaugcccaaauacaaccacauuggauagcagcaaguauaauacuggaguucuuucuaauuguuuugcuaaucccagaaccugaaaaacaacguacaccgcaggacaaccaguuaacuuacgucgugauugccauauuaacagucguggccgcuaccauggcaaacgaaaugggauuucuugaaaagacaaagaaggaccuagguuuagggagcauaaccacacaagaaucggaaucgaacauacuugacauugaucugagaccagcuucggccuggacucucuacgcaguugcuacuacauucguuaccccaauguuaagacauucuauagaaaauucgagcguaaauguaucauuaaccgcuauugcuaaccaagccacggugcuaauggguuuaggaaaaggauggccucuuucaaaaauggauauaggagucccauuacuagcaauuggaugcuacucacaaguaaacccgauaacauuaaccgcugcauuauuauuauuaguugcacauuacgcaaucauugggccgggguuacaagcgaaggcuacaagagaggcacagaaaagggcggcugcagguaucaugaaaaacccaacgguggacggaauuacgguuauugacuuagaaccaauccccuacgauccaaaauucgagaaacaauuagggcaagucaugcuacuuaucuuaugcguuacacaaguccuaaugaugaggaccacuugggccuuaugcgaagcacucaccuuagccaccggacccauuucuacguuaugggaaggaaacccgggacgcuucuggaauacaacaauagcuguuagcauggccaauauauuucgagguagcuauuuggcgggugcaggcuuauuguucaguauuaugaaaaacacgacaaauacgcgaagagguacaggcaauaucggugaaacacuaggagaaaaauggaaaucuaggcuaaacgccuuaggcaaaucugaauuucaaauuuauaagaaaucaggcauucaagagguugaucgcacacuggcaaaggaaggcaucaaacgaggugaaacagaucaccaugcuguuaguagaggcuccgcaaagcuacguugguuuguggaaagaaauauggucacacccgaagguaaaguugucgaucuaggcugcgggagaggcggcugguccuacuauuguggaggauugaaaaacguucgugaaguaaaagguuuaaccaaagguggucccggacacgaagaaccaauuccaaugaguacuuacggauggaauuuaguaagacuccaaagcggaguugauguguuuuucaccccgccggagaaaugcgauacccuuuuaugcgauauaggggaaucgucgccuaauccaacaaucgaagcaggaagaacuuuacguguacugaaccuuguagaaaacugguuaaauaacaauacucaauuuuguauuaaagugcuaaauccuuacaugccuucaguaaucgaaaagauggagacgcuccaaagaaaguacgguggugcucuaguccgaaauccucugucgagaaauagcacacacgaaauguacuggguuucuaacgcgacgggcaauauaguaucaagugucaauaugauuaguagaauguugaucaaccguuucacaaugaagcauaagaaggcgacauaugagccagauguugacuugggauccggaaccaggaauauugguaucgagagcgaaguacccaaccucgauauaauaggaaaaaggauagagaaaauaaaacaagaacaugagacaucauggcacuaugaucaagaucauccuuauaagacaugggcauaucacgguaguuaugaaacaaagcaaacaggaucagccagcaguauggugaacgggguaguaaggcuguuaacuaaaccgugggacguaguccccauggucacucaaauggcuaugacagauacaacuccuuuuggacaacaacgaguguucaaagagaaaguggauacuagaacgcaagaaccaaaagagggaaccaagaaauuaaugaaaauuacugcugaaugguuauggaaagaguuagguaagaagaaaauuccgcgcaugugcaccagagaagaauuuacacggaaggugagaaguaacgccgcccugggcgcaauuuuuacagacgaaaauaaauggaaaagcgccagggaagccguagaagaugguagauuuugggaacucguagaccgugaaagaaauuugcaccucgaaggaaaaugugaaacuugcguuuacaacaugaugggaaagcgagaaaagaaauugggggaauuugguaaggcaaaagguaguagagcuauaugguauauguggcuuggcgcgagguuuuuagaauuugaagcacucggcuuccucaacgaggaucauugguucagucgugguaacucacuaagugguguugaaggugaaggacuccacagauugggauacauauuaagagaugugucuaagaaagaggguggggcuauguaugcugacgauacagccggaugggauacccgaaucacucuggaagacuuaaagaaugaggagaugaucacuaaucauaugaagggagaacauaagaaacuagcagaagcgaucuucaaacuuaccuaucaaaauaaaguuguaagaguucaacgcccuacaccuagaggcaccguuauggauaucaucagucgcagagaccagagaggaucaggucaagucggaacauacgguuugaacacuuuuacaaauauggaggcgcaauugauaaggcaaauggaaggagaaggaauauucaaaucuauacaacauuuaacgguaaccgaggaaaucgcaguacagaauuggcuagcaagagucggaagagaacgcuuaacacggauggcaaucagcggggaugauugcgucguaaaaccuauagaugauagauuugcgaaugcucucaccgcacuaaaugauauggguaaaguucggaaggauauucaacaaugggagccaaguagaggguggaacgauuggacccagguuccuuucugcagccaucauuuucaugaauugguuaugaaagauggaagaguguuagucguaccuugucggaaccaagacgaguuaauugggagggcucguauaucacaaggagccgguuggaguuuaaaagaaacggcaugccuugguaaaagcuaugcccaaauguggacauuaauguacuuucauaggagggaccuacgacuagcagcgaaugccauuugcucugcuguuccgucacauugggugcccacuucaaggaccacaugguccauacaugcaaaacacgaguggaugaccaccgaagauaugcuagcaguauggaaucgcguauggauccaagaaaauccuuggauggaagauaaaacaccgguagaauccugggaagaaguaccuuaucuagggaaacgugaagaucaauggugcggaagucuuauaggcuuaacuucacgcgcuaccugggccaaaaacauucaaacugcaauaaaucagguuaggagcuuaauaggaaaugagggauauacggauuauaugcccagcaugaaaagauuucgacgagaggaagaggaagcagggguuuugugguga

SEQ ID NO: 22273 - RNA, 9876 nt, Artificial Sequence
  derived and/or modified CDS sequence (opt6) from DENV-2__FJ850085__SS-prME
acaguaggugugauagucaugcuuaucccaacugcuauggcguuucaccugacaacgaggaauggggaaccacacaugaucgugggccgacaagagaaaggaaaaucauuauuguuuaaaacggaaaaugguguaaauauguguacacuaauggcaauugacuugggggaguugugugaggauacaaucacuuauaaaugcccucuacuaaggcaaaaugaaccggaagacauagauuguuggugcaacucaacuuccacuuggguaacauacgguacuuguacgacgacaggugaacaucgaagggagaaaaggucgguagcucuagucccgcacguaggcaugggccuagaaaccaggacagagacguggaugaguucagaaggagcauggaaacacgugcagagaauagaaacuuggauacuuagacauccaggauuuacaauaauggcggcgauacuagcuuauaccauuggaacuacccauuuucagcgcgcauugaucuucauucuacuaacagcuguagcaccuagcaugaccaugcggugcaucggcauuagcaauagagacuucguagaaggaguaagcgguggaucuuggguugacaucgugcucgaacauggaaguugcguaacaacuauggccaaaaauaaaccuacucuugacuuugaacuaauaaaaacugaagcgaaacaaccugcgaccuuacguaaauacuguguugaagcaaaauuaacuaacacaacaacugaaaguagauguccuacccaaggagaaccuagcuugaaugaagaacaagauaaaagauuuauaugcaaacacucuaugguugaucguggaugggguaaugguuguggauuauuuggaaaaggagguauaguaacuugcgcaauguucacaugcaagaaaaacauggaagguaaaguuguccaaccggaaaacuuagaguauacaauuguaauuaccccacacucaggugaagaacaugcuguuggaaacgacacagguaaacaugggaaagaaaucaaaauaacaccccaaucaaguauaacagaagcugaauuaacgggguaugguacgguaacaauggaaugcagcccgcgaacgggcuuagacuuuaacgaaaugguauuauuacaaauggaggacaaagcauggcuuguccacaggcaaugguuccuagaucuaccacugccguggcugccaggggcggauacacagggcaguaacuggauucaaaaagaaacuuuaguaacauucaaaaacccucacgcaaagaaacaggauguugucguucuugguucacaagaaggugcuaugcauacagcacuuacgggagccacagaaauucagaugucuaguggaaacuugcuauucacuggccaucuuaaaugcagacuucguauggacaaacuucaacuaaaaggcaugaguuauucgaugugcacaggaaaauucaaaauaguaaaagaaauugcagaaacgcaacacgguacaauaguaauacgugugcaauaugagggagauggcagcccauguaaaauuccuuuugaaaucauggauuuagaaaaacggcauguauuaggaagacuaauaacuguaaauccuauuguagcggaaaaagauagcccagugaacaucgaagcggaaccuccauucggcgacagcuauauuauuauuggagucgaaccugggcaacuaaaauugaauugguucaagaaagggagcucaauuggucaaauguuugagacaacaaugcguggggccaaaagaauggcgauucuuggggauacagcuugggauuuugguucauugggcgguguauucacaaguauuggcaaagcauugcaucaaguauucggugcuauauacggagccgcauuuaguggaguuagcuggacgaugaaaauccucauaggaguaaucauaacuuggaucggaaugaacucccgguccaccucccuuucuguaucauuaguauuaguuggagucgugacacucuauuuaggagcaaugguccaagcagauucaggauguguagugagcuggaagaacaaagaacugaaaugugggagugggauuuucauaacagauaacgugcacacguggacugaacaauauaaauuucagccagaaucuccauccaaacuagcaucggcgauacagaaagcucaugaagagggaauaugugguauucgaucagugacaagauuagaaaacuuaauguggaaacaaauuacuccagaauuaaaucacauucuaagcgaaaaugagguaaaguuaacaauaaugacgggagacauaaaaggcauaaugcaggcuggaaaacgaagucugcgaccccagcccacagaacuaaaguacucauggaaaacuugggguaaagcuaagaugcuaucgacugaaagucauaaucagacauuucuaauugauggaccagaaaccgccgaaugucccaauaccaauagggcguggaacagccuugaaguugaagauuauggauuuggaguguuuacaacgaauauauggcuaaaguuaagagaaaaacaagacguauuuugugacaguaaauuaaugucagccgcaguaaaagacaaccgagcugugcaugcagauaugggauauuggauugaaucagcauuaaaugauacauggaaaauggaaaaggcuaguuuuauagaaguaaagaguugucauuggcccaaaagccacacauuaugguccaaugguguguuagagagugaaaugauaauucccaaaaauuucgcaggaccuguaagccaacauaacuaucgaccaggauaucacacccaaaccgcuggcccuuggcaccuggguaaauuagagauggacuucgacuucugugaaggaacaacuguagucguuaccgaggauuguggaaaucgagguccgucuuuaagaacaacaacugccucuggaaaauuaauaaccgagugguguugccgaucguguacuuuaccuccacuacgauaccguggggaagacggguguugguacgguauggagauuaggcccuuaaaggaaaaagaagagaacuuagucaauuccuuaguaacugccggacauggacaaauugauaauuuuucauuagguguauugggcauggccuuauuucucgaagaaaugcugagaacacgcguaggaaccaaacaugccauucuauuaguugccguuucauuugugaccuuaauaacuggcaauaugucuuuuagagaucucggcagaguuauggugauggugggcgcuacaaugacugaugacauugguaugggugugacauaucuagcuuuacucgccgcauuuaaaguacggccgaccuuugcugccgguuuguuauuacgaaaacuaacaagcaaagaacuaaugauggcuacaauugguguagcuuuguugucucaaagcacaauuccagaaacgauucucgaacuuacagaugcacuggcuuuaggcaugauggcauuaaaaauugugaaaaacauggaaaaguaucaacuugcaguuacgauaauggcgauauccugugucccuaaugccguaauacuucaaaaugcuuggaagguauccuguaccauuuuagcagcugugucuguaaguccuuuacuacuaacuucuucccagcagaaagcagauuggauuccacuugcgcugacaauuaaaggauugaacccgacagcuauuuuucuaacuacucuuucucgaacuuccaagaaaagaagcuggccucuuaaugaagccauuauggcuguaggcauggucaguaucuuggcgaguaguuuacucaaaaacgacauaccaaugacgggaccauuaguggcaggaggguugcuaacuguguguuacguacugacagggcgcucggcugacuuagaguuagaacgugcugcagacgugaaaugggaagaucaggcugaaauuucaggauccucaccaauccucaguauaacuauuucggaagaugggucuaugucaaucaaaaacgaagaagaggaacaaaccuuaacaauucuuauaagaacaggacuccuagugauaagcgggguguuuccugugucaauacccauaacagcugcggcaugguaucuuugggaaguaaagaaacagagggcaggaguacucugggacgugccuagucccccaccaguaggaaaagcugaauuagaagaaggggcuuaccguauaaaacaacgugguauacucggauauucccaaauaggagcgggaguauauaaggagggaacguuucacaccauguggcaugugacccgcggugcaguccugaugcaccgagguaagaggaucgaaccaucuugggcugacgugaagaaagaucuagugaguuacgguggaggguggaaacuugaaggggaauggaaagaaggcgaagaaguacaagucuuagcacucgaacccgguaaaaacccuagagcagugcaaaccaaaccugguaucuuuaaaacgaacacaggaacgauaggagcgguuucguuggacuuuucuccuggaacuucaggaucgccgauaguagaccgaaaagggaaagugguaggccuauauggaaacggagucgucacacgaucaggggcauauguuucagcaauagcacaaacagauaaaucuauagaggacaauccagaaauugaagaugacauuuuucgcaagaaacguuugacuauuauggacuugcauccaggagcgggaaagacuaaaagauacuuaccggcuauagugagagaagcaauaaagaggggauugcguacguugauacuagcuccgacgcguguuguagcggcugaaauggaagaagcacuacguggacugccaauucguuaucaaacgccagcaauuagagcggaacauacuggucgagagauuguagacuuaaugugccaugcaacguuuacgaugaggcugcucucaccgguaagaguaccuaauuauaauuuaauaaucauggacgaagcacacuucacggauccagcuucgaucgcggcccgaggauauauaucaacgagaguagagaugggagaggcagcagggauuuucaugacagcaacgcccccaggaucgcgcgauccguuuccucaguccaaugcaccuauaauggacgaagaacgggagauuccugaaagaucuuggaauaguggccaugaauggguaacagauuucaaaggaaaaacgguuugguuuguaccaagcauaaaagcagguaaugauauagcagcaugucuuagaaagaaugguaagaaaguaauucagcuaucucgaaagacguuugauucagaauaugucaaaacgcgcgccaacgauugggauuucgugguuacaacagacauuagcgagaugggcgcgaauuuuaaagcagaaagaguuauagaucccagaagguguaugaaaccagugauauugacugacggagaagaaagaguaauccuagcaggaccaaugccuguaacacacagcucagcagcucagagaaggggacgaauuggucguaaucccaaaaacgagaaugaucaguacauuuauaugggggaaccuuuagaaaaugacgaagacugcgcgcauuggaaagaagcuaaaaugcuacuugacaauauuaauaccccugaagguauaauucccagcauguucgaacccgaaagggaaaagguggaugcgauagacggagaauacagacugagaggcgaagcaaggaaaacuuucguugauuugaugcggcgaggagaccucccaguauggcuggccuauaaaguugcagcugaaggcauaaauuacgcugacaggagauggugcuuugauggaauuaaaaauaaccaaauauuggaagaaaauguagaaguggaaauauggacaaaagaaggugaaagaaagaaauuaaaaccacgauggcuugaugcuagaauuuauagcgacccuuuagcacuaaaagaauuuaaagaauuugcugcgggucguaaguccuuaacauuaaauuugauuacugagaugggaagacuaccgacauuuaugacucaaaaagcgaggaaugcacuugauaacuuagcagugcugcauacugcagaagcuggagguaaggcauauaaucaugcacuuuccgaacucccugagacucuggaaacccuauuacucuuaacucuccuggccacaguuaccggagguauuuuccucuucuuaaugucgggaaaaggaauugggaaaaugacacucggaauguguuguauaauuacagcuaguauacuucugugguaugcacaaauucaaccacacuggaucgcggcaucuaucauacuggaguucuuucuuauaguccuauugauaccugaacccgagaagcaaagaacuccacaggauaaucaguuaacguacgugguaaucgcuauuuugaccgugguagcggcuacaauggcgaacgaaaugggguucuuggagaaaaccaagaaagaucucggacugggcagcaucacuacacaagagagcgaaucaaauauuuuggauauagaccuccgccccgccucagcuuggacuuuauacgccguagcaacaacauucguaaccccuauguugaggcauagcauugaaaacaguucaguuaaugucucauuaacagcgaucgcuaaccaagcaacuguacuaaugggccugggaaaaggauggccguuauccaaaauggacaucgggguaccacuuuuagcuauaggaugcuacagccaaguuaacccaaucacccuuacggcugcuuuauuacucuuggucgcgcacuaugcaauaauaggaccggggcuacaagcuaaagcuacaagggaggcccagaagcgugcugcagcugguauuaugaaaaauccuacaguugacggcauaacaguaauagaccuggaaccuauaccguaugauccuaaguucgaaaaacaauuggggcaagucaugcuacuuauauugugcgugacccaaguuuuaaugaugcgcacuacgugggcauuaugcgaagcacuaacauuagcaacuggaccuauaucuacgcugugggaagggaacccaggucgguuuuggaauaccacuauagcugugaguauggcaaauauuuuuagagguuccuaucucgccggggcaggacuauuauucucuaucaugaaaaacacgacgaacacgagacgagguacaggaaauauaggagagaccuuaggagaaaaguggaaaucgagauuaaaugcacuuggaaaaucagaguuucaaauuuauaagaaaucagguauacaagaaguugaucguacauuggcaaaagaggggauaaaaagaggugaaacagaucaucacgcgguaucgcgaggaagcgcgaaacuaagaugguucguugaacguaacaugguuacgcccgaagggaagguuguggaucuuggaugcgguagagguggcuggaguuauuauuguggaggccucaaaaacguuagagaggucaaaggauuaacaaaaggaggaccaggucaugaagaaccaauuccuaugagcacguaugguuggaaucucguaaggcuacaaaguggcguagacgucuucuuuacaccaccagaaaaaugcgacacauuguuaugcgauauaggagaaucgucaccaaacccuacgaucgaggcagggaggacucuuagaguacuaaaccuaguagaaaacugguuaaauaacaacacucaauucuguauuaaagucuuaaacccuuauaugccgagugucauagagaaaauggaaacuuuacagagaaaauacgguggagcucugguuagaaauccacuaucuagaaauucaacucacgaaauguauuggguaucgaaugcaacgggaaauauugugaguaguguaaauaugauaucacgcauguuaauuaaucguuuuacuaugaaacauaagaaagcuacguaugagcccgacguggaucuaggaagcgggacaaggaauaucggcaucgaaagugaaguuccaaauuuagauauuauaggcaaacgaauagagaaaauaaaacaggaacaugaaacgaguuggcacuaugaucaagaucauccauauaaaacaugggcauaccacgggagcuaugagacaaaacaaacuggcucagccucgaguaugguuaauggaguggugagacuccucacaaaaccuugggauguuguaccaaugguuacucaaauggcuaugacggacacuacaccuuuuggccagcaaagaguguucaaggaaaaaguugacacacggacacaagaaccaaaagaagggacaaagaaauuaaugaaaauuacagcugagugguuauggaaggagcucgggaagaagaaaauaccuaggauguguaccagagaagaauuuacacgaaaaguacggucaaacgcagcacuaggagcuauuuuuaccgacgaaaacaaguggaagucugccagagaagcaguagaagacgguagguuuugggaauuaguugaccgugagaggaacuuacauuuggaagggaaaugcgaaacuuguguauacaauaugauggggaagcgagaaaagaaauuaggugaauuuggaaaagcuaaagggucaagagcgauaugguauaugugguuaggcgcuagguuccuagaguucgaggcauuagguuuucuuaacgaagaccauugguucagccgcgggaacaguuuaagugggguagagggcgagggguuacaucggcuaggguacauucuuagagacguaagcaagaaagaaggaggugcaauguacgccgacgacaccgcagggugggauacccguauaacuuuggaggauuuaaagaacgaagaaaugauuacuaaccacaugaaaggcgaacauaaaaagcuagcggaggcaaucuuuaaacuaacguaucaaaauaaaguuguuagaguccaacgucccacaccgcggggaacugugauggauaucauaagucgaagggaccaacggggcaguggacaaguuggaacauauggucuuaacacauuuaccaacauggaagcacaacugauaagacagauggaaggagaaggaauauuuaaaaguauacaacacuuaacuguaaccgaggaaauugcgguacagaacuggcuggcgagaguaggaagagaaagacuuacaaggauggcaauuuccggugaugacugcgugguaaagccgaucgaugauagauucgcuaaugcauugaccgcucuaaaugauauggggaaaguucggaaagacauacaacagugggaaccaucucguggauggaaugacuggacgcaaguuccguuuugcagccaucauuuucacgaacugguuaugaaagacggcagggugcucguuguuccgugccgaaaccaagaugaacugauaggacgugccagaauaucucaaggcgcagguuggucacuaaaagagaccgcgugucuagggaaaucuuaugcccagauguggacucugauguacuuccauaggagagacuuacggcuggcagcaaacgcaauaugcuccgccgugccgagucauugggucccuaccagucgaacaacgugguccauccacgcuaaacacgaauggaugacgacagaggauaugcuugcuguauggaaccgggucuggauucaggaaaauccguggauggaagacaaaacaccaguggaaucaugggaagaagugccauaucucgggaaaagagaagaucaaugguguggcucgcuuauaggucuuacuagcagagcaacgugggcaaagaacauccaaaccgcaauaaaccaaguaagaucacucauaggcaaugaaggcuacacggauuacaugccaucaaugaaaagauuuagaagagaagaggaagaggcuggcguacucugguga

SEQ ID NO: 22274 - RNA, 9876 nt, Artificial Sequence
  derived and/or modified CDS sequence (opt6) from DENV-2__FJ850088__SS-prME
accgcaggaguaauaguaauguuaauaccaacugucauggcuuuccaucuaacaacaaggaacggagaaccacacaugauaguagggagacaggaaaaaggaaaaaguuuauuauuuaaaacugaagaugguguuaacaugugcacauuaauggcaauugauuuaggggaauuaugcgaagauacaauaacuuacaaauguccucuauuacgacaaaacgaaccagaagauauugauuguugguguaauuccacaagcaccuggguaacauaugguaccuguacaacuaccggagaacauagaagagagaaacgguccguagcgcugguuccccacguagguauggggcuggaaacgaggacagaaacauggaugagcagcgaaggcgcguggaaacauguacaaaggauugaaacauggauucugcgacacccaggauuuacaaugauggcugcaauauuagcuuauaccauuggcacaacucacuuccagagggcgcuuauuuucauuuuauugacggcuguagcaccaucgaugacaaugaggugcauuggaaucucaaauagggacuuuguggaagguguuagcggaggaaguuggguagacaucguucuugaacaugguaguugugugacaacaauggccaaaaauaaacccacacuggauuuugaauuaaucaaaaccgaagcuaaacaaccagcuacauuacggaaauacugcguagaagcaaaacuuacaaacacaaccacagaaucgagguguccaacacaaggagaaccaaguuuaaaugaagaacaagauaaaagauucauaugcaaacauaguaugguagauagaggaugggggaacggaugcgggcucuuuggaaaaggugguauaguaacuugcgcuauguuuacgugcaagaaaaauauggagggaaaagucguacaacccgaaaacuuggaauauacaauaguaaucacuccacacucaggugaagaacacgcagucgggaacgauaccgguaaacauggaaaagaagugaagauuacuccucaaucaucuauaacugaagcugaauuaacuggauauggcacaguaaccauggaauguaguccacgaacuggccuugacuuuaaugaaaugguacuuuugcaaauggaagauaaggcuuggcuggugcauagacagugguuucucgacuugccuuugcccugguuaccaggggcugauacucaagggucaaauuggauccaaaaagaaacucugguuacauucaaaaauccacaugcuaagaaacaggaugugguagugcuugguagucaggagggagccaugcacacagcguuaacaggagcaacagaaauucagaugucuagcggcaaccuacuuuuuacuggccauuugaaauguagacugagaauggauaaacuucagcugaaagguaugucuuauucaaugugcacugguaaauucaagauaguaaaagaaaucgcagaaacucaacauggaacaauaguaauaagaguucaauacgagggagacggcucuccuuguaaaauaccuuuugagauuauggacuuggagaaacgccauguacucggaagauuaauuacaguaaauccgaucguuacggaaaaagauucgccaguaaauauagaggcugagccuccuuucggggacuccuacauuaucguaggagucgagccgggacaguuaaaacucaauugguucaagaaaggaucgagcauuggacaaauguuugagaccacuaugagaggcgcgaaacgaauggcaauacuaggagauacugcaugggauuuugguucccuaggggguguauuuacaaguauagguaaagcacuacaccaagucuucggugcuaucuauggagcagccuucaacggugucucuuggacgaugaaaauucuaauuggcgucauuauuacauggauaggaaugaacucacguagcacuucguuaaguguuucauuaguccuuguaggcguaguaacucuguauuuaggugcaaugguacaagccgauucaggguguguaguuucguggaaaaauaaagaauugaaaugcgggucagggauuuuuauaacggacaauguucacacguggacagagcaauacaaauuccaaccugaaagcccaucuaaacucgccagugccauacaaaaagcucacgaggaagggauuugugggauaaggucuguuacuagauuagaaaaucuuauguggaaacaaauaacgccugaauuaaaucauauuuuaagcgaaaaugaaguaaaauuaacaaucaugacuggggacauuaaaggcaucaugcaagcaggaaaacgaucuuugagaccacaaccaaccgaguuaaaauauucguggaaaacuugggguaaggcgaagaugcuaccaacagagucacacaaucagacuuuccuuauugacggcccugaaacagcggaauguccuaacgcaaacagagcuuggaacucacuagaaguagaggacuauggauuugggguauuuacaacaaacaucugguuaaaacuucgagaaaagcaagauguauucugcgauaguaaauuaaugucagcugccauuaaggacaaucgagcgguccaugcggacauggguuacuggauagaaucugcgcuaaaugauacguggaaaauggaaaaggcaucauuuauagaagugaaaucaugucauuggccaaaaucccauacacuuuggaguaauggcgugcuggaaucagagaugauuauacccaaaaacuuugcuggaccagucagucaacacaacuaccgcccaggauaccauacgcaaacggcugggccguggcacuugggaaaauuagagauggauuuugacuuuugugaagggaccacuguuguaguuacggaggacugcggaaaccgcggucccagcuuacgaacuacgacagcuagugguaaauuaauaacggaauggugcuguagaucuugcacacuucccccacugcguuaccggggugaggacggauguugguauggaauggaaauaaggccgcuuaaagaaaaagaagaaaaccucguuaacagucuaguuacagcgggacauggacaaaucgacaacuuuagcuuaggcguauuaggcauggcuuuauuccucgaagaaaugcuaagaacuagaguaggcacaaagcacgccauucuauuaguugcagugagcuuggucacucuaauaacugguaauaugucauuuagagauuuaggacgagucaugguuauggucggcgcaacaaugacugaugacauaggcaugggcguuacauaccucgcuuuacuagcagccuucaaaguacgacccacuuucgcagcuggacuuuuauuaaggaaguugacuagcaaggaauugaugauggcaacaauaggaguagcacuucuuucccaaaguacaauccccgagacgauauuagaacuaacugacgcguuagcguuaggcaugauggcccugaaagucguuaaaaauauggaaaaauaucaauuagcugugacaauaauggcaauaucuugugucccuaaugcugugauccuccaaaacgccuggaaagucaguuguacaauacuagcggcaguaucuguaaguccacuauuacucacuucaagccaacagaaggccgauuggaucccguuagcguuaaccauuaagggcuuaaacccgacagccauauuucuaacaacucucaguagaacaucgaagaaacggucguggccccuaaacgaagccgucauggcaguaggaaugguuagcauuuuggcgaguucuuuacugaaaaacgauauaccgaugacgggaccgcucgucgccggaggucuuuuaacaguaugcuacguucuuacuggaagaagugcggacuuagaauuggaaagagcagcagauguuaaaugggaagaccaagcagagauuucuggcucauccccgauauuaucgaucacaaucucagaagauggaaguaugucaauuaaaaaugaggaagaggaacagaccuuaaccauauugauacgcacaggacuacucguuauuucuggaguauuccccguaagcauaccaauuacagcagcugcaugguaucuaugggaagucaagaagcaaagagcgggcgucuugugggauguuccuucuccaccaccugucgaaaaagcugaguuagaagauggcgcauaccggauuaaacaaagagguauauuagguuacucacaaauaggagcagggguuuauaaggaaggcacuuuucacacgauguggcaugucacacguggcgcgguucucaugcacagaggaaaaagaauugaaccuaguugggcugacguuaagaaagaucuugugaguuauggugggggauggaaauuggagggugaguggaaggagggcgaagaggugcagguuuuggccuuagaaccgggcaaaaauccuagggcuguacagacaaaaccuggcauuuuuaaaaccaacacggguacaauaggagcagugaguuuggacuucagcccuggaacaucugggaguccaauuguggauaggaaaggcaaaguuguggggcuuuacggaaacgguguuguaacaagaucuggggcuuauguuagcgcaauagcccaaaccgaaaaaucaauagaagauaauccagagaucgaggacgauauuuuuaggaagaagagauuaacgauaauggauuugcauccaggggcaggcaaaaccaaacgcuaucuaccugcuauaguaagagaagcgauaaaacgaggauuaagaaccuugauucuagcaccuacgcguguaguagcugcugaaauggaagaagcgcuaagggguuugccaaucagauaucagacgccagcaauccgagcagaacacacgggacgagagauaguagaccuaaugugucaugcgacauucacaaugagacuucuuucuccaguuagaguaccaaacuauaacuugaucauuauggacgaagcucacuucacagauccggcuucuauagcagcucgcggauauauauccacacgcguagagaugggggaggcugcaggcauuuucaugacugcuacuccaccaggaaguagagaccccuuuccacaaaguaaugcaccaaucauggacgaagagagggaaauaccugaaagaaguuggaacuccggccaugaaugggucacagauuuuaagggaaagacaguaugguuuguaccaagcauuaaagcuggaaaugauauagcagcuugucuuagaaagaaugguaagaaaguaauacaguugagucgaaaaacauuugacagugaguacguuaaaacccggucgaacgacugggauuuuguaguuacgaccgauauaagugagaugggggcaaauuucaaagcugaacgagugauugauccuagacgaugcaugaagcccguaauccuuacagacggggaagaacguguaauuuuagcuggucccaugcccguaacacauaguuccgcugcacaaaggcgcggccgaauagggcgaaauccaaagaaugaaaaugaucaauacauauacaugggcgagccauuggaaaaugaugaagauugugcucauuggaaagaggcaaaaaugcuccucgauaacauuaacacgccagaaggcaucauaccgaguauguucgagccggaaagggaaaaagucgacgcaauugauggagaauacaggcuaaggggugaagcaagaaaaacguuuguagaucuuaugcggagaggugauuuaccuguuuggcuagcuuauaaaguugcagcagaagggauaaauuaugcugauaggagaugguguuuugacggcaucaaaaauaaucaaauauuagaagagaacguagagguagagauauggacaaaggaaggugaacgcaaaaaguugaaaccuagaugguuggacgcacgaauauauagugauccuuuggcguuaaaagaguuuaaagaauuugcagcugguaggaaaucauugacucuaaacuuaauuacagaaaugggaagauugccaacguuuaugacacaaaaagcuaggaaugcccucgauaaucuagccguacuacacaccgcagaagcagggggaaaagcauacaaccaugcacuaagcgaauuaccagaaacgcuagaaacauugcuuuugcucgcguugcuagcuacagucacaggaggaauauuccuauuucuaaugucaggaaaaggaauagggaaaaugaccuuaggcauguguugcauuaucacagcauccauauuacuaugguacgcacaaauacaaccacacuggauagcggccucuauuauauuagaguuuuucuuaauaguacuccugauuccugagccagagaaacaaagaaccccacaggacaaucaauugaccuaugugguaauagcaauacuaacggugguagcggcuacaauggcgaacgagaugggauuuuuagagaaaacuaagaaagauuuaggauuaggaucaauaacaacgcaagaaagcgaaaguaacauacuagauauagauuuaagaccugccucugcauggacucuauaugccguugcaacgacauuuguaacgccgaugcuacgucauucaaucgaaaauucaucagugaauguaagccuaacugccauugcaaaucaagcaacaguuuuaaugggauugggcaaggguuggccuuuaaguaaaauggacaucggcguuccacucuuagcgauagguugcuauagucaaguuaacccaauuacucuaacugcggcacuuuuacuccuaguggcccauuaugcuauaaucggucccggucuucaggcuaaagcgacaagagaagcacagaaaagagcugcugcagguaucaugaagaaucccacgguagaugggauaacaguaauagauuuagaaccuauuccuuaugaccccaaauuugaaaaacaauugggucaaguuauguuacuuauucuaugcguaacucagguccucaugaugagaacaacuugggcgcuuugcgaagcauuaaccuuggcgaccgguccaauuaguacuuuaugggaagggaaucccggcagauucuggaauacaacgauagcgguaucaauggcgaauauauuucgagguucuuaccuggcuggggcagggcucuuguuuuccguaaugaaaaauaccacaaauaccagacguggaacaggaaauaucggagaaacuuuaggugaaaaauggaagaguaggcuaaacgcguuaggaaagagcgaauuucaaaucuauaagaaaagcgggauccaggaaguggauagaacgcuggccaaagaagguauaaagaggggugaaaccgaucaccacgcuguaagccggggaagugcaaaacuuagaugguucgucgagagaaacauggucacgccggaagguaaaguagucgaccuggguugcgggagagguggauggagcuacuauugugguggauuaaagaacguaagggaaguaaaaggacuaacuagagggggaccgggacacgaggaaccuauuccaaugucgacuuauggguggaacuuggugcgacuccagucugguguagacguauucuuuaccccgccagagaagugcgacacacucuuaugugauaucggugaaucaagccccaauccaacuauagaagccgguagaacuuugaggguacucaauuugguagaaaacuggcuaaauaacaacacccaauucuguauaaaaguuuuaaacccuuauaugccgucaguuauagaaaagauggagacgcuacagagaacauacggaggagcccuaguaagaaacccgcuaucgagaaacaguacgcacgaaauguauugggucucuaaugcaacuggaaacauagucucuagugucaacaugauuagccgaaugcuaauuaauagauuuacaaugaaacauaaaaaggcuacuuaugaaccagauguagaccugggcagcggaacgagaaauaucggaauagaaagugaaauuccuaaucuagacauuauaggaaagaggauagagaaaaucaaacaagaacaugaaacuucauggcauuacgaucaagaccauccuuacaaaacuugggcauaucacgguagcuaugaaaccaagcaaacagggucagcgucuucaaugguaaacggaguaguaagacuucuaacaaaaccaugggauguaguaccaauggucacacaaauggcgaugacagauacuacuccguuuggccaacaacggguauucaaagagaaaguagauacucguacccaagaaccaaaggaaggaacaaagaaauuaaugaaaauuacugcagaauggcuauggaaagaacuaggcaagaagaaaacaccuagaauguguaccagagaggaauuuacuagaaaaguccgaucaaaugcugcguuaggagcuauauucacugacgagaacaaauggaaaagugcacgcgaagccguagaagaugggagauucugggagcuaguagacagagaaagaaacuuacaucuagaaggaaagugcgaaacgugcgucuacaauaugauggguaaacgagagaagaaauuaggugaguucggaaaagcuaaaggcaguagggcgauaugguacauguggcuaggagcaagguuucuagaguucgaggcacucggauuuuugaaugaggaucauugguuuagcagagguaauucuuugucaggaguagagggagaaggauuacauagauuaggauauauacuacgugauguaaguaggaaagaaggaggagcuauguacgcggaugauaccgcaggcugggauacccguaucacacucgaagaucuuaagaaugaagaaaugguaaccaaccauaugaaaggagaacacaagaaauuggcugaagcgaucuuuaaacuuacguaucaaaauaaagugguacguguucagcguccaacuccuagaggaacugucauggacaucauuucucggagagaccaacgaggaucuggacaagucgguacauacggauuaaacacauuuacuaacauggaagcgcaauuaauacgacaaauggaaggugaaggcauuuuuaaaaguauacaacaccuaacaguuaccgaggaaauagcagugcagaauugguuagcaagaguaggucgagaaagauuaacgagaauggcuaucuccggagaugacuguguaguaaaacccaucgaugacagauucgcaaaugcacuuacggcacuaaacgauaugggaaaaguacgaaaagacauacagcagugggaacccagcagaggguggaaugacuggacccaagucccguuuugcagucaccauuuucacgaauuaguaaugaaagacggcagaguccuaguugugccaugccgaaaucaggaugaauuaaucgguagagcacggauaagucaaggcgcugguuggaguuuaaaagaaacggccugcuuagguaaaucuuacgcacaaauguggacacugauguacuuucacagacgugacuuaagauuggcugcuaacgcuauauguucugccguuccuucacacuggguaccgacuagcaggacaaccuggaguauccaugcaaaacaugaauggaugacuaccgaggacaugcuagcaguuuggaauagagucuggauucaagagaacccguggauggaggauaaaacuccuguagagaguugggaagaggucccuuacuuaggaaagcgagaagaucaguggugcggaagucuuaucggacucacaagucgugcaacgugggcgaagaauauccagacggcuaucaaccaaguacggucacucauaggcaaugaagaauauacagacuauaugccaagcaugaagagauucagaagagaagaagaggaagccggggugcuaugguag

SEQ ID NO: 22275 - RNA, 9876 nt, Artificial Sequence
  derived and/or modified CDS sequence (opt6) from DENV-2__FJ850091__SS-prME
acugcgggagugauaguaaugcuaauaccaaccgcuauggcauuucauuugacuacuagaaauggggaaccucauaugauaguuggacgccaggaaaaagguaaaucgcuuuuauuuaaaacugaagaugggguaaacauguguacccugauggcaauggacuugggugaacuaugcgaagacacgauaaccuauaaauguccauuauuacgccaaaaugaaccagaagacauugauugcugguguaauagcacaucaacguggguuacuuaugguacguguacaaccacgggggaacauagaagagaaaaacguucaguagcguuaguaccacaugucggaaugggucuugaaacucguacugaaacauggaugucgucagaaggugcauggaaacacgugcagcgcauagaaacauggauacuuagacacccagguuuuacaauaauggcagcgauauuagcguacacuauuggaacaacacauuuccaaagagcauuaauauucauuuuauuaaccgcagucgcaccgucuaugacaaugaggugcauaggcaucucaaaucgcgacuuuguggaaggaguaaguggaggaucauggguagauauaguuuuagagcacggcagcuguguaacaacuauggcuaaaaauaaaccuacgcuugauuuugagcuaauaaaaacagaagcaaaacaaccagcgacacugaggaaauacugcauugaagcaaaacuaaccaauacgaccaccgaaagcagaugcccaacacagggagaaccgucauuaaaugaagaacaagauaaacgauuuauauguaaacauucaaugguggacagaggaugggggaacggauguggauuguucggcaaagguggaauaguaacaugcgcgauguuuacguguaagaaaaauauggaaggcaaaauaguacaaccagaaaacuuagaauacacaaucgugaucacuccgcauucgggugaggaacaugcggucggaaacgacacaggcaaacacggcaaagaaauaaaaauaacaccucagaguucuacuacugaagcagaacuaacuggcuacggcacggugacuauggagugcucuccacgaacaggccuagauuucaaugaaaugguauuacuucaaauggaggauaaagcauggcucguacauagacaaugguuccuugaucuuccuuuaccaugguuacccggugcugacacacaagguuccaauuggauacaaaaagagaccuuagugacguucaaaaauccccacgccaagaaacaagacguaguagucuuagguagucaagaaggggccaugcacacugcccuaacaggugcuacugaaauccaaauguccagcggcaaucuguuguuuacaggccaucugaaaugcaggcuccggauggacaagcuccaauuaaaagguaugucguacucaauguguacuggaaaauuuaagauaguaaaagaaaucgcugaaacccagcauggaacuauuguaaucagaguacaguaugaaggcgauggaucaccauguaaaauaccguuugaaaucacagauuuagagaaaagacauguauuggggcgauuaauaacaguaaaucccauaguaacagaaaaagauucaccuguuaauauagaagcagaaccaccauuuggagauaguuacauaauuguggggguugagccaggacaacuaaaauuaaauugguucaagaaagguucaaguauaggucagauguuugaaacaacgaugaggggugccaaaaggauggccauacuaggcgacaccgcaugggauuuuggcagucuaggaggggucuuuacaaguauaggcaaagcauugcaccaaguguucggagccauauacggcgcggcuuuuucagguguaucguggacuaugaaaauacuaauaggaguuauaauaacauggauagguaugaauagcagaagcacaucucucagugugucauuaguucugguagggguaguaacauuauaccuaggagcaaugguacaagcugauucggggugcaucgugucuuggaaaaacaaagagcuaaagugcggaucagguauauuuauaacggauaauguucauacauggacagaacaguacaaauuucaaccagaaucaccuucuaaacuugcuucagccauacaaaaagcucaugaggaagggauuuguggcauucgaucugugacuagauuggagaaucuuauguggaaacagauaacccccgaacuaaaccauauacuuagcgaaaaugaaguaaaguuaaccauaaugacuggugauaucaagggaaucaugcaagccgguaaaaggagcuugaggccgcaaccuacagaacuaaaauauucauggaaaacguggggcaaagccaaaauguuaaguacagaaucccauaaucagacauuccucauagauggcccugagacugccgaaugcccuaacacuaaccgggcauggaacucacucgagguagaagauuauggauuugguguauucacaacuaauauuuggcuuaaauuaagggaaaaacaagauguauucugugacuccaaguugaugagcgcagcuauaaaagauaaucgugccguucaugcagacaugggcuauuggauugaaucagcccuuaaugauacauggaaaauggagaaagcguccuuuauugaaguaaaaaguugccacuggccaaaaucgcauacccuuuggagcaacggaguuuuggaauccgaaaugauaauccccaaaaauuucgccggaccuguuagucaacacaauuaccgacccggauaucauacgcaaacagcugguccguggcauuugggaaagcucgaaauggauuuugauuucugugaggguacaacagucguaguaacagaggauuguggaaaucgcggcccgucuuugcgaacaacgacugcaaguggaaaauugauuacugaaugguguugcagaaguuguacacuaccuccauuaagguacagaggugaagacggguguugguauggaauggagauucgaccauuaaaagaaaaagaagagaaccuaguuaauucauugguuacugcgggacacggucagauagauaauuucucauuaggaguucucggaauggcguuauuuuuagaggaaaugcugaggacacgugucggaaccaaacacgcaauacucuuaguagcuuuaucauucguaacacuaauaacagguaauaugucauucagagaccuugguagagugaugguaaugguuggagcgaccaugacugacgauauaggaaugggaguuacauaucuugcucucuuggcagccuucaaagugaggccuacguuugccgcuggauuacuucuacgcaaguuaacaagcaaagaguugaugauggcaacaauagguauagcacuuuuaucacaaucuaccuuacccgaaaccauauuagagcuuaccgaugcauuagcauuaggcaugauggcauuaaaaaucgugagaaauauggaaaaauaccaauuagcugugacaauaauggcaauuuccugcguacccaacgcaguaauucuacaaaaugcuuggaaaguaucaugcacuauucuagcugcugucucaguuagcccucuucuauuaacgucuagucagcagaaggcagauuggaucccacuugcacugaccauaaaggguuugaaccccacggccauauuucuuacaacucugucaagaacaaguaagaaaagaucuuggccauuaaaugaagcaauaauggcuguuggaaugguaagcauucuagcaaguagucuacuaaagaaugacaucccaaugacaggcccucuuguugcuggagggcuacuaacaguaugcuauguacuaacaggucgagcagcagauuuagagcuggaaagagccgcagaugugaaaugggaagaucaggcagaaauaaguggcaguucaccaauauuauccaucacaaucagugaagauggaaguaugucaaucaaaaaugaagaggaagaacaaacgcuaacaauuuugauccgcacugguuuauuaguuauuaguggaguuuuccccgugucuauucccauuacugcggcggcuugguaucugugggaagugaaaaagcaaagagccgguguacuuugggauguuccgucuccaccuccuguugguaaggcagagcuugaagauggugccuaucgaauaaaacaaagaggaauccugggauauucgcagaucggcgccgguguuuacaaagaaggaaccuuucacacaauguggcacgugacaaggggagcuguacugaugcauagagggaagaggauagagccuagcugggcagacgucaagaaagaccuuauaagcuaugggggaggauggaaauuagaaggagaauggaaggaaggugaagaaguacagguuuuagcacucgaaccgggcaaaaacccucgcgccguacagacuaaaccaggcauauuuaaaacaaauaccgguacuauaggagcuguauccuuagauuucucacccggcacaucaggcucuccaaucgucgauagaaagggaaagguuguuggacuauaugguaacggaguaguaacuagaucgggcgcuuaugucucugcaauagcacaaaccgagaaaagcauugaagacaacccagagauugaggacgacauuuuuaggaagaaaagauuaacaauaauggaccuucaucccggugcgggcaaaaccaaaagauaccuaccagcgauaguucgcgaagcgauuaaacgaggucuuagaacacugauacuagcgccgacaagggucguugcggcagagauggaagaagcccuccguggucuuccuauuagauaccaaacucccgcuauaagagcugagcauaccggaagagagauaguggacuuaaugugucaugcaacauuuacgaugaggcuacuaaguccaguucgaguaccaaauuauaauuuaauuaucauggaugaggcgcacuuuacggacccagcuaguauugccgcuagaggauacauaagcacaagagucgaaaugggugaggcagcagguauauuuaugacagcaacgccaccuggcucgagagauccuuuuccacaaucaaaugcaccuauuauggaugaagaaagggagauaccggagcgaaguuggaacucaggacacgaauggguuacugauuuuaaagguaaaacggugugguucguucccuccauaaaggcagguaaugacauugccgccugccuacguaaaaacggcaaaaagguuauacaguuaucacgcaaaacauucgauucugaauacgccaaaaccagggcaaaugauugggauuucgugguuacgacagauauaucagaaaugggggcuaauuuuaaagcugaaaggguaauagacccccgucgcugcaugaagccggugauacuaacagauggcgaagaacgagucauauuagcugguccgaugccagugacacacucuagugcugcccaaagacgagggagaauaggaagaaaucccaaaaacgagaaugaucaauacaucuacaugggagagccgcuugagaacgacgaagacugugcgcacuggaaggaagcuaaaauguuguuggauaauauuaauacuccagaagggauaauucccuccauguucgaaccagaacgcgaaaaaguagacgcgauugacggagaguacagacugcgaggagaagccaggaaaacauuuguggacuuaaugagaaggggagaccuucccguuuggcuggccuauaaaguugcagcagaaggaauuaacuaugcugaucguaaauggugcuuugauggaaucaaaaacaaucagauauuggaggagaacguagaaguugaaauauggacaaaagagggcgaaaggaagaaacuuaaaccgagauggcuggaugcccguaucuauucugauccauuggcacuaaaagaauuuaaagaauuugcggcuggacgaaaaucauuaacucuaaacuugauuaccgaaaugggucgccugccaacguuuaugacucagaaagcccguaacgcacuagauaaccuugcaguguuacauacugcugaggucggaggaaaagcguauacacaugccuuaagugaacuaccagaaacacuggaaacuuuacucuuacuaacacuacucgcagcugucacgggagguauauucuuauuucucaugucugguaaaggcauaggcaagaugacccuaggcaugugcuguaucauuacagcaucuauacuuuuaugguacgcgcaaauucaaccucauuggauugccgcaucuauuaucuuggaguucuuuuuaauuguacuacugauaccagaaccagaaaaacaaagaaccccacaggauaaucagcuaacuuauguuguaauagcgauacuaaccgugguagccgcaacgauggcuaacgaaaugggauuccuagagaaaacaaagaaagacuuaggguuugguucgaucaccacucaagaaagcgaaagcaauaucuuagacauagaccugagaccagcgucagcuuggacauuauaugcaguggccacuacuuucgugacuccaauguugcggcacucuauugaaaacucaucuguaaaugugaguuuaacggcaauagcaaaucaagcuacuguccuuaugggucuaggaaaaggauggccuuuaucuaaaauggauauaggaguaccacuccuagcuaucggauguuacucacagguuaaucccauaacgcucacugcugcauugcuuuuauuaguugcacacuacgccaucauaggcccaggacuucaagcaaaagcuacacgggaagcucagaaaagagccgcugcaggcauaaugaaaaauccuacaguagauggcauaacgguaauagaucuagaaccaauuccauaugauccaaaauucgaaaaacaguuaggucaaguaaugcuccuaauucuaugcgucacacagguuuugaugaugagaacgacaugggcacucugugaagcacuaacacucgcaacaggccccaucucuacacuaugggaagguaauccuggacgauucuggaacacaacaaucgcaguaucuauggccaacauauuucgaggguccuauuuagccggcgcaggauuacuguucaguauaaugaagaauacuacaaauaccagaagagguacggggaacguaggagaaacacugggagaaaaauggaaaucuagauugaacgcgcuaggaaagucagaguuucaaauuuacaaaaagagcggaauccaggaaguugauagaacuuuagcgaaagaaggcauaaaacggggagaaacagaucaccaugccguuucuagaggaagugcaaaauugcgaugguuuguugaaagaaauaugguaacgccagaaggcaagguaguagacuugggaugcggacguggagguuggucguacuauuguggcggucucaaaaaugugagagaaguaaaggggcucacaaaaggaggaccaggacaugaagaacccauaccgaugucuacguauggguggaacuuagugcguuuacaaagcggaguugaugucuucuuuaccccaccggaaaaaugcgacacauuauugugcgauauaggagagucauccccaaauccaacgauagaagcaggcaggacuuugcgcguacucaauuuaguagagaauugguugaauaacaacacacaauucuguaucaaaguacugaaucccuacaugccauccgucauugagaaaauggaaacccuccaaagaaaauacggcggggcauuaguucguaauccauugagcagaaauuccacucaugagauguacuggguauccaacgcaaccggcaacauuguaucuagcguuaacaugauaucgcgaauguugaucaauagauuuacgaugaaacauaagaaagcgacauacgagcccgacguagaucuugguucagguacacgaaauauugggauugaaucagagauuccaaaucuggauaucaucggaaaaagaauagagaaaauaaaacaagaacacgaaacuagcuggcacuacgaccaagaccacccuuauaaaacaugggcuuaccacggaaguuaugaaacuaaacaaacugggucagcaagcucgaugguuaauggugugguuaggcucuuaacaaaaccgugggauguuguaccaauggucacccaaauggccaugacugacacaacaccauucgggcaacagaggguuuuuaaagaaaaggucgacacuagaacucaggaaccuaaagaaggaacuaagaaacugaugaaaauaacagcugaauggcucuggaaagaacuaggaaaagagaaaacgccgagaauguguacucgagaagaguucacacgaaaaguacgaucuaaugcggcacucggagcaguauucacagacgaaaacaaguggaaaucugcuagagaggcuguugaagauggaagauucugggagcuaguagaucgagaaagaaaccuccaucuagaagggaaaugugaaacauguguauacaacaugauggguaaaagagagaagaaacuaggcgaauuuggaaaagcaaaaggcucaagagccauuugguauauguggcugggggcacgauuccuagaguucgaagcauugggauuccugaaugaagaccauugguuuucacguggcaacucuuugagugggguggaaggagaaggacuucaccgguuaggcuacauucuacgugaaguaggaaagaaagaggguggggcgauguacgcagacgauacugcagggugggacacacguauuacuuuggaagaucucaaaaaugaagaaauggugacgaaucacaugaaaggugagcauaaaaagcuagcggaagcaaucuuuaaauuaacguaccagaauaaaguaguccgaguacagagaccaaccccgcgaggcacaguaauggauaucauaagucgcaaagaccaacgggguaguggacaaguugggacuuacggucuaaauacuuucacaaauauggaagcucaacuuauacgucagauggaaggggaagguauuuucaaaucuauacaacacuuaaccgccaccgaagaaauagccguucaaaauuggcuagccaggguaggcagagaacgauugaguagaauggcaauaucaggugaugauuguguuguuaaacccauagaugaccgauuugccucagcccuaacggcucuaaaugauauggggaaagugcgaaaggacauacaacaaugggaaccaucaagggguuggaaugauuggacacaaguaccuuucuguucacaucauuuucaugaacuuguaaugaaagauggccguguguuagucgugccaugcaggaaucaagaugaacuuauugguagggcucgaauaucccaaggagcgggcuggucccuuaaagaaacagcaugccugggcaaaagcuacgcucaaauguggacgcucauguauuuucauagaagagaucuaaggcuggcggcgaaugcaauaugcucggcaguacccucacacuggguuccgacgaguagaacuacuugguccauucaugcaaaacacgaauggaugacaaccgaagauauguuggcaguguggaaucgaguauggauucaagagaauccuuggauggaagauaaaacuccgguagaaucgugggaagaagucccguauuuagguaagcgagaagaucaaugguguggaucuuuaauaggacuuacauccagagccacaugggccaagaacauucaaacggcgauuaaccaagucagaucauuaaucggaaacgaaggcuacacagacuacaugccgaguaugaagagauuucgccgcgaggaagaagaagcuggggucuuaugguaa

SEQ ID NO: 22276 - RNA, 9876 nt, Artificial Sequence
  derived and/or modified CDS sequence (opt6) from DENV-2__GQ199890__SS-prME
acugcaggaguuauaguaauguuaaucccaaccgcaauggccuuccaccuaacuacucgaaauggagaaccacacaugauaguggguagacaagaaaaaggaaaaaguuugcuuuucaaaacggaagaugguguuaauaugugcacuuuaauggcgauagaucugggugaauuaugugaagauacuaucacauacaaaugcccguuauugcgacaaaacgaaccagaagauauagacugcuggugcaacagcacgaguacguggguaacauacggaacguguaccacaaucggugaacacagacgagagaaacgaucaguagcuuuaguaccgcauguaggaaugggucuugaaacaaggaccgaaacguggaugucgucggaaggagccuggaaacacguucagagaaucgaaacauggauauuaagacauccuggauucacuaucauggcagcuauucuagccuauacaauuggaacgacucauuuucaacgagcguuaauauucauucuguuaaccgcaguagcaccaucaaugaccaugagauguaucggaauaucuaaccgagauuucguugaaggaguaagcggagggagcugggucgacaucguucuagagcacggaucuugcguaacaacuauggccaaaaauaaaccuacucuggauuuugaauugaucaaaacagaagcaaaacaaccagcaacauuaagaaaauauugcaucgaggcaaaacuaacuaauaccacuacagagagcagauguccuacucaaggugagccuucucuaaaugaggaacaggauaaacgauuuauaugcaaacacuccauggucgaucgagguuggggaaauggauguggacuuuuuggaaaagguggaauaguaacuugugcaauguuuacguguaagaaaaauauggaaggaaaaauuguucaaccggagaaucuagaauacacaaucguuauuacuccccauuccggagaagaacgagcaguaggaaacgauacagguaaacacggaaaagaaauuaaaaucacuccccagucgucaacaacugaagcggaauuaacuggguaugggacaguaacaauggaauguaguccaaggaccggacuagacuuuaacgaaaugguauugcugcaaauggaagauaaagcaugguuaguucaucgacagugguucuuggauuuaccacugccuugguuaccaggagcagacacacaaggguccaauuggauucagaaagagacuuuaguaacuuucaaaaacccgcaugcaaagaagcaagauguugugguucugggcucucaagagggagcaaugcacacugcuuugacaggggccacagaaauccaaaugagcucuggaaaccuacucuucacaggucaucucaagugucgacuaagaauggacaaacuacaacuuaagggaaugucuuauucaaugugcacugggaaauucaaaauaguaaaagaaaucgcagaaacccaacacgguacgauagucauuagaguucaguaugagggggauggaucaccaugcaaaauuccauuugagauuacggaucuagaaaagaggcauguacuugguaggcuaauaacuguaaacccuauagucacggaaaaagauuccccaguuaacauagaggcugaaccucccuuuggcgacagcuacauaauuguagggguugagccagggcaauugaaacuuaacugguucaaaaagggaucaucaauagggcagauguuugaaacuacaaugaggggagcuaaacgaauggccauacugggagacacagcaugggauuuuggaagccugggcggaguauuuaccaguaucggcaaggcacugcaccaggucuuuggugcuaucuacggagcagccuuuuccggaguaucguggacaaugaaaauacugauuggcguuauaauaaccuggauaggaaugaauagccguaguacuucauuaucuguuucucuagucuuaguagguguuguuacuuuguaccuaggggccauggugcaagcagauucuggauguauagugucauggaaaaauaaagagcucaagugcgggucugguauauuuauuacagauaacguacauacauggacugagcaauacaaauuccaaccugaaucuccuucaaaacuagcaagugccauccagaaagcacacgaagaagggauuugcggcauacgauccgucacgagacuagaaaaucugauguggaaacaaaucacaccagagcuuaaucauauccuuagugaaaaugaaguuaaauuaacuauaaugacaggugauauaaaaggcauuaugcaagcaggaaaacgcucacugcguccacaaccaaccgaauugaaguacucguggaaaacaugggggaaggcuaagauguuaucaacagaaucacacaaucaaacauucuugauagauggccccgagaccgcugagugcccaaacacuaaccgagcauggaacaguuuagaaguagaagacuacggcuuuggcguauucacaacgaauauauggcuaaaauuacgagagaaacaagaugucuuuugcgauucgaaacuaaugucugcugcaauaaaggauaauagagccguucacgcugauauggguuacuggauagaaagugcccuaaaugacaccuggaagauggagaaagcaucuuucauugaagugaaauccugccauuggccgaaaucacauacacucuggagcaauggcguucuagaaagugaaaugauaauaccuaaaaacuucgccgggccgguuucgcaacacaacuaucgaccaggauaucacacacaaacagcaggacccuggcauuuggguaaacuugaaauggauuucgacuuuugcgaagggacaacagugguuguuacagaggauuguggaaauagaggaccuuccuugagaaccacaaccgcauccggaaaauuaauaacagaguggugcugcagaucguguacacuaccaccacucagguaccggggugaggauggaugcugguauggcauggagaucagaccauugaaagaaaaagaagagaauuuagugaacagcuuaguaacggcuggacauggacaaauugauaacuuuagccucggaguacuggggauggcucuauuuuuagaggagaugcuccggacacguguaggaacaaaacaugcuauucuauuaguggcucucagcuuugugacacuuauaacuggcaauaugucuuuucgugauuuagggagggucaugguaaugguaggagccacuaugacugaugacauugguaugggaguaacuuaccucgcgcuuuuagcugcauuuaaagucagaccgacguucgccgccggccuacucuuaagaaagcuaacaucuaaagagcuaaugauggcuacuaucgguauugcucuuuuaucucaaaguacucuaccugaaacgauauuagaacuaaccgacgcucucgcacuugggaugauggcucuuaaaauaguuaggaauauggagaaguaucaauuagcagugacaauaauggcgaucucaugugucccaaacgccgugauucuucaaaaugccuggaaaguaucgugcacuauacuagcagcaguaucuguaaguccuuugcuauuaaccucgucacaacagaaggcagacuggauacccuuggcccugaccaucaaagguuuaaauccuacggcuauauuucuaacaacccucaguaggacaaguaagaaacgcaguuggccucugaacgaagcuauaauggccguuggaauggugaguauacucgcuaguuccuuacucaaaaacgacaucccaaugacagguccacuggucgccggaggauuauugacagucuguuauguauuaacuggacguucagcggaccucgaacuagaaagggccgccgacgugaaaugggaagaccaagccgaaauuagugguucauccccgauacuaaguauaacaauaucugaggacgguucuaugucgauaaagaaugaggaggaagaacaaacuuuaacgauacugauccgaacuggucuuuuagugauaucaggaguuuuccccgugagcauaccuauaaccgccgcggcgugguauuuaugggaagucaagaaacaacgagcagggguucuaugggacguaccuucaccgccuccaguugguaaagcagaauuagaggauggcgcuuaucguaucaaacaacggggcauucuaggauauagucaaauaggagcaggaguauauaaagaaggaacuuuccauacaauguggcauguuacacguggugcaguccuuaugcaucggggaaaaagaauugaacccucgugggccgaugucaaaaaggaucucauauccuacgggggagguuggaaauuagagggugaguggaaggaaggcgaagaaguucaaguucucgcauuggaaccaggcaaaaauccaagagcuguccagaccaaaccuggcaucuucaaaacgaacaccggcacaauaggugcaguuucacuugacuuuaguccgggaacaaguggaagcccaauuguugaucgaaaaggcaaaguaguuggccuauauggcaauggaguugugacuagaaguggugcguacguaagcgcuauagcgcagacggaaaaaucaauugaggacaauccugaaauagaggacgauauauuucguaagaaaagacugacuauaauggaccuacaccccggagcuggaaagaccaaaagguaccuaccagccauugugagggaagcaauaaaaagaggccuacgcacgcugauucuagcaccaacaagagucguugcagcagagauggaagaagcgcuacguggacuaccaauaagauaucaaacuccagcuauuagggcugagcauacagguagggaaauuguagaccuaaugugucaugcaacauuuacuaugcgacuucuaucaccgguaaggguaccuaauuauaacuugauuauaauggaugaagcucauuuuaccgacccugcauccauagcagcucgaggcuacauuaguacaagaguagagaugggagaagccgcuggcaucuucaugacagcuacuccaccaggaagcagagacccuuuuccacaaucaaaugcgccuauaauggacgaagaaagagagauucccgaacgaagcuggaacuccggccacgaauggguaacggacuuuaaagggaaaacaguaugguuugugccauccauaaaagcagggaacgauauugcagcuugucuaaggaaaaacgguaaaaagguaauacaacugaguagaaaaaccuuugauagcgaauacguaaaaacgcgcgcaaaugauugggauuucguagucacuacggauauuuccgaaaugggagcuaauuucaaagcugaaagaguuaucgauccuagaagauguaugaagccaguuauccuaacagacggagaggaaagaguaauucuugcgggcccuaugccagucacucacucaucagccgcacaacguagggguagaauaggacguaaccccaaaaacgaaaaugaucaauauauauacaugggggaaccccuagagaacgacgaggauugcgcccauuggaaggaagcaaaaauguuauuagauaauauuaauacaccugaaggaauaauucccaguauguuugaaccagaacgagagaaaguugaugcaauugauggggaauauagauugcguggcgaagcaagaaagacauucguagauuuaaugagacgaggcgacuugccuguauggcuggcguauaaaguugcggcagaaggaaucaacuacgcagaccguaaaugguguuucgaugguauaaagaacaaucaaauucuugaagaaaauguggaaguagaaauauggacaaaagagggcgaaagaaagaaauuaaaaccacgguggcuugaugcucgaaucuacagcgaucccuuggcauuaaaagaauuuaaggaguuugccgcaggccgcaagucauuaaccuuaaaccuuauaacugagauggggagacugccaacauucaugacucaaaaagcacgaaaugcauuagauaaucuagcugucuuacacacugcagagguagggggaaaggcauacacccacgcuuugucagaguuaccggagacccuagaaacucuucucuuguuaacauuacuagcaacuaucacuggagguauuuuucuuuucuuaaugagcgggaaagguauaggcaaaaugacucugggcauguguuguauaauaacagcgucuauucuacugugguaugcacaaauccaaccccacuggauugcugcuucuauaauccuagaguucuuucuaaucguacuauuaauuccugaaccagaaaagcagcgaacuccacaagauaaccaacuaaccuaugucguaauagcaaucuuaaccguaguugcggccacaauggcaaacgaaauggguuucuuagagaaaaccaagaaagaccuagguuucgguaccauuaccacgcaggagucagaaucaaauauauuggauauagauuugagaccugcaagugcguggacacuuuaugcuguagcaacaacauuuguuacaccaauguuaagacauucuauugaaaauaguagugugaauguaucacuaacggcaauagcaaaccaagcgacaguacuuaugggcuuagguaagggauggccgcuaucuaaaauggauauaggaguaccacuccuagcuauaggauguuauucacaagucaauccaauaaccuuaacagcagcuuuauuacuauuaguagcacauuacgcaauaauugguccuggacuacaagcgaaggcaacgagggaagcccagaaaagggcugccgcaggaauuaugaaaaacccgacagucgauggaauaacuguaaucgacuuagagccuaucccguacgacccaaaauuugagaaacaacucggacaaguaaugcuccuaauccuaugugucacgcaagugcuaaugaugaggacgacaugggcauuaugugaggcgcuaacucuagcaacugguccuauaucuacacuuugggaagguaauccagggcgguucuggaauaccacuaucgcaguaucgauggcaaauauauuucgcggcagcuauuuagcuggagcaggacuccucuuuucuauaaugaaaaauacaacuaauacccgacgaggcacaggaaaugucggagaaacucuuggugagaaguggaaaagccgucugaacgcacugggcaagagugaauuucaaaucuacaagaaauccggcauucaagaaguggacagaacacucgcaaaagaaggaauaaaaaggggagaaacugaccaccaugccguaaguaggggaagugcaaaacuaagaugguuugucgagagaaacaugguaacuccugaaggaaaagucguggacuuggggugcggacggggagguuggaguuauuauugcgguggauugaaaaacguacgggaaguuaaaggucuaacaaaagggggcccgggucacgaagaaccaauuccuaugagcacauauggcuggaaccuaguacgguuacaaucagguguugauguuuucuucacaccuccagaaaagugcgauacacugcuaugcgacauuggugaauccucaccaaacccgacuauugaagcagguagaacccuacgugucuuaaaccugguugagaauuggcuaaacaacaauacacaauuuuguauuaaaguauuaaacccguacaugccgucuguaauugagaaaauggagacauugcaaagaaaauauggaggagcccucguuagaaauccgcucucacgaaauucuacccaugaaauguauuggguuagcaaugcaacgggaaauauuguuaguucugugaauaugauuagcagaauguugauaaacagauucacuaugaaacauaagaaagccacauaugagccagauguagacuuagguuccggaacucgcaacauaggaauagaauccgagauucccaacuuagacaucaucgggaaaagaaucgagaaaaucaagcaggaacaugagacuucguggcacuacgaccaagaucaucccuacaaaacuugggccuaucauggcucauacgagaccaaacagaccgggagcgcuucaucaaugguaaacggaguggugagacuauugacaaaaccaugggacguagugccaauggucacacaaauggcaaugacggauacaacaccguucgggcaacagagaguauucaaagaaaaaguagauacacgcacucaagagccuaaagaagguacuaagaaauuaaugaaaauaacagcugagugguuauggaaagaauuaggaaaggaaaagacaccuagaaugugcaccagggaagaauuuacccggaaaguccgaagcaacgcggcgcuaggagcuauauuuaccgaugagaauaaguggaaaagcgcaagagaggcaguagaggauggaagguuuugggagcuaguugacagagagagaaauuuacaucuugaagguaaaugcgaaacaugcguguauaacaugauggguaagagagagaagaaauugggggaauuuggaaaggcaaaaggaucuagggcaauaugguacaugugguuaggggcaagauuuuuagaauuugaggcacuagguuuucuaaaugaagaucauugguucucaagaggaaauucucucagcggaguugaaggcgagggcuuacacagauuagguuacauccuacgggaaguaggaaagaaagagggaggagcaauguaugccgaugauacggcuggaugggacacucggauaacacuggaggaccugaagaaugaagaaaugguaaccaaucacaugaaaggugaacauaagaaacuugcagaggcgauauucaagcuaaccuaucaaaauaaagugguaagaguucaaagacccacaccaagaggcacaguuauggauauaauaucaagaaaagaccagagaggcucaggacaagucggaacauauggacuaaacacuuuuacaaauauggaagcacaauugauaaggcaaauggaaggagaggguauauuuaaaaguauacaacaccugacagccacagaagaaauugcaguccaaaauugguuagcacgaguugguagagaacgacuaaguagaauggcaauaucuggcgaugauugugugguuaaaccgauugaugaucgguuugcaucagcacuaacagcauugaaugacaugggaaaggugaggaaagacauacaacagugggagccaaguagaggauggaaugauuggacucaaguaccuuuuugcucccaccauuuucacgaguuaguaaugaaggauggucguguuuuagucgucccaugcaggaaucaggaugaauugauaggacgugcaagaauaagucagggagccggauggagcuugaaggaaacagcgugucuaggaaaaucuuacgcacagauguggaccuuaauguauuuccaucgacgagaucuacguuuagcugcaaaugcaauaugcucagcuguuccgagccauuggguuccuacaucccgaacaacauggaguauucaugcaaaacaugaauggaugacaacugaagacaugcuagcaguguggaacagagucuggauacaagaaaaucccuggauggaagacaagacaccuguagaaucuugggaagaaguaccauacuuaggaaaacgggaggaccaguggugcgggucacugauugguuuaacuagccgugccacaugggcaaagaacauucaaaccgcuauuaaucaagugaggucacugauaggcaacgagggcuauacagacuauaugccuuccaugaagcgauuuagaaaggaagaagaggaagcgggcgucuuaugguga

SEQ ID NO: 22277 - RNA, 9876 nt, Artificial Sequence
  derived and/or modified CDS sequence (opt6) from DENV-2__GQ868549__SS-prME
acugcugguguuauaguaaugcucaucccaacagccauggcauuccaucuaacuacucggaacggagaaccucacaugaucguaggaaggcaagaaaaagggaaaucguugcuauuuaaaacugaagauggcguaaauauguguacauuaauggcuauagacuugggcgaacucugugaagauacuauaacauauaaauguccucucuuacgucaaaaugaacccgaagacaucgauuguugguguaacucaacuucuacaugggucacauacggcacauguacaacuacaggagaacacagacgcgagaaaagaaguguagcgcuaguaccucauguagggaugggauuagaaacuaggacugaaacguggaugucgucagaaggggccuggaaacauguucaaaggauugaaacauggauucuuagacauccuggauuuacaaucauggccgcaauucuagcuuacacaauugguaccacacacuuucagagagccuuaauuuuuauucuauugacagcuguugcaccaucuaugaccaugagauguauaggaauuucgaacagggacuuugucgaagggguuagcgguggaucguggguugacauuguacuagaacacgguuccuguguaacaacaauggccaaaaauaaaccuacccuggauuucgaauugauaaaaacggaagcaaaacagccggcuacacugcgaaaauauuguaucgaagcuaaacuaacaaauacuacaacggaaucaagaugcccgacacaaggagaacccucauugaaugaagaacaggauaaaagauuuauauguaaacauucaauggucgaucgaggaugggggaaugguugcggacuguuugguaaaggaggaauaguuacaugcgcaauguucacuuguaagaaaaauauggaaggaaaaaucguacaaccugagaauuuagaauacacaauaguaauaacaccucauagcggcgaagaacaugcuguaggaaacgauacuggaaaacaugguaaagaaauuaaaauuaccccacaaucgucgacuacugaagcggaacuaaccggguauggaacuguuacuauggagugcucaccacgaacugguuuagauuuuaaugaaaugguguuacuucaaauggaagauaaagcauggcuaguacacagacagugguuccuugaucuaccuuuaccaugguuaccuggugccgauacgcagggaucuaauuggauacaaaaagaaacccuuguuacguuuaaaaacccucaugcgaagaaacaggaugucguugucuuagguagccaagaaggagcaaugcacacugcguuaacgggagcaacggaaauacaaaugagcucagguaaccuauuguuuacgggccaucugaaaugucgcuuacgcauggacaaacuucaauugaaaggaaugaguuauagcaugugcacaggcaaauucaaaaucguaaaggagauagcugaaacacaacaugggacaauagucauaagaguacaauacgagggagacgguucgccuugcaaaauaccuuuugaaauaacggacuuggaaaagcgucacguauuggggcgguugauaaccguaaauccuauaguuacagaaaaggauaguccaguaaauaucgaggcugagccuccguucggcgacaguuauauaauagucggugucgagccgggacaacuaaaacuaaacugguuuaaaaagggaagcagcauaggucaaauguucgaaaccacuaugagaggggcgaaacggauggccauacuuggugauacagcaugggauuuugguagcuuggguggaguguuuacguccaucgguaaagcccuccaucaaguguuuggagcaaucuacggugcagcauuuucaggugucucuuggacuaugaaaauacuaauugguguaaucauaacauggauugguaugaacagcagaucaacaagucuaagugucaguuuagucuuagucggaguaguaacauuauaccuaggggcuauggugcaagcagacagcggauguauuguaucuuggaagaauaaagagcuuaagugcgguucagguauuuuuaucacugacaauguacacacuuggacggagcaguacaaauuccaaccugagaguccgaguaaacuugcgucagcuauccaaaaggcacacgaagaaggcauuugugggauucguucuguaacucgacucgagaaccucauguggaaacaaauuacaccugaauuaaaccauauauuaucugaaaaugaaguuaaacuaacuauaaugacaggagauauaaagggaauaaugcaagcagguaaaagaucauuacggccucaacccacagaacuaaaauauucauggaagacuuggggaaaagcaaaaaugcuuucuaccgaaucgcauaaucaaacuuuccugauagacggaccagagacagcagaauguccuaauacuaauagagcuuggaacucgcuagaaguagaagacuacggauucgguguauuuaccacuaauauuuggcuuaaacugagagaaaaacaagauguauuuugcgacucaaaacuuaugagcgcugcaaucaaagauaauagagccgugcacgccgauaugggcuauuggaucgaaucggcacuuaaugauacauggaaaauggaaaaggcuucauucauugagguuaaaagcugccacuggccaaaaucacauacacuuuggaguaaugguguacuugaaagugaaaugaucauccccaaaaauuucgcaggaccaguaucacaacauaacuauaggccaggauaucauacccaaacagccggacccuggcaucuuggaaaauuagagauggauuucgauuuuugugaaggaaccacaguuguaguuacagaagacuguggaaacagaggucccucucuacgaacgacgacagccucaggcaagcucaucacagaaugguguugcagaaguugcacauugccaccacucagauauaggggagaagauggaugcugguacgguauggaaauccgaccacuuaaagaaaaagaagaaaaucuugucaauucauuaguuacagcuggucauggacaaaucgacaauuuuucauuaggcguacuugggauggcccuguuucuugaggagauguuacggacccguguugggacaaagcacgcaaucuugcuaguagcacuuaguuuugugacguugauuacaggcaauaugaguuuuagagauuugggcaggguuaugguuaugguaggagcgacgaugacugacgauauuggaaugggaguuaccuauuuggcacuauuggcggcauuuaaaguaagacccacuuuugcggcuggacuuuuacuaagaaaauuaacuucuaaagaauuaaugauggcuacgaucggaauagcccuauuaucacaaaguaccuuaccugagaccauucucgaauuaacugaugcccuugcguuaggaaugauggcacuuaaaauaguaagaaauauggagaaauaccaauuggcugucacuauuauggcaaucucuuguguaccgaaugcgguaauauugcaaaaugcauggaaagucaguugcacuauucuugcugcuguuucgguaagcccacuccuuuuaacaucaucacaacaaaaggcagauuggauaccacuagcguugacgauaaagggacuaaaucccacugcuauauuccuaacaacacuaucucguacaaguaagaaaaggagcuggccucuaaaugaagcgauaauggcggucggaauggucaguauauuagcuaguucucuucuuaaaaaugauauaccuaugaccggaccuuuaguagcuggaggccuucucacgguauguuauguauuaacuggcaggucugcugaucuggaacuagaacgagcggcugacguuaaaugggaagaucaggcugaaauuagcggaucgucaccaauuuuaucaauaacaauuuccgaggauggcucgaugucuaucaaaaacgaagaagaagaacagacauuaacuauuuuaauaagaacgggccuuuuaguaauaagugguguguuuccgguaagcauuccgauaacagcggcugcuugguaccuaugggaagucaagaaacaacgggcuggggucuuaugggacguaccauccccucccccagucgguaaagcggagcuagaagacggagcauauagaauuaaacagagagguauacuagguuacagucaaauuggagcgggcguauauaaagaaggcacauuccacacaauguggcauguaacacgaggggcgguucuuaugcacagaggaaagaggauagaaccaagcugggccgaugugaaaaaggaucucauaucuuacgggggaggcuggaaauuagaaggggaauggaaagagggcgaggaagugcaaguacuagcauuagaaccggggaagaacccaagagcgguucaaacaaaaccgggaauuuucaaaaccaauacuggcacaauaggagccguaucccuugacuucagcccaggaacaucgggaagucccauaguugaucguaaaggaaaagucgugggccuuuacgguaacggaguaguaacuagaucaggugcauauguuuccgcuauagcucaaacagagaaaagcaucgaagauaauccggaaaucgaagacgacauauuccgcaagaaaagguuaacaauaauggacuuacauccaggggcugggaaaacgaaaagauaucuaccugcgauaguuagagaagcuauaaaacgaggacugagaacacuaauacuugccccuacacgagucgucgcugcagaaauggaagaagccuugagaggacucccaauuagguaucagaccccagccauuagagccgaacauacggggagggaaaucguggaccuaaugugucacgcaacuuucacgaugcggcuacuuuccccaguaagaguaccaaacuauaauuuaaucauuauggacgaagcccacuuuacugacccggcgucgauugcggccagaggguacauaucaacucgaguagaaaugggcgaagcagcuggcauuuucaugaccgccacaccgccaggaucgcgagauccauucccacaaagcaaugccccaauaauggacgaagaacgagagauaccggaaaggucuuggaacucagggcaugaauggguaacggauuuuaaaggaaagacuguuugguuuguuccuucuauuaaagcaggaaaugauaucgcagcauguuuaagaaagaacggaaagaaaguuauucagcucagccgaaaaaccuuugacagcgaauacguaaaaacccgcgcgaacgauugggauuuugugguuacaacugacauaagcgaaaugggagccaacuuuaaagcugagagagugauagauccacgcagaugcaugaaaccaguaauucucacagauggcgaagaacgaguaauuuuagcaggaccaaugccaguaacacauagcagcgcagcgcaaaggcgaggaagaauuggaagaaacccuaaaaaugaaaaugaccaauacauauacaugggcgaaccuuuagaaaacgacgaagacugcgcucacuggaaggaagcaaaaauguuacuggacaacauaaauacacccgaggguauuauaccauccauguucgagccugaacgggaaaaaguugacgcaauugauggcgaguacagauugcguggugaagcaagaaagaccuuugucgacuuaaugagacguggugaucuuccaguuuggcuugcuuacaaaguagcagcugaaggcauaaauuaugcagaucguaaaugguguuucgauggaauuaaaaauaaccagauauuggaagaaaacguagagguagaaaucuggacaaaggaaggcgagcgaaagaaacucaagcccagguggcuugacgcacgaauauauagugauccacuagcguuaaaagaguuuaaagaauuugcugcuggcaggaaaaguuugacauuaaaucugauuacagaaauggguaggcugcccacguucaugacucaaaaagcaagaaacgcuuuagauaaccuggccguauuacacacggcggagguaggagguaaggcuuacacacaugcccuaucagaguuaccugaaacacucgaaacgcuguuacuacuaacccuucuagcagcuguaacuggcgggauuuuccuauuucuaaugucugguaaaggaaucggaaaaaugacauugggcauguguuguauuauaacggcgucuauucuucucugguaugcacaaauacaaccacauuggauagcagccaguauuauucuugaguucuuccuaauaguacuuuuaauuccagaaccugaaaaacaacgaacuccacaagauaaucaacucacguacguaguaauugcaauuuuaacggucguggcagcaacaauggcaaaugagaugggauucuuagagaaaacgaagaaagaccuagguuuugguucgauaacaacucaagagucugagaguaacauauuagacauagaccucagaccagcuagugcauggacacuguaugcuguugcaacuacuuuugugacacccauguuaagacauaguauagaaaacucuagcguaaaugugagucuaaccgcaaucgcaaaucaagcgaccguauuaaugggacucggcaaaggauggccucuaucaaaaauggacauaggugucccauugcuggcaauagguugcuauucccaaguuaauccgauaacacuaacagcagcacuucucuugcucguugcacauuacgcgauuauaggaccuggacugcaagccaaagcgacuagagaagcacagaaaagagcggccgccggcauaaugaaaaaucccacaguagacgggauuacuguaauagacuuagaaccuauaccuuaugauccuaaauucgaaaaacaauugggacaaguuaugcuacucauacuaugcguuacgcaaguuuugaugaugcgaacaacaugggcuuuaugugaagcauugacauuagcgacaggaccuauuuccaccuugugggagggaaacccgggacgguuuuggaauacgaccauugcaguuaguauggccaauauauuccguggaucuuauuuggcuggugcuggacuucucuuuagcauaaugaagaauacaacaaauacgagaaggggcacagggaaugucggugaaacccuaggagagaaauggaaaucgagauugaaugcuuuaggaaaauccgaauuucaaaucuauaagaaaagcgguauacaagaaguggacagaacguuggcuaaagaggguaucaaaagaggagagacugaucaccacgccgucucuagggggucugcgaaacuacggugguucguagaaagaaauauggugacgccagagggaaaaguuguagaucucggaugcggaagagguggguggucuuauuauugcggagggcugaaaaauguaagagaaguaaaaggucuaacgaagggaggcccuggacacgaagaacccauuccaaugucaacuuacgguuggaaucuaguacguuugcaaucaggagucgauguauucuuuacacccccagaaaagugcgacacuuuacuaugugacauaggggaaucaaguccuaauccgacuauugaagcaggcagaacuuugagaguauugaaccugguagagaauugguuaaacaauaauacgcaauuuugcauaaagguccugaauccuuacaugccaagcguaauagaaaagauggaaacacuacaacguaaguauggcggugcguuaguucgaaauccacugucucgaaacagcacacacgagauguauuggguaagcaaugcaaccgguaauauaguguccucgguuaauaugauuagccguaugcugauaaacagauuuacaaugaagcauaaaaaggcgacuuaugaaccagauguagaccugggaaguggaacuagaaacauagguauagaaagugagauuccuaaccuugauauaauagguaaacgaauagagaaaauaaaacaagaacaugagaccaguuggcauuaugaucaagaucacccuuauaaaacgugggcguaccacggaagcuacgaaacaaaacaaacaggcucggcgucaagcauggucaauggaguuguucggcuauuaacaaagccuugggauguaguacccaugguuacgcaaauggcaaugacagauacaacuccauuuggccagcaaaggguguuuaaagagaagguugauacuagaacgcaagaaccuaaagaaggcacuaagaaacugaugaaaaucacagcagagugguuauggaaggaguuagggaaagagaaaacaccuagaauguguacucgugaggaguucacgaggaagguucgaucgaacgcggcguuaggagcagucuucacagacgaaaacaaauggaaaucggcccgagaagcuguagaagauggcagguuuugggagcuaguugacagagaaagaaaucuucauuuagaagguaagugcgaaaccugcgucuauaauaugaugggaaaacgagagaagaaauuaggagaauuugggaaagcgaaaggcagcagagccaucugguauaugugguugggugcaagguuccuagaauuugaagccuuaggauuccugaaugaagaccacugguuuucacgggggaacaguuuaagugggguugagggugaaggucugcacagacuuggcuauauccuaagagaggucgguaagaaagaggguggagcaauguaugcagaugacacugcugguugggacacaagaauaacacuugaagauuugaaaaacgaagaaaugguaacaaaccacaugaaaggagaacauaagaagcuagcggaagcuauuuucaaauuaacuuaucagaacaaaguuguucggguucaaagaccaacaccacggggaacagugauggauauaauuucacgcaaagaccagcgggggagcggacaaguaggcacuuacggccuuaauacuuucaccaauauggaagcgcaacuuauaagacaaauggagggagaaggaauauucaagagcauccaacauuuaacagcaacggaagagauugcagugcaaaacugguuagcucgagucggucgugaacgauuaagucguauggcuauuuccggagaugacuguguuguaaagccgauagaugacagguucgcaucagcuuuaacggcuuuaaaugauaugggaaagguacgaaaagacauccaacaaugggaaccgucacgcgguuggaacgauuggacccaaguuccuuuuuguucacaccauuuccacgaacucguuaugaaagauggucgagugcuuguaguaccuuguaggaaucaagacgaauugaucggccgugcacgaauaucacaaggagcugguuggagucucaaagagacggcaugucucggaaaaucauacgcucagauguggacacuuauguauuuucacagaagagaucuucguuuagcagcaaacgccaucuguucugcaguaccuucacacuggguaccaacguccagaacaacguggagcauccaugcaaaacaugaauggaugacgacagaagauaugcuagccguauggaaccguguauggauccaggaaaaucccuggauggaggauaaaacgccaguggaaucaugggaggaagugccuuacuuaggcaaaagggaagaccaguggugcggcagcuugauaggauuaacaaguagagcgacaugggccaagaauauccaaacagcaauuaaucaagucagaucuuugaugggcaaugaaggauauaccgacuauaugcccagcaugaagagauuuagaagagaggaagaagaagcggguguucuaugguga

SEQ ID NO: 22278 - RNA, 9876 nt, Artificial Sequence
  derived and/or modified CDS sequence (opt6) from DENV-2__GQ868551__SS-prME
acugcaggcguaauagucaugcuaauaccaacagcaauggccuuccaccucacgacuagaaacggggaaccucauaugauuguugggagacaagaaaaagguaagucucuucuauucaaaacugaagaugggguaaauaugugcacacuuauggcaauugauuuaggagaauuaugugaagauacaauuacuuauaaauguccucucuuaagacagaacgagccggaggauauugauuguugguguaauaguaccagcacauggguuacauacgguacaugcacaacuacuggagaacaccgaagagaaaaaagaaguguagcacuagugccccaugucggaaugggucucgaaacacgaacagaaacuuggaugucgagugaaggagccuggaaacacguacaaagaauagaaaccuggauccugagacacccaggauuuacgauuauggcagcuauacuggcguacacaaucggcacgacacauuuucaacgcgccuugauauuuauauugcuuacggccguagcgccgucaaugacuaugagguguaucgguauaucgaaccgcgacuucguagaggguguaaguggggggagcuggguagacauaguucucgaacacgguagcuguguaaccacaauggcuaaaaauaaacccacguuagacuuugaacuuauaaagacagaagcuaaacaaccagcuacucuaaggaaguauugcaucgaagcaaaguugaccaauacuacaacagaaaguagauguccaacacaaggcgagccuagucugaacgaagaacaagauaagcgcuuuauauguaaacauagcaugguggaucgaggaugggguaacggauguggccuuuucggaaaaggagguauuguaacaugugcuauguuuacuugcaagaaaaauauggagggaaaaauaguccaaccagagaauuuagaauauacaaucguaauuacaccucacucuggggaggaacacgcaguaggaaacgauaccgguaaacacgguaaagaaauaaaaauaacuccacagagcaguacgacugaagcggaacucacagguuacggcacaguaacgauggaaugcaguccgcggacagguuuagauuucaaugaaaugguauuacuacaaauggaagacaaggcauggcuaguccauaggcagugguuucuagaucucccuuugccguggcuacccggggccgacacacaaggaaguaacuggauacagaaagagacccucguaacuuuuaaaaacccucaugcuaaaaaacaagauguaguaguauuaggcagucaagaaggagcuaugcauacugcuuuaacaggagccacggaaauucagaugucaagugguaauuuguuguucaccgggcauuugaagugcagauuacguauggauaaacuucagcuaaaagggaugagcuacucaauguguacgggaaaguuuaaaauagugaaagagauagccgaaacucagcauggaacaauuguuauaaggguacaguacgaaggagacggaucaccaugcaaaauaccauuugaaauaacagaccuggagaaaagacacguacucggaagacuuauaacuguuaauccaauaguaacagagaaagauaguccugugaauauagaggcagagccgccauuuggggauucuuacauaauaguggguguggagccaggacaauuaaaacuuaacugguuuaaaaaaggaaguagcaucgggcagauguuugaaacgacaaugcguggcgcaaagcgaauggcgaucuuaggagauacagcaugggacuucgguagccuaggagguguauuuacgagcaucggaaaagcacuacaucaaguuuuuggcgcuaucuacggagcagcguuuagcggagucaguuggacgaugaagauacucaucgggguaauaauuacuuggauaggaaugaacaguagaucaacaucacucucagugagucugguauuaguagggguaguaacauuauauuugggcgcgaugguacaggcagauucuggauguauuguuucauggaaaaacaaggaauuaaaaugcggaagcggaauauucauaacggacaauguucauacauggacagagcaauacaaauuucaaccugagagcccuucuaaauuggcaucagcaauccagaaagcacacgaggaaggcauuugcggaauacgcaguguaacacgacuagaaaacuuaauguggaaacagauaacaccagaacuaaaccacauauuaagugaaaaugaagucaaacugaccauaaugacuggagacaucaaaggaauaaugcaagccggaaaaagaagucugcgaccucaaccaacugaauuaaaauauuccuggaaaacgugggguaaaguaaaaaugcuuaguacagaaagucacaaccaaacauuuuuaauugauggccccgaaacagcugaauguccgaacacaaaccgcgccuggaacucacuugaaguggaagacuauggcuuuggugucuuuacuacaaacauaugguuaaagcucagagagaaacaagauguuuuuugcgacucaaaacuaaugagugcugcgauaaaagauaacagagccguucacgcugauaugggauacuggauugagagugcgcuuaaugacacauggaaaauggagaaagcaucauucauagaaguuaaaaguugucauuggcccaaaagucacacgcuauggagcaacggugucuuagaaucugaaaugauaauuccaaagaauuucgcugggccggucucacagcacaacuauagaccaggcuaccauacacagaccgcaggaccauggcauuuagggaaauuagagauggacuuugacuucugcgaggguacaacuguuguggugaccgaagauuguggaaacagaggaccaucgcuacgaaccacaacagccuccgggaaacucaucacagaauggugcugucguagcuguacacuuccaccauuaagguacagaggagaagacgguugcugguacggaauggaaauacgucccuuaaaagaaaaggaagaaaauuuggugaauagucugguaaccgcaggucauggucaaauagacaauuuuucucuugggguacuugguauggcacuauuccuugaagaaaugcuacgaacaagaguagguacaaagcaugcaauauuguuaguugcacucagcuuuguaacacuaauaacaggcaacauguccuuuagagaccuagguagaguaaugguuaugguaggagccacaaugacugacgacauaggaauggggguaacauaucucgcccuucucgccgcauucaaggugagaccgacuuucgcugcugguuuacuacuacgcaaacucacgucaaaagaauuaaugauggcaacuauugguauagcgcuauuaucacaaucaacacuaccagagacaauacuggaacuaacagaugcuuuagcauugggaaugauggcacugaaaauuguacgcaacauggaaaaguaucaacuagccgugacaaucauggcgauuucauguguaccaaacgcaguaauauugcagaacgcguggaaaguuaguuguacuaucuuagcugcagucaguguauccccccuauugcuaaccucgagucaacaaaaggcugacuggauaccacuagcuuuaacaauaaaaggacugaaccccacagcgauauucuuaacaacauuaucaagaacuagcaaaaaacggaguuggccacuuaaugaggcaauaauggcuguaggcauggugaguauacuagcaucgucucuccugaaaaaugacauaccaaugacaggaccccugguugccgguggucuacuaacgguuuguuacguauuaacgggucgcucggcugaucucgaacuagagagagcugcagacgugaaaugggaagaccaagcggaaauauccggcucauccccaauauuaucaauuacaauuucagaagaugggaguaugucaauuaaaaaugaagaggaagagcaaacacuaaccauccuaauccgcacuggauugcuuguaauauccggcguuuucccuguaucaauuccaauaacagcagcagcgugguauuuaugggagguuaagaaacagagagcugggguacucugggacgucccaucaccccccccagucgguaaggccgaauuagaggauggcgcuuauagaauaaagcaaagaggaauuuuaggcuauagccaaauaggcgcuggugucuacaaagaaggcacauuucacacuauguggcacguaacgcgaggagcugugcuaaugcauagagggaaacgaauagagccuagcugggcagaugugaaaaaggaucuaauuaguuauggaggggguuggaaacuagaaggugaauggaaggaaggagaagaaguucaaguuuuagcucuagagccuggcaagaaucccagagccguacagacaaagccugggauauucaagacuaauacggguacaauaggagccguaucuuuagauuuuuccccggguacaaguggaucgccgauaguagaucgaaaaggaaaagucguaggccuguaugguaaugguguaguuacaagaucaggcgccuacgugucagcaauugcucagacagaaaaaucuauagaggauaauccugaaauugaagaugauauauuccguaaaaagcgacugacaauaauggaucuacacccgggagcugguaaaacaaagcgcuaucucccagcuauagucagagaagcaauaaagagaggauuaagaacccuaaucuuagcuccaacaagggucguagcugcagaaauggaagaagccuuaagaggcuugccgauacgcuaucaaacaccagcaaucagggcagagcauacaggcagagaaauaguugaucugaugugucacgcgacuuucacaaugcgccuucucaguccuguucguguaccaaacuacaacuugauuaucauggaugaagcacacuuuaccgacccggcaucaauugcagcaaggggguauauuagcacacggguugaaaugggagaagcagcggguauauuuaugacagcaacaccuccaggaucccgagauccuuucccacaaucgaaugcaccaauaauggaugaagaaagagagauccccgaaagaucuuggaacucagggcaugaguggguaacggacuuuaagggaaagaccguuugguucguccccaguauaaaggcaggaaacgauaucgcugccugcuuacgaaaaaacggaaagaaagucauucaacuuagccgcaaaacauuugauucugaguacguaaaaacuagagcaaaugacugggauuuuguaguuacaaccgauauuagugaaaugggugcuaauuuuaaagcagaacguguuauagacccuagaagguguaugaaaccaguaauauuaacugauggugaggaaagaguuauauuagcaggacccaugcccguuacccacucaucugcagcgcaacggcgaggcagaauaggccguaacccaaaaaaugaaaaugaccaguauauauacaugggagaaccucuggaaaacgaugaagauugcgcccauuggaaagaggcgaaaauguuacuugauaacaucaauacuccagaaggaaucauaccauccauguucgaaccggaaagggaaaaaguggacgcaauagauggugaauacagauugagaggcgaggcucgaaaaacauucguggaccuaaugcgacgaggagauuugccagugugguuagcguauaaaguggccgcugaagggauaaacuacgcagaccgaaaaugguguuuugaugguaucaaaaauaaucaaauccuugaggaaaacguggaaguagagauauggacgaaagaaggugaaagaaaaaagcugaaaccucgcuggcuagacgcccguauuuacuccgacccccucgcauugaaagaguuuaaagaguucgccgcugggcguaaaagcuuaacacucaaucuaaucacggaaauggguagacucccaacuuuuaugacacaaaaagcccgcaacgcgcucgacaacuuagccgucuuacacaccgcagaaguaggggguaaggcuuauacacacgcuuuaagugaacucccagaaacuuuagaaacauuauuguugcuaacucuacuagcugcagugacgggcggcauauucuuauuuuuaaugucuggaaaaggcauugggaagaugaccuuaggaauguguugcauaauuacugcaaguauucucuugugguaugcucaaauacaaccucauuggauugcggcguccauaauauuggaguuuuuccuaauugucuuacugauaccugaaccggaaaaacaaagaacgccucaggacaaucaacuaacguaugucgucauagccaucuuaacuguaguggcagcaacaauggcaaacgaaauggguuuuuuagaaaaaacgaaaaaagaucuaggauuuggaucaauuacaacacaagagagugaguccaacauacuagauauugacuuaagaccugcaagugccuggacacuauaugcaguagcaacuacuuuuguaacucccauguuaaggcacucaauugaaaacaguuccgucaacguaucucuuacagcuaucgcuaaucaggccaccguauuaauggguuugggaaaagguuggcccuuaaguaaaauggacauaggugugccucuacuagcaauuggcuguuacucgcaagucaacccuauaacacuaacagcagcauuauuacuacuuguagcucauuacgccauuaucggucccggauuacaggcuaaagcaacucgagaagcccaaaagcgagcugccgcgggcauuaugaaaaacccgacgguagauggcaucacaguaauugaucucgaaccuauaccguacgacccaaaauucgaaaaacaacuuggacaagugaugcuuuuaauccuuuguguaacccaaguauuaaugaugaggacgacaugggcuuugugcgaagcacuaaccuuagcaacaggaccaaucagcacacuaugggaagguaacccuggacgauuuuggaacaccaccauagcuguuagcauggcgaacauauuccgaggaucauacuuagcaggcgccggacuacuuuucucaauaaugaaaaacacgacaaauacgcgucgagguacugggaacguaggagaaacauugggagagaaauggaaaucucgcuuaaaugcacuuggaaaaagcgaauuucaaauauauaagaagucagggauccaagagguugaucgaacccuagcuaaagaaggaauaaaaagaggagaaacugaccaucacgcagugucaagaggauccgccaaauuaaggugguuuguagaacguaacauggugacuccagaaggaaaggucgucgauuuaggauguggaagaggugguuggaguuauuauugcgguggauuaaaaaaugugagagaggugaaaggauuaacaaaaggcgggccaggacacgaagaacccauucccaugucgacauaugguuggaaccugguaagacuucaaaguggugucgauguuuuuuucacuccuccagaaaaaugugauaccuuacuaugcgacaucggagagucaaguccuaacccuacuauugaagcuggcagaacucuuaggguacugaaccucguugaaaauugguugaauaauaauacacaauuuugcauaaaagugcuaaacccauauaugccgagugugaucgaaaagauggaaacuuuacagagaaaguaugggggagcauuaguacguaauccauugucucgaaauaguacacacgaaauguacugggugucuaaugcaaccggcaauauagucagcucaguaaacaugauuagcagaaugcuuauaaacagguucaccaugaaacauaaaaaagcaacuuaugaaccagauguagaucugggauccgguacacgaaauauaggaauugaaucagaaauacccaauuuggauauaauagggaagagaaucgaaaaaaucaagcaagagcacgagacuucguggcauuacgaucaagaccacccguacaagacgugggcuuaucaugguucauacgagaccaaacaaacagggagugcauccuccauggucaauggcguuguucgauuacuaacaaaaccgugggacguaguaccgaugguaacucaaauggcaaugacagacacgacgccguucggucagcaacgagucuuuaaggaaaaaguugacacgaggacacaagaaccaaaagaagggacaaaaaaacuaaugaagauuacugcagaaugguuauggaaggagcuugguaaagaaaaaacaccccgaauguguacacgggaagaauuuacacgcaagguucgaucuaaugccgcucucggugcuguguuuacugacgaaaauaaguggaaaucggcaagagaagcagucgaagacggacguuuuugggaauuaguugaccgugagagaaacuugcauuuggaggguaaaugcgaaacaugcguguauaacaugauggggaagcgagaaaaaaaacuuggcgaauucggaaaggcaaagggaucaagggcaaucugguacauguggcuaggugcuagguuuuuagaauucgaagcgcuagguuuucugaaugaggaccacugguuuagccgaggcaacagucucagugguguugaaggcgaaggguuacaucggcuaggauauauccuccgagaaguagguaagaaggaaggaggagcuauguaugcggacgauacggcuggaugggauacucgaauaacuuuagaagaccuaaaaaaugaagaaauggucacgaaucauaugaaaggagagcacaagaaacuagcagaagcgaucuucaaguuaacauaccagaauaaagucgugagaguacaaaggccuacgccaagaggaacaguuauggauauaaucaguagaaaagaccaacgcggaucgggacaaguggguacauauggcuuaaacacauucacaaacauggaagcacaacuuauaagacaaauggaaggagaagggaucuuuaagaguauacaacaucuaacugcuacugaagagauagcaguacaaaacuggcuagcaaggguaggaagagaaaggcugucaagaauggcaauaucaggugacgacugugucguuaaaccuaucgaugaccgguucgccuccgcuuugacggcucuaaaugauauggguaaaguccgcaaggacauccagcagugggaaccuagccgugguuggaaugauuggacucaggucccguuuuguagucaccacuuucacgaauugguaaugaaagacggcagaguauugguuguuccgugucgcaaucaggaugaauuaauaggccgagcuaggauuagucaaggcgccggauggucauugaaggaaacagcaugucucggcaaaagcuaugcucaaauguggacuuuaauguauuuucauaggagagaccuaagauuggcagcuaaugccaucugcucugcgguaccgagccauuggguaccaacaagucgaacaacuuggucgauccacgcaaaacaugaauggaugaccaccgaagacaugcuggcuguauggaaucgcguauggauccaagaaaauccauggauggaagacaagaccccaguggaaucuugggaagaaguaccguauuuagggaaacgggaggaucaauggugugguagucugauuggucugacaaguagagcaacaugggcaaaaaauauucaaacagcaauuaaucaaguuagaucuuuaaugggaaaugaagguuacaccgacuacaugccuucuaugaagcgguucaggagagaagaggaagaagcuggaguccucugguag

SEQ ID NO: 22279 - RNA, 9876 nt, Artificial Sequence
  derived and/or modified CDS sequence (opt6) from DENV-2__HM181971__SS-prME
accgcagggguaauaguaaugcuaauuccuaccgcaauggcuuuucaucugaccacuagaaauggggagccacacaugauaguaggaaggcaagaaaaagggaaaaguuuauuauucaaaacagaagacggggugaauauguguacucuuauggcaauugaccuuggcgaauuaugugaagauacaauuacauauaaauguccucuguuacgucagaaugaaccagaagauauagacugcugguguaauucaacuucaacauggguuacauacggaacauguacuacaacaggagaacacaggagagaaaaacgcucagucgcuuuaguuccgcacguuggcaugggccuagaaacuagaacagaaacguggaugaguucagagggagcauggaaacaugugcaaagaaucgaaacauggauacuccgacauccgggauuuaccauaauggcugcaauucuugcguauacuauagguacaacgcauuuucaacgugcgcuaauauucauucuacuaacggcgguagcaccuucaaugacaaugagaugcaucgggauuagcaacagagacuuuguagaaggcguuaguggcggaucgugggucgauauaguccuagaacauggcucuuguguaacgacaauggccaaaaauaaaccgacauuagacuuugaacuuauaaaaacagaggcaaaacaaccggcaacccuacggaaguauugcaucgaagcuaaguuaacaaauacaacaacagaaucaagauguccaacacagggugaaccaagccucaacgaagaacaggacaaaagauuuauuugcaagcacaguaugguugauagaggguggggaaaugguugcggucuuuuugggaaaggaggaauaguuaccugcgcaauguucacauguaaaaagaacauggagggaaaaauagugcaaccagaaaacuuggaauauacaauaguaauaacuccucauucaggagaagaacaugcaguaggaaaugauacaggaaagcauggaaaggaaauaaaaauuacuccacaaaguaguacaacagaagcagaauuaacagguuaugggacaguaacaauggaaugcaguccgcggacggguuuagauuucaaugaaaugguauuauugcaaauggaagauaaggcaugguugguccaccgacagugguuucucgacuugccacuaccauggcuuccaggugcggauacacaagguucaaauuggauccaaaaagagacauuaguuaccuuuaaaaauccccaugccaagaaacaagaugucguaguauuagguagucaagaaggugcaaugcauacggcgcucacuggggcuaccgaaauccaaaugucaagugggaaucuccuauucacgggacaucucaaauguagauuaagaauggacaaacuccaacucaaggguaugaguuauucuauguguacuggcaaauucaaaauaguaaaggagauugcagaaacgcaacauggaacgauugugauacggguucaauacgagggggaugguuccccaugcaagauuccauuugaaaucacugaucuugagaaaagacacguacuaggaagauuaaucacaguuaacccgauagucaccgaaaaagacaguccuguaaacauagaggcagagccgcccuuuggagauaguuacaucauagucgggguagaaccaggacaauuaaaauugaacugguuuaagaaaggauccaguauaggacagauguucgaaacuacgaugcguggggcaaaaagaauggcaauauuaggagauaccgcaugggauuuuggaaguuuaggcgguguauucacuucaauaggcaaggcguuacaccaaguauucggagcaaucuauggggcagcguuuuccggaguaucauggacuaugaaaauucuaauuggggugaucauuacguggauaggaaugaacucgcguucaacgucccuauccguaagucuuguacuuguugguguaguaacucuguauuuaggggcuaugguucaagcagacaguggauguauugugagcuggaaaaacaaggaauuaaaaugugggaguggaauuuuuauaacggacaacguacauacauggacagagcaauacaaguuucaaccagaaucccccagcaaacucgcaagugcuauucaaaaggcacacgaagaggggauuugcgguauaagaagcgucaccagauuagagaaucucauguggaagcaaauaacuccagaauugaaucacauuuuaucagaaaaugaagugaaacuuacgaucaugacaggagauauaaaagguauuaugcaagccgguaaacgaaguuuaagaccucaacccacagaacuaaaguauucauggaagacuugggguaaagcgaaaauguuaaguacagaaucucauaaucaaacguuccuuauagauggaccugaaacagcggaauguccaaacacaaacagagccuggaacucacuggaaguagaggauuauggcuucggcgucuucacuacaaauauuugguuaaaacuccgagaaaaacaagacguguucugcgacucaaaauuaaugagugcggcaauuaaagauaaucgugcuguucaugccgacaugggcuauuggauagagucagcgcuaaacgauacuuggaaaauggaaaaagcaaguuuuauagaaguuaaaaguugucacuggccaaagucucauacacuauggucaaaugguguucucgaaucugaaaugauaauccccaaaaauuucgcugguccaguaucccagcacaacuauagaccaggguaucacacacaaacugcagguccguggcacuuaggaaaacuggagauagacuuugacuuuugcgagggaacuacuguggucgugacagaggauugcggaaauaggggaccaagucuccguacgacgacagcuucuggaaaauuaauaacagagugguguugcagaucuugcacccuacccccgcugagauacagaggagaggauggauguugguauggaauggaaauacgcccauugaaggaaaaagaagaaaaccuaguaaauucuuuaguaacugcuggacacggccagauagauaacuuuucauuagguguauugggcauggcucuauuuuuagaagaaaugcugagaacucguguagguacgaaacaugcuauacucuuagucgcccuauccuuuguuaccuugauuacagggaauaugucguucagagaucuagguaggguaauggucaugguaggagcaacuaugacugaugacauaggcaugggugucacauauuuggcacuauuagcagccuucaaagucagacccacguuugccgcgggcuuacuacugagaaaauuaacaucaaaggaacucaugauggcuacgauagguauagcacuacuuucucaaagcacccugccugaaacaauacucgaauuaacagaugcucuagcuuuagggaugauggcccuuaaaauugucagaaacauggaaaaauaccaauuggcgguaacuaucauggcgauaaguugcguuccgaaugcaguaauauuacagaaugcuuggaaaguuuccugcacuauauuagcagcagucucugugucuccacuuuuacugacaaguucacagcagaaagcggauuggauccccuuagcccugaccauaaaagggcugaauccaacagcuaucuucuuaacaacauuaucccggacgagcaagaaaaggucuuggccauuaaaugaggcuauaauggcaguagggaugguuuccauccuugcuucuagccugcuuaaaaaugacaucccgaugacuggaccccuaguggccgggggacuguugaccguuuguuaugugcuuacaggaagaagugcugauuuggagcucgaacgugcagcagaugucaaaugggaggaccaagcagaaauaucaggaucaucuccaauuuugaguaucacuauuucugaagauggaucgaugaguaucaaaaaugaggaggaagaacaaacgcuaacaauacuuauucggacugggcuauuaguuauaucaggaguguucccagugucaauaccaauuacagcggcugcaugguaucugugggaaguuaagaaacagagagccggcguucuaugggauguacccagcccaccacccguagguaaggcagaguuggaagauggcgcauauaggauuaaacagcgagguauucucgguuacagccaaauaggagccgguguauauaaagaaggaacguuucauacaauguggcauguaacaagaggggcagucuugaugcacagggguaagcguauagagccaagcugggcagacgucaaaaaggaucuuauaucuuacggagguggauggaagcucgaaggugaauggaaagaaggagaagaaguacaaguucuagcuuuggaaccaggcaaaaauccaagagcugugcaaacgaaaccgggcauauucaagacaaauaccgguacuauaggugccguaucuuuagacuuuagccccggaacgagcggaucaccuauuguagauagaaaaggaaaagugguuggucuguacggaaauggaguggucacccggaguggggccuaugugagugcaauugcgcagaccgaaaaaucaauagaagauaacccugaaaucgaggaugauauuuuuaggaagaaaagauuaacuauaauggauuugcauccgggagcuggcaaaaccaaaagauaucucccagcuauuguucgugaagccauaaaaaggggacuaaggacauuaauauuagcgccaacuagagucguagcagcagagauggaagaagcacuacguggacuaccgauacgauaccaaacacccgcaauacgggcagaacauacuggccgugaaauaguggaucuaaugugccaugcgacauucacaaugcgauuacuaagcccuguaaggguuccgaacuacaaucugauuauuauggaugaagcacacuuuacagauccugcuucaaucgcagcucggggauacauuucaacgaggguagagaugggagaggccgcugguauauuuaugacugcuacgcccccuggaucgcgagacccauuuccacaauccaaugcaccaauaauggacgaggaaagagaaaucccggagagaucuuggaacuccggacaugaauggguuacagacuuuaaaggaaaaacggucugguucgugccauccauuaaggcggguaaugauauagcugcaugccuaaggaaaaacgggaagaaaguaauacaacuaucucggaaaacauucgacucagaauaugucaagacaagagcaaacgacugggacuuugucguaacaaccgauauuucggaaaugggugcuaacuucaaggccgagcgaguuauugauccucgucgcugcaugaaaccaguaauccucaccgauggcgaggaaagagucauacuugcuggaccuaugccaguaacacacaguagugcagcacagcguagggggagaaucggacgaaaucccaaaaacgaaaaugaucaguauauuuacaugggugaaccauuagagaacgaugaagauugcgcgcauuggaaggaggccaaaaugcucuuagauaauauuaauacacccgaaggaaucauaccgaguauguuugaacccgaacgugagaaaguagaugcaauagauggagaauaucguuuaagaggcgaagcacgcaaaacguucguugaucucaugaggaggggugacuugccuguauggcuugcauauaaggucgcggccgaagguauuaacuacgccgacagaaaaugguguuuugacggaaucaaaaacaaccaaauucuggaagaaaacgucgagguugaaaucuggaccaaagaaggugaacguaagaaacuaaaaccgcguuggcuagaugcgcgaauuuacagcgacccauuggccuugaaggaauuuaaagaauuugccgcuggacgaaagucauuaacccuaaauuugaucacagagaugggaagacuucccaccuucaugacccagaaagcaagaaacgcuuuggacaaucuggccguacuucacacggcugaaguaggugguaaagcguauacccacgcacuuucagaacugccagaaacgcuggaaacacuacuucuauugacguugcuggcugcggucacagggggaauauucuuguuuuuaaugucuggcaaaggaauagguaaaaugacguuaggaauguguugcaucauuacagcaagcauacuauuaugguaugcucaaauucaaccacacuggauagcagcaaguauaauuuuagaguucuuuuuaauuguacuauuaaucccagagcccgaaaaacaaagaacgccucaagacaaucaacucacauacguagucauagcuauauuaacaguagucgccgccaccauggcaaaugagauggguuuccucgagaaaacgaagaaagacuuaggauucggaagcauaacgacgcaagaaucagaaaguaauauacucgauauagaucuaagacccgcaucagcauggacauuauaugcaguugcaacgacuuucguaacaccaauguuacgacacucgauagaaaacucaagcguaaauguuagcuuaacagccauugcuaaucaggcaacuguguuaaugggacuggguaaagguuggccgcuaagcaaaauggacauaggcgugccucuucuugccauaggguguuauagucaagugaaccccauaacauuaacggcagcauugcuauuacuggucgcacauuacgcuauaaucggaccaggacuccaagcaaaggcuaccagagaagcgcagaaacgugcagcagccgggauuaugaaaaaucccaccguagaugggauuacaguaauagaucuagaaccuauaccauacgacccuaaauucgaaaaacaacuuggacagguaauguuauuaauuuuaugcguaacgcaaguuuuaaugaugcguaccacaugggcacuaugcgaggcauuaacccucgcaacggguccuauuaguacuuuaugggaggggaauccugggagauucuggaacacuacuauagcgguguccauggcgaauaucuuccgaggaaguuacuuggcgggggcgggccuauuauuuaguauuaugaagaauacaaccaauacucgucgcggaacagggaacguaggggaaacccuuggagaaaaguggaagucucgacuaaacgcccuuggaaaaagcgaauuucaaauuuacaagaaaagugguauacaagaaguagauagaacguuagccaaagaagggauaaaacggggagaaacugaccaccacgcagugaguagaggaagcgcuaaauuacggugguuugucgaaagaaacaugguaacucccgaagggaaaguaguugauuuaggauguggaagaggaggauggaguuacuauuguggagguuugaaaaauguaagagaaguaaaaggacuaacgaagggagggccaggucacgaagaaccaauaccaaugucaaccuauggcuggaaucuaguacguuuacaauccgguguagacguguucuuuacgccacccgaaaaaugugacacauuauuaugcgacaucggagagagcuccccaaauccuacaauagaggcuggccgaacgcucaggguccuaaaucuuguagaaaauugguuaaauaauaauacccaguuuuguauuaaaguacugaauccauauaugccaagcgugauugaaaagauggagacccuucaacggaaauacgggggagccuugguacgaaauccccugaguagaaauaguacccacgaaauguauuggguuucaaacgcaacugggaacauuguguccagcguaaauaugauuucgcgaaugcuuaucaauagguucaccaugaagcauaagaaagccaccuaugaaccagacguagaccucggaaguggcaccagaaacauaggaauagaaagcgagaucccuaaucuugauaucauaggaaaaaggauagagaagauaaaacaagagcaugaaacuucguggcacuacgaccaggaccauccauacaaaaccugggccuaucacgguagcuacgaaacuaaacaaaccggaucugcuaguaguauggucaauggaguaguaagacuccuaacaaaaccuugggacgucgugccaaugguaacccaaauggccaugaccgacacaacaccuuuuggacaacagagaguuuuuaaagaaaaaguugacacuagaacacaagagccuaaagaaggaacgaagaaacuaaugaaaauaacagcagagugguuguggaaagaacuugguaaagagaagacaccgaggauguguacaagagaagaauuuacaagaaaaguacgaaguaacgcggcguuaggggcaguuuuuacagaugaaaacaaauggaagucggcccgugaagcgguugaagacggaagauuuugggagcucguagauagggaacgaaacuuacaucuagaaggaaaaugcgagacuuguguuuauaauaugaugggcaaaagagagaagaaacuaggagaauuuggcaaggcuaagggcagccgggccauuugguauauguggcuuggcgcucguuuucuagaauuugaagcucuaggauuccuaaaugaagaccauugguuuucuagaggcaauuccuuaucugggguggaaggagaaggauugcaucgccugggauacauacuucgugaaguuggcaagaaagaggguggugcaauguaugcagaugacacugcuggaugggacacccgaaucacacuugaagaucucaaaaacgaagagaugguaacaaaccauaugaaaggcgaacacaagaaacuugcagaagcuauauuuaaauuaacauaucaaaauaaaguaguacgaguacaacguccgacaccacggggaacaguaauggacauaauuucacgcaaggaucaacguggaagugggcaaguagggacuuauggauugaacacauuuacaaauauggaagcucaauuaauccgacagauggaaggagaaggaauauucaaaagcauccaacaucuaacagcaacggaagaaaucgcuguccaaaauugguuagcucgaguaggccgugaaagauugaguagaauggcaauuucaggugacgauugugugguaaaaccuauagacgaucgauucgcgagcgcucuaacugcuuuaaaugacauggguaaaguaagaaaagauauucaacagugggagcccucacgagguuggaaugacuggacgcaaguuccguucugcucccaccauuuucaugaauuaguaaugaaagacggaagaguccucgugguuccuugcagaaaccaagaugaauugauugguagggcccguauuucgcaaggagcagguuggucauuaaaagagaccgcauguuugggaaaaucuuacgcacaaauguggacauuaauguacuuucauagacgagacuugagauuagcagcaaaugcuauauguuccgcugugcccagucacuggguaccuacaagucguaccacuuggucaauucaugcuaaacaugaauggaugacaacagaagacaugcuagcgguauggaacagaguguggauucaagagaacccguggauggaggacaagacaccaguagagaguugggaagaagucccguauuuaggcaaacgagaggaucaauggugugguucuuugauuggauuaacgagccgugcaacgugggccaaaaauauucagacagcuaucaaccaagugaggucauuaaugggaaacgagggauacacugauuauaugccauccaugaagagauuuagacgggaggaggaggaggccgguguucucugguaa

SEQ ID NO: 22280 - RNA, 9876 nt, Artificial Sequence
  derived and/or modified CDS sequence (opt6) from DENV-2__GU131881__SS-prME
acagcggguguuaucguuauguugauucccacggcaauggcauuccacuuaacaacuagaaauggagaaccgcacaugauuguaggacgccaagaaaaagggaaaaguuuguuauuuaaaaccgaagacggggugaauauguguacacugauggcaauugauuuaggcgaacuuugugaagacacuauaaccuauaaaugcccacuauuacggcaaaaugaaccagaagauauagauugcugguguaauucgacuucaaccuggguaacuuacggcacaugcacuacuacuggcgaacaccgucgagagaaaaggucagucgcacucguuccgcaugucggaaugggucucgaaacucguaccgaaacuuggaugaguucagaaggugcuuggaaacaugugcaaagaauagaaaccuggauauuacgacacccugguuuuacgauaauggcggcaaucuuagcuuacacaauugggacaacacacuuccagagagcucuaaucuucauacugcuuacggcaguagcacccaguaugacgaugagaugcauuggaauuucaaaucgagauuucguugaaggaguaucgggcgguagcuggguugauaucguucuagaacauggaucuuguguuaccacgauggcuaaaaauaaaccgacccuugacuuugaauuaauaaaaacagaagcgaaacagccagccacauuaagaaaauauuguauagaagcaaaacuuacgaauacuacaacggaaucuagaugcccaacucaaggagaaccgucccuuaacgaagaacaagacaaaagauuuauaugcaaacauucaaugguugaucgcggauggggaaacggauguggccuauuugguaaaggagggaucguuacaugugcuauguucacaugcaagaaaaacauggaaggaaaaauuguucagcccgaaaauuuagaauacacuauagugauaaccccucauaguggcgaagaacacgcaguagguaaugauacaggaaaacauggaaaagaaauaaaaaucacaccacaaagcucaacaaccgaagcggaauuaacuggauauggaacaguaacaauggaaugcucaccuaggacgggguuggauuuuaaugaaauggugcugcuucaaauggaggauaaagcauggcugguacacagacaaugguuuuuagaccuaccacuucccugguuacccggugcggacacacaaggaagcaauuggauacagaaagagacuuuaguaacauucaaaaacccacaugcgaagaaacaagauguaguuguacuagguucacaggaaggugcaaugcauacugcacucacuggggcuacagagauucagaugucaaguggcaauuuguuauuuacgggacauuugaaaugcagguuacguauggauaaauuacaauuaaaagguaugaguuauucgaugugcacgggaaaguuuaagauagucaaggagaucgcagagacccaacauggcacgauuguaauuagagugcaguaugaaggcgacgguucgccuugcaaaauacccuuugaaauuaccgaucuagaaaaacgacacgucuuaggacguuugauuaccgugaaccccauaguaaccgagaaggauucaccaguaaacauagaagccgaaccuccuuucggagauuccuacauuauugugggcguagaaccuggucaauuaaagcucaacugguucaagaaagguucuagcauuggacaaauguuugagaccacaaugcggggugcuaaacgcauggcuauacuaggggauacggcaugggauuuuggcagucuagguggcguauuuacgucaauuggcaaagcacuucaccaaguuuuuggagcuauauauggugcagcuuucucaggggucucuuggacaaugaaaaucuuaauuggaguaauuauuacguggaucggcaugaacucacgaucuacaucuuuaaguguuucuuuaguauuaguagguguuguaaccuuauauuuaggagcaaugguacaagccgauagcggauguauagucaguuggaaaaacaaggaguuaaaaugugguuccggaaucuuuauuacugauaacgugcacacauggacagagcaguacaaguuucaaccugaaaguccuagcaaauuggccucagcuauucaaaaagcucaugaagagggaauaugcgggauucgcucagugacaagacuugaaaaccugauguggaagcaaauaacaccugaacuaaaucauaucuuaagcgaaaaugaagucaaauuaacaaucaugacaggugauaucaagggaauuaugcaagcagggaaaagauccuuaaggccucaaccuacagaguugaaauacucauggaaaacguggggaaaagcuaaaaugcuaaguacagaaagucacaaucaaacuuuccuuaucgacgguccagagaccgcagagugcccuaacacaaaucgagcguggaacucauuggaaguagaagacuacggauucgggguauuuacuacuaauauuuggcuaaagcugagagaaaaacaagacguauucugugacucuaaauuaaugucagcagcgauuaagaauaauagggccguccaugcugauaugggguauuggaucgaaucggcacuaaacgacacuuggaaaauggaaaaggcuucuuucauugaagucaaaaguugucacuggccaaaaucccacacguuauggucaaauggugucuuagaauccgaaaugauaauaccgaagaauuuugcuggcccaguaagccaacacaauuaucggccgggcuaucauacucagacugcugguccuuggcaucuaggaaaauuagagauggacuuugauuucugcgaggguaccacggugguuguuacugaagacugcggcaaccggggaccaucauuacggacaacaaccgcaaguggcaaauugauuacggaguggugcugucgcucaugcacauuaccacccuugagguacaggggagaggauggcuguugguauggaauggagauaagaccguuaaaggagaaagaggagaacuuggucaacucauugguuacugcuggucacggccaaauugauaauuucagucuggggguuuuaggaauggcacuauuccuagaagaaauguuaagaaccagagucggcaccaaacaugcgauuuuacuugucgcucuuucauucguaacacucaucacgggcaauaugucauucagagacuuaggaagaguaaugguaaugguaggagcaaccaugacugaugauauaggaauggguguaacauacuuggcccuucuugcugcauucaaaguuagaccgacauuugcagcugggcuguuacuucgaaaacuuacaaguaaagaacucaugauggcaacuauugggauagcacuucugagccaaucuacccuaccagaaacuauauuagaauuaacagacgcauuagccuuaggaaugauggcacuaaaaaucguuaggaauauggagaaguaucaguuagcgguaacuauaauggcuauuucgugugugccaaaugccguaauucuacagaaugccuggaaagucagcuguaccauucuugcagcaguaagcgugaguccgcuauugcugaccucgucacaacaaaaagcagauuggaucccucucgcuuugacgauaaaaggauuaaacccaacggcaauauuccuuacuacguuaucgagaacgucaaagaaaagaucauggccuuuaaaugaagcgauuauggcugugggaaugguuucaaucuuagcaucaucacuacuaaagaacgacauuccaaugacuggaccauugguugccggugguuugcuuacuguuugcuauguacucacuggacgaucugcagaucuggaacuagagagggcagcggacgugaaaugggaagaucaagcagaaauaucaggaucaucacccaucuuaaguauaacaauuucagaagacgguaguaugucuaucaaaaaugaagaagaggagcaaacguugacaauccuuauaagaacgggauugcuaguaauaagcgggguauuucccgugucaauaccaauuacugcagcagcuugguaccucugggaaguaaagaaacagcgagcggggguauuaugggacguacccucucccccaccugugggaaaagcugagcuggaagacggugcauacagaaucaaacaaaggggaauacuagguuauagccagauuggagccggugucuauaaagaaggcacuuuccauacaauguggcauguaacacguggggcuguauuaaugcaccgaggaaaacgcaucgagccaucuugggcagaugugaagaaagaccucauaucguauggaggugguuggaaacuugagggagaguggaaggaaggagaagaaguucaaguguuagcucuugaaccggguaaaaauccucgggcugugcagaccaaacccgguauuuucaagacaaauacagguaccaucggggcaguuagcuuagacuucagcccuggaacuuccggcuccccuauuguagaucgaaaaggaaaaguaguuggguuauacggaaauggagucguaacccggagcggagcguacgugagugcuaucgcucaaacagaaaaaucgauagaggacaauccagagauugaagaugauauuuuuagaaagaagcgacucaccauuauggauuugcacccaggagcuggaaaaacuaagagauauuugccggccauugugcgugaagcaaucaaaagaggguuacguacucuaauauuggcaccaacgaggguuguugcagccgagauggaagaagcucugagaggacugccgauacgauaucagacaccggcaauacgagcagaacacacugguagagagauaguggacuugaugugucacgcgacauuuacaaugaggcuguuaucacccguacgcguaccaaauuacaacuugaucaucauggacgaagcacacuuuacagacccagcaucaauagcagcacgcggauauaucucgacuagaguagagaugggugaagcagcagggauuuuuaugaccgcgacuccuccaggaagccgcgacccguuuccacaauccaacgccccgauaauggacgaagaaagggaaauuccagaaaggaguuggaacucaggccaugaguggguuacggauuucaaagguaaaacaguaugguuuguaccaaguauaaaagcuggcaaugauauagcagcaugucuuaggaaaaacggcaagaaaguaauacaacuaucacguaagacauucgacuccgaauauguuaagacaagagcgaaugacugggacuuuguaguaacuacugacauaucagaaaugggagcuaauuucaaagcugaaagagugauugauccuagaagauguaugaaaccgguaauccuaacugacggugaagaaaggguaauacuggcaggcccaaugccuguaacacauucuucagcagcacagaggagaggccgaaucggaagaaauccaaagaacgaaaacgaucaguauauuuauaugggugagccauuagagaaugacgaagauugugcucauuggaaggaagcaaaaauguuauuagauaacaucaauacgccggagggaauaauccccucaauguucgagccugaaagagagaaggucgaugcaaucgauggagaauacagacuaaggggagaagccagaaagaccuuuguagaucuaaugcguagaggggaucuaccggucuggcuagcauauaaaguggcggcggaaggaauaaauuacgcagaucguaaaugguguuucgaugggauaaagaauaaccagauucuagaagagaauguugagguagaaauuuggacuaaagaaggcgaaaggaagaaacuaaaacccagauggcuagacgcaagaauuuauucagacccacuugccuuaaaagaauuuaaagaauuugcggcaggacgaaaaucacuuacgcucaacuuaauaacugagaugggacggcuucccacauucaugacacaaaaagcaaggaacgcauuagauaaccuagcgguguuacacacggcagaaguaggggguaaggcauacacacacgcuuuaagugaauuaccagagacuuuagaaacuuuauugcuccuuacucuauuagccgcaguuacgggcggcauuuuucuauuuuuaaugaguggaaaaggcaucgggaagaugacguuaggaaugugcuguaucauaacugcuucuauccuacucugguaugcucaaauucaaccacacuggauagcugcgagcaucauacuagaauuuuuccuaauagucuuauugauuccugaaccugaaaagcagaggaccccgcaagauaaccaauuaacauacguuguaauagcuauuuuaacaguaguugcagcgacuauggcuaaugaaaugggauuucuagagaaaacuaagaaagaccuuggauuuggcucaauaacaacccaagagagugaaucaaauauauuggauauagaucucaggccagcauccgcauggacacuauacgcgguugcuacuaccuucgucacaccaaugcuucgucacucaauagagaauagcucuguuaauguaucacuuacugcgauagcaaaucaagccacuguacugaugggauuagguaaaggcuggccacuuucaaaaauggacauaggagucccucuauuagccaucgguugcuauagucagguaaauccaauaacacuaacggccgcguugcuauuacuuguggcccauuaugcaauuauugggccggguuuacaagcaaaagccacuagagaagcucagaaaagagcagcugccggaauuaugaaaaacccgacugucgacggaauuacaguuauagauuuagaaccaauucccuaugacccaaaauucgagaaacaacuuggacaaguuaugcugcugauauuaugugucacccaaguucucaugaugcggacaacaugggcauuaugcgaagccuuaacuuuagcaacaggcccuaucaguacgcuaugggaaggaaacccaggcagguucuggaacaccacgaucgcuguuucgauggcuaacauuuuuagagguucauaucuagcuggcgcaggauuacuauuuucaaucaugaagaacacuacuaauacgagaagaggaacgggaaacgucggcgaaacucuaggagagaaauggaaaucgagauuaaaugcucucggaaaaagugaguuccaaauauacaagaaaucggggauacaagagguagaccgaacgcuggccaaagaagggauaaaacgaggcgagacugaucaccacgcaguaucuaggggaagugcgaaauugcgaugguuuguagagagaaauaugguuacucccgaaggaaaggugguagacuugggauguggccgcggagguuggagcuauuauuguggcggccuuaaaaauguacgagagguaaaaggcuuaacgaaagguggaccgggucacgaagaaccaaucccaauguccacauauggcuggaacuuagucagauuacagucaggaguagacguguucuuuacgccaccggaaaaaugugacaccuuacucugcgacauaggagaaucaagcccaaacccuaccauagaggcgggucggacucugcgggugcuaaaccucguagaaaacuggcuuaauaacaauacucaauucuguauuaaaguguuaaauccguauaugccgucaguaaucgaaaagauggaaacucuccaaaggaaauaugguggugcauuaguuagaaauccgcuuaguagaaauagcacacaugaaauguauuggguuucuaaugcaacugggaacaucguuuccaguguaaauaugauuagucgaauguuaauaaaucgauucacaaugaaacacaaaaaggcgacguaugaaccagacguggacuuagguaguggaacaagaaauauaggcauugaauccgaaauaccgaaucucgauauaauaggaaagcgaaucgagaaaauaaaacaagaacaugaaacuucuuggcacuaugaccaagaccauccuuauaagacuugggcauaccauggaucuuaugaaacaaaacaaacaggcucagcaaguagcauggucaaugggguagugcgacuucuuacgaaaccaugggaugucguaccgaugguuacgcaaauggcuaugacagauacaaccccuuuuggucaacaacggguuuuuaaagagaaaguagacacaagaacccaagaaccgaaagaggguacaaagaaauuaaugaaaauaacugcggaaugguuauggaaggaauuagggaaagagaaaacaccucguauguguacuagagaagaguucacacgaaaaguuagaagcaacgcugcucugggugcagucuucacagacgaaaauaaauggaagucagcuagggaggcgguugaagacgguagauuuugggaauugguagacagggagagaaaucuccacuuagaagguaagugugaaacauguguauauaauaugaugggaaaaagggaaaagaaauuaggcgaguucggaaaagcaaaaggaucacgagcaauuugguacaugugguuaggagcaagguuucuagaguucgaagcucuaggauuccuaaaugaggaucauugguuuagucguggaaacucgcuaaguggcguggaaggugaagggcuccacagguuaggauauauacugagagaaguaggcaagaaagaggguggagcaauguaugcagacgauacagcgggaugggauacaaggaucacuuuagaagaucucaaaaaugaggaaaugguuacaaaucauaugaaaggagaacacaagaaauuagcugaagccauauuuaaacuuacauaccaaaauaaagucguacggguacaaagaccgacaccucgcggaacaguaauggauauuauaagucggaaagaucaacggggaucggggcaaguaggaacuuauggacuuaauacauuuacgaauauggaagcucaauuaauaagacaaauggaaggggaaggaauauuuaaaagcauacaacaucuaaccgcgacugaagaaauagcuguucagaacuggcuugcgcgcguagguagggaacguuuauccaggauggccauaucgggagaugauuguguuguaaaaccaauagacgacagauucgcguccgcccucacagcuuugaaugauaugggaaagguuagaaaagauauucaacagugggagcccucucguggguggaaugauuggacucaaguuccuuucugcagccaccauuuccaugaauuggucaugaaagauggccgaguacucguaguuccauguagaaaucaagaugaauuaauaggacgggcaagaaucagucaaggagcaggauggaguuugaaggagacugccugucuuggaaaguccuaugcccaaauguggacauuaauguauuuucaucgacgagacuuacgacuagcugcgaacgcuauauguucugcagucccaagccacuggguaccaacgucgagaaccacuuggaguauacaugccaagcacgaauggaugaccacggaagacaugcuugcuguauggaaucguguuuggauucaagaaaacccauggauggaagauaaaacuccuguugagucaugggaggaagucccuuaccuugguaaaagagaagaucaauggugcgggagucuuauaggccugacgucuagagcgacgugggcgaaaaacauucagacagcgaucaaucaaguuagaaguuuaaucggaaaugaaggauauaccgauuauaugccuucuaugaaacguuuucgccgugaagaagaagaagcggguguuuuaugguga

SEQ ID NO: 22281 - RNA, 9876 nt, Artificial Sequence
  derived and/or modified CDS sequence (opt6) from DENV-2__FJ898461__SS-prME
acagcuggugugaucgucauguuaauacccaccgcaauggcauuucacuuaacaaccagaaauggcgaaccacauaugauuguaggaagacaagaaaaagggaaaucauuauuguuuaaaacagaagacggagucaauauguguacucuuauggcaauugauuuaggcgaauuaugcgaagauacuauuacuuauaaauguccuuuauuacgucaaaaugaaccagaagauauagauugcugguguaauuccacauccacauggguaacuuacggcacaugcacaacgacuggagaacacaggagagagaaaagaagcgucgcucucguaccucauguuggaauggggcuugaaacccgcacagaaacguggauguccucagaaggcgcauggaaacauguacaacggaucgaaaccuggauccuacgacauccaggcuucaccauuauggcagcaauauuagcauacacuauaggcacaacacauuuucaaagagcacucaucuucauucuucuaaccgcaguugcgccuucaaugacaaugcguugcaucggaaucaguaaccgcgauuucguagaagguguuucaggagggucauggguggauauaguuuuagaacaugguagcugcgugacuacaauggcuaaaaauaaaccuacucuagauuuugaacucauaaaaacagaagcaaaacaaccugcuacgcuacgcaaauacuguauugaagcaaaauuaacaaauacgacaacugaauccagaugcccgacucagggugaacccagcuugaacgaagaacaagauaaaagauucauuuguaaacauagcaugguugaucgagggugggggaauggaugugguuuauuuggcaaaggaggcaucgugacgugcgcuauguuuaccuguaagaaaaauauggaagguaaagugguucaacccgaaaaucuagaauauacaauugugauuacaccacauaguggggaggaacaugcaguuggaaacgacacaggaaaacauggaaaagaaaucaaaaucacaccacaguccagcauaacugaagcagagcuuacaggcuauggaacuguaaccauggaauguagcccuagaacaggcuuggauuucaacgaaaugguuuuguuacaaauggaagacaaagcgugguugguacauaggcaaugguuuuuagauuuaccguuaccuugguuacccggcgcagacacacagggaucaaacuggauccaaaaagaaacuuuggugacauuuaaaaauccgcacgccaagaaacaagacguaguuguacugggcucucaggagggagcaaugcacacagcucucacaggcgcaacagaaauacaaaugucaagugggaaucuucuauucacuggccaccucaagugccgacuuagaauggacaaauuacaauuaaaagguauguccuauucuauguguaccggaaaauuuaagauaguaaaagagauagcggagacacaacacggaaccauaguaauuagaguccaguacgaaggcgacggaucacccuguaaaauacccuuugaaauaacagauuuagaaaaacgacaugugcuuggacgucugaucacaguuaauccaauagugaccgaaaaagauaguccaguaaauauugaggcagaaccgcccuuuggugauucauauauuauaauagggguagaaccagggcaguugaaguuaaacugguuuaaaaaggggaguagcauaggacagauguuucaaacaacuguuagaggggcuaaacgcauggcaauucuaggggauacagcgugggauuucgguagucuaggaggcguguuuacuucuaucgguaaagcgcuacaccaaguauucggcgcuauauauggagcggcuuuuuccggaguaucauggacaaugaaaauauugauugguguuaucauaacauggauuggaaugaacucgcguucgaccucacuaucagucagucuagucuuaguuggugugguaacacuauauuuaggcgcaaugguacaagcagauagugguuguguaguaaguuggaaaaacaaggagcuaaaaugcgggaguggcaucuuuaucacggauaauguacacacauggacagaacaguacaaauuccagccggaaucaccaaguaaacuggcuagugcgauucaaaaagcgcaugaagaaggaauaugugguauaagguccguuacucgucuugagaaccucauguggaaacaaauaacgccugagcuaaaccauauauugucagagaaugaaguaaagcugacuauuaugacaggugauauaaaagggauaaugcaagcaggaaagagaaguuuaagaccacaacccaccgaacuaaaauauagcuggaaaacaugggggaaagcaaaaaugcucucuacagagucccacaaucaaacuuucuugauugacgggccagaaacagcggaaugccccaacacuaaccgugcuuggaacucauuggaaguugaagauuauggcuuuggaguuuuuacuacaaacauuuggcuaaaguuaagagagaaacaggauguauuuugcgauucuaaacuaaugagugcagcgaucaaggacaacagagcaguucacgcugauaugggcuauuggauagagucugcgcuuaacgauacauggaaaauggaaaaagcgagcuucaucgaaguuaaauccugucacuggccaaaaucacacacguuauggaguaauggaguacuagaaucagaaaugauuauuccuaaaaauuucgccggccccguuucucaacauaacuauagaccgggcuaucacacgcaaacagcaggacccuggcacuuagguaagcucgaaauggauuuugauuuaugcgagggaacuaccguaguaguaacggaagauuguggcaacagaggcccgagcuuacgaacuacaacugcgaguggaaagcucauuacagaauggugcuguaggagcuguacgcuuccuccacuacgauauagaggugaggauggaugcugguaugggauggaaauuaggccccucaaagaaaaagaagagaaucuuguuaauucacugguaacugccggucacggacagaucgauaacuuuagucucggaguauuagggauggcauuguuccuagaggaaauguuacguacuagaauagggacgaaacaugcaauauuacucgugguaguuagcuuuguuaccuuaaucaccgggaauaugucauuucgggacuuaggaagaguaauggucaugguaggggcaaccaugacugacgacauaggcaugggugucacauaccuggcccuacuagccgcauucaaagugagacccacauucgcagccggguuauuguuacgaaagcucacaucaaaagaauuaaugauggcaaccauugguauugccuugcucucucagucaacaauuccggagaccauacuggaauuaacagacgcguuagcacucggcaugaugguuuuaaagaucgugcgcaacauggagaaauaucaacuagcaguuaccauaauggcaauaucaugugucccaaacgcgguaauucuacaaaaugcuuggaaaguaucauguacaauucuggcagcaguaucaguaucaccacuauuauuaacuucgucccaacagaaagccgauuggauaccucuagcauugacgauaaaaggucuuaauccaacggcaaucuuccuuaccacauuaucacgcacaaguaagaaacggucauggccuuuaaacgaagcaauuauggcuguuggcauggugaguauuuuagcaagcaguuugcugaagaaugacaucccaaugacugggccucuagucgcuggagggcuacuuacaguauguuauguguuaaccgguagaucagcagauuuagaacuagagagggcagcugauguuaagugggaagaucaggcugaaauaagcggauccagcccaauacuuaguauaacuauaucagaggauggaaguaugagcauuaaaaacgaagaagaagaacaaacacuuacuauauugauaaggacugggcuuuuagucauuucuggcguguuuccaguaucgauucccauuaccgcugccgcgugguacuuaugggaaguuaagaaacagagagccgguguucucugggaugucccaucgccuccgccgguagaaaaagcagaauuagaggauggagcauauagaauuaagcaacgaggcauccugggauauucucaaaucggcgcugguguguauaaggaaggaacguuucacacaauguggcacguaacuaggggagcgguguuaaugcacagagggaaacgaauagaaccaaguugggcagaugucaagaaagauuugauaaguuacggaggaggauggaagcuagaaggugaauggaaggagggugaagaaguucaggugcucgcguuggagccuggcaaaaauccacgagcuguccaaacaaagccagguauauucaagacgaacacgggaacaauuggagcuguaucacucgauuucagcccuggaacaucaggcucgccgauaguagacagaaaaggaaaggucgucgggcuauacggaaaugggguggucacccgaagcggagcauauguuagugcgauagcccaaacagaaaaguccauagaagauaauccagaaauagaagaugauauauuccgcaagaaaagauuaacgaucauggaucuacaccccggugccggcaaaacaaaaagauaccuaccugcaauaguaagggaagccauaaagcguggcuugagaacacuaauauuagcaccaacuagagucguggcugcagaaauggaggaagcucuccgaggauugccaauuagauaccaaacgcccgccaucaaaacagaacauacagggcgggaaauuguagaccuaaugugccaugcuaccuucacgaugaggcuucuaucaccuguacgaguuccaaauuacaauuuaaucauaauggaugaagcucacuuuacugaucccgcauccauagcugcacguggauauauaagcacaagaguagaaaugggugaggcugccgggauauucaugacagcaacaccacccgggagcagggacccauuuccgcaaucuaacgcacccauaauggaugaagaaagagaaaucccagaaaggagcuggaacucgggccacgaauggguaacagacuucaaagggaaaacagucugguuuguaccguccaucaaagccgguaacgauauagcugccuguuuacguaagaaugguaagaaaguaauacaacuaucaagaaaaacauucgauagcgaauacguuaaaacaagagcaaaugacugggauuucguaguuacaacagauauaucagagaugggugccaacuuuaaagcagagcggguuaucgacccuagacgaugcaugaaaccagucauuuugacagacggagaagaaagaguaauccuugcagguccaaugccagugacacacaguuccgcagcacaacgccgcgggaggauuggacgcaaucccaaaaaugaaaaugaucaauacaucuauaugggagaaccacuugaaaaugaugaagacugugcacacuggaaggaagccaaaauguuguuagauaauauaaauacaccugaaggaaucauaccaaguauguuugaacccgaaagagaaaagguagaugcuauugacggagaauacaggcugcguggagaagcaaggaaaacguucguagauuuaaugcgcagaggugauuuaccaguguggcuugcuuauaaagucgccgcugaaggaauaaauuaugcggaucgaaaaugguguuucgacggcauuaaaaauaaucaaauauuggaagaaaauauggaaguagaaauauggaccaaagaaggcgaaaggaagaaacuuaagccacguugguuagaugcucggauauauuccgaccccuuagcucucaaagaauuuaaggaguuugcagcagggcgaaagucauuaacucuaaaucucauaacagaaaugggaaggcuaccuacguuuaugacgcaaaaagcaagaaacgcgcuggauaauuuagccguccuucauacagcagaagcugguggacgagcauauaaucaugcuuuaucagaacuacccgaaacauuggaaacucuguuacuacuuacuuuacuagccacagucacagggggcauauuucucuuucuuaugaguggaaaaggcauagggaaaaugacacuugguaugugcuguauuauaacugccaguauauuacuaugguacgcgcaaauacaaccacauuggauagcggcuucuaucauacuugaauuuuuccuaauaguccuacucauaccagaaccagaaaaacaaagaaccccacaagacaaucaacuuacuuaugugguaauugcuauauugacugugguggccgccacaauggcuaaugaaaugggauuuuuagagaaaacuaagaaagaccuaggauuaggaucaauaacgacacaggaaccagaaucgaauauucuggauauagacuuacgaccggccucagcguggacacucuaugccguggcaacaacguucguaaccccgauguugaggcauucuauugaaaauagcucugucaacguaucucucacugcgauugcaaaccaagcaaccgucuugaugggauugggaaaaggguggccauuauccaagauggauauaggaguaccguuauuagcaauuggauguuacagucaggucaauccaauuacauugacugcggcuuuacuauuauuaguugcacauuacgccauuaucggaccaggucuacaagcuaaagccacaagggaagcucagaaaagagcggcugcaggcauaaugaaaaaccccacagucgacgggauuacuguaaucgacuuagagccaauaccauacgauccaaaauuugagaaacaauuagggcaagugauguuacuaaucuugugcguuacucaaguacugaugaugagaacgacaugggcccuaugugaagcauuaacacucgcuaccgggccaauuuccacacuaugggagggcaacccaggaagauucuggaacacgaccauagcaguuucaauggcuaauauuuuuagaggaucguaccuagccggagccggucuacuuuucaguaucaugaaaaauacaacaaacacuagacgugggacagguaacaucggugaaacccuuggagaaaaauggaaauccagacuaaacgcacuaggaaaaucugaguuccagauuuauaagaaaucggggauacaagaaguagauagaacccuggcaaaggaaggaauaaagcgaggcgaaaccgaucaccacgccgucucccgugguagugcaaaacuacgcugguuuguugaacggaauaugguuacuccugaagggaaagugguugacuuaggaugcggcagagggggcuggucguauuauugcgguggacuaaagaacguccgggagguaaaaggucuaacuaaaggagggccaggacaugaggaaccgauaccaaugucuacuuacggcuggaauuuaguuagacugcaaagcggaguugauguguucuuuacuccuccugaaaaaugugauacacuauuaugugacaucggugaauccucaccaaaucccaccauagaagcuggaagaacacuaagggugcuaaauuugguagagaacugguugaacaacaacacacaauuuugcauuaaaguauuaaauccguacaugccaucugucauagagaaaauggaaacauuacaacguaaauacggaggggcauugguacguaauccccugagccgaaauucaacccaugaaauguauuggguaucuaacgccacagggaacauuguuaguuccgucaacaugaucucucggauguuaaucaaccgauuuacaaugaaacacaagaaagcuacauacgagccugauguugaucucgguucagguaccaggaauauagguauagaguccgaaauaccaaacuuagacauaauuggaaaaagaauagagaaaauaaaacaggaacaugaaacaaguuggcacuaugaccaagaccauccauauaaaacuugggcguaccacggcucauacgagacgaagcagacugguagugcuucgagcaugguaaauggagucguaagacuucuuaccaaacccugggaugugguaccuaugguaacacaaauggcaaugacggauacuacaccguucggucagcaaaggguauucaaagaaaagguagauacaaggacucaagaaccaaaagaagguacuaagaaauuaaugaaaauuacagcagaaugguuauggaaggaauuagggaaaaagaaaacaccacgcaugugcacacgcgaagaauuuacaagaaaagugcgcucaaaugcugccuugggugcuauuuuuacggaugaaaacaaauggaaaagcgcaagagaagcuguugaggaugguagauucugggagcuaguagaccgagaacgaaaucuacaucuagaagguaaaugcgaaacgugugucuauaauaugaugggcaaaagagagaagaaauuaggagaguucgggaaagcaaaaggcuccagagccauuugguauauguggcucggagcucgauucuuagaguucgaagcucuuggguucuugaacgaagaucacugguuuucaagaggaaauucauuaagugguguagaaggagaaggacuacauagauuaggauauauccuccgugaugucgggaagaaagaaggaggagcgauguacgcggaugauacugcggguugggauacccguauaacauuagaagaccugaaaaacgaagagaugguaacaaaccauaugaaaggagagcacaagaaacuugcagaagcaauauuuaaacuuacauaucaaaacaaaguaguaaggguucaaagaccaacaccucgugguaccgugauggauauaauuuccagaagggaucaacgaggcucaggucaaguagguacguauggcuuaaauacguuuacuaacauggaagcacaacuuauaaggcaaauggaaggcgaagggauauuuaaaaguauacaacauuuaacggccacggaagagauugccguacagaacugguuagccagguuagggagagaacgacuuucacggauggcuauaucaggagaugacuguguaguaaagccuauugacgauagauuugcauccgcguuaacugcucuaaaugauaugggcaaaguuagaaaggauauucagcaaugggagccuucuagagguuggaaugacuggacacaaguuccuuuuugcucucaucauuuccaugaguugguaaugaaagaugggaggguccugguugugccaugcagaaaccaagaugaacuaauugguagggcacgcauaagucagggcgcugguuggucacucaaagaaacggccugucuagguaagaguuaugcacaaauguggacauuaauguacuuccacagaagagacuuacgacuagcugccaaugcuaucugcucagcaguucccagccacugggugccaacaucaagaacaacguggaguauccaugcgaaacacgaauggaugacaacugaagauauguuagcuguauggaaucgaguauggauucaagaaaacccguggauggaggacaaaacgccaguugaauccugggaagaaguuccauacuuggguaaacgagaagaucaauggugugguucuuuaauuggacuaacaucgagagccacaugggccaaaaacauacagacggcaauaaaucaaguacguaguuuaauaggcaaugaagaauacaccgauuacaugcccagcaugaaacgguuuagaagagaggaagaagaggcgggcgugcuaugguaa

SEQ ID NO: 22282 - RNA, 9876 nt, Artificial Sequence
  derived and/or modified CDS sequence (opt6) from DENV-2__FJ024473__SS-prME
acagcaggggugauagugaugcuaauuccgacggcaauggcauuucaucucacaacccgcaacggagagccgcacaugauaguaggcagacaagaaaaaggaaaaucacuacuguuuaaaacagaagauggagugaacaugugcacacuuauggcaauagaucuaggugaguuaugugaagauacaauaacauauaaauguccuuuauuaaggcaaaaugagccagaggauauagacuguuggugcaauaguacaagcacauggguaacguauggaacuuguacaacaaccggagaacaucgacgagagaaaagaucaguggccuuaguaccccacgugggaaugggcuuagagacacgaacagagacguggaugucaagcgaaggggcuuggaaacacguacaaagaauagaaacuuggauucuuaggcauccgggcuucacaauuauggcagcaauacuugccuacaccaucgggacaacgcauuuccagagagcucuaaucuuuauacuccugacggcaguugcaccgagcaugacaaugagguguauuggaacaagcaaccgcgacuuuguugagggcguaagcggugggucuuggguggauauuguguuagaacacggaagcugcguaaccacuauggccaaaaauaaaccgacucuugacuuugagcuaauaaaaacagaagccaaacagccagcaacacuaaggaaauauuguaucgaagcaaaacuuacuaauacaacaacagaauccaggugcccaacucaaggagaaccaucauugaaugaagaacaagacaaacgauuuauuuguaaacacucuaugguagaucgggguuggggaaaugguuguggcuuauuuggaaaaggaggcauugucacuugugcaauguuuacauguaaaaagaauauggaagguaagguugugcaaccagaaaaucuggaauacaccauugucauaacaccacauucgggugaggaacaugccgugggagaugacacugguaaacaugguaaagagauuaaaauaacaccgcaaaguucaaucacagaagccgaacuaacuggauacgggacaguuacaauggaaugcaguccuagaacagggcuagauuucaacgagaugguacuccuccaaauggaggacaaagcgugguugguucaccgccagugguuucuugaucuaccacucccgugguuaccaggggcggacacacaaggaucaaauuggauacaaaaagaaacucugguuacguuuaaaaauccacacgccaagaaacaagauguaguagucuuagggucacaagaaggagccaugcauacugcccuuaccggagcuaccgaaauccaaaugucaagugguaauuuacucuuuacgggucaccuaaaaugccggcuuagaauggauaaacuccaacugaaaggcaugaguuauaguaugugcacgggaaaauuuaaaauagugaaggagauugcugaaacucaacauggcacuaucgugaucaggguacaauacgagggagacgguagcccauguaaaauucccuucgaaaucaccgauuuagagaagcggcauguccuagguaggcuuauuacugucaauccaauaguaauagaaaaagacucaccaguuaacauagaagcagaaccgcccuucggggauaguuacauuauuauuggaguugagcccggacaacucaaacucaauugguuuaagaaagggucaucuauaggacaaauguuugaaacaacaaugaggggagccaaacgaauggccauccuaggggacacggcuugggacuuugguucuuuaggugguguuuucaccaguauagguaaggcuuuacaucaagucuucggggcaauauacggagcugcauuuagugguguuagcuggacaaugaaaauucuuaucggcguuguaauuacuuggaucggaaugaacucucgaucaacuagccuaucgguuucuuugguucuugucggcguaguuacauuauaucuaggagcaaugguccaagcagacucgggcugcguggugaguuggaaaaacaaagagcuuaaguguggcucaggcauuuucaucaccgauaauguacacacguggaccgaacaguauaaguuucaaccagaaucaccaucuaaguuggcgucggccauacaaaaagcacaugaagaaggaauuugugggauucggagcguuacacgacuagagaaucucauguggaaacaaauuacacccgaguugaaccauaucuuaagugaaaaugaaguuaaacuaacaauaaugacgggggacacuaagggaauuaugcaagcgggaaaacgauacuuacggccacaaccaaccgaguuaaaauauaguuggaaaacaugggggaaagcgaaaauguuaagcacggaaucgcacaaccagaccuuucugauagaugggccagaaacugcggaaugucccaacaccaaccgggcuuggaacucauuggaaguagaagauuacggcuuuggaguauucacuacuaauauaugguuaaagcuaagagaaaagcaagacguauuuugugauucgaagcugaugagugcggcaaucaaagacaauagagcaguacaugccgacaugggcuauuggauugaaucagcacugaaugacacauggaaaauggagaaagccaguuucauagaagucaagaguugucauuggccaaaaucccacacgcuuugguccaacggcguacuagagucggaaaugauuauucccaaaaauuucgcaggccccgugucucaacauaauuacagaccugguuaccacacacaaacagccggaccuuggcaucuuggaaaauuagaaauggacuuugauuucugugaaggaacuacgguaguagucacagaagauugcgguaauagaggaccuucacuaagaacaaccaccgcaaguggcaaauuaauuacagaauggugcuguagaucgugcacccucccgccgcuaagauaccgaggggaagaugguugcugguauggcauggaaauuaggccgcuaaaggaaaaggaagagaauuugguaaauucccuuguaaccgcaggacaugggcaaauagauaacuuuaguuugggaguuuugggaauggcguuauucuuagaagaaaugcuaagaacaaggguaggcacaaaacaugccauucuucucguagcgguaucauuuguuacauugauaacagguaacaugucuuuuagagauuuaggacgaguuauggucaugguaggagcaacaaugacugaugacauaggcauggguguuacuuacuuggcucuacuggcagcauuuaaggugcgacccaccuucgcugcaggauuauuacucagaaaacuuacaaguaaagaacugaugauggccacaaucgguauaacauuguuaucccaaucuacuauacccgaaacaauacuagaauugacagaugcacuagcacuagguaugaugguuuuaaaaauuguaagaaauauggaaaaauaucaguuggccguaacgauuauggcgaucagcugcguaccuaaugcaguaauccuaaggaacgcuuggaaaguaucgugcacaauucuugccgcgguaagugucucaccuuuacuuuuaaccagcagucagcagaaagcugacuggauuccauuggcuuuaaccauuaaaggcuuaaauccaacugcaauauuucucacaacgcugucaaggacuuccaagaaacgaucauggccccuuaaugaagcgauuauggcaguuggaauggucucaauuuuagcuagcucuuugcuuaaaaaugauaucccaaugacgggaccacugguggcaggagggcuauuaacgguguguuauguauugacaggaagaagcgcagaccuggaacuggaaagggcugcagauguaaaaugggaggaucaagcagaaauuucaggaucuucgccgauacuuagcauuacuaucagcgaggacgggucaaugagcauuaaaaaugaagaagaagaaaccacguugacaauucuuauuagaacaggacuucugguuauaucugguguauuuccugugucaauacccauaaccgcggcggcaugguaccuaugggaagucaagaaacagcgagcaggaguccuaugggauguuccaucuccaccuuuaguaggcaaggcugaauuagaagacggagcguacaggaucaaacaacgcgggauucuaggcuauucgcaaauuggcgcuggcguuuacaaagaaggcacauuucauaccauguggcauguaacgcgaggugcggugcucaugcaucgagguaaaaggauagaaccuucuugggcugaugucaagaaagauuugauaucguauggcggcggcuggaaauuagaaggugaguggaaggaaggugaagaaguacaaguacucgcauuagagccgggaaagaaucccagagcaguacaaacaaaaccuggaauauuuaaaaccaacacagguacaauuggugcaguaucuuuagauuuuagcccugguacaaguggauccccgaucguagaucgaaaaggaaaagucgucggauuauacggaaauggcgucguaacacgaucuggugcauaugugucagcaauugcccaaaccgagaagucuauugaagacaacccggaaaucgaggaugauauuuuucgcaagaaacgacugacuauaauggaucuucacccgggcgcgggaaagacuaaaagauaccuacccgcgauaguucgugaagcaauaaaacgaggucuaagaacgcucauuuuagcacccacucggguaguggcagcugaaauggaagaagcacuccgaggcuuaccaaucagauaucaaacaccagcgauaaaggcggaacacacggguagagagauaguagaucucaugugucaugcaacguuuacuaugagauuacucucucccguaagaguaccaaauuauaaccuaauaauaauggaugaagcccauuucacagacccagcuucgaucgcagcacgaggauauaucaguaccagaguagaaaugggcgaagcagcgggaauauucaugaccgcuacaccacccgguucuagagaccccuuuccacaaucgaaugccccaauaauggaugaagaaagggagauuccugaacgcagcuggaacagcgggcaugaaugggugacagacuucaaagggaaaacuguaugguuugugcccaguaucaaggcaggaaaugacauagccgcuugcuuaagaaagaacgggaaaaagguaauucaacuaucaagaaaaacauuugacuccgaauacgucaaaacaagagcuaaugauugggauuuugucguuacaacagauauuagugaaaugggagcgaacuucaaggcagaacggguaauagauccuagaagguguaugaagccgguaauacuaacugauggcgaggaaagggugauucuagcagggccuaugccaguaacucacucaucugcggcccaacgcaggggaagaauuggcagaaauccuaaaaacgaaaaugaucaauacauuuauaugggagaaccacuagaaaacgaugaagacugcgcucacuggaaagaagcuaaaaugcucuuggauaauauuaacacgccagagggcauuauaccuucaauguuugagcccgaaagagaaaagguagaugcaguggauggcgaguaucgcuuacgaggugaagcgagaaaaaccuucguugaucuuaugagaagaggagaucuaccaguaugguuagccuauaaaguagccgcugaaggaauaaauuaugcagaccguaaguggugcuucgaugguaucaagaacaaucaaauuuuagaggaaaacgucgaagucgaaauauggaccaaagaaggagaaaggaagaaacucaaaccccguugguuagacgcacgcauuuacagugacccauuagcccucaaggaguuuaaagaauuugcagcuggacguaagagucucacacuaaauuugauaacugagaugggcagacucccgaccuuuaugacacaaaaggcgcgaaaugcauuagauaaucuagcgguacuacauacagcagaagcaggagggagggcauauaaccacgcauuaagugaacuaccggaaacauuagaaacauuauuacuccuaacccuccuugccacuguaacagguggcauauuucuauucuuaaugucuggaaagggaauuggcaaaaugacucuaggcauguguuguaucauuacggcaucuguucuuuuaugguacgcgcaaauucaaccgcacuggauugcagcgucaauuauucuggaguucuuuuuaauuguauuauugauaccggaaccagaaaagcaaaggacgccacaagauaaucagcuuacauauguaguaauagcaaucuugacagugguggcggcaacaauggcgaacgagaugggauucuuagagaaaacuaagaaagaccuagguuuggguucaaucacaacccaagaaagcgaaucaaauauacuagacauagaucuucgcccagccuccgcuuggacccuauaugccguggcgacuacauuuguaaccccaauguugcgacacucuauagaaaauagcaguguaaauguaucuuuaacggcaaucgccaaucaagcaacaguacuaaugggauuggguaaaggauggccuuuaaguaaaauggacaucggcgugccacuguuagccauaggaugcuacucacaagugaauccgauaacccucaccgcagcuuuacuacuccuagucgcacauuaugcaaucaucggcccaggacuacaagcaaaagcgacgagggaggcacaaaaacgcgcagcagcagguauaaugaaaaauccaacggucgacggaauaacaguaauagaccuggaaccuauuccguaugauccaaaauucgagaaacaacugggacagguaauguuauuaauacuguguguaacacaaguccuaaugaugcguacuacaugggcguuaugugaagcucucaccuuagcaacuggaccaaucucuacccuuugggaaggaaauccaggacguuuuuggaacacaacgauagcaguaaguauggcaaauauauuuagaggaagcuaucuggccggcgcgggacuacuguuuucuauaaugaaaaacacuacuaacacaagacggggaacgggaaacauuggugagacauuaggggagaaauggaagagucgacuuaaugcauuaggaaaaagcgaguuucaaauauauaagaaaagugguauccaagaaguagaucguacguuggcaaaagaaggcauaaagcguggagaaacagaccaucaugcuguuagcaggggaagugcaaaacuaagaugguuuguagaacgcaauaugguaacucccgaaggaaaaguuguagaucuugggugcggcagaggaggcuggagcuauuauugugguggccucaaaaacgucagagagguaaaagguuuaacaaagggaggacccggccacgaagaaccaaucccaaugucuacauaugguuggaaucuggugcgacuacaauccggaguagauguguucuuuacaccgccagaaaaaugugacacuuugcuuugugauauuggugaaucaucaccgaauccaacaaucgaagccggucgcaccuuacgaguucuaaaccuaguugaaaacugguuaaauaauaacacacaguuuuguauaaaagugcuaaauccuuacaugccaaguguuauugagaaaauggagacauuacaacgaaaauaugggggugcucuaguaaggaauccgcuauccagaaauagcacacaugaaauguauuggguaagcaaugcuacaggaaauauaguuucuucuguuaacaugauuucaaggaugcuaauuaaccgauucacaaugaagcauaaaaaggcaacauaugaggcagauguggauuuagggucagggacacgaaauauagggauagaaucagaaauacccaauuuggauauaaucggaaaacgaauugagaaaauaaaacaggaacaugaaacguccuggcauuaugaucaggaucaucccuauaaaacuugggcauaucacggaucguacgaaacgaaacagacaggcagugcaucaucgaugguaaacggcguaguaagacuauugaccaaaccgugggaugucgugccaauggugacccaaauggcaaugaccgauacaacuccuuucggacagcaaaggguguuuaaagaaaaaguggauacgcgaacacaagaacccaaggagggcacuaagaaacugaugagaauuacggcggaguggcuuuggaaagaacuggggaaaaagaaaacacccaggauguguaccagagaagaauuuacaagaaaaguucgcaguaacgcugcccuuggugccauauucaccgacgaaaauaaauggaaaucugcaagggaagcaguugaggacggacgauucugggaauuagucgauagagagcgaaaucuacauuuagaggguaaaugcgaaaccuguguuuacaauaugauggggaaaagggagaagaaacuuggggaguuugguaaagcaaaaggaagccgggcgaucugguauauguggcuaggagccagauuucuagaauuugaagcgcuaggcuuucugaaugaagaccauugguucucgagaggcaacagucuuaguggcguagaaggagaggguuuacauagacuuggauacauucuaagagauguugguaagaaagaaggaggggcaauguaugcugaugauacugcagguugggauacaagaauuacguuagaagaucugaaaaaugaagagauggucacaaaccacaugaaaggcgagcauaagaaacuagcugaagcaauauuuaaauuaaccuaccaaaacaaaguagugcguguacaaagaccaacuccaagaggaacaguaauggauauaaucucacgacgugaucaacggggaagcggccaaguuggaacuuaugguuuaaacacauuuacuaacauggaagcucaacuaauaagacagauggagggagaagguauauucaaaucgauacaacaucugacagccacagaagagauagcugcucaaaauugguuagcgagaguuggcagagaacgauugagcaggauggcuauuucuggcgaugacugcgucguaaaaccuauugacgaucgauuugcuucugcacuaacagcauuaaaugauaugggcaagguuagaaaggacauucaacaaugggaaccgagucgagguuggaaugacuggacucaaguaccauuuuguagucaucauuuccaugaacugguaaugaaagauggcagaguacucgucguuccgugcagaaaucaagaugaguugauaggucgugcaagaauaagucaaggagcaggauggucacugaaagagacagccugucuuggaaaaaguuacgcucaaauguggacccuaauguacuuucacaggcgggaccuucgccucgccgcuaacgcaauauguagugccguacccucacacugggugccaacaaguaggaccacuuggaguauucacgcuaaacacgaauggaugacaacggaagacauguuagcaguguggaaucgugucuggauccaagaaaacccauggauggaagacaaaacccccguggagagcugggaggaagucccuuauuuagggaaacgggaagaccaguggugcggaucccucauaggccugacaucuagagccacaugggcgaagaauauucaaacagccaucaaucaggucagaagucuuauagguaaugaagaauacacggacuauaugccuagcaugaaaagauuccgacgggaagaagaagaagcuggaguucuaugguag

SEQ ID NO: 22283 - RNA, 9876 nt, Artificial Sequence
  derived and/or modified CDS sequence (opt6) from DENV-2__FJ024474__SS-prME
acugcgggggucauuguaaugcuaauacccacagcuauggcuuuucacuuaacaacacgaaauggagaaccccacaugauuguuggacgucaagaaaaaggaaaaagucuacuauuuaaaacggaagauggaguaaacauguguaccuuaauggcaauagacuugggagaacucugugaagauacaauuacuuauaaauguccauuguuaaaacaaaacgaacccgaagauauagauuguugguguaauucuacuucuacauggguaacauacggcacauguacuacaacaggggaacauagaagagagaaaagaaguguggccuuaguuccccacguagguaugggucuagaaacacgaacagaaacauggauguccagugaaggcgcauggaaacauguucaacgaauagaaacauggauccuaagacauccagguuucacgauuauggcagcgauauuagcauauaccauaggcacgacgcauuuucaacgugcauugauauucauucuucuuacagcuguagcaccaucaaugacaaugcgcuguaucggcauaucgaaccgcgacuuuguagaaggagugaguggaggcuccuggguagauauagucuuagaacauggaucuugcgugacuacaauggcuaaaaacaaaccaacgcuagauuuugaauuaaucaaaacagaagcaaaacaacccgcaacacuacguaaguacuguaucgaagccaaauuaacuaacacaacaacggaaucaagaugccccacccaaggggaaccgucauuaaaugaagaacaggacaagcgauuuauauguaaacauucaaugguggaucgugguugggguaaugguuguggguuauuugggaaaggcggaaucguuacuugugcaauguucacauguaaaaagaauauggaagguaaaguaguccaaccagaaaaucuugaguauacuauaguaauaaccccucauucaggugaagaacacgccgugggaaaugauauugguaagcacggcaaggagauaaaaaucacaccccaaucuaguauuacggaggccgaauugacaggguauggaacuguaaccauggaauguucccccagaacuggcuuagauuuuaacgaaauggugcuacuucaaauggaagacaaagcauggcuaguacauaggcaaugguucuuagaucuaccccuuccauggcuacccggagcugacacacaagguucuaauuggauccaaaaggaaacguugguaacauuuaaaaacccucaugccaagaaacaagauguuguagugcucggcucccaagaaggugcgaugcacacagcguuaacaggagcaacugagauacaaaugucauccggaaaucuacuauuuacuggacaucuuaaguguagacuaagaauggauaaauugcaacucaaaggcaugucuuauaguaugugcacagguaaauucaaaauuguuaaggagauagcagaaacucagcauggaacgauaguuaucagaguacaauaugaaggagacgggucaccuuguaaaaucccguucgaaaucacggacuuggaaaagcgucacguuuuaggaagauuaauuacaguaaaucccauuguaauagaaaaggauaguccagugaauauugaagcggagccuccuuuuggagauagcuacauuauuaucggaguugaaccaggccaauugaaacuaaacugguuuaagaaagguaguaguauaggacaaauguucgaaaccacaaugaggggagcaaagaggauggcgauacuuggggauacugccugggacuuuggcucauugggcggugucuuuacaaguauaggaaaggcuuugcaccaaguuuucggcgcaauauauggagcugcguuuucaggcgugucuuggacaaugaaaauacucauaggaguuguaauaaccuggauugggaugaauagcagaagcacuuccuuaagcgugucuuuaguauuagugggcguuguuaccuuauaccuuggcgcaaugguacaggccgauuccgguugcguuguauccuggaagaauaaagaauuaaagugugguucagguaucuucaucacggauaauguacauacauggacugaacaauauaaauuccaaccagagucaccguccaaacuugcaucagcuauccaaaaagcucacgaagagggaauaugcggaauacgaucaguaacaagauuagaaaacuuaauguggaaacagauuaccccagagcuuaaucacauuuuaagugaaaaugaagucaaauuaacaauuaugaccggggacacaaaggguauaaugcaagcaggaaagagauacuuaagaccacagccaaccgagcuuaaauauuccuggaagacauggggaaaagcgaaaaugcuaucaaccgagagccacaaccaaacuuucuuaauagacgguccugagacagcugaauguccgaacacuaauagagcguggaacucauuagaaguagaggacuauggauucggagucuucacaacaaauauauggcuaaaauuaagagaaaagcaagacguauuuugcgauucuaaauuaaugucagccgcaauuaaagacaacagagcaguccaugcagauauggguuauuggauugaaagugcccucaacgauacguggaaaauggagaaggcuucguucauagaaguuaaaagcugccacuggcccaaaagccacacauuauggucaaauggaguauuagaaagugaaaugauaauaccuaaaaauuuugcuggaccaguaucacaacauaauuacaggccaggguaucacacacagacggccggaccuuggcaccuaggcaagcuggaaauggauuuugacuucugcgaagggacuacggucguaguuacagaagauuguggaaaucgaggacccaguuuacguacaacaacagcuagugguaaacuaauuacagagugguguugucgguccuguacuuuaccuccucuacgguaucgaggggaagauggaugcugguacggaauggagaucagaccauuaaaagaaaaagaggaaaacuuaguuaauucguuggugacugcaggucacggacaaauagauaacuucaguuuaggcgucuuggguauggcauuguuccuagaggaaauguugcgaacacgaguuggaacaaagcaugcaauucuauuaguugcaguaucauuuguaaccuuaauaacagguaauaugucuuucagggaucuugguagagugaugguaaugguaggggcaacuaugacggaugacauagguaugggagucacuuauuuagcauuacuggcagcguuuaaaguucgaccgacguucgcagccggacuuuuacuacguaaauugacaagcaaagaacuaaugauggcaacaaucgguauuacccuccuaucgcaaaguacaaucccagaaacaaucuuggaacuaaccgacgcauuagcauuggggaugaugguucuaaaaauaguacguaauauggagaaguaucaauuagccgugaccauaauggcaaucucuuguguaccuaaugcuguaauacuuagaaaugcauggaagguaaguugcacuauauuagcugcugccucagucucuccacuacuuuuaaccucaagccaacaaaaagcggauuggauacccuuagccuuaacuauuaaaggauuaaauccaaccgcaauauuucuaacaaccuuaagcagaacaucaaagaaaagauccuggccauuaaaugaggcaauuauggcaguagggauggugaguauccuugcuagcucauuacucaaaaaugauauuccgaugaccgguccccuaguggcggguggacuacuaacgguguguuacguacucacaggucguucugcagaucuagaauuagaacgugcagcagacgucaaaugggaagaucaagcagaaauuaguggguccucaccuauacuauccauuacaaucagugaagauggcucaaugaguaucaaaaaugaagaagaggaacaaauacuaaccauauuaauaaggacagggcugcugguaauuucuggaguauucccgguaucuauuccaaucacugcggcagcaugguaucugugggaaguuaaaaagcaacgggccggaguacuaugggacguuccaaguccaccaccuguugguaaggccgaauuagaagacggggcuuauagaauaaaacaaagaggcaucuuaggauauucucaaauuggagccgguguauacaaagagggcacauuccacacuauguggcacguaaccagaggcgcuguucucaugcauagaggaaaaagaauagaaccaucgugggccgaugucaagaaagacuuaauaucguauggcggaggguggaaacuggaaggcgaauggaaagaaggagaagaggugcaaguacuugcauuggagccaggcaaaaauccucgcgcaguucaaacuaaacccggaaucuuuaaaacaaacacuggcacuauaggagcgguuuccuuagacuuuucgccagguaccuccggaucaccgauaguggauagaaaaggcaaagugguaggacuguacggaaauggagucguaacgcgcagcggugcuuacguaucggccauugcacaaacggaaaaaucgauagaagacaauccugaaauugaggacgauauuuucaggaagaaaagacuuacgaucauggaucuccauccaggugcugggaaaacuaaaagauacuuacccgccauaguucgcgaagcaauaaagcgaggacuaagaacguugauauuagcuccaacaagggugguagcugcugagauggaagaagcgcugagaggccugccaauccgauaucaaacucccgcaauaaaggcagagcacacuggacgagaaauuguagaccuuaugugucaugcaacauucaccaugcggcucuuaaguccuguuaggguaccaaacuacaaucuaaucaucauggacgaagcgcauuuuacggauccagcgucgauugcugcucgaggguauauuucgacgagaguugaaaugggcgaagcagcuggaauuuucaugacagcgaccccaccugggucucgggauccauuuccacagucaaaugcaccaaucauggaugaagaacgggaaauucccgaacgaucuuggaacucuggccacgaaugggucacagacuucaaggguaaaacaguaugguucguaccuaguauaaaagcugguaaugacaucgccgcaugucugcguaaaaaugguaagaaaguuauacaacucucgagaaaaacuuucgacucagaauauguaaaaacaagagcaaaugacugggacuucgugguaacuacagauaucucggaaaugggggcgaauuuuaaggcagaaagaguaaucgacccgagacgcuguaugaagccaguuauucuaacccacggugaagaaagaguuauuuuagcaggcccaaugcccgugacacacaguagcgcagcacaacgccguggaagaaucgggcgaaauccuaaaaacgaaaaugaccaguauauauauaugggggaaccacuagaaaacgaugaggauugugcgcauuggaaggaggcgaagaugcuauuagacaacauaaacaccccagaagggaucauuccauccauguuugaaccugaaagagaaaaagucgaugcgguagacggugaauauagacuaagaggcgaggcaagaaagaccuuuguugauuuaaugagacgcggagaucucccgguaugguuagcuuacaaaguagccgcagagggaauaaacuacgcagauagaaaguggugcuucgacggcauuaaaaauaaccagauacuagaggagaacguggagguugaaauauggacuaaagaaggagaaaggaagaaacuuaaaccccguuggcuggaugcgcgcauuuauucagacccuuuggcucugaaagaguuuaaagaguucgccgcaggucgaaagagucuuacucugaacuugauaacagaaauggggagacuuccgacuuuuaugacgcagaaagccagaaaugccuuagauaaucuagcaguguuacauacagcugaagccgguggaagggcguacaaucacgcccuaucggaauuacccgagacucuagagacacuacuauuauugacauuacuagccacagugacaggggguauauuccuauuucuuaugucuggaaaagguauaggaaaaaugacauugggaauguguugcauaauuaccgcuucaguucuucuaugguacgcacaaauacagccccacuggauugcugcgucgauuauacuagaguucuucuuaauugucuuauugauccccgaaccagaaaagcaaagaacaccucaagauaaccaacuuacuuacguaguaauugcaauauuaaccguuguugcagcgacaauggcaaaugagauggguuucuuagagaaaacgaagaaagaucuggggcuaggauccauuaccacccaagagucagaaaguaauauacucgauauagacuugaggccugcaagcgcauggacauuauaugcugucgcaacuaccuuugugaccccuaugcuaaggcacucuaucgaaaauucuucaguaaaugugucacuaacugcuauugcaaaucaagccacagugcuaaugggacuaggcaaaggauggccccuaucgaaaauggacauaggagugccccuacuagcaauuggauguuauagucaaguuaauccaaucacauuaacggccgcacugcuauuacucguagcacauuacgcuauuauagggccgggacuacaggcaaaggcaacacgugaagcucaaaaacgagccgcugcuggaauuaugaagaacccaacagucgauggaauaacugucauagaccuagaaccuauaccauacgauccuaaauuugaaaaacaacuugggcaaguaaugcucuuaauacuuuguguaacccaaguauuaaugaugaggacaacaugggcacugugugaagcccuaacucuagcaaccggaccgauuaguacacuaugggaagguaacccuggaagguuuuggaauacuacgauugcugugaguauggcgaauaucuuuagaggauccuaccuagcaggcgcaggacuuuuauuuaguauaaugaagaacacuaccaauaccagacgaggaacggguaacauuggggaaacuuuaggggaaaaauggaaaagucgccuaaacgcacuaggaaaaagugaauuucagauuuauaaaaagucuggcauccaagaaguggaccgcacuuuagccaaggagggaaucaaaagaggagagacugaucaucaugcagucagccggggcucggcaaaacuaagaugguucguugaaaggaauaugguuacaccugaaggaaaaguaguggaucuagguugcgggagaggaggguggagcuacuacugcgguggcuugaaaaacguuagagagguuaagggacuaacaaaaggagguccuggacaugaagaaccaauacccaugucuaccuacggguggaaucuggugaggcuccagagugguguggacguguucuuuacuccucccgaaaaaugugacacacuacugugcgacauuggggaaagcuccccaaauccuacaauagaagccggacggacgcuacgcguacucaaucuuguagaaaauugguuaaauaauaauacgcaauucugcaucaaaguacuuaauccauacaugccuucaguaauugagaaaauggaaacauuacaacgaaaguauggaggagcauugguuagaaauccauuaagccgaaauucaacucaugaaauguauuggguaucaaaugcaacuggcaauaucguaaguucaguuaacaugauaagcagaaugcucauaaauagguuuacaaugaaacauaaaaaggcaaccuacgagccugauguugaccuugguucgggaaccagaaauauuggaauagaaagugagauaccaaauuuagauauaauugguaaaagaaucgagaaaauuaagcaagaacaugagaccagcuggcacuaugaucaggaucauccauauaaaacuugggcuuaccaugguaguuaugaaacaaaacaaacagguucagccagcucuauggucaacgggguuguaagauuauuaacgaagccaugggauguagugcccaugguuacucaaauggcaaugacugacaccacuccauucggacaacaacgaguuuucaaggaaaaagucgacacaaggacacaggaaccaaaagaagguacaaagaaacuuaugagaauaacugccgaguggcucuggaaggaauuagggaagaagaaaacuccgagaauguguacucgagaagaauuuacaaggaagguaagaagcaacgcggcauuaggagcuaucuuuacugacgagaauaaauggaaaagugcccgagaagcuguugaagacgggagauuuugggaauuggucgaccgcgaacguaaccuccaccuagaaggaaagugugaaaccugcguuuauaauaugauggggaagagagagaaaaagcugggcgaauuugguaaagcaaaaggcagcagggcaaucugguauaugugguuaggagcucgauuccuagaguuugaagcauuaggauuucuaaaugaagaccauugguuuuccagaggcaacaguuugaguggcgucgaaggcgaagggcuucacagauuaggauacauacuucgcgauguugguaaaaaggaaggaggugcuauguacgcagaugauacagcagguugggacaccagaauaaccuuggaggacuuaaagaaugaggagauggucacuaaccacaugaaaggagaacauaagaaacuugcggaagcaauauuuaaauuaacuuaucaaaacaaagucguuaggguucagagaccaacaccccgaggaacgguaauggauauuauaucaaggcgagaccaaagggguucuggccaagugggaacguauggccuuaauaccuuuacaaacauggaagcccaacucauaagacagauggaaggugaagguauauuuaaaucuauacaacaccuaaccgcaacagaagaaauugcagcucagaacugguuagcuagaguuggaagagaacgcuuaucacgcauggcuauaagcggugaugauugcguaguaaagccuaucgaugaucgguucgccagugcacuaacugcucucaacgacauggggaaaguaagaaaagacauccagcaaugggaacccaguagagguuggaaugauuggacucaagucccauucuguucacaucauuuccaugaauuaguuaugaaagauggccguguccuaguaguaccaugccguaaccaggaugaacucauugguagagcuagaauaucucaaggagcugguuggucccugaaagaaacagcuugccugggaaagucauacgcacaaauguggacuuuaauguacuuucacaggagggaucuuagguuagcagcuaaugccauuugcucugcuguaccuucucacuggguaccgacuucuagaacgacaugguccauacacgcuaagcacgaauggaugacaacagaagacaugcuggcgguguggaaucgaguguggauacaggagaauccauggauggaagauaaaaccccuguagagucuugggaagaagucccguacuuaggaaaaagagaagaucaauggugcggcagcuuaauugggcuuacuucgcgagcuacaugggcuaaaaauauucaaaccgccauaaaccaagucaggucuuugauagggaaugaggaguacacagacuauaugcccucaaugaaacgauucagacgagaagaggaagaagcaggcgugcuuugguaa

SEQ ID NO: 22284 - RNA, 9876 nt, Artificial Sequence
  derived and/or modified CDS sequence (opt6) from DENV-2__FJ024475__SS-prME
acugcugguguuauaguaauguuaauuccaacggcgauggccuuucauuuaacuacaagaaacggggaaccgcauaugauaguaggccgacaagaaaaagggaaaucuuuauuauucaaaaccgaagauggaguaaacauguguacauuaauggcgauagauuuaggcgaacuaugugaagacacaauaacauauaaauguccucuacuacgucaaaaugaaccugaagacauugacugcugguguaacagcacaaguacauggguuacguacgggacuugcacaacaaccggagagcaucgucgagagaaaagaucuguagcauuaguaccacauguaggcaugggauuagagacaagaacugaaaccuggaugucgagcgagggagcuuggaaacauguacaaaggauagagacuuggauacuucgucauccaggcuuuaccauuauggccgcuaucuuagcauauacaauuggaacuacacauuuccagcgcgcacuaaucuuuauucuacuuaccgcaguugcgccuaguaugacuaugagauguaucggaauuucuaaccgagacuuuguggaaggaguaagcggagguucguggguugauauagugcuugagcaugguucuugcguuacaacuauggcuaaaaauaaaccaacacuugauuuugaacugauaaaaaccgaagcaaaacagccagccaccuuaagaaaauauuguauugaagcaaaacucaccaauacaaccacagaaucaagaugucccacacaaggcgaaccaucucugaaugaagaacaagacaaaagguuuauaugcaaacauucaaugguugaucgggguuggggcaaugggugugggcuguucggaaaaggaggcauaguaacaugcgccauguucaccuguaagaaaaacauggaagggaaaguggugcaaccggaaaauuuagaguacacuauugugaucacaccacauagcggggaagaacaugccguaggugaugauacaggaaaacacgguaaagaaaucaaaauaacuccucaaagcucaaucacagaagcugaguuaacuggguaugguacuguuacuauggaaugcucaccaagaacuggauuagauuuuaaugagaugguauuacuacaaauggaagauaaagcaugguuaguucaccgacaaugguuucuugauuuacccuuaccauggcugccaggagccgauacacaaggaagcaauuggauucaaaaagaaacauuaguuaccuuuaaaaacccgcaugccaagaaacaagacgucguaguccuagggucucaagaaggugcaaugcauacugcacuaacaggagcgacugaaauccaaaugaguucaggcaacuuauuauuuacuggacaccugaaauguagauuaagaauggauaaauuacaauuaaaaggcaugucauacucuauguguacagggaaauuuaaaauaguaaaagaaauugcagaaacacaacacgguacuauaguaauuagaguacaguaugaaggcgauggaagcccauguaaaaucccauuugagauuacggauuuggaaaaacgacaugucuuagguagguugauuacaguaaacccgaucgucauagaaaaagacagcccagucaacauugaagccgagccgccuuucggggauucauacaucauaauaggagucgaaccgggccaguuaaaacucaauugguucaagaaagguucaucaauugggcaaauguucgaaaccacaaugcgcggagcaaaaagaauggcuauuuugggcgauaccgccugggacuuuggcagcuuaggaggaguuuuuacaaguaucggaaaggcuuuacaucaagucuuuggcgcaauauauggagcugcguucaguggugucucuuggacaaugaaaauuuugauuggcguuguaauuaccuggauuggaaugaacucgagaagcacgucuuuaaguguuagccuuguccuaguaggcgucgugacucuguaucugggugcuaugguucaagcggacucaggaugcguagugucuuggaaaaauaaagaauugaaaugcggaagcgggauauuuauuaccgauaacguacacacuuggaccgagcaauacaaauuccaaccagaaucuccgagcaaauuggcaucggcaauccaaaaagcacacgaagaaggaauuugugguaucagaucaguaacaaggcuggaaaacuugauguggaaacaaauaacaccugaacuaaaccacauauuaucugagaacgaagugaaauuaacuauaaugacaggugauacaaaagguauuaugcaagcagguaaacgguaucuacggccacagcccacugagcuuaaauacucauggaaaacauggggaaaagcaaaaauguuaucgacagaaagucacaaucaaacauuucuaauagauggcccggaaacagcagaaugcccuaacaccaauagagcguggaacucuuuagaaguagaggacuauggguuugguguuuucacaacuaacauaugguugaaacuacgggaaaaacaagauguuuucugugauaguaaacuaaugucagcugcaauaaaggacaacagagcuguacaugcugauauggguuauuggauagaaagcgcauugaaugacaccuggaaaauggaaaaggcaaguuuuauagaaguaaaaucgugccauuggccuaagucacauaccuuauggagcaaugguguguuagagucagaaaugauuauacccaagaacuuugcgggucccgucagccaacauaacuauaggccaggcuaucauacacaaacggcggguccauggcacuuaggcaaguuagaaauggauuuugauuucugcgagggcacaaccguuguuguaacggaggauugcggcaauagaggcccaagccuucggacgaccacagcaucaggcaaacuuauaacugagugguguuguagaucaugcacacuaccuccucugagauacagaggugaagacggguguugguaugguauggaaauaagaccuuuaaaggaaaaagaagaaaacuuaguaaauucccuggucacagccggacauggucaaauagauaacuuuagcuuagguguauugggcauggccuuauuucuagaagaaauguuacgaacacggguaggaacgaaacaugcuauccuccuaguggcuguuuccuucguuacacuaauaacuggaaacaugucauuucgagacuuaggacgagugaugguaaugguuggggcaacuaugaccgacgacaucggaaugggaguuacguaucuugcucugcuugcagcauuuaagguuagacccacguucgcggccgggcuuuuacuuaggaaauuaacaucaaaagaacuuaugauggcaacaaucggaauuacccuuuuaucucaaucuacaauaccagagacaauuuuggaacuuacggaugccuuagcucugggaaugaugguucuaaagauugucagaaacauggaaaaauaucaguuggcaguaacuaucauggcaauuagcugcgucccgaacgccguuauccugaggaaugcauggaaaguaagcugcacaauacuagcagcaguaaguguauccccucuucuacuuacgucaucccaacaaaaagccgacuggaucccgcuagcacucacgauaaaagguuuaaacccuaccgcaauuuucuuaacaacgcugucacguacgucuaagaaacgaucauggccacuuaacgaagccauaauggcuguaggaaugguuucaauccuagcaucgagcuugcucaaaaaugauaucccuaugacggguccauuagucgcggguggccuauuaacaguuuguuaugucuuaaccggacgaagcgcggaucuagaauuagagcgugcugcagacguuaaaugggaagaucaagcugaaauaaguggaaguucuccuauacucagcaucacuauuucggaggauggaucuaugucgaucaaaaaugaggaagaagaaacgacauugacaauucucaucagaacaggauuguuaguaauuaguggggucuuuccuguaucuauucccauaacugcugcugcgugguaccuaugggaagucaagaaacaaagagcugguguuuuaugggauguaccaucucccccacccguagggaaagcugaacuugaagacggagccuacaggauuaaacagagaggcauacugggcuauucucagauaggugcugguguguauaaagaagguacauuucauacgauguggcaugucacgagaggggcagugcuuaugcacagaggaaagcgcauugagccuucgugggccgacgucaagaaagaccuuauauccuauggggguggcuggaaacuugagggagaguggaaagaaggagaggaagugcaagucuuggcguuagagccaggaaagaacccaagagccguccaaacgaaaccgggaauuuucaaaacaaauaccgguacgauuggcgcuguaucucuugauuucucaccaggaacuucuggaucacccauugucgaucgcaaagguaaaguugugggacuauauggaaauggagucguuacuagauccggcgcauauguaagugcuauagcucagacagagaagaguauugaagacaacccugagaucgaagacgacauauuuaggaagaaacgucuaacuauuauggauuuacacccgggugcugguaagacuaagcgguauuuaccagcaaucguuagagaagcaauaaaacgagguuuacguaccuuaauacuagccccaacuagaguggucgcggccgagauggaagaggcauuaagaggucuaccaauccguuaucaaacuccggcgauaaaagccgagcauacaggacgagagaucguugaucuaaugugccaugccacguuuacgaugcggcuguugucgccuguuagggugccaaacuauaaccugauaauaauggaugaagcacauuuuaccgauccagcguccauugcagcuagaggauacauaaguacuagaguugaaaugggugaggcagcgggaauauuuaugacugcuacaccaccagguucaagggacccuuuuccucaaucuaacgcccccauaauggacgaagaaagggagauuccugagcguucuuggaauagcggacacgaaugggucacagauuuuaaagguaaaacaguaugguucguaccuucaauuaaagccgguaacgacauagccgcaugucucagaaagaaugguaaaaagguaauacagcuaaguagaaaaaccuucgacuccgaguacguaaagacuagggccaaugauugggauuuuguaguaacaacagacauuuccgaaaugggugccaauuucaaagcugaaagagugauagacccacgacgguguaugaaaccaguuauacuaacggacggagaggagagagugaucuuagccgggccaaugccaguaacacauucgucggcugcacaacgaagggguagaauagggaggaauccaaagaaugaaaaugaccaguauauauauaugggagagccccuugaaaaugacgaagacugugcacauuggaaagaagcaaaaaugcugcuagacaauauaaauacuccugaaggaauuauaccaucuauguuugagcccgaacgggaaaaaguugaugcaguagauggugaguauagauuaagaggggaagcaaggaagacguuuguagaccuaaugcgacgaggagaucucccaguaugguuagcauauaaaguagccgcggaaggcauaaacuacgccgacagaaaaugguguuuugacgguauuaagaauaaccaaauccuagaagaaaacgucgaaguagaaauauggacaaaggagggcgaaaggaagaaacuuaaaccgagaugguuagacgcaagaauauacucagauccguuagcccuaaaggaauuuaaagaguuugccgcgggacgaaaaagucucacucuuaauuuaauaaccgaaaugggcagacugccaacauucaugacgcaaaaagcacguaaugcguuagacaaccuagcuguucuacauacggcggaagcgggcggacgcgcguacaaccacgcacugagcgaauuaccagaaacccuagaaacacucuuauuacuuaccuugcuugcuaccguaacaggagguauuuuccucuucuuaauguccgguaagggaauuggaaaaaugacauuagguauguguuguaucauaacagccucuguacuucuuugguaugcucaaauucagccacauuggauugcugcuucaauuauccucgaauuuuuccuuauaguauuauuaauaccagaacccgaaaaacaacggacgccacaagacaaccaacuaaccuacguugugauagccauacugacagucguagcagcaaccauggcaaaugagaugggcuuuuuggagaaaacgaagaaagacuuaggccuaggaagcauuacgacucaagagucagaaaguaauaucuuggacauugauuuaagaccagcuucugcguggacauuauacgcaguugcaaccacauucguaacacccaugcuacgucacucgauugaaaacucgucaguaaaugucagcuugacugcaauagcgaaucaagcgacgguauuaauggguuuaggaaaagguuggccacuaagcaaaauggacauaggcgucccacuauuagcaaucggauguuauucucaagucaaucccaugacccuaacugcagcuuuauugcuuuuaguugcgcauuaugcaauaauuggaccgggacuccaggcuaaagccacaagagaagcccaaaaacgggcggcugccggaaucaugaaaaauccuacaguagaugggauaacgguuauagauuuagaaccgauaccuuacgaucccaaguuugaaaaacaauuagggcaagugaugcuacucauacuaugugucacucagguacucaugaugcgcaccacaugggcacucugcgaagcccuuacccucgcaacgggacccauauccacuuugugggaagggaauccaggacguuuuuggaacacaacaauugcaguaucaauggccaacauauuuagaggaucauauuuagcuggcgcuggacuauuguuuucaauaaugaaaaauacuacuaacacccgaagagggacaggaaacauuggcgagacccuaggugaaaaguggaaaagucgacuaaaugcucuaggaaaaagugaauuucagauauacaagaaaucgggaauccaagaaguugacagaacuuuagcaaaagaagguauuaaacgaggcgaaacagaccaucaugcgguaaguagaggauccgccaaacuuaggugguuugucgagagaaacauggugacaccugaaggaaagguagucgaucugggaugcggacguggagguuggaguuacuacuguggugguuugaagaauguuagggagguuaaaggacuaacaaaaggagggccuggacacgaagaaccgauaccaauguccaccuauggauggaacuuaguccggcuacagucggguguagacguguucuuuacgccaccugaaaaaugugauaccuuauuaugcgacauaggagaaaguucaccaaacccaacaauagaagcaggcaggacgcuaaggguacucaaucucguagagaacuggcuaaauaauaacacgcaauuuugcauaaaagucuugaacccguauaugccgagcgugauugagaaaauggaaacuuuacagagaaaauacgggggagcacucguucgaaaccccuuaucucggaacaguacccaugaaauguacuggguuagcaacgccacaggaaacaucgugaguucugucaacaugaucucaagaaugcuuauuaacagauucaccaugaaacauaagaaagcuacauacgaaccggauguagacuugggaucaggaacucgaaauaucggaauagagagugaaauuccaaaucuagacauaauugguaaaagaauugagaaaaucaaacaagagcaugaaacuucauggcauuacgaucaagaccacccauacaaaaccugggcuuaucauggcuccuaugaaacaaagcagaccggcagugcaaguagcauggucaaugguguagugagauugcuaacaaaaccuugggauguagucccuaugguuacccagauggcuaugacagacacuaccccuuucggccagcaaagagucuuuaaggaaaaaguugacacgcguacacaggaaccgaaggagggcacuaagaaacuaaugcgaauuacagcagaauggcuuuggaaagaauuaggcaagaagaaaacaccacgaauguguacccgagaggaguucacaagaaaagugagaagcaacgcagccuugggcgcaauauucacugaugagaauaaauggaaaucagcacgggaagcgguagaagacgguagauuuugggaacucgucgaucgagaaagaaacuuacauuuagaagguaaaugugaaacuugugucuauaacaugaugggcaaacgggagaagaaauuaggcgaauuuggaaaagcaaaaggaagcagggccauaugguauaugugguuaggagcgagauuucuggaguucgaggcacuaggauuccuaaaugaagaucacugguucucgagagguaauagcuuaucaggaguagaaggagaaggauuacauagauuagguuauauucuaagggacguggguaagaaagaaggaggggcuauguaugccgaugacaccgcggguugggauaccaggauuacuuuggaagaucuuaagaaugaggaaaugguuaccaaucacaugaaaggcgaacauaagaaauuagcagaagccauuuuuaaacucacguaucaaaauaaaguuguacgaguccaaagaccgacuccacggggaacaguuauggauaucauuagcaggagagaccagaggggaucuggucaaguagguaccuauggccuaaacacauuuacgaacauggaagcacaacuuauuagacaaauggagggggagggaauauuuaaaaguauucaacaucucacugcaacugaagaaauagcugcacaaaauuggcuggcuagaguuggccgagagagguuauccagaauggcgauuucaggugaugacuguguaguuaagccaauugaugaucgauuugcaagcgcccugacagcccuaaacgauauggguaaaguaagaaaagauauucaacaaugggagccuucacgcggauggaacgacuggacucaaguaccuuuuuguagucaucauuuccaugaacugguaaugaaagacggaagagucuuaguggucccguguagaaaucaggaugaauuaauugggagggcacggauuucucagggggccggcuggagcuuaaaagagacggcuugucugggaaaaagcuaugcccagauguggacauuaauguauuuucaccgaagagauuuacgacuggcugccaaugcgauauguucagcaguaccaucucacuggguuccuacaaguagaacgaccuggaguauacacgcuaaacaugaguggaugacuacagaagauauguuagcugucuggaaucgcguuuggauccaggaaaacccauggauggaggacaaaacuccuguagagucaugggaagaaguuccauacuuaggaaaaagagaagaucaguggugugguucucucaucggccuaacaucccgcgccacgugggcgaaaaauauucaaacugccauaaaccaaguccggucacuaauaggaaaugaagaguacacugauuacaugccaucaaugaaaagguuccgaagggaagaagaagaggcagggguucuaugguag

SEQ ID NO: 22285 - RNA, 9867 nt, Artificial Sequence
  derived and/or modified CDS sequence (opt6) from DENV-2__FJ182012__SS-prME
acagcgggaguaauaguuaugcuaauuccuacagcaauggcauuccaccugacaacucgaaauggagaaccacauaugaucguaggacgacaagaaaaaggaaaaucauuacuauuuaaaaccgaagaugguguaaauaugugcaccuuaauggcaauugaccuaggugaacuaugcgaagauaccaucaccuauaaauguccucuauuaagacaaaacgaaccugaagauauugauuguuggugcaacucaacuucaacauggguaacguacgguaccugcacaacaacuggggaacauagacgugaaaaacggaguguagcauuagucccacauguggguaugggauuagaaacaaggacggaaacauggaugaguucggaaggcgccuggaaacauguacaaagaaucgaaacuuggauauuaagacauccgggguucacaauaauggccgcaauacuggcauauacuauaggcacaacccauuuccaacgagcguuaaucuuuauacuauuaaccgcaguagcccccucuaugacuaugagauguauagggauuucaaaucgagacuuugucgaagguguuagcgguggauccuggguggacaucguauuagaacacggcucauguguuaccacuauggccaaaaauaaaccgacauuagauuucgaacuaaucaaaaccgaagccaaacaaccagcgacguugaggaaauacugcaucgaagcaaaauuaacaaauaccacuaccgaaagccgguguccuacgcaaggcgaaccaagucuaaacgaggaacaagacaaaagguucauaugcaaacacagcaugguagauagaggauggggaaauggauguggauuguuuggaaaagggggaaucguaacgugcgcuauguuuacaugcaagaaaaacauggaaggaaaagugguacaaccggaaaaucuugaauacacuaucguaauuaccccacauucgggcgaagaacaugcgguaggaaaugacaacggcaaagaaauaaaaauaacaccacaauccucaauuacggaagcugaacuaacaggauaugggacuguaacaauggaguguucaccgcgcacgggucuagauuucaacgaaaugguacuguuacaaauggaagauaaagcgugguuaguccaucgucaaugguuccuagaucuuccccuaccuuggcuuccaggugccgauacucaagguaguaacuggauucagaaagaaacgcuugucacauuuaaaaauccacacgccaagaaacaggacguuguaguauuagguucucaggaaggugccaugcacacagcucuuaccggcgcgacagagauacaaaugaguucaggcaauuuguuguuuacuggucacuugaaauguaggcuucguauggauaaacuacaacuaaaaggaauguccuacucaauguguacagguaaauucaaaauaguaaaagaaauagcugaaacccaacaugggacaauaguuauucgaguucaauaugaaggagauggauccccuugcaaaaucccauucgagauuacggaccuggagaaacgacauguauuaggucgauuaaucaccgugaauccaaucguaauagaaaaagacaguccggugaacaucgaagcagagcccccauucggcgauucuuacauuauaauaggcguagaacccgggcagcuaaaacuaaacugguuuaagaaagggagcucgaucggacaaauguuugaaaccacuaugcgaggagcuaaacguauggccauuuuaggcgauaccgcgugggauuuugguucacuaggaggugucuuuacaucuauuggcaaagcacuacaucaaguauuuggggcaauauacggugcggcauuuuccggaguuagcuggacaaugaaaauacuaauuggagucguuaucacauggauagggaugaacucucgauccacaucgcuaucuguaucguuaguacuuguuggcguaguaacauuguaccuuggagccaugguucaggccgacuccgguugcguugugagcuggaaaaauaaagagcuuaaaugcgguucugguauuuuuauaacggacaauguucacacguggacagaacaauauaaauuucaacccgaaaguccuucaaaauuagcgucagcuauucaaaaagcgcacgaagaagggauaugcgggauuagaucggucacucgacuugagaauuuaauguggaaacagauaacucccgaauugaaucauaucuuaucagaaaaugaaguuaaacuaacaauuaugacgggagauacgaaaggaauaaugcaagccggaaaacguuaccuacgaccgcaaccuaccgagcucaaauauucauggaaaacuuggggaaaagcaaaaauguugucaacggaaagucacaaucaaacauuccuaauagacggcccagaaacagccgaaugcccuaauacaaacagagcauggaacagucuggaaguagaagacuacggauucgggguauucacaacuaacauauggcuaaaacuucgugagaaacaagauguuuucugugauucuaaauuaaugagugcagcuauuaaagauaaucgagccguucaugcagauauggguuauuggauugagucggcguugaaugacacauggaaaauggaaaaagccaguuucauagaagucaaaucuugccauuggcccaaaucacauacccuauggucaaaugguguucuagaaucggaaaugauaauuccuaagaauuucgccggaccaguuucacaacauaauuauaggccaggguaucauacucagacagccgguccuuggcacuuaggaaaacuugagauggauuuugauuuuugcgagggaaccacggugguaguaacagaagacugcgggaaucgagggccaucauuacgcacaaccacagcaagugguaaacuaauaaccgaaugguguugucguaguuguacuuuaccuccgcuccgauacaggggagaagacggaugcugguauggcauggaaauaagaccguuaaaagagaaggaggaaaacuuaguuaauucgcuaguaacagcgggacauggacaaauagauaauuuuaguuugggagucuuagguauggcauuauuccuagaagaaauguuacguacaagagucggaacgaaacaugccauacuacucguagcaguuucauucguaacccuaauaacaggaaacaugucauucagggaccuaggcagaguaauggucaugguuggcgcaaccaugacggaugacauagggauggggguuacuuauuuggcucucuuagccgcuuucaaggucagaccuacuuucgccgcuggauuauugcucagaaaacugacaucaaaagaacucaugauggcgacaauagggaucacauuguuaagucagaguaccauuccagaaacaauauuagagcuaacugaugcucuggcauuaggaaugaugguauugaaaauaguuagaaauauggaaaaauaccaacuagcaguuaccaucauggccaucaguugcguacccaaugcuguuauacuuagaaaugccuggaaaguuucgugcacaauccuagcugcugucagcguaaguccuuuguugcugacaucaucucaacaaaaagcagauuggauuccacucgcccucaccauuaaaggacuaaauccuacagccauauuuuuaacaacucuaaguagaacaucaaagaagcggaguuggcccuugaaugaagccauaauggcaguugguauggucagcauucuagcgucaucacuacuuaaaaaugauaucccuaugacagguccacuugucgcgggaggucuucuaacaguaugcuauguccucacaggacguuccgcagaccucgaauuagaaagggcggccgacguuaaaugggaagaucaagcugagauaaguggaucaaguccgauccuaaguauaaccauuucggaagauggaucgaugucaauuaaaaaugaagaagaagaacaaauccuaacaaucuugauacgaacagggcugcuaguuauuucgggaguauuuccagucucaauaccuauuaccgcggccgcgugguacuugugggaggucaagaagcaaagagcugguguauugugggauguaccaagucccccgccaguuggaaaggcagagcuggaagacggcgcauauaggauuaagcaaagaggcauccucggguauagucaaauuggcgcaggcguauauaaagaggguacauuucauacaauguggcauguaacaagaggugcaguguuaaugcauagaggcaagagaauugagccaaguugggcagaugucaagaaagacuuaauaaguuauggaggcggcuggaagcuggaaggagaauggaaagagggcgaagaaguucaaguacucgcacuugaaccuggcaaaaacccgagggccguucaaacaaaacccggaauuuucaaaaccaauacggggacuauaggugcagucucacuggauuuuucaccggggacaaguggaaguccaauuguagauagaaagggcaaaguagucggauuguauggcaauggaguaguaacuagaaguggcgcauauguaagugccauagcgcagaccgaaaaaucuauagaagauaauccagagaucgaagacgacauauuuagaaagaaaagguuaacaaucauggaucuacauccuggugcaggcaaaacaaaaagauaucuaccugcaauagugagagaagcuauuaaacgggguuuacguacauugauacucgcaccaacgcgcguagucgccgcugaaauggaagaagcacuaagagggcucccaauaagauaccaaacaccggcaaucaaagccgaacauacaggcagggaaauuguagauuuaaugugucacgcgacuuuuacuaugagacuucugucacccguacgaguacccaauuacaaucuaauaauaauggaugaggcacacuuuacggacccagcgucaauagcggccaggggauauauuucaacccgugucgagaugggggaagccgcaggcauauuuaugacugcgacuccuccugggucacgugaucccuuuccucaaagcaaugcgccaauaauggaugaggagagagaaauacccgaaaggucauggaauagcggucacgaguggguaacugacuucaaaggaaaaacaguaugguucgugccgucaauaaaagccgggaaugauauagcggccuguuuaaggaaaaauggcaagaaaguaauucaacugucaagaaaaacuuucgacucugaauacguuaaaaccagagcuaacgauugggauuuuguugucacuacggauauaucagagaugggcgcuaacuucaaagccgaaagagucauagauccgcgaagaugcaugaaaccagucauuuugacucauggugaagagagaguuaucuuagcuggaccaaugcccguaacucacucuucggcggcucaacgaaggggacgaaucggaaggaaccccaaaaaugaaaacgaccaauauauauacaugggagagccuuuagagaacgaugaagauugugcacacuggaaagaagcgaagaugcuacuagauaauauuaauacacccgaaggcauuauaccaucaauguuugagccagagcgagaaaagguagacgcaguagacggagaauaucgucuacgaggagaagcccgaaaaacuuuuguggaucuuaugcgccgaggcgaccugccuguaugguuagcauacaaaguugcugcugagggcauaaacuacgcagaucgaaagugguguuuugaugguauaaagaacaaccaaauacuggaggaaaacguagaaguugaaaucuggacuaaggagggggaaagaaagaaacuaaagccaagauggcuagacgccaggauauacagugauccucucgcauugaaggaguucaaagaguuugcagcaggaagaaagucuuuaacucugaaucuaauuacugagauggggcgauugccuacauucaugacucagaaggcuagaaacgcgcuagauaauuuagcaguauuacauaccgccgaggcuggaggcagagcauacaaucacgcccucuccgaauugccugaaacacuagaaacuuuacuguuauuaaccuugcuagcaaccgucacaggaggaaucuuucuauuuuuaaugucagggaaggguauugguaaaaugacuuuagggaugugcuguauuaucacagcaucaguacuacuuugguacgcucaaauucaaccacauuggauagcugcaaguauaauauuagaguucuuccuaauuguuuuguuaaucccagaaccagagaaacaacgcacaccccaagauaaucaauugacguaugucguuauagcuaucuuaacagugguugccgcgacaauggcgaaugaaaugggcuuccucgagaaaaccaagaaagaccuuggguuaggcucaauaacaacacaggaaagugagucuaacauuuuggauauagacuugcgaccugcuagugccuggacucuauaugcuguagcgacaacguucguaacgcccaugcucagacauagcaucgaaaauaguucuguaaaugugucauugacagcgauugccaaucaagcaacuguuuuaaugggguugggaaaaggcuggccacucucaaaaauggacauaggaguaccucuauuagcgauuggaugcuauucacaaguaaaucccauaacucucacugcugcacuacucagucuaguugcacacuaugcuauuauaggcccgggccuucaagcgaaggcuacgagagaagcccagaaaagggcagcagcaggaaucaugaaaaacccgacggucgacgggauuacuguuaucgauuuagaaccaauuccguaugauccaaaauuugaaaaacaguuaggccaggucauguuauuaauuuuaugcgucacacagguguuaaugaugcgaacaacuugggccuuaugugaggcccucacgcuagccacugguccuauaaguacuuugugggaaggaaauccaggcagguucuggaacaccacuauugcagucucaauggcaaacauuuuccgcggcaguuauuuagcaggggcagggcuauuguucucgaucaugaaaaacaccacaaauacuagacggggaaccggaaacauuggugagaccuuaggagaaaaauggaaauccaggcuuaaugcauuggggaagucagaguuccaaauauacaagaaaagugguauucaagaaguagaucgaacccucgccaaggaaggcaucaaacgaggggaaaccgaucaucacgccgugucaagaggcagcgcaaaauuaagaugguuugucgaaagaaauaugguuacaccagaaggaaaagucguagaucucggauguggcagaggaggauggagcuacuacugcggaggacucaaaaauguuagagaaguaaaagguuugaccaaaggagguccuggacacgaagaaccaauaccgaugaguacauauggguggaauuuaguaagauuacaaagcgggguagauguauucuuuacuccuccggaaaagugugauacuuuauugugugacaucggugagaguucccccaaucccacaauagaagcugggcggacccuaagagugcuaaaucuuguggaaaacuggcuuaauaacaauacucaauucugcaucaaaguauuaaauccuuauaugccgucgguaauagagaaaauggaaacucuucaacgcaaauacggaggugcccuuguacgaaauccacuaucacgcaauucaacucacgaaauguacuggguuagcaaugcuacuggaaacauugucucaucagucaauaugauaagucguaugcuaauaaaucgcuuuaccaugaaacauaagaaagcaaccuacgagccggauguagaucuagguucagguacuaggaacauuggaauagagucggaaauuccaaaucuggauauuauuggaaaacgaaucgagaaaauuaaacaagaacacgaaacauccuggcauuacgaucaagaccacccauauaagacuugggcauaucacggaucuuaugagacgaagcagacuggaucagccuccuccauggucaauggaguagucagauugcuaacuaaacccugggauguaguaccaauggucacacaaauggcuaugacagauaccacaccauuuggucagcagagaguauucaaagagaaagucgacacuagaacucaagagccaaaagaagguaccaagaaauugaugagaauuacagcggaaugguuauggaaagaauuaggcaagaagaaaacuccuagaauguguacaagagaggaauuuacaagaaaaguaagaaguaaugcagcauuaggagccauauuuacagaugagaacaaauggaagagugcccgugaagcgguggaggauggaagauuuugggagcuuguagacagggagagaaacuugcacuuagaaggaaaaugugaaacaugcguauacaacaugauggggaaaagagagaagaaauuaggggaguucggaaaagccaaaggaucgcgagcuauaugguauauguggcuuggagcacguuuccuagaguuugaagcauuaggauuuuugaaugaagaucauugguuuaguagagguaauaguuugucgggaguagaaggugaaggauuacacagacuagguuauauuuuaagagauguaggaaagaaagaagggggagcuauguaugcggacgacacugcuggaugggauacaaggauuacucuugaagaccucaaaaacgaagagaugguaacaaaccacaugaaaggugagcauaagaaauuggcagaagcgaucuuuaaacuuacauaccaaaauaaagucgucagaguucaaagaccuaccccgcggggaacugucauggacauaaucucgcgaagagaucagcgggguagcggucagguugggacuuacggauuaaauaccuuuacaaauauggaagcccaauugauuagacaaauggaaggagaaggaauauucaaaucaauucaacaucucaccgcaacagaagagaucgcagcccaaaacuggcucgccagagucgguagagaaagauuaucuagaauggcuauaucuggugacgacugcguuguuaaaccgauagacgaucgauucgcaucggcuuuaaccgcucucaacgacauggguaaggugagaaaagauauccaacaaugggagccauccagaggauggaaugacuggacucagguccccuucuguagucaccauuuucacgaacugguaaugaaagacgguagaguauugguaguaccaugcagaaaccaagaugaauuaauuggcagagcuagaauaagucaaggggcaggguggucacuuaaagaaacggcuuguuuaggcaaaucauaugcacaaauguggacacuuauguauuuccauagaagagaccuaagguuagcugcgaaugcgauauguuccgcgguaccgagccacuggguaccaacgucuaggacaacuuggucuauucaugcgaaacaugaguggaugacaacggaagauauguuggcaguuuggaaucgcguguggauacaagaaaauccauggauggaggauaagaccccgguggaauccugggaagaaguuccauaccuuggaaagagagaagaucaauggugcgggaguuuaaucgguuuaacuagcagagcuacaugggcaaagaacauacaaacugcaauuaaucaaguaaggucauuaauaggaaaugaagaguauacagauuauaugcccagcaugaagcgcuuccgaagggaagaagaagaagcaggcguccugugguaa

SEQ ID NO: 22286 - RNA, 9876 nt, Artificial Sequence
  derived and/or modified CDS sequence (opt6) from DENV-2__EU854293__SS-prME
acagcaggaaugauaaucaugcugauaccgacaguaauggcguuucaucuaacgacaagaaauggugaaccacacaugauaguuucgaggcaagaaaaaggcaaaucguuauuguuuaaaacaggagacgguguaaacaugugcacccugauggcgauggaccuaggggaacuaugcgaagauacaauaacauauaaaugcccucuacuacgccaaaaugaaccggaagacauagauuguugguguaacuccacaucaaccugggucacguacggaacaugcacaacaacgggugaacauagaagagaaaaacgcaguguagcguuggugccucacguagguaugggacuagaaacacguacagaaacauggauguccagugaaggagcguggaaacacgcacagcguauugaaacuuggauauuacgacauccaggauucacuaucauggcagcgauucuugcauacaccauuggcacaacccacuuucaaagagccuuaaucuuuauccuauuaacagccguagcuccaucgaugaccaugagauguauagguauuucaaaccgagauuucguggaaggugucagugguggcucuuggguagacaucguuuuagaacaugguuccugugucacaacaauggccaaaaauaaaccgacguuagacuuugaacuuauaaaaacugaagcaaaacaaucagcuacccuacgaaaauacugcaucgaggcaaaacuuacuaauacuacaacggaaucucgauguccuacucaaggcgagccaucacugaacgaagaacaagauaaaagauuugucugcaaacacuccaugguagauaggggcuggggaaacgguugcggucuuuuuggaaaaggagguaucguaaccugcgcuauguuuacaugcaagaaaaauaugaaaggcaaaguuguacagccagaaaaucuugaauauacgauuguaauaacaccacauucaggcgaagaacaugcugucggaaacgauacagggaaacauggaaaagaaauuaaaauaacuccacagaguagcauuacugaagcugaacuaacaggcuaugguacaguaacaauggaguguuccccacguacugggcuagacuucaacgaaaugguauuacuucaaauggaaaacaaagcgugguuaguccacaggcaaugguuuuuagaucuaccacucccuuggcuaccuggugcagacacacaagguucgaacuggauccaaaaagaaaccuuagugaccuucaaaaauccacacgcaaagaaacaagaugugguuguacuaggcucucaagaaggugcgaugcacacagcccuaacaggugcgaccgagauacaaaugucaagugguaauuuacuauuuacuggucaucuaaaauguagauuaagaauggauaaauugcaguugaaagggaugaguuauuccauguguacugggaaauucaaagucgucaaggaaauugcagagacacaacauggaacuauaguuaucagaguucaauaugaaggagaugguagcccaugcaaaauaccauuugaaauaauggaccucgagaaaaggcaugucuuagguagguuaauuacugugaauccuauugucacugaaaaggauucaccuguuaacauugaggcagagcccccauuuggcgauucguauaucauaauuggaguagaaccugggcaacuuaaguuaaauugguucaagaagggcucaagcaucggacaaauguucgagacaacaaugcggggugcaaaacgcauggcaauucuaggagauacagccugggauuuuggaagucuagggggaguuuucaccagcauugguaaagcacuucaccaaguauucggagccaucuauggugcagcauuuagcggaguaaguuggacgaugaaaauacuaauagggguuauaauuacauggaucggcaugaauagcaggaguacaucauuaucugucucuuuaguccucgugggaguuguaacgcuauaccucggggucaugguucaagccgauaguggaugugucguaagcuggaaaaauaaggaacucaaaugugguucugguauauuuaucacugacaacguacauacauggacggagcaguacaaauuucaaccagaaagcccgagcaaacuugccuccgcaauacaaaaagcucacgaagaagggaucuguggaauccguaguguaacccgacuagagaaccuuauguggaaacagauuacaccagaacuaaaucauauauugucugaaaacgaaguaaaacuaacuauuaugaccggggauauaaaagggauuaugcaagcugguaagcguucucuacgaccucaacccaccgaacucaaauacuccuggaaaacauggggaaaagcaaaaaugcuuucaacggaaucccauaaccagacauuuuugauugacgguccagaaacggcggagugccccaauacuaaucgcgccuggaacucgcuugaaguugaagauuauggauucggaguauuuacuacgaacaucugguuaaaauuaagagaaaaacaagacgucuucugugauaguaaguugaugagcgcagcuauaaaagauaauagagcagugcacgcugauauggguuacuggaucgaaucugcuuugaaugauacauggaagauagaaaaggccuccuucauagagguuaaaucgugucauuggccuaaaucgcauacauuaugguccaaugaagugcuggagagugaaaugauaauuccgaaaaauuuugcagggccgguuucacaacauaauuaucgacccgguuaucauacacaaacagcgggacccuggcaucuuggcaaguuggaaauggauuuugacuucugugagggaacaacaguagucgugacggaggauugcgguaaucguggucccucacuucgcacaacuacagcgucgggaaagcuaauuaccgagugguguuguagaucaugcacacucccgccgcuaagauauagaggcgaagauggauguugguauggaauggaaauucgcccacuaaaagagaaggaggaaaaucuuguuaauagcuuaguaacagcuggacauggccaaaucgacaauuuuagucuugguguccuaggaauggcucuguuccuugaagagaugcuacgaacuagaguagguaccaaacacgcuauccuauugguagcagucucguucgucacgcucaucaccggaaacaugucauuccgagaccuaggacggguuaugguuaugguaggagcaaccaugacugacgauauaggaaugggaguaacauaucuagcccugcuagcugcuuucaaaguacgcccaacauucgcggcaggguuacuccuucguaaauuaacuucuaaggaauuaaugaugacaacuauagguauaguucuucuaucccaaagcaccauaccugaaaccauauuagaauuaacggaugcucucgcacuagguaugaugguguuaaaaaugguaagaaaaauggagaaauaucaacuagcagugacaauuauggcuauucuauguguaccgaaugcagucauccugcaaaaugcguggaaagucaguugcacgauacuugcagugguaagcguuuccccucuauucuuaacuucaucacaacaaaaagcugauuggaucccguuggcacuaacaauaaaagguuuaaaucccacugcaauuuuucuaaccacauuaucccguacaaauaagaaaagaucauggccauuaaaugaagcaauaauggccguaggcaugguaagcaucuuagcaagcagucugcucaaaaaugauauaccaaugaccgggccgcugguugccggaggacugcuaacaguuugcuaugucuuaacgggaagaucugcagauuuagaacuugaacgcgcugcggacguaaaaugggaagaucaagcagaaauuagcgguaguucgccgauauuaucaaucacaauuagugaggacgggaguaugaguaucaaaaaugaggaagaagaacaaauacuuacaauucuuauaaggacaggauuacucguaauaucaggguuauuucccguaagcaugccaaucaccgcagcugcgugguaccuaugggaagucaagaaacaaagagcggguguacuuugggauguaccuaguccgcccccgguagguaaggcugaauuagaagauggagccuauaggauaaagcagaaggggauuuugggauauucgcaaauaggggcggggguauacaaagaagggacuuuucacacgauguggcauguaacccguggcgcaguuuuaaugcauaaagggaagagaauagaacccagcugggcagaugucaagaaagaccuaauaaguuacggaggaggauggaagcuagaaggagaauggaaggagggugaggaaguccaaguccucgcucucgaacccgguaaaaacccacgagcuguccagacuaaaccaggauuguuuaaaaccaacgcuggaacgauaggugcaguuucucuagacuucucucccggcacaucaggaaguccgauuauugacaagaaagggaaagugguaggucucuacggaaacgguguuguuacacguagcggagcuuacguuucugcuauagcacagacggaaaaauccaucgaagauaaccccgaaauagaagacgacauauuuaggaaacgcaaauuaacaaucauggauuuacacccuggagcagguaagacuaaaagauaccuaccugcuauaguaagagaagcgauaaaaaggggacuacguacacuaaucuuagcuccaacuaggguaguagccgcugaaauggaggaggcucuaagggggcuacccauaagauaucaaaccccugcaauaagagccgaacauaccggccgagagauagucgauuuaaugugucacgcaacuuuuacaaugaggcuacucucaccgguccgugucccgaauuauaaccuaaucauuauggaugaggcucauuuuacagauccggcaaguauagcggcacgagguuacaucagcacacguguagaaaugggcgaagcggcugguauuuucaugacugcaacgccgcccggcaguagggacccauuuccccagaguaaugcaccuauaauggaugaagagagagaaauuccugagcgaucauggucauccggacaugaguggguuacagauuuuaaggggaaaacuguaugguucguaccaucaauuaaagccgguaaugacauugcugcaugucuucggaagaaugggaagaaagucauacaacuaucaagaaaaaccuuugacuccgaauacgucaaaacuagaacaaaugauugggacuuuguaguaacuacggauauuucugaaaugggagcaaacuuuaaagccgaaagagucauagacccacgaagaugcaugaaaccaguuauacuuacggauggugaagaacgagugauauuggccgggccuaugccagucacccauaguagcgcagcgcaaaggagaggucggauugggagaaacccaaagaaugaaaacgaucaauacauuuacaugggagaaccauuagaaaacgacgaggauugcgcccauuggaaggaagcaaaaaugcuccuugauaacauaaauacucccgagggcauuauuccuucuauguuugaaccagaacgugaaaaaguagacgcuauagauggagaguaccgcuugcgcggagaagcgagaaagacguuuguagaucuuaugagaagaggagaccuuccugucuggcuagcauauaggguagcugcagaagguaucaauuaugcagauagacggugguguuuugauggaauuaaaaacaaucaaauccuugaagaaaauguagaaguagagaucuggacaaaagagggagaacgaaagaaauuaaaacccaggugguuagaugcucgaauauauagugacccauuggcucugaaagaguucaaagaguucgcugcgggccguaagucucuuacacuaaaucucauaacagaaaugggcagacuaccaacuuuuaugacgcagaaagccagagaugccuuagacaauuuggccguacuacauaccgcggaggcaggaggacgcgccuauaaucacgcacuaucggaauuaccugagacucuugaaacguuacuauuacugacacuacuugccacaguuaccggggguaucuuccuuuuucuuaugucaggacgagguaucgggaaaaugaccuugggcaugugcuguauuaucacggcuucaaucuuauugugguaugcucaaauccaaccacauuggauagcagcuagcauaauacuagaguucuuuuugauaguauuguugaucccagaaccggaaaaacagagaacgccucaagacaaccaacuuacuuauguuguaauugcgauacucacuguaguugcagccaccauggcuaaugaaaugggauuuuuagagaaaacgaagaaagacuuaggccuaggaucaauaacaacacaacaaccagaaucgaacauacuagacaucgaccuaagaccagccuccgcauggacucuauacgcgguagccacuacguuuguaaccccaaugcuucgacauucaauagaaaacucaucagucaaugucagcuuaacggccauagcaaaccaggcgacgguauugaugggacuaggaaaaggauggccauuauccaagauggauauaggaguaccauuauuagcaauuggauguuauagucaaguuaaucccaucaccuuaacagcagcacuuuucuuacugguggcccacuacgccauuauuggaccaggauuacaggcaaaagcaacuagggaagcccagaaaagagcagcugcaggcauaaugaaaaauccuaccguugauggcauuacaguaauagacuuggacccuauuccguaugauccgaaauuugaaaagcaguuagggcaaguaaugcuauuaguacuaugcguaacgcaagugcuaaugaugaggacaacgugggcacuaugcgaagcucugacgcuugcgacaggaccaauaagcacacuaugggaaggcaacccaggacguuucuggaauaccacuauagcagucuccauggccaacauuuuuaggggaucauaccuagcuggggcuggguuauuauucuccaucaugaaaaauacaaccaauacaagacgggggaccgggaauauaggagaaacucugggcgaaaaguggaaaucgcgauuaaaugcuuugggaaaauccgaauuucaaauuuacaagaaaucugguauucaagaagucgauagaacguuagcaaaagaaggaauaaaaagaggugaaaccgaccaccaugccgucucaagaggauccgcuaaacucagaugguuugucgagcguaauaugguaaccccagaagguaaaguaguugauuuagguugugguagaggcggcuggucauacuacugcggaggacuaaagaauguacgugaaguaaaaggauuaaccaaaggaggacccgggcacgaagaaccgauaccaaugucgacauacggguggaauuugguacgucuucaaagcggaguagauguguucuuuaccccuccagagaaaugcgacacccuacuaugcgauauuggagaguccaguccuaacccaacaguugaggcaggaagaacacuaagaguacuaaacuugguagagaacuggcuaaauaacaacacgcaguucugcauuaagguauuaaacccuuauaugccuucugucauagaaaagauggaggcucuacagagaaaauauggaggggcucucguaagaaauccacuaucacguaauagcacacaugaaauguacuggguuuccaacgccagcggcaacauaguuucaucagucaacaugauaagcaggauguuaauaaauagauuuacaaugagacacaagaaagcgacguacgaaccggacguugaucuaggaucaggaacaagaaacaucggaauagaaucggagauacccaauuuagacaucauugguaaaagaauagagaaaauuaaacaggaacaugagacaucauggcauuaugaucaagaccaucccuauaaaacaugggcuuaucauggcucauacgaaacuaagcaaacagguagugcaucaucuaugguaaacggaguagucagguuacuaacuaaaccgugggauguaguacccaugguaacccagauggcaaugacagacacaacaccguuuggacagcagaggguauuuaaggagaaaguugauacaagaacacaagaaccaaaagaggguacuaagaaauuaaugaagauaacugcagaauggcuauggaaagaacuaggcaagaagaaaacaccccgaaugugcacuagagaagaguucacaagaaaaguacgaaguaaugccgcgcuaggagcgaucuuuacugaugagaacaaauggaaaagugcaagagaagcaguagaagauagcagauucugggaacugguagauaaagaacgaaauuugcaccuugaaggcaaaugcgaaacaugcguauauaauaugaugggcaaaagagagaagaaacuaggagaauuugggaaagcaaaaggaucaagagcgauaugguauaugugguugggagcuagguuuuuagaguucgaagcucucggguuccucaacgaggaucacugguuuuccagagaaaacucgcuaagcggaguagagggagagggguugcauaaguuagguuacaucuuaagggacguaucaaagaaagagggcggugcaauguacgcagaugauacagccgguugggacacuagaauaacguuagaggacuugaaaaaugaggaaaugguaacgaaccauauggaaggggaacauaagaaauuagccgaagcaaucuucaaauuaacguaucagaauaaaguaguucggguccaaagacccaccccucgagguacaguaauggauauaauuagcaggcgagaucaaagagguucaggccagguuggaaccuauggauuaaauacauucacuaacauggaagcgcaguugaucaggcaaauggaaggagaagguguguucaaaaguauucagcauuuaaccgucacagaagagaucgccguccagaacuggcucgcccgaguaggucgagagagauuaucucgcauggcaaucaguggggacgauugcguuguaaaaccgcuggacgauagauuugcaucagcguuaacugcauuaaaugacaugggaaaaguaagaaaagacauacaacaaugggagccuaguagagguuggaaugacuggacccaaguccccuucuguucacaucauuuucacgaauugaucaugaaagauggaagaguauuaguaguuccuugccgaaaccaagacgaacuuauagggcgggcacgaaucagccaaggcgcggguuggucguuacgcgaaacugcuugucuaggcaaaucuuacgcucaaauguggucauuaauguacuuucacagaagagauuugagacuugcugcgaaugcaauuugcucagcggucccaagccauuggguucccacaaguaggaccacauggucaauccaugcgaagcacgaauggaugaccacagaagauauguuaacaguuuggaaucgcgucuggauacaagaaaauccuuggauggaagacaaaacccccgucgagaguugggaagaaauuccguaucuaggcaaacgggaggaucaauggugugguucucuaauaggcuugacuucgagggcaaccugggcgaagaacauacagacagcaauaaaucagguucguagccuaauaggaaaugaagaguauacugauuauaugccaaguaugaaaagauuuaggcgagaagaagaagaagcaggaguucuaugguga

SEQ ID NO: 22287 - RNA, 9876 nt, Artificial Sequence
  derived and/or modified CDS sequence (opt6) from DENV-2__EU854294__SS-prME
acugcugguguuaucguaauguuaauuccuaccgcaauggcauuucacuuaaccacaaggaacggagaaccacauaugauaguuggacgucaagaaaaaggaaaaaguuuguuauuuaaaaccgaagaugggguuaacauguguacauugauggcaauagaucuaggggaacuaugcgaagauaccauuacauacaaaugcccacuguuaagacaaaaugaaccagaagacauagauugcugguguaauucaacgagcacauggguuacguaugguacauguacaacuacaggagaacauagacgggaaaaacgguccguugcauuaguaccacaugucggaauggggcuggaaacucguacagaaacauggaugucuucagagggagcauggaaacauguacaacgaauugagacauggauauugcgacauccgggguuuacaauuauggcagcaauacuagcauauacgauuggaacaacacauuuccaaagggccuuaauauucauccuacugacugcaguagcuccuucuaugacaaugagauguauaggaauaaguaaccgcgauuucguagaaggagugucuggagguucauggguggacaucguacuagagcauggaucuugugugaccacaauggccaaaaauaaaccuacccuagacuuugaguuaaucaaaaccgaggccaaacagccugcuacgcuccgaaaauauugcauagaagcuaaacuaaccaauacaaccacggagucuagaugcccuacccagggagaaccaagucuuaaugaagaacaagauaaaagauuuauauguaaacauucgaugguggacagaggaugggguaaugggugcggccuuuuuggaaaaggcgggauaguaacgugugcaauguuuacuuguaagaaaaacauggaagggaaagucguacaaccggagaacuuagaauauacaauaguaauuacgccucacucaggcgaagaacaugcuguagguaaugacaccgguaaacaugguaaagaaauaaaaaucacaccucaaucaagcauaacagaagcagaauuaacaggguauggcacuguaacaauggaaugcuccccaagaaccggcuuggacuuuaaugaaauggugcuauuacaaauggaagauaaagcgugguuaguacauaggcaaugguuuuuagacuuaccccuaccaugguuaccaggugcugacacucaaggaucaaacuggauccaaaaagaaacacuggugaccuucaaaaacccacaugccaagaaacaggacguuguugucuugggaagccaagaaggagcaaugcacacugcauuaacaggcgcuaccgaaauacaaaugaguagcgguaauuuauuguuuacaggacauuugaaaugcagauuaaggauggauaaauuacaauuaaaagggaugagcuauagcaugugcacaggcaaauuuaaaaucguuaaagaaauagcugagacacagcauggaaccauagucaucagggugcaguaugaaggggauggcagcccauguaaaaucccauucgaaauuacugaucuagaaaaacggcauguccugggacgauugauaacaguaaaccccauaguuauagaaaaagacaguccagucaauauagaagcagaaccaccuuucggugacuccuauaucauaauugguguagagccaggucagcuaaaacugaauugguuuaagaaaggaucaaguauugggcaaauguuugaaacaacaaugcguggagcaaaacgaauggcuauacugggagauacagcaugggauuuugguucguuagguggaguguucacuucaauugguaaagcucuccaccaaguguuuggggcuauuuauggagcugcauuuagcggugucucuuggacaaugaaaaucuugauuggagucguuauuacauggauaggaaugaacucacgauccacuucacuauccgucagcuuaguucucguuggcgugguaacauuauauuugggagcgaugguucaagccgauucagguugcguugugagcuggaaaaauaaagaauuaaaaugcgguucaggaauauuuauuacugacaauguucauaccuggacagagcaauacaaauuucaaccggaaagcccaagcaaacuagcauccgcaauucagaaagcacacgaagagggaauuugugguauacgaucgguaacucgcuuagaaaacuuaauguggaaacaaauaacuccggaacugaaucauauacugucagaaaaugaggugaagcucacgauaaugacaggagacacuaaaggaauuaugcaggcagguaagagguaccugagaccacaaccuacugaauuaaaauauucuuggaagacuugggguaaagccaagaugcuuucaacugagucccauaaccaaacauuccucauagauggaccggaaaccgcagaaugcccaaauacuaacagagcauggaauagccucgagguagaagauuacggcuuuggaguuuuuacaacaaacauuuggcuuaaguuaagggaaaaacaagauguauuuugcgauagcaaauuaaugucggccgcaaucaaagauaaucgggcagugcaugcagauaugggauauuggauugaaagcgcguuaaacgauacuuggaaaauggaaaaagcgaguuucauugaaguuaaaucuugucacuggccuaagucacauacacuauggagcaacggaguccuggagagugaaaugauaauacccaaaaacuucgcugguccaguaucccaacauaacuaccgacccggauaccauacacagacggcaggucccuggcauuuaggaaaacuagagauggacuucgauuuuugcgaagguacgaccguaguaguaacugaagacugcggcaaccgagguccaucguuacggacgacaaccgcgucugguaaguuaauuacugaguggugcugcagaagcuguacacuuccaccacugagauacagaggcgaggauggauguugguauggaauggaaauacgaccauuaaaagaaaaggaagaaaauuuaguaaacaguuugguuacagcagggcacggccaaauagauaauuuuagccuugguguacuuggcauggcuuuguuccucgaagaaaugcuacgaacucgagucggaaccaaacaugcaauucuacucgucgccguaaguuuuguaacgcugauuaccggcaauaugucuuuuagagaccuuggaagggugaugguaauggucggagcuacaaugacugacgacauagggaugggaguaacuuacuuggccuuacucgcugcuuuuaaaguccgaccaaccuucgcagcaggccuuuuacuucgaaaauuaacuucgaaagaacugaugauggcaacaauuggcauaacuuuauuaagccagucaacuaucccagagaccauauuagaacuaacggaugcauuggcguuggguaugaugguacuaaaaauaguacgaaacauggaaaaauaucagcuggcuguuacuauaauggcaauaucauguguaccaaacgcuguaauauuaaggaaugcuuggaaaguuuccuguaccauccucgcagccgucagcgugucuccacuacuccuaacuucgucgcaacaaaaggcagauuggaucccuuuggccuuaaccauaaaaggacuuaaccccaccgcuauuuuucuaaccacucuaucuagaacgucuaagaaacgaaguuggccucuaaaugaggcaauaauggcgguagggaugguguccauucuagcgaguucacuauugaaaaacgauauaccgaugacagguccccuaguagccgguggccuauuaacaguuuguuauguuuuaaccggucguuccgcagacuuagaacuugaacgcgcagcagacgucaaaugggaagaccaagcggaaaucagcgguucuucaccaauauuaucaauaacuaucucugaagauggcagcaugucaaucaaaaacgaagaagaagaacaaacucugacaauauugaucagaacgggccuguuagugauaagcgggguauucccaguaucuauuccaauaacagcagcagcaugguauuuaugggaagucaagaaacaaagggcugggguucuaugggacguuccgaguccaccgccggucggcaaagcagaauuggaagauggagcuuaccgaauuaaacaaaggggcauccuaggauacagucaaauuggagccgguguuuauaaggaaggcacguuccauaccauguggcacguuaccagaggcgccguauugaugcauagaggaaagcgaaucgaaccaagcugggcagaugucaagaaagaucugauuaguuacggagggggauggaaacuugagggagaguggaaagagggugaggagguucaaguacuugcacuagaaccaggaaagaacccuagggcaguccaaacuaaacccggaauauucaaaacaaacacaggaacuauuggggcggucaguuuagauuuuucgccugguacaagcggcucaccuauugucgacaggaaagggaaggucguuggauuauauggaaauggcguggugacacgaucaggggccuauguaucugcaauagcacagacagaaaaaucuauagaagauaauccugaaaucgaagaugauauauucagaaagaaaagauuaacaauaauggauuuacacccuggagccggcaaaacaaaacgauacuuaccggcaauagugagagaagcuauaaaaagaggcuugcguacauugauuuuagcuccuacaagaguuguagccgcugaaauggaagaggcauuacggggacuaccaauuagauaccaaacaccagcuauaaaagcagaacacacuggacgcgaaauuguugauuuaaugugucacgccacguuuaccaugcgauuguuaucaccaguccgaguccccaacuauaacuuaaucauaauggaugaggcacacuuuacagacccugcaucuaucgccgccagaggguauauauccacuagaguagaaaugggagaggcagccgggauauucaugacagcaaccccaccaggaagcagagauccauucccucaaucaaacgcaccaauuauggacgaagaacgagaaauaccggagcgcucauggaacucagggcaugagugggugacagacuucaaaggaaaaaccguaugguuuguuccaaguauuaaagcgggcaaugauauugcagccugccuccguaagaauggcaagaaaguuauccaauuaagccggaagacauucgauagugaauauguuaaaacaagggcuaacgacugggacuuuguaguaaccacugacauauccgaaaugggggccaacuuuaaagcagaacgaguuauugacccaaggagaugcaugaaaccagucauacucacggauggcgaagaaagaguaauucuagcuggucccaugccaguuacacauucgagugcagcucaaaggcgaggaagaauuggcagaaauccgaaaaacgaaaacgaucaauacauauauaugggagaaccacuugaaaacgacgaagacugugcucauuggaaagaagcgaaaaugcuuuuagauaacauaaacaccccagaagguauuaucccuucaauguucgaaccggaacgagagaaaguggaugccguugacggcgaauaucgguuaaggggugaggcacgaaaaacauuuguagaucugaugaggagaggagaucuaccgguuugguuggcuuacaaaguggcugcagaagguauaaauuaugcugaccgcaaauggugcuuugacggaauuaaaaauaaccaaauuuuagaggagaacguagaaguagagauauggacaaaggaaggugaaagaaagaaacuaaaaccucggugguuagaugcuaggaucuacucugacccucuagccuuaaaagaguucaaggaguucgcugcggguagaaaaaguuuaaccuuaaaucuaauaacagaaauggggcgucugccaaccuuuaugacucaaaaggcaaggaacgcccuggacaacuuagcgguauuacacacggcagaggcaggaggcagagcuuauaaccaugcucucuccgaauuacccgaaacauuagaaacacuacucuugcugaccuugcuagcgaccguuacagguggaauauuucuuuuccuaaugagcgguaagggaaucggaaaaaugacuuuaggcauguguuguauaauaacagccucuguuuugcuuugguaugcacagauccaaccgcacuggauagcagcuaguauaauucucgaguucuuucucauaguacucuuaauaccugaaccugaaaagcaacggacaccacaagacaaccagcuaaccuacguaguaauugcaauuuuaacagugguagccgcaacaauggccaaugaaaugggauuucuagagaaaacuaagaaagacuuaggucuaggaagcauaacaacacaagaauccgaaagcaacauccucgacauugacuuaagaccagcuagugccuggacauuauaugcaguagccacaacuuucguuacaccaauguuacggcauucaauagaaaauaguuccgugaacgucagcuuaaccgcuauagcuaaccaagcaacagugcuaaugggucuaggaaaaggauggccguugucuaaaauggacauuggagucccucucuuagcaauagguuguuacagucaaguaaauccaaucacguuaacugccgcacugcuacuucuaguugcacauuacgcgauuauaggaccuggacuacaagcaaaggcaacgcgcgaagcgcaaaaacgggccgcggcaggcauuaugaaaaauccuaccgucgauggaaucacgguuauagacuuggagccaaucccauaugauccaaaguuugagaaacaacuaggacaaguuauguugcuaauucuuuguguaacgcaaguucuuaugaugaggacgacaugggcuuugugcgaagccuuaacucuugcaacaggaccaauaucuaccuuaugggaaggaaacccaggacguuuuuggaauacaacaauugcagugagcauggccaauauauuuaggggcagcuaccuugcuggagccggcuuacuauucucaauuaugaagaauacgacaaacacacgaagaggcacaggcaauauaggggaaacacucggugaaaaauggaaaucacggcuaaaugcauuaggcaaaucugaauuucagauauacaagaaaucgggcauacaagagguagaucguaccuuggcaaaagaagggauuaagcggggagaaacugaucaucaugccguaucuagaggaucggcuaaacuaaggugguuuguugagagaaauauggugacucccgaaggaaaaguaguagaucuuggcugugggcguggggguuggucuuauuauugugguggacuaaagaauguccgggaaguaaagggucucacaaagggugguccaggacaugaagaaccaauaccuaugucgacuuaugguuggaauuuagucagauuacaaagcggcguugaugucuucuucaccccaccggaaaaaugcgauacauugcuuugugauauuggagaaucaucuccuaauccaacaauagaagcuggaaggacauuacguguauuaaacuuaguagaaaauugguuaaauaacaauacacaauuuuguaucaaagucuuaaauccguauaugccgucagugauagagaaaauggaaacuuuacagagaaaauauggaggagcguuaguacguaacccucuauccagaaacucuacccacgaaauguauuggguauccaaugcuacagguaauauaguaagcagcgucaauaugauaucucgaauguuaauuaaccgauuuacaaugaaacacaagaaagcaacauaugaaccugacguugacuuagguucaggaacaaggaacauaggcauagaaagcgaaauaccgaauuuagauaucauugggaagagaauugagaaaauaaagcaagaacaugaaacauccuggcauuacgaucaagaucaccccuacaaaacaugggccuaucacgggucuuaugaaacaaaacaaacggggucugcaucauccaugguuaacggcgucguucgguuguuaacaaagccgugggaugugguccccauggucacccagauggcgaugacggauaccacuccauuuggacagcaaagaguauucaaagaaaagguggacacacgcacacaagaaccaaaggaaggaacuaaaaaguuaaugaggaucacagcugaguggcuuuggaaagaacugggcaagaagaaaacaccuagaauguguacccgggaagaauuuacuaggaaagugaggaguaacgcggcgcucggagcuauauucacagacgagaauaaauggaaaagugcuagagaagcaguugaagacgggagauucugggaauuaguggaccgggagagaaaucugcaucucgaaggcaaaugugaaaccuguguauauaacaugauggguaaaagagagaagaaacuaggugaguuuggcaaagcaaagggaaguagagcaauuugguacaugugguuaggagcucgauucuuagaguucgaagcauuagguuucuugaaugaagaccauugguuuucacgaggaaacagucuuucaggaguggaaggagaagguuuacaccgguuaggauacauauuacgggaugucgguaagaaagaagguggcgcgauguacgcagacgauacagcagggugggacacgagaauaacguuagaagauuugaagaacgaggaaauggucacaaaucacaugaagggcgaacacaagaaacuagccgaagcaauauucaagcuaacguaucagaacaaagugguaagaguucaaagaccaacgccacgaggaacuguaauggacauaaucagucgucgugaucaaagaggaagcggccaaguagguacauauggauugaacaccuuuacgaacauggaggcacaacugauccgccagauggagggagaaggaauauuuaaaaguauacaacacuuaacagcuacagaagaaaucgcugcacaaaauuggcuagcucgaguagggagagagagacuaagucgaauggcaauaaguggcgacgauuguguagugaaaccaauagaugauagauuugccagugcucucaccgcucuaaaugauaugggaaagguccggaaggacauucaacagugggaaccuucucgcggauggaaugauuggacucagguaccauuuugcagucaucacuuccacgaauuaguaaugaaagacgggagaguccuggucgugccuugccguaaccaagaugagcugaucggccgugcacggauuucacaaggugcaggcuggagccuaaaagaaacagcgugucuaggaaaaucuuaugcacaaauguggacacuaauguacuuucauagacgcgacuuacgcuuagcagcgaacgcuauauguucugcagucccgagucauugggucccuacgagccgcacaaccuggucaauucaugcaaagcacgaauggaugacuacugaagauaugcuagcaguauggaacagaguauggauacaggaaaauccauggauggaagauaaaacaccaguagagucuugggaagaaguuccauaucuagguaaacgcgaagaucaauggugcggauccuuaauagguuuaaccucacgugccaccugggcgaagaauauucagacagcaauaaaucaaguacgaucacuuauaggcaaugaggaguacaccgauuacaugccaucgaugaagagauucaggagagaagaagaggaggccggaguacuaugguga

SEQ ID NO: 22288 - RNA, 9876 nt, Artificial Sequence
  derived and/or modified CDS sequence (opt6) from DENV-2__FJ024477__SS-prME
acugcagggguuauaguuaugcuaaucccaacggcaauggcuuuccaccugaccacucggaauggagaaccucacaugauuguuggacgccaggaaaaagggaaaucccugcuguucaaaacggaagauggggucaauauguguacauugauggcaauugaucuaggagaguuaugugaagacacaauaacuuacaaauguccucuacuacgacaaaacgagccugaggacauagauuguugguguaacaguacgucuaccuggguuaccuaugggacuugcacuaccacaggggaacaucguagagagaaaagaucggucgccuuaguuccccaugucgguaugggauuagaaacgagaaccgaaacuuggaugagcagugaaggggcauggaaacauguacaaagaaucgaaacauggauacuaagacauccuggguucacaauaauggcggcuauauuagcuuacacaaucggaaccacacacuuucaaagggcacucauuuucauauugcuaacugcaguggcaccgagcaugacaaugaggugcaucggaaucucuaaucgcgauuuuguugaaggagugucuggagguucguggguagauauuguccuugaacaugguuccugcguaaccacuauggcgaaaaauaaaccuacacuugauuuugaauugauaaaaacagaagcaaaacaaccugcaacauuaagaaaauauugcauagaggcaaaauuaacaaauacaacuacugaaucacgcugcccgacucaaggagaaccuucucuaaaugaagaacaagauaaaagguucaucuguaaacauucaaugguggaucgggguugggguaauggaugugguuuguuuggaaaaggaggaauugugacaugcgcuauguuuacuugcaagaaaaauauggaaggaaagguaguucaacccgaaaaccuugaguacacaauuguaauaacaccacauaguggagaagaacacgcaguaggcaaugauacgggaaaacauggaaaagaaauaaaaauuacgccacagaguaguauaaccgaggcugaguuaacagguuaugggaccgucacaauggaauguucucccagaacagguuuggauuuuaacgagaugguccuucugcagauggaggauaaagcaugguuaguucauagacaaugguuucucgauuuaccacuaccaugguugccaggcgcugacacacaaggaucaaacuggauacaaaaagaaacguugguuacguucaagaacccgcaugccaagaaacaagaugugguugugcuuggaagucaagaaggcgcaaugcauacugcgcuaacuggugcaacggaaauucagaugagcagugguaaucuacuauuuaccggacacuuaaaaugucggcuuagaauggauaaacuccaacucaaaggaaugucuuauucaauguguacaggcaaauucaaaauaguaaaggaaauagcugaaacucaacacgggaccauaguaauaaggguacaauaugaaggcgauggaaguccuuguaaaauuccauucgaaauaaccgaucuugaaaagcgacauguucucgggcgauuaauaacaguuaauccaauaguuaccgagaaagacagucccguaaacauagaagcggaacccccauucggugacagcuacauaauaaucgguguagaaccugggcaguuaaaguugaauugguucaaaaaggguucgucaauuggacaaauguucgaaacuacaaugcggggcgcaaaaagaauggcaauacuaggugauacugccugggauuuugguagucucgggggugucuucacgucaauaggaaaggcacuacaucagguauucggggcaauuuauggcgcugcauuuucuggugugucauggacuaugaaaauauuaauaggagugaucaucacauggauagggaugaacucacgaucaacgucuuuguccguuucucucguacuggucggaguuguuacacucuacuuaggagccauggugcaagccgacagcggguguguugucagcuggaaaaacaaagaguugaaaugcgggucaggaauuuuuaucaccgacaacguacacacauggacggaacaauacaaauuucaaccggagaguccgucaaaauuagcuuccgcaauacaaaaggcccacgaagaaggcauaugcgggauaagguccgcgacgagguuggaaaaccuaauguggaagcagauuacgccggaguugaaccauauccucucagaaaaugaagucaaacuaacgauaaugacuggugacaucaaggggaucaugcaagcagggaaacgaucauuacguccccagccgacagaacuaaaguauucauggaaaacaugggguaaagcuaagauguuaaguacggaaagccauaaucaaacauuccuuaucgauggacccgaaacggcagagugcccaaauacuaaucgugcguggaacagucucgaaguugaagauuauggguucggcguuuuuacgacaaauauauggcuuaagcucagagagaaacaagacguauuuugcgacucaaaacuuaugagugcggcgauuaaagacaaucgggcaguucacgcugauaugggauacuggauagagucagcauuaaacgauacauggaagauggaaaaggcaucauuuauugaaguaaaauccugccacuggcccaagucgcacacacuauggaguaacggugucuuggaaucggaaaugaucauccccaaaaauuuugcugguccuguaucacaacacaacuaccgaccgggguaucauacucaaacagccggacccuggcauuuaggaaagcucgagauggauuuugacuucugcgaagguacuacaguaguugugaccgaagauugugggaauaggggaccuucacuccguacuaccacugccucaggcaagcuaauuacagaauggugcugcagaagcugcacauuaccaccacuucgguaucgaggcgaggauggaugcugguacgggauggaaauaaggccacugaaagaaaaagaagagaacuuaguaaauucuuuaguaacagcaggucacgggcagauugauaauuuuucuuuagguguuuugggcauggcuuuauucuuggaagaaauguugaggacaagaguagguacaaaacacgcgaucuugcuugcggcgguaucguucguuacuuugauuacaggaaauaugaguuucagagacuuaggacgaguaaugguaaugguaggagcaaccaugacggaugacauaggaauggguguaaccuauuuagcacuucuagccgcuuuuaaggugcguccgacguuugcugcagguuuacuguuacggaaguuaaccucaaaagaacuaaugauggcuacaauugggauagcacuucuaagccaaagcacaauaccagaaaccauacuugaauuaacagacgcacuagcucuggggaugaugguacuaaaaauaguuaggaauauggaaaaauaucaauuggcaguuacaaucauggcuaucucauguguaccaaaugcuguuauuuuacaaaaugcuuggaaagucaguuguacaauacuugcaguagucucagugucaccauugcuccuuaccucaagucagcaaaaagccgacuggaucccccuagcccugacaauuaagggacucaacccaacagccauauuuuuaacuacccuaucacgaacaaguaagaaaagaaguuggccacuuaaugaggcaauaauggcaguaggcaugguaagcauuuuagcauccucccuauuaaagaacgauauuccaaugaccgguccacuuguagccgggggauuacugacgguaugcuacguccuaaccggaagaagugcugauuuagaauuagaacgagcugcugauguuaaaugggaggaucaggcugaaauauccgggaguuccccuauucucucuaucacaauaucagaagaugggucuaugucuauuaaaaacgaagaagaagaacaaacucuaacgauucuaauaagaacggggcuccuaguuaucucugguguuuuuccaguaucaauacccauuaccgcagcagcgugguaucuaugggaagugaagaaacagagagccggugucuugugggaugugccaucuccuccaccgguagguaaagcugaauuagaggacggggcuuaucgaauuaaacagcguggaauccuagguuauagccaaaucggagcugguguauauaaggaggggacauuucacacuauguggcauguaacgcgaggugcaguacuaaugcauagaggaaaaaggauugagccgaguugggcggaugucaaaaaggaccucaucucauacgguggaggcuggaaacucgagggagaauggaaggaaggcgaggaagugcaagucuuagcuuuagaaccuggcaaaaauccuagagcaguacaaacaaaaccaggaauauucaaaaccaacacuggaacaaucggagcaguaucuuuggauuuuaguccaggaacaagcggguccccaauagucgauagaaaaggcaaagugguaggccuauaugggaauggaguaguaacacgaucuggugcauacgugucagcaauagcgcaaacagagaaaaguaucgaagauaauccugaaauagaagacgauaucuuucggaagaaacgacugacaauaauggauuugcaucccggugcggguaaaacaaaaagauauuugccggcaauaguucgagaagcaaucaaacggggauuaaggaccuuaauuuuggcccccacucgagucguugcagcagaaauggaagaggcacuaaggggacuaccaauuagauaccaaacuccagcuauaaaagcagaacacacgggacgcgaaauagucgaucuaaugugucaugcaacauuuacgaugagauugcuaucacccguacguguccccaauuauaaucuaaucauaauggacgaggcccauuuuaccgaucccgcuucgauagcggcaagagguuauauuucaacaagaguagaaaugggagaggccgcuggaauauucaugaccgcgacaccaccaggcagcagagacccguuuccgcaguccaacgcuccaauaauggacgaagaaagggaaauaccagagagaagcuggaauaguggacaugaauggguaacagauuucaaaggaaaaacaguaugguuuguuccaucaauaaaagcugguaaugauauagcugcaugccuccgaaagaauggcaagaaagugauucaauuauccagaaaaacuuuugauagcgaauaugucaagacccgagcuaaugacugggauuuuguuguuacaacggacauaagugaaaugggagcaaauuuuaaagcagagagaguaauugaucccagaagaugcaugaaaccuguaauauuaacagacggagaagagagaguaauacuggcagggccaaugccaguaacacauagcagcgcagcucaaagaagagguagaauuggacggaaucccaaaaaugaaaaugaucaauacauuuauaugggagagccacucgagaaugaugaagacugcgcacacuggaaagaagccaaaaugcuacuugauaacauaaauacuccagaaggaauaauuccgagcauguucgagccugaaagggaaaagguugacgcuauugauggagaauacagacuuaggggcgaagcgagaaagacuuucguagaucucaugagaagaggugauuuacccguauggcuggcauauaagguagcagccgaggguauaaacuacgcggauagaaaaugguguuucgacggaauuaaaaauaaucaaauucuugaagaaaauguugaaguugaaauuuggacuaaagagggagaaaggaagaaauuaaaaccaagguggcuugaugcacguauauauagcgauccucuugcgcuuaaagaguucaaagaguucgcugcaggccgaaagagccucacuuugaauuuaaucacugaaauggguagauugccaacauucaugacacaaaaagcaagaaacgcauuagacaaccuggcaguguuacacacggcggaagccgguggcagagcauauaaccacgcccuuucagaguugcccgaaacauuggaaacuuuguuacuauuaacacuacuggcaacaguuaccggcgguauauucuuauucuuaaugucgggaaaaggaauaggcaagaugacauuaggcauguguuguaucauaacagcgagugucuuauuaugguaugcccaaauccaaccgcacuggaucgcagcaucaaucauucuagaguucuuucuaauaguacuuuugauacccgagccagaaaaacagagaacaccacaagacaaccaacugacuuaugucguuauagcaauucuuacggucguagcagcaacgauggcaaaugaaaugggauuucuugagaaaacuaagaaggacuuagggcuaggaucaaucacaacucaagaaucggaauccaacauucuggacaucgaccuaaggccagccucggcauggacauuauacgcuguagcuacaacauuuguuacacccaugcuaaggcacucuauagaaaauuccaguguuaacguaucuuugacagcuauagcgaaucaagccacgguauuaaugggauugggcaaaggauggccuuuaucaaaaauggauauagguguaccuuuguuagcuauagguugcuacagccaggugaacccgauaacgcuaacagcggcauuacuguuauugguugcccacuaugccaucauaggcccaggacuccaagcgaaggcgacuagggaagcacaaaaacgagcagcggcggguauaaugaagaauccgacuguugauggaaucaccgugauagaucuggaaccuauaccauaugacccaaaguucgaaaagcagcuuggacagguaaugcuccuaauauuauguguaacucaaguauuaaugaugcguacgacaugggcgcuaugugaagcucuuacauuagcuacaggaccuaucagcacacucugggagggcaacccgggucgauucuggaauacaacaauugcaguaucuauggcgaauauuuuuaggggaucauaucuggcaggggccggacuucuuuucucaauaaugaaaaauacaacgaauacucgucgagguacagggaauauaggugagaccuuaggagaaaaauggaaauccagacuuaacgccuuaggcaaaagugaauuucagauuuacaagaaaagugggauacaagaagucgacaggacauuagcaaaagaaggaauuaaaaggggcgagacugaccaccacgcuguuucuaggggcagcgcaaagcuacgaugguuuguagagcggaauaugguaacuccggaagguaaaguuguugacuuaggguguggcagagggggauggucauacuacugcggaggccuuaaaaacguacgagagguuaaggggcuaacgaaaggugggccaggccacgaagaacccauaccaaugagcacauaugguuggaaucucguaagauuacaaagcggcguugauguauuuuucacacccccagaaaaaugugacacccuauugugcgauauaggugaaucuaguccgaacccuacuauagaagcggggagaaccuugcguguucucaaucuaguagaaaauugguugaauaauaacacccaauuuuguaucaaggugcugaauccguauaugccgaguguaauagaaaagauggagacauuacaaagaaaguauggaggagcccuagucagaaacccauuaucaagaaauagcacacacgagauguacugggucucaaaugcaacagguaacauuguuaguucagugaauaugauuagcagaaugcucauaaauagguuuaccaugaaacauaaaaaggccacauacgaacccgacguggacuuaggaucggggacacgaaauauuggaauagaaucagaaaucccaaaccuagacauaauaggcaaaaggauagagaagauaaaacaagaacacgaaacuucauggcacuaugaucaagaucauccguauaaaacuugggccuaucacggcagcuaugagacgaaacaaacuggaucagcaucgucaaugguaaacggaguaguaagacucuuaacuaaaccaugggacguaguaccaaugguaacgcaaauggcuaugaccgauacgacaccuuuuggccaacagcgaguuuuuaaagaaaaaguagauacaaggacccaagaaccaaaagaagguacgaaaaagcugaugaagaucacagcugaaugguuguggaaagaacuaggcaagaagaaaaccccgcgaauguguacuagagaagaauuuacccgcaagguaaggucaaaugcagcccuaggcgccaucuucacagaugaaaacaaguggaaaagcgcuagggaagcaguagaggaugggcgguucugggagcuagucgaucgugagagaaaucuacaucuagaggguaaaugugaaacaugcguuuauaacaugaugggaaaaagagagaagaaacuaggugaguuuggaaaagccaaagguucacgugccauaugguauaugugguugggugcgagauucuuagaauuugaagcucuuggguuuuuaaacgaagaucacugguucucuagaggaaauucauuaagcgguguggagggagagggacuccauagacuaggauacaucuuacgagacguuagcaagaaagaagguggagcaauguacgcagaugauacugccggaugggauacacgcauaacacuagaagaucucaaaaacgaggagaugguaaccaaucacaugaaaggggagcauaagaaacuugcugaagcuauauuuaaacuaacauaucagaacaaaguaguccguguacaaaggccaaccccucgcggaacuguaauggacaucauaagucggagggaccagaggggcagcgggcaagucggaaccuacgguuugaacacauuuacgaauauggaagcucaauuaauaagacaaauggaaggagagggcauauuuaaaucuauacaacauuugacggccacagaagaaaucgcaguacaaaauugguuggcaagggucggaagagaaagauugaguaggauggcgaucuccggugaugacugcgucgucaaacccauugacgacagauucgccucagcauuaacagcccuaaacgauaugggaaaggugagaaaagauauacaacaaugggagcccucuagaggcuggaaugacuggacgcagguaccguuuuguucacaccauuuccacgaacuuguaaugaaagaugggagaguccuugugguaccguguaggaaccaggaugaacuaaucggucgagcgcggauaagccaaggugcuggcuggagcuuaaaagaaacagcuuguuuaggaaaaucauacgcacaaauguggaccuuaauguauuuccaucggcgggaucugagacuggcugcuaacgccaucuguagugcaguaccuucucauuggguuccaacuagcagaaccacauggagcauacacgcaaaacaugaauggaugacgacugaggauaugcuugcagucuggaauagggucuggauacaagaaaacccauggauggaagacaaaacaccgguagaaucaugggaagaagugccauaccucggaaaaagagaagaccaaugguguggcucccuaaucggcuuaacaucacgagcuacuugggccaaaaacauacaaacagcuauuaaucagguccgaaguuugauaggaaaugaagaauauacagauuauaugccaaguaugaaacguuuccggcgagaagaagaagaagcugguguacugugguag

SEQ ID NO: 22289 - RNA, 9876 nt, Artificial Sequence
  derived and/or modified CDS sequence (opt6) from DENV-2__GQ868552__SS-prME
acagcaggaguaauaauuauguuaauuccuaccgcaauggcauuccaucugacaacuaggaauggagaaccacauaugauaguaggcagacaagaaaaagguaaaucucucuuauucaaaaccgaagauggagugaauauguguacacugauggcaauagauuugggagaauuaugcgaagacacaauaacauauaaauguccauuacucagacaaaacgaaccagaagacauugauuguugguguaauucgacuucuacauggguuaccuauggaacaugcacgacgacaggagaacaucgucgagaaaaacgcaguguagcauuggucccgcacguuggaaugggauuagaaacccgaacagaaacauggaugucaagugaaggagcguggaaacacguacaacgaauagagaccuggauacuacgacauccggguuuugcaauuauggcggcaauacucgcauauacaaucggcaccacccacuuucagagggcacuuauuuuuauuuuauugacggcuguagcacccaguaugacuaugagaugcauaggcauuagcaacagggacuuugucgaaggagugucuggugguucguggguagacaucgucuuggagcacggcuccuguguaacaacuauggccaaaaauaaaccaaccuuagauuucgagcuuauuaaaacugaagcaaaacaaccagcuacccuuaggaaauacuguaucgaagcgaaacuaacgaauaccacaacagaaagccgaugcccaacacagggggagccaagucuuaacgaagaacaagacaaaagguuuauauguaaacauagcaugguagacagagguuggggaaacggaugcggauuauuuggcaaagguggaauuguaaccugugcuauguuuacuugcaagaaaaacauggaaggaaaaguaguauugccggaaaacuuagaauacaccauugucauaacaccccacucuggugaagaacaugcaguaggcaaugacacaggaaaacauggcaaagaaauuaaaaucacgccacaguccaguauuacggaagcagaauuaacagguuacggaacgguaacuauggaauguucgccccgaacuggccuagauuucaacgaaauggucuugcuacaaauggaagaaaaagcgugguuagugcaccggcaaugguucuuagauuuaccacucccauggcuaccgggugcggauacacaaggaucaaacuggauucaaaaagaaacauugguuacguuuaaaaacccucacgccaagaaacaagauguaguagugcuuggaagccaagaaggagcgaugcauacggcucuaaccggcgcaacugaaauccaaaugucauccggaaauuuauuauuuacgggacaucugaaaugcagguuaagaauggacaaauuacaauuaaaaggaaugucauauucuauguguacaggaaaauuuaaaauuguuaaagaaaucgcagaaacucagcaugguacaauuguaauucgggugcaauacgaaggcgacggcaguccuuguaaaaucccuuucgaaauuauggaccuugaaaaacgacauguacuuggaagacuaauaacaguaaauccuauaguaacagaaaaagacucacccguuaauauagaggcagaaccgccauuuggagacuccuacauaauaauaggaguagaaccuggacaguugaaacucaauugguuuaagaaaggaucuucaauagggcaaauguuugaaacaaccaugagaggagcaaaacgaauggcuauauuaggagacacagcaugggacuuuggcucacuagguggugucuuuaccucaauaggaaaggcuuuacaccaagucuuuggcgcaauauauggggcagcuuuuagcggcguaucguggacuaugaaaauacugauaggaguaauaauuacuuggauaggaaugaacucaagaucuaccucccucaguguaucuuuaguacugguggggguggugacauuauaucucggugcuauggugcaagccgacucuggcugcguagucucuuggaaaaauaaagaauuaaaauguggaucaggaauauucauaaccgauaacguacauaccuggacggaacaguauaaauuccaaccugagagucccucaaaauuagcaucugcuauacagaaagcucaugaagaagguauuuguggcauaagauccgucacaagacuagagaaucucauguggaaacaaaucacuccagaauuaaaccacauacuaucagaaaaugaggugaaacuaacaauaaugacaggugauauaaaaggaauuaugcaagcagguaaacgcagccucaggccgcaacccacggaacuaaaauauuccuggaaaacauggggaaaagcaaagaugcugaguacggaaagucauaaucaaacuuuucugauagacggaccagagacggcagaauguccaaauacgaaucgggcauggaacucauuagaaguugaagacuauggauuuggcguauuuacaacgaauaucugguuaaaauuaagagagaaacaagacguauuuugugacucaaaauuaaugucggcagccaucaaagacaaccgagcgguacaugcagauauggguuacuggaucgagucagcccucaaugacacguggaaaauggaaaaggcgucguucauagaaguaaaaucaugucauuggccuaagagucauacauuaugguccaaugguguccuugaauccgaaaugauaauccccaaaaacuuugccgggcccguuucacaacacaauuacagaccagguuaccauacacaaacggccggucccuggcaucuagguaaacuagaaauggacuuugauuuuugugaagguacaacuguuguugugacagaagauugcggcaauagagguccaucauuacgaacgaccaccgcgaguggcaaacuaauaacugaaugguguuguaggucuugcacacuacccccauugagauacagaggagaagaugggugcugguauggcauggaaauaagaccauuaaaagagaaagaggagaauuuagucaauagcuuaguuacggcuggucacgggcagauagauaacuucaguuuaggcguacuugguaucgcauuauuuuuggaagagauguuacggacaagaguaggaaccaaacaugccauccucuuaguagcuauaucauucguuacacucauuacaggaaacaugagcuuucgagaucucgggagagucaugguaaugguaggcgcuacgaugaccgaugacauaggaaugggagugacuuauuuagccuuauuagccgcuuucaaaguaagaccaacauuugcugcaggcuuauuauuacgaagacuuacuucaaaagaauuaaugauggcaacgauugguauugcacuccugucacaaucuacaauaccggaaaccaucuuagaguuaacagaugccuuggcccucgggaugaugguacugaaaauuguucguaacauggaaaaauaucaauuagcagucacaauuauggcuauaucaugugucccuaaugcuguaauacugcuaaaugccuggaaaguaucauguacuaucuuggcugcuguaucaguaucaccauuacuacugacgagcucgcaacagaaagcugauuggauaccauuagcacucacaauaaaaggcuugaacccgacggcaauauuuuuaacaacacuuucacgcaccucaaagaaaaggucauggccguugaaugaggcaguaauggccguaggaaugguaucaauauuggcaucgucgcuccugaagaaugauaucccaaugaccgguccauugguugcugggggauuauuaacggucugcuacguccuuacaggacgcucagcugaucuagaacuggaaagggcggcagauguaaagugggaagaucacgcagaaauaagcggaucaaguccgauacuuucaauaaccauaucagaagaugguucgaugucaaucaaaaaugaagaagaagaacaaacauuaacaauauuaauacgaacuggacuacuugugauuaguggcgucuuccccguauccaucccuauaacagcagcagcaugguauuuaugggaagucaagaaacagcgugccggugugcuaugggauguaccgaguccaccuccgguagaaaaagcagaacuugaagauggcgcguaucgaauaaaacaaagaggcauucuaggauauagucaaauaggagcaggaguuuauaaagagggaacauuucacacaauguggcacguaacuaggggcgccguacugaugcauagaggaaaacgaauugaacccucaugggcagacgucaagaaggaucuuauuucuuacggagggggauggaagcuagaaggggaauggaaggaaggagaagaaguacaaguauuggcucuagaaccagguaagaaucccagagcgguacagacgaaaccugggcuuuuuaagacgaacacugggacgauaggggcgguaucgcuagauuucuccccaggcaccaguggaucgccaauugucgacaggaaaggcaaaguaguaggacuauacgggaauggagucguaacaagaucaggagcauauguuucugccauagcgcaaacagaaaaaucaaucgaaaacaauccggaaaucgaagacgacauuuuucguaagaaaagauugaccauaauggacuuacauccuggagccgguaagacuaaacgauaccuuccugcgauaguucgagaggcaauaaaaagaggacugcgaaccuugauuuuagcuccuacaagggucguagcagcugaaauggaagaagcacuaaggggcuuaccuauacguuaccaaacacccgcaauacgagcagagcacacugguagagaaauaguagaucucaugugucacgcgacuuuuaccaugagauuguugucaccugugagaguaccuaauuacaauuuaauaauaauggacgaagcucauuuuacggaucccgcaagcaucgcugcaaggggcuauauaucgacuagaguagaaaugggugaagcagcaggcauauuuaugacugcgaccccgcccgguaguagggacccauuuccccagucaaacgcaccaauuauggaugaagaaagagaaauaccagaaagguccuggaauaguggucaugaauggguuacagacuucaaaggaaaaacgguaugguucguaccaaguauuaaggcaggaaacgacaucgccgcaugccuacguaaaaaugguaagaaaguaauacaguuaucuagaaagacguuugacucugaauacgucaagacccgagcuaaugauugggacuuugucguaacgacagauauaucugaaaugggagcaaauuuuagggccgaacgggugauugauccaagaagguguaugaaaccgguuauccugacagacggcgaagaacgagugauacuagcugguccuaugccagugacacauuccagugcagcccaaaggcgugggcguauugggaggaaucccaaaaacgaaaaugaccaauacaucuacaugggagagccacuagaaaacgaugaagacugcgcccauuggaaggaggcgaagaugcuauuagauaauauaaauacacccgaaggaauaaucccuuccauguucgagccugagagagaaaagguagaugcaauugauggagaauacagauugagaggggaagcccgaaaaacauucguugaucucaugcgucguggugaccucccaguaugguuagcauauagaguagcggcagaaggcauaaacuaugcggaucgucgaugguguuuugauggaaucaaaaacaaucagauuuuggaggaaaauguagaaguggagauauggacaaaagaaggugaaaggaagaaauuaaagccuagguggcucgaugcucgaauuuacagugauccauuagcuuuaaaagaauuuaaggaguucgcugcuggucgaaagaguuuaacucuaaaucuaauuacagagaugggacgacugcccaccuucaugacgcagaaagcgagggaugcauuggauaaccuuucagugcugcauacugcagaagccggagguagagcuuacaaccaugcccuguccgaguugcccgaaacacuugaaacgcuauuacuacuuacuuuauuggcgaccgucacagggggaauauuccuauuucuuauguccgggaaagguauaggcaaaaugacauuaggaauguguuguaucauuacugcaagcauacuauugugguacgcacaaauacaaccgcacuggauagcugccucaauuauacuggaguucuuucuuauuguuuuguuaauacccgagccggagaaacagcgaacaccgcaagacaaucaacugacuuauguaguuauugcaauauuaacagucgucgcagcuacuauggccaaugagaugggcuucuuggagaaaaccaagaaagaccuugggcuggguucuauuacgacacaagagcccgaaagcaacauccuugauauugacuugcgacccgcuucugcauggacacuauaugcaguagcaacuaccuuugucacaccuaugcuacgccacaguauugaaaauaguucugucaaugugucucuuaccgcgauagcaaaucaagcaacuguguugaugggacuagggaaaggauggccauuaagcaaaauggacauuggcgugccacuacuugcuauaggauguuauucacagguaaauccaauaacguuaacagcugcucugcuguuacugguagcucauuaugcuaucauuggccccggauuacaagcgaaggccacaagagaagcacaaaaacgugcagcugcagguauuaugaagaacccaacgguagauggcaucacuguuauagauuuggaaccgaucccauacgauccgaaguuugaaaagcagcuaggucaaguaaugcuucugauacuuugcguaacgcaagucuuaaugaugcgaacaacuugggcucugugugaggcuuugacacuagcaacaggaccuauaagcacccuaugggaagguaauccagguagauuuuggaacacaaccaucgcugugagcauggcaaauauauuuagggguaguuaccuagccggugcaggucugcuauuuucaauaaugaagaacacuaccaacacaagacgggggacuggaaacauaggcgaaacauugggugaaaaauggaaaagucggcuaaacgcgcuaggcaaaagugaguuccaaauuuacaagaaaaguggaauacaagagguagaccgaacacuugcaaaagaaggaauaaagcgaggagaaacagaccaccacgcugugagucgaggaucugccaaguuaagaugguuuguugaaagaaauaugguaacacccgaagguaaagucguugaccuuggcugcggaaggggaggcugguccuacuauugugguggauugaaaaaugucagagaaguaaagggacuuacuaaaggagguccaggucaugaggaacccauuccaauguccacauauggguggaauuuaguaagauuacaaucggguguagacgucuucuuuacaccgccagagaagugugacacccugcuaugugauaucggagaaucaaguccaaauccuacaauagaggcugggcgaacauuaagaguauugaaucugguagaaaauugguugaacaacaauacucaguucuguauuaaaguauugaaccccuauaugccaucagugaucgagaaaauggaaacguugcaaagaaaguacggaggugcccuaguccguaaucccuuaaguaggaacaguacacacgaaauguacuggguaaguaaugcaacaggaaauauaguuaguagcguaaauaugaucuccagaauguugauuaauagguuuacaaugaaacauaagaaagcuaccuacgaaccagacguugaucuagggucgggcacccggaauauuggaauagaaagugagauuccaaaucuagauauuauugggaaacgaauugagaaaauaaaacaagaacaugagacuucuuggcauuacgaccaggaccacccauauaaaacuugggcauaucacggcucauacgaaacuaagcaaacggguagcgcaagcuccaugguaaauggcgucgucagauuauuaacuaagccgugggacguugucccgauggugacucagauggcuaugacagauacuacacccuuuggacaacagagaguauuuaaagaaaaaguggacacgcgaacucaagagcccaaggaagguacgaagaaauuaaugaaaauuaccgcagaauggcuauggaaagaauuggguaagaagaaaacgccgcguaugugcacacgggaagaauuuacccgcaaaguaaggucaaacgcggcauuaggugcuauauuuaccgaugaaaauaaauggaagucagcuagagaggcaguggaagauagcagguuuugggaauuggucgaucgugaaaggaauuugcaucuggaggggaaaugcgaaacuugcguguacaacaugaugggcaagcgagagaagaaauuaggagaguucggcaaagcuaaaggaucuagggcgaucugguacauguggcugggagcacguuuccuagaauuugaggcccuaggguuccuuaacgaagaucauugguuuagccguggaaauagucuuucaggaguagagggagaagguuuacauagacugggauacauacuacgagacgugucgaagaaagaagguggagcgauguaugcggacgacacagcuggcugggacacccgaauuacucuugaagauuugaaaaacgaagagauggugacaaaucauaugaagggggaacauaagaaacuagcagaagcuauauucaaacuaacauaccaaaacaaagucguaagagugcagagaccaacaccuagaggaacggugauggauauuauaaguagacgcgaccaaagaggcucgggucaagucggaacguacggauuaaauacuuucacaaauauggaagcgcaauuaauccgacagauggaaggugagggaauauuuaagagcauucaacaucucacaguuacagaagaaauugcgguucagaauuggcucgcgcgugucggcagagagagguuaagucguauggcaauaaguggugacgacuguguugucaaaccauuagacgacagguuugcaucugcacuaacugcauuaaacgauaugggcaaagugcgaaaagacauucagcaaugggaaccuagcagaggauggaacgacuggacucaaguaccguucuguagucaucauuuccaugagcucguaaugaaggauggucguguauuaguuguccccuguagaaaccaagaugaauuaauuggcagagcacguauuagucaaggagcaggauggagucugaaggaaacagcauguuuaggaaaaaguuacgcgcaaauguggacguuaauguacuuccauaggagggaucuacggcuagcagcaaaugcuaucuguuccgccguaccaucucauuggguuccuacgagucggacuacauggucaauacacgcaaaacaugaguggaugacaacagaggauaugcuagcgguauggaacagaguauggauccaggaaaauccguggauggaagacaaaacgccgguagaaaguugggaagaggucccguaucuugguaaacgugaagaucaauggugcggauccuuaauaggucuuaccucaagagcaacaugggccaaaaacauacaaaccgcgauaaaucaaguaaggagccucauaggaaaugaagaauauacagauuauaugccuagcaugaagagauuucgcagagaagaagaggaagccggaguccuuugguga

SEQ ID NO: 22290 - RNA, 9876 nt, Artificial Sequence
  derived and/or modified CDS sequence (opt6) from DENV-2__GQ868553__SS-prME
acagcggggguaauuguuauguuaauaccuacagcuauggcuuuccauuuaacaacccguaacggggaaccucauaugauaguugggaggcaggaaaaagguaaauccuuauuguucaaaacugaagaugguguaaauauguguacauuaauggcaauagacuuaggggaauuaugugaagauaccauuacuuacaaaugcccucuuuugaggcaaaacgaaccagaagauauagauugcugguguaacucaaccagcacuugggugacauacggaacauguacgacaacuggugagcaucggcgcgagaaaagaaguguugcuuuaguuccacacguagguauggguuuagaaaccagaacugaaacauggaugagcuccgaaggagcguggaaacacguccagagaauugagacguggauacucagacacccuggauucacaauuauggcagcgauauuagcauauacaauagguacgacacacuuucaaagagcguuaauuuuuauuuuacugacagcaguagcuccgagcaugacuaugagaugcauuggaauaaguaaucgagauuucguagaaggagugucaggugguaguugggucgacauuguccucgaacaugguaguugugugacuacuauggccaaaaauaaaccgacauuagacuucgaacuaauuaaaacugaggccaaacaaccagcuacauuaaggaaauauugcaucgaggcuaaacugacgaacacuacaacugaaucaagauguccuacccaaggagagccgucgcuaaaugaagaacaagauaaaagguucauauguaaacauucaaugguagaucgcggauggggaaauggcuguggguuauuuggaaaaggagggauuguaacaugcgcaauguuuaccuguaagaaaaauauggagggaaaagugguacagccagaaaacuuagaguacacaauuguaauuacaccacauaguggggaagaacaugcuguugggaaugauaccggcaaacauggcaaagagaucaaaauaacuccacagaguucgaucacggaagcagaacuuacaggauauggaacugugacuauggaauguucgccucguacaggauuggauuuuaaugagaugguuuuauuacaaauggaagauaaagccugguuaguccauaggcaaugguuucuugaccuaccucuaccaugguuaccuggugcggauacgcagggcucuaauuggauccaaaaagaaacuuuagugacauucaaaaauccacacgccaagaaacaagacguaguuguucugggcucacaagaaggagccaugcauacugcccuuacgggagcuacagaaauucaaaugaguagugguaacuuguuguucaccggccaucuaaaauguaggcucaggauggauaaacugcaauuaaaagggaugucuuacuccauguguacaggaaaauuuaaaauaguuaaagaaauagcggagacucaacauggaacgauagucauuagaguacaauaugaaggcgauggaagcccuugcaaaauaccauuugaaaucacagaucuggaaaaacgacacguacuuggaaggcuuauaacggugaaccccauuguuacagagaaagauucgcccgugaacaucgaagccgaaccuccguucggggauucuuauauaauaauugguguggagccuggccaacuuaaauugaacugguuuaagaaagguaguaguauaggacagauguuugaaacgacaaugcgcggagcaaaaagaauggcgauacuaggugauaccgccugggacuuuggaucucugggagguguuuucacuucaauugggaaagcacuucaccaaguauuuggagccauauacggagcagcuuuuuccgguguaagcuggacaaugaaaauacucauaggaguaauaauuacuuggauugguaugaacaguaggaguacuucuuuaagugucucauuaguccuuguaggcgucguaacccuguacuuaggcgcaaugguacaggcagauagcggguguguaguuucauggaaaaacaaagaacuuaaaugcggaucuggaaucuuuauuaccgauaacgugcauacuuggacggaacaguacaaauuucaaccagaaagcccaagcaaauuagcaucugcaauucaaaaagcacacgaggaaggaauuuguggcauacgaagugugacacgacuagagaauuuaauguggaagcagguuacgccagaacuuaaucacauucuaagcgaaaaugaaguuaaacucacaaucaugaccggcgauauaaaagggauaaugcaggcgggaaagagaagucuuagaccccaaccaacagaauugaaauacagcuggaagacauggggcaaagcaaaaaugcuaucgacggaaagucacaaccaaacauucuugauugauggcccagaaaccgcagaaugcccgaauacaaauagagccuggaacagcuuagaaguagaagacuacggauucgggguauucacuacuaauauauggcuaaaacucagagagaaacaagaugucuuuugugacaguaaacugaugucugcugcaaucaaagauaauagagccguacaugcagauaugggauauuggauagagucugcgcuuaacgauaccuggaagauggaaaaggcuuccuuuauugaaguuaaguccugccauuggccaaaaagucacacauuauggaguaauggaguucuagaaagcgaaaugauuauaccuaaaaacuucgccgguccugucagccaacauaacuaccgaccaggauaccauacacaaacggugggaccuuggcauuugggcaagcuggaaauggauuuugacuucugugaggggacuacagucguuguuacagaggauugugggaaucgagguccuucguuaagaacuacaacagcaucagguaaauugaucacagaauggugcugucgaucauguacccugccuccguuacguuauagaggcgaggacggguguugguauggaauggaaauaagaccauugaaagaaaaagaagaaaauuuaguaaauucacugguuacugcaggacauggacagauagauaacuuuuccuugggcguucuaggcauggcauuauuccuagaagaaauguuaagaacaagagugggaacaaaacacgcuauacuucugguggcaguaucauucguaacccuuaucaccgggaacaugucauuucgggaucucggaaggguuaugguuaugguaggagcaaccaugacugaugacauagggaugggugucaccuaucuagcacuucuggcggcguuuaaaguaagacccacuuuugcugcuggacuguuacuacgaaaacucacuucgaaagaauuaaugauggccacgauuggcaucgcauuauuaagccaauccacuaucccggaaacaaucuucgaacuaacagaugccuuagcauuagguaugaugguauugaagaucgugcguaauauggaaaaauaucaguuggcaguaacuauuauggcgaucaguugcguacccaaugcaguaauauuacaaaaugcauggaaaguaucuugcacaaucuuagcugcugucagcguaagcccguuacuguugacgagcagccagcagaaagcagauuggauuccuuuggccuugacaauuaaaggacuaaauccgacugccauauuccuuaccacacuuucucgcacaagcaagaaacgcucauggccacuuaaugaggcuauaauggcagucggcaugguaucaauccuggcuucuucguuacuuaaaaacgacauaccaaugacaggcccccuaguagccggaggacuauuaacuguguguuacguacugacuggacgaucggcagaccuagaguuggaaagagcggcagaugucaaaugggaagaccaagcugaaauaucagggucaagccccauauuauccauuacuaucucagaagacggaucuaugucuaucaaaaaugaagaagaggaacaaauauuaacaauauuaauuagaacuggacuuuuaguaauaagcgguguguuuccuguaucuauuccaauuaccgcagcugccugguauuuaugggaggucaagaaacaaagagcaggaguuuuaugggauguccccagcccaccaccggucgaaaaagcagaauuagaagauggugcauacagaauuaaacaaagggggauucuagguuauucgcagauaggagccggaguuuauaaggaaggaacuuuccacacuauguggcacguaaccagaggggcuguauuaaugcaccgagguaagcgaauagagccaagcugggcagauguuaagaaagaccuaaucucauauggaggcggcuggaaguuagaaggagaguggaaagagggagaagaaguacaaguauuagcauuagagccaggcaaaaacccuagggcgguacaaacaaaaccaggaaucuuccgcacgaauacaggaacuauuggugcuguaucucuugauuuuagcccuggaaccucaggaucaccaauagucgaucguaaagguaagguugucggacuuuaugguaacgguguaguuacgcgaucaggagccuacguuucggcaauugcacaaacagaaaaguccauagaagauaacccagaaauagaagacgauauauuuaggaagaaacgacuaaccaucauggauuuacaucccggagcugguaagacaaaacgcuacuuaccagcaauaguuagagaggccauuaaacguggauuacguacacuuauucuggcuccaaccaggguaguagcugcagaaauggaagaagcacuacguggacuuccuaucagauaucagacaccagcuauuaaagccgaacacaccggaagagaaauagucgacuuaaugugucaugccacauucacuaugaggcuauuaucgcccgugagagucccgaacuauaauuuaaucaucauggaugaggcacacuuuacggauccugcuucaauugccgcacgggguuauauuucgacccgggucgaaaugggugaagcugccggcauauuuaugacggcaacuccuccagguucacgagauccauuuccacaaucaaaugcaccaauuauggacgaggaaagagaaauaccggaacgcagcuggaacucaggccacgaauggguuacagauuuuaaagggaagacugugugguucgugccuagcauaaaagcggggaaugauauagcagcuugccuaaggaaaaacggaaagaaaguaauucagcuuagcagaaaaacauucgacucggaauacguuaaaacucgagcaaacgauugggauuuuguuguaacuacagauauaagugaaaugggagccaauuucaaggcagaaagaguaauagaccccagaagaugcaugaaaccagugauucuaacggauggugaagaaagagucaucuuagcagggcccaugccaguaacucacucuagugcagcucaaaggagaggaagaauuggacggaaucccaaaaaugaaaaugaucaguauauuuacaugggagaaccguuagaaaaugacgaagacugugcccauuggaaagaggcgaagaugcuacuagacaacauaaacacuccagagggaauaaucccuucaauguuugaaccagagagagaaaaaguagaugcgauagacggagaauaucgacuacgaggcgaagcccgaaagacauuugucgauuuaaugcgaagaggugaucuucccguuuggcuugcuuacaaagucgcggccgaagggauaaacuaugccgauagaaagugguguuuugacggaaucaaaaacaaucagauuuuggaagaaaauguagagguagaaauauggacaaaagagggugagcgaaagaaauuaaaaccaagguggcuagaugcgcgaauauauucugacccucuugcuuuaaaagaauuuaaagaauuugcggcgggaagaaaaucuuuaacuuuaaacuugauuacagagauggguagacuccccacauuuaugacacaaaaagcucguaaugcccuugacaaccucgcaguauuacauacggcugaagccggugggcgugcguauaaccaugcucuaagcgaauugccagagacccuagaaacccuauuauuacuaacuuuauuagcaacaguaacgggcggaauuuucuuauuucuuaugucggggaaaggaauugguaagaugacauugggcauguguuguaucauaacugcuagcauccuccucugguaugcgcagauacaaccacauuggauagccgcaucaauuauacuagaauuuuuccuuaucguucuauuaaucccagaaccagaaaaacagcguaccccucaggauaaucagcuaacauauguggugauugcuauucugacugugguggcagcgaccauggcaaaugaaaugggauuccuagagaaaaccaagaaagauuuagguuuaggcagcauaacaacgcaagagucagaaaguaauauacuugauaucgaccuacgcccagccagcgcguggacacuuuaugcaguugcgacuaccuuugugacuccgauguuacgucacaguaucgaaaauaguagcguaaacguuaguuuaaccgcaaucgcgaaucaagcaacgguacuaauggggcuaggcaaggguuggccacuaucaaaaauggacauuggcguaccucuuuuggcgauagguuguuacucgcaaguaaauccaauaacgcugacagcagcucuuuuauugcucguagcgcacuacgcuauuaucggcccaggccuucaagccaaggccacucgugaagcacaaaagagggcagccgccgggauuaugaaaaauccuacuguagacggaauaaccguaauagauuuggaacccauaccauaugacccaaaauuugagaaacaguuagggcaaguuauguuauuaauauuaugugucacucaagugcugaugaugagaaccacuugggcacuuugugaagcacuaacauuagcaacuggcccuaucucgacacuaugggaaggaaauccagggagauuuuggaauacuacaauugcaguuagcauggcuaauauuuuccggggaagcuaucuagccggugcaggucuuuuguuuucgauaaugaaaaauaccaccaauacucguagaggcacuggaaauauaggggaaacgcuaggagagaaauggaaaagucgccucaaugcuuuaggaaagucggaauuucaaauauacaagaaaucugggauacaagaaguagaccgaacauuggcaaaagaagggaucaaaagaggugaaaccgaccaucacgcggugucucgaggaucagcgaaacuucgaugguuuguggaaagaaauaugguaacucccgaaggcaaagugguggacuuaggcuguggucgcgguggguggucauacuauugcggagggcuaaagaauguccgagaaguaaaaggguuaacgaaaggagguccuggacaugaagaaccuaucccaaugaguacauacggauggaaucuaguccgauuacagaguggaguagauguguucuuuacgccgccagagaaaugcgacacacuacuaugcgauauaggcgaaaguucgccuaauccuacaauugaggcagggagaacauuaagaguacuaaaucuugucgaaaauugguuaaacaacaauacgcaauuuuguauuaagguacugaacccuuauaugccaucagucauugaaaagauggaaacauugcaaagaaaauacggaggggcucuaguacguaauccauuaucaagaaacaguacccaugaaauguacuggguuucuaacgcaacuggaaauauugugucuucaguaaauaugauuucgagaaugcugauaaauagauuuacaaugaaacauaagaaagcaacuuacgagccugauguugauuuagguagugguacacgaaacauaggcaucgaaucugagaucccaaacuuagauauaaucggaaaaagaauugagaaaauaaaacaagaacacgagacaucauggcacuaugaucaagaccacccguauaaaacgugggcguaucaugguucauacgaaacuaaacagacuggaagugcauccuccaugguaaacgguguaguacguuugcuuacuaagccuugggaugugguuccaaugguaacgcagauggcaaugaccgacacaaccccauucggccaacaacggguauuuaaagagaaaguugacacacguacgcaagagccuaaggaagguacgaagaaauuaaugaagaucaccgccgaaugguuauggaaggaauugggcaagaagaaaaccccuagaaugugcacgagggaagaguuuacaaggaaagucagaucaaaugcugcguuaggggcuauuuuuacagacgagaauaaguggaagucagcccgugaagccguagaagacggccgcuucugggaauuggucgaucgugagcgaaaucuacacuuagaagggaaaugcgaaacuugcguauacaacaugauggggaaacgugaaaagaaauuaggagaauuuggaaaagcuaagggaucaagagcaaucugguacaugugguugggagcccguuuucuagaguucgaggcacucggauuuuuaaacgaggaucacugguucucgcgaggcaacagcuugucaggggucgagggcgaagggcuucaccgacucggcuacauauuacgagacguagggaagaaagaaggaggagcuauguaugcagaugacacagccggcugggacacuagaauaacuuuagaagaucucaaaaacgaagaaaugguuacgaaucauaugaaaggcgaacauaagaaacuagcggaagcgauuuucaaauuaacauaucaaaauaaaguaguucgaguacaacguccuacaccaagggggacaguaauggauauaauaucucgacgggaccaacggggaaguggacagguuggcacuuacggauuaaacacauucacuaauauggaagcucagcuuauuagacaaauggaaggugaaggaauuuuuaaaucuauccagcauuuaacugcuacagaagaaaucgcagcacaaaacuggcuggccagagucggccgagagcguuuaucacgaauggcuauauccggugacgauugcguaguuaaaccaauagacgauagauucgcuagcgcucuaacagcccuaaaugauauggguaaaguacggaaggauauacagcagugggagccaagucgagguuggaaugauuggacacagguuccguuuugcucucaccauuuucacgaacugguaaugaaagacggaagaguauuaguaguucccugcaggaaucaggaugaguuaauaggaagggcgagaaucucgcaaggugccgguuggucacucaaagagacggccugucuggggaaaucuuaugcacagauguggaccuuaauguauuuccacagacgagacuuaagacucgcggccaaugccauaugcucagcagucccaucacacuggguacccacuagcagaaccacauggucgauacaugcgaagcacgaauggaugacuacagaagauauguuggccguguggaacagagucuggauucaagaaaacccauggauggaagacaaaacccccguggagucuugggaagaaguaccuuacuugggcaaaagagaagaucaguggugcgguucacuaaucggauuaacgucgagagccacaugggcgaaaaauauucagacggcgauaaaucaaguaaggucauugauaggaaaugaagaauacacagacuacaugccaucaaugaaaagauuuagaagagaagaggaagaagcaggaguucuaugguaa

SEQ ID NO: 22291 - RNA, 9876 nt, Artificial Sequence
  derived and/or modified CDS sequence (opt6) from DENV-2__GQ868554__SS-prME
acagcaggaguaaucguaaugcucauuccaacugcaauggcauuccauuuaacaacgaggaauggagaaccccauaugauaguuggcaggcaagaaaaaggcaaaagucuguuauuuaaaacugaagacggaguaaauauguguacgcuuauggcgaucgaucuaggggaacuaugugaagacacaauaaccuacaaauguccccuacucagacaaaaugaaccugaagauaucgauugcuggugcaauaguaccaguacauggguuacguauggaacuuguacaacuacaggggaacaucguagagaaaaacgaagcguagcgcuuguaccacauguugggaugggacuggagacacgaacagaaacguggaugucuucagagggugcauggaaacacguucaacggauugaaacauggauccuaagacaccccgguuuuacaauuauggcagcaauacuggcguauaccauaggaacuacucauuuccagcgggcucugaucuuuauuuuauuaacugccguagcucccuccaugacgaugaggugcauaggaauauccaaccgagacuuuguagaaggcgugaguggaggcucauggguagauauaguauuagaacauggaucaugcguuacgacaauggcgaaaaauaaacccacucuagauuucgaauugauaaaaacugaagcaaaacagccggccacucugaggaaauacugcauugaagcuaaauugacaaacaccacaacagaaagucgcugcccaacgcaaggagaaccaucauuaaaugaagaacaggacaaaagguucaucugcaaacauuccauggucgauagagguugggggaaugguugcggauuauucgggaaaggagguauuguuacgugugcaauguuuaccugcaagaaaaacauggaagguaaaguuguucaaccagagaauuuagaauauacaaucguuauuaccccucauucaggugaagaacaugcagugggaaaugauacaggaaaacaugguaaagaaauaaaaauaacaccucagucaagcaucacggaggcggaacuaacggguuaugguacaguaacaauggaguguuccccacgcacgggacucgauuuuaaugagaugguguugcugcaaauggaggacaaagcguggcuuguucaucgacaaugguucuuagaccuucccuugccauggcuaccuggagcggacacccaaggauccaacuggauacaaaaagagacauuaguaacuuucaaaaauccgcaugccaagaaacaagaugucguaguccuugguagccaggaaggugccaugcacaccgcacugacuggcgcuacggaaauacaaaugucaagcggcaaucuucuuuucaccggacaucuuaaauguagacucaggauggauaaacugcaguugaaagguaugaguuauaguaugugcacgggcaaauuuaaaaucgucaaagaaauagcggaaacacaacacgggacgauugucaucagaguccaauacgaaggggacgggagcccuuguaaaauuccauucgaaauaaccgaccuagagaaaaggcacgugcuugggagacugauaacuguuaauccuauaguaauagaaaaagauucuccaguaaauauugaagcugaaccgccauucggcgacucguauauaauaauugguguagaaccagggcaacuaaaauuaaacugguucaaaaagggcaguaguauaggucaaauguuugaaacgacgaugcgaggagcaaagcgaauggcuauccuaggugauacugcaugggacuuuggaagucuugguggaguauuuacaucaaucggaaaagcgcuacaccaaguauuuggugcuaucuauggggcagcuuucucaggagucucauggacaaugaaaauuuugaucgggguuguaauuacuuggauaggaaugaacucgagauccaccucacuaucaguaucuuuaguucuuguagguguggugacucuauauuuaggagccaugguacaagcagacucaggguguguuguuaguuggaaaaauaaagagcucaaguguggcaguggcauuuuuauaacggacaacguacacacauggaccgaacaauauaaguuucaaccagaaaguccaucgaaacuagcaucagccauacaaaaagcacacgaagaggguaucugcgguauccgaucagugacuaggcuagaaaaucucauguggaagcaaaucacaccagagcuuaaccacauuuugagugagaacgaaguuaaauuaacaauaaugacuggagacacaaagggaaucaugcaagcuggcaagaggucacuuagaccacaaccgacugaacucaaauacagcuggaaaacuugggggaaagcaaaaauguuaucaacagaaucucacaaucaaacuuucuuaauagacggaccagaaacaguagaauguccuaacacaaaccgugcauggaacagucucgaaguugaagacuauggauucggaguuuucacaacuaauauauggcuaaaguuaagagaaaagcaagacguauuuugugauucaaaguugaugucggcugcaauaaaggacaauagagcaguucaugcagauauggguuauuggauagaaucugcauuaaaugacacuuggaaaauggagaaagcaucguuuauagagguuaaaucaugucacuggccuaaaagucauacccuaugguccaacggaguauuggaaucagaaaugauaauacccaaaaauuucgcgggucccguaucucaacauaauuacagaccaggauaucacacucagacugcgggcccauggcaccuaggcaaacuagagauggauuuugauuuuugcgagggaaccacaguuguuguaaccgaggauugugguaauagaggucccucacuucguacuacuacugcuagcgguaaacuuauaaccgaauggugcugucguaguugcacucucccuccuuuacguuacagaggugaagacggcuguugguauggaauggagauaagaccacuaaaagaaaaagaagaaaacuugguaaacucucuuguaacugcaggccauggucaaauagauaacuucagccuuggcguuuugggaauggcauuauuucuggaagaaaugcucagaacacgugucggcacgaagcaugcaauccucuuaguagcagugaguuuugucacuuuaauuacggguaacaugucuuuccgagaucuugggcgcguaauggucaugguaggagcuacaaugacagacgauauaggcaugggugugacuuauuuagcgcuacuggcagcauuuaaggugcgaccaacguucgcagcuggcuuguuacuaaggaaauuaacgaguaaagaauugaugauggcaacuauugggauaacacuauuaagucaauccacuauaccugaaacaauacuagagcuuacggaugcauuggcgcuaggaaugaugguuuuaaagauugugagaaacauggaaaaauaccaacuugcagucacaauaauggcaauaucgugugucccgaacgcagugauauuaagaaaugcuuggaaagugucguguacaauacuagcugccguaagcguaagcccauuacuuuuaacauccagccaacagaaggcugauuggauuccauuagcccuaacuauaaagggauuaaauccgacagcuauuuuucugacaacgcuaaguaggacuagcaagaaacgaucuuggccucugaaugaagcaauaauggcaguagguaugguaaguauucuugccaguucacuucucaaaaacgauauucccaugacugggccucugguagcaggaggguuauuaacaguuugcuacguauugaccggacgaucagcagaucucgagcuagaacgagccgccgacgucaaaugggaagaucaggccgaaauaagugggaguucucccauauugaguauaacuauaagugaagaugguagcaugaguaucaaaaacgaggaagaagaacaaacacuuacuauauuaauccguacaggccuuuugguuauaaguggaguuuuccccgugucuauuccaauaacagcagcugcaugguacuugugggaagugaagaaacaaagagcugggguuuuaugggaugucccaaguccaccaccuguagguaaagcugaauuagaagacggagcguaucguauaaaacaacgcggcauucucggcuauucacaaauaggcgcuggaguauauaaggaaggaacguuucacacaauguggcacguaacucguggagcgguuuuaaugcaccgggguaaacgaaucgagcccucgugggcugaugucaagaaagaccugauuucguacggaggugguuggaagcucgagggugaguggaaagaaggggaagaaguucaaguguuagcguuggagccaggaaagaauccaagggcaguucagacaaagccaggaauauuuaaaaccaauacuggcacuaucggagcaguaucgcuagauuucucuccagggaccagcggaaguccuaucguugacagaaaagguaagguuguuggauuauaugguaauggggugguuacccgcucuggagcauacguuucggcaaucgcucaaaccgaaaagucaauugaagauaaucccgaaauagaggaugauauauuuagaaagaaaaggcuaacuauuauggaccuucacccaggggcuggaaaaacuaaacgauaucuaccggcgaucgucagagaagcaauaaagagaggacugcgcacacuuauacuugcaccgacgagaguaguggcagcugaaauggaagaagcccuuagaggcuuaccaauaagguaucaaacgccagcuaucaaagcggaacacacgggaagagagauaguggacuuaaugugucacgcuacauuuacgaugcgauuauuaucucccguucgaguuccaaauuauaauuuaauaauaauggaugaggcccacuucacggaucccgcaagcauagcagcacgaggguacauaucgacaagaguagaaaugggagaagcugcagggaucuucaugacugcgacacccccaggaucaagagacccuuucccacaaagcaaugccccaauaauggaugaagaaagagaaauuccggaaagauccuggaacucaggccaugaaugggucacagacuucaaagguaaaacagucugguuugucccaagcauaaaagcggguaaugauauagcagcaugucuucgaaagaauggaaagaaaguaauucaguuaagcagaaaaaccuucgauuccgaauauguuaaaacuagggcuaaugacugggacuuuguugucacgacagauauaagugaaaugggugccaacuucaaagcagagagaguuauagauccacgaagaugcaugaaaccaguaauucuuacggacggggaagaaagagugauauuagcuggaccuaugcccguaacacacucuagugcagcucaaaggagaggaagaauuggaagaaacccuaaaaaugaaaacgaccaauauaucuauaugggagaaccauuagaaaaugacgaagauugcgcgcauuggaaagaggcgaaaaugcucuuggauaauauaaacacuccagagggaaucauaccauccauguuugaaccggaaagagaaaagguagaugcaaucgacggcgaauauagacuacgaggagaagcccgaaaaacuuucguggaucucaugagaagaggagaucuucccguuuggcuugcauauaaagucgcggccgagggaauuaauuacgcagaccguaaauggugcuuugauggaauuaagaauaaucaaauacucgaggagaacgucgaaguagagauuuggacuaaagaaggcgagcggaagaaacuaaaaccaaggugguuagacgcgagaauauauagugauccacuugcuuuaaaagaauuuaaagaauuugcagccggccgcaaaucauuaacacuaaaucucauaaccgaaaugggaagguuaccuacguuuaugacacaaaaagcuaggaacgcauuagauaacuuagcugucuuacacacagcugaagccggcgguagggcauacaaucacgcacuaucagaauuaccagaaacucuggagacauuacuccuccucacauuacuagcaacaguaacuggaggcauauuucuauucuuaaugagcggcaaagggauagguaaaaugacauuagguaugugcugcauuaucacugcaucuguacuccuaugguacgcucaaauucagccacauuggauagcagcgucgaucauucucgaguuuuuccuaauaguccuauugauucccgagccggaaaagcaaagaacuccucaagauaaucaguugacauacguaguaauagcgauauugaccgucguagcagcgacuauggcgaaugaaaugggguuccuagagaaaaccaaaaaggaucuaggcuuaggcucaauuacuacgcaggaaagcgaaucaaauauacuagauauagaucuacgaccagccucugccuggacauuauaugccguagccacgaccuuuguaacuccaaugcugcgacacucaauagaaaauucaaguguuaacguuucauugacggcuauugccaaucaagcgacgguuuuaaugggguuaggaaaaggcuggccauuaucaaagauggauaucgggguaccguugcuugcaauaggauguuacucccaagugaacccaauuacucugacagcugcucugcuacuacucguagcacacuaugcgauaauuggccccggcuuacaagcaaaggcuacucgugaagcccaaaagcgugcggcagccggaaucaugaaaaauccuaccgucgacggaauaaccguuauugauuuagagcccauucccuacgacccaaaauuugaaaaacaacugggucaagucauguuacuaauacuaugcguaacgcaagugcucaugaugaggacaacgugggcauuaugcgaagcacuuaccuuagcgaccgggccaauuucaacacugugggagggaaacccgggucgcuuuuggaauacgacaauagcgguuucgauggccaauauauuuaggggaaguuaucucgcaggggccggacuauuguucucaauaaugaaaaauacaacaaacacacggcgcgggacaggaaauauaggugagacacuaggugagaaauggaaaucacgauugaaugcccuaggaaagagugaguuccaaauuuacaagaaaucgggcauacaggaagucgauagaacuuuagccaaggaggggauuaaaagaggugaaacggaucaucaugcgguuucacgaggaagcgcgaaauuaagaugguuuguggagcguaacaugguuacaccagaaggaaagguuguagacuuagguugcggucgaggaggcuggucauacuacugcggaggauuaaagaaugucagagaaguaaagggucucacaaaaggaggcccuggacaugaggaaccgauuccuaugaguacauacggcuggaaucucgucagguuacagaguggaguagacgucuuuuucacuccacccgaaaagugugauacgcuuuugugcgacauaggugaaaguagcccuaauccgacgauugaagcaggacgaacacuacgaguccuuaaucuuguagaaaacuggcuaaauaacaauacacaauuuugcauaaagguccuuaauccguauaugccauccguaauugagaaaauggagacauuacaacgaaaauacggcggagccuugguucgaaacccauugaguagaaauucuacccaugaaauguauugggucaguaaugccacaggcaacauaguuucuucagucaacaugaucaguagaaugcuaauaaacagauucacgaugaaacacaaaaaggcgaccuaugaaccggauguagaccuggggagcggaacuagaaauaucggaauagaaucagaaauaccgaauuuagauauaauaggcaaacggauagagaaaauaaagcaggaacacgaaacaucauggcacuacgaucaagaucauccauauaaaacuugggcuuaucacggauccuacgaaaccaaacaaaccggcuccgcauccagcaugguuaacggagugguuagacucuuaacaaaaccuugggauguagugccaaugguaacucagauggcaaugaccgacaccacucccuuuggucaacagagaguauuuaaagaaaagguggauacacgaacgcaggaacccaaagaagggacgaagaaauuaaugaggauuacggcagaguggcuuuggaaagaacucgggaagaagaaaacuccaaggauguguacgcgggaggaguucacaagaaaaguacgcucaaaugccgcucucggagcgauuuucaccgaugagaauaaguggaaaagcgcaagagaggcagucgaggacgggcgcuuuugggaauuaguagacagggagaggaaucuacaucuugagggaaagugcgagacuugcguauacaacaugaugggaaaaagagagaagaaacuuggugaguucggcaaagcgaaaggaagcagagcuauaugguacauguggcuaggggcacgcuuccuggaguucgaggcgcuaggcuuuuugaaugaggaccacugguuuucuagaggaaacagucuuucgggggucgaaggcgaaggucugcacagauugggcuauauacugagagauguaggaaagaaagaaggcggugcaauguaugcagaugauacagcagguugggauacccgaaucaccuuagaagaccugaaaaacgaagagauggugaccaaccacaugaaaggagagcauaaaaaguuagcagaagcaauauuuaaauuaacauaucagaacaaaguuguucgcgugcaaagaccaaccccacgagggacagugauggauauaauaaguagaagagaccagcgaggcaguggucaaguaggaacauacggucuaaauaccuuuacuaauauggaagcacaacugaucagacaaauggaaggggaagguaucuuuaaaucuauccaacacuuaaccgccacagaagaaauagcagugcaaaacugguuagcacggguuggacgagagcguuuaaguagaauggcgauuucuggagaugacugcguggucaagccaauagacgaccgauuugcuucagcacuaacugcccuaaaugauaugggaaaaguacgaaaagauauacaacagugggaaccuaguagaggcuggaaugauuggacucaaguaccauuuuguucacaucauuuccaugaauuggucaugaaagaugguagaguauuaguaguuccuugucgaaaccaggaugaauugaucggaagggcacgaauaucacaaggagcggguuggucuuuaaaggagacggcaugcuuagguaaaucauaugcacaaauguggacucuaauguacuuccauagaagggaccucaggcucgcagcaaaugcuauaugcucggccgucccuucgcacuggguaccaacaagucgaacaacauggaguauacaugcuaaacaugaguggaugacaaccgaagauauguuagcgguauggaaucgaguuuggauacaagagaacccuuggauggaagauaaaacaccaguggagaguugggaggaaguucccuaccugggaaaaagagaagaccaauggugcggcucccuaaucggacuuacaucacgagccacgugggcaaagaacauacagaccgcuauuaaucaaguaaggagcuuaaucggaaacgaagaauacaccgacuacaugcccaguaugaaacguuuuagaagggaagaagaagaagcggguguacuaugguaa

SEQ ID NO: 22292 - RNA, 9876 nt, Artificial Sequence
  derived and/or modified CDS sequence (opt6) from DENV-2__GQ868555__SS-prME
accgcaggcguaaucguuaugcugauuccgacggcaauugcauuccauuuaaccacacguaacggcgaaccacauaugauaguaggcaggcaagaaaaagggaaaucucuauuguuuaaaacagaagauggugugaauaugugcacucuuauggcaauugacuugggugaacugugugaagacacgauaacauauaaauguccacuacuaagacaaaaugaaccugaagacauugacuguuggugcaacucaaccucaacauggguaacguauggaaccugcacaacgacgggcgaacaucgacgugagaaaagaucgguagcccuaguaccgcauguagggauggggcuagaaacuagaacggaaacauggaugucaucugaaggggcauggaaacacguacaaagaauugaaaccuggauauugagacauccagguuuuacaauaauggcggcuauucuugcauauaccauugguacuacacacuuccaacgagcacuaauauucauacuauuaaccgcuguugcacccucaaugacuaugcguugcauaggcauaagcaacagagauuucguagaaggaguuagcggcgggagcuggguagauauaguacuagaacaugggucuugcgugacaaccauggccaaaaauaaaccuacguuggauuuugaacugauaaaaacagaagcuaaacaacccgcaacccuaaggaaauacugcauugaagccaaauugacuaacacaacgaccgagucaaggugcccgacacaaggugaaccgucacugaaugaagaacaagacaaaagguuuauuuguaaacacucuaugguagacagaggaugggggaacggguguggauuauuugguaaaggagguaucguuacaugcgcaauguuuaccugcaagaaaaauauggaagggaaaguuguacaaccugaaaacuuagaguauacgauuguaauaacuccccacaguggcgaagaacaugcaguagggaacgauacugguaaacacgggaaagaaaucaaaauuacaccucaaaguucaauuacugaggccgaguuaacaggguacggaaccguaacgauggaauguuccccaaggacaggacuggacuuuaaugagaugguauuacuucaaauggaagauaaagcaugguuggugcacagacaaugguuucuugacuuaccccuacccuggcuaccuggagcagacacucaaggaucaaacuggauacagaaagaaaccuuaguaacauucaaaaacccacaugcgaagaaacaagacguaguaguacuaggaucacaagaaggugcaaugcacacugcccuuaccggggccaccgaaauacaaaugagcagugggaaucuuuuauucacgggacacuuaaaauguaggcuaagaauggauaaacuccaacugaaggggaugagcuacucaauguguacaggaaaauuuaaaauaguaaaagaaauugcggagacccaacacggcacgauaguuauacgagugcaauaugagggcgaugguucccccugcaaaauccccuucgagauaacagacuuggagaaaagacacguguuaggacgacugauaaccguaaauccaauaguuaccgaaaaagauucccccguuaauauagaagcugaaccaccuuuuggagauagcuacauuauuauugggguggaaccaggacaacuaaagcucaauugguuuaagaaggguucaucgaucgggcagauguucgagacuacaaugaggggagcaaagagaauggcaauauuaggagauaccgcuugggacuucggaagucucggggguguauucacauccauagguaaagcguuacaucagguauuuggggcgauuuacggagcagccuuuaguggaguuaguuggacuaugaaaaucuuaauaggaguugucauaacauggaucgggaugaacuccagaucuacaucgcuuucaguuucgcuggucuugguaggaguaguaacucuuuaccuuggggcgaugguucaagcugauucaggcuguguagucagcuggaaaaauaaggaacuaaaauguggcucaggaauauuuauaaccgauaacguccauaccuggaccgagcaauauaaauuccagccugaaucaccuaguaaacucgcaagugcaauacaaaaggcacacgaggaaggaauuugugggauuagaagugucaccagguuagagaauuugauguggaaacaaauaaccccggaacuaaaucauauacuaucugaaaacgaagucaaacuaacgaucaugacuggcgauacaaagggcaucaugcaagccggaaaaaggucacugaggccccagccaacugaauuaaaauauucguggaaaacaugggggaaggcuaaaauguugucaacggaaagucacaaccagacguuucucauagauggcccagaaaccgcagaaugcccgaacacgaaucgugcuuggaacaguuuggaagucgaagauuauggauuuggggucuucacaacaaacaucugguuaaagcuaagagaaaaacaagacguuuucugugacuccaagcuaauguccgcggcuauaaaggauaaucgggcgguacacgcagauaugggauacuggauugaaucagcauugaaugacacauggaaaauggaaaaagcaucuuucaucgaaguaaagagcugucauuggccgaaaucucacacccuauggucaaauggcguccuagaaucagaaaugauaauaccuaaaaacuuugcaggaccagugucacaacacaauuauaggccaggguaccauacacagacugcaggaccauggcacuuaggaaaguuagagauggauuucgacuuaugcgaagguacaacugucguuguaaccgaagacugugguaacagagggccaagucugcgcacuaccacagcaucagguaaauugauaacagaaugguguugucgaucgugcacauugccuccucuuagauaccguggagaagacgguugcugguaugggauggaaauaaggcccuuaaaggaaaaagaagaaaacuuaguaaauaguuugguaacagcugggcauggccaaauagacaauuucucucuaggcguuuuggguauggcauuauuuuuagaagagaugcugaggacaagaguuggaaccaaacaugccauauuauuaguggcgguaaguuuuguaacccuuaucacggggaauauguccuuuagagaucuagggagagucaugguaauggucggagcaacuaugaccgaugauauagggaugggcguaacguaucuagcguuacuagcugcguuuaaaguacgcccuacauucgcagcaggacucuuguuaagaaaauugacguccaaagagcuuaugauggcuacaauaggcauagcauuacuuucacaauccacuauaccggagaccauacuugagcugaccgaugcccucgccuuaggcaugaugguuuuaaaaauugucagaaauauggaaaaguaucaacucgcaguaacaauuauggcaaucucaugcguaccaaacgcaguaauccugagaaaugcuuggaaagucuccuguaccauacuugcagccgugucuguuaguccgcucuuacuaacaaguucccaacagaaggcugauuggaucccauuagcuuuaaccauuaaaggguugaauccuaccgcuauuuuccugacaacuuuaucuagaacaagcaagaaacgaaguuggccacuuaaugaagcaauaauggcaguaggaauggugaguauuuuagcuuccagcuuauugaaaaaugauauaccaaugacagggccccuaguugcuggcggauuauuaacugucuguuauguacuaacuggaagaagugcagaucuagaacuugaacgagcggcugaaguaaaaugggaagaccaggcggaaauuucaggcucguccccgauccucucgauuacgauuucagaagaugguucaaugucuaucaaaaacgaagaagaggaacaaacuuuaacuauacuaauucgaacaggccuacuuguuauaucuggaguguuuccuguuagcauaccuauuacugcggcagcaugguauuuaugggaagucaagaaacaacgcgcaggaguguugugggauguaccaaguccuccacccguagggaaagcugaauuagaagaaggagcauaucggauuaaacaacgugggauauuaggauauagccaaauaggugcuggaguauacaaggaaggaacauuucauaccauguggcauguuacaagaggcgcaguacuuaugcauaggggaaagcguaucgaaccaucaugggcagaugucaagaaagaucugauaagcuacggcgggggauggaaacuugagggugaauggaaagaaggagaggaaguucaaguguuggcauuagagccugguaaaaauccaagagcugugcagacaaaaccgggaaucuuuaaaacuaacacaggaaccauaggagcagugucacuagauuucuccccgggcacaucgggaucuccaauaguggauagaaaaggaaaaguagugggacuauauggaaauggcguagucacgagaaguggagccuauguaucagccauugcucagacagaaaaaucaauugaggauaacccagaaauugaggacgacauuuuucguaaaaagcgucuaacaauuauggaucuccauccgggugcagggaaaacaaagcguuaucuuccagccaucguucgagaagccauaaaaaggggcuuaagaacacuuauacuagcuccaacccgaguugucgcagcagaaauggaagaagcguugagaggauuaccuaucagauaccaaacuccagcaauuaaagccgaacacaccggaagagaaauugucgaucuaaugugccaugcgacuuucacgaugagacuucuuuccccgguacgaguuccaaacuacaauuugauaauaauggacgaagcacauuucaccgauccagcaucuauagccgcucggggcuauauaucaacuaggguugagaugggugaagcugcagggauauucaugaccgcaacacccccugguagccgugauccguucccgcaaaguaacgcccccauaauggacgaggaacgagaaaucccagagcgcaguuggaacucuggacacgaaugggugacagacuuuaagggaaagacugugugguucgugccuucaauuaaagcuggaaacgauaucgcggcauguuuacgaaagaaugguaagaaaguaauacaacuuagcagaaaaacuuucgacucagaauauguuaaaacgagggccaacgauugggacuuugucguaaccacugauaucucggaaaugggggccaacuuuaaagcagaacgagugaucgacccgagaaggugcaugaaaccaguaauuuugacagacggagaggaaagagugaucuuagcaggaccaaugcccguaacucauaguucggcagcucaacggagagguagaauagggcgaaaucccaaaaaugagaacgaucaauauauauauaugggugagccacuagaaaacgacgaagacugcgcucacuggaaagaggccaaaaugcuauuggauaauauaaacacgccagagggaauaauacccucgauguuugaaccggaaagagaaaaaguagacgcaauugauggugaauauaggcuaagaggugaagcccggaaaacguuuguagaccuaaugagaagaggugacuuaccaguaugguuagcauauaaaguggcagccgaggguauuaauuaugcggauagaaaaugguguuuugaugggauuaaaaauaaccaaauacuagaagaaaauguggagguagaaauauggacuaaagaaggagaaaggaaaaaguuaaaaccucguuggcuagaugcucgcauauauagugauccacucgcauuaaaggaguuuaaggaguucgcugcugguagaaaaagucuaacuuuaaauuuaauuacagaaaugggaagauugccuacauucaugacccagaaggccagaaacgcguuagacaacuuggcaguccuccacaccgcagaggcaggcggccgagcuuacaaccacgcuuuaucagaauuaccagagacuuuagaaacuuugcuacuacugacccuuuuagcaacagugacuggaggaauuuuccucuuucuuaugucgggaaaagguauaggaaagaugacacuuggaauguguugcaucauaacugcaagcguuuuauuaugguaugcccaaauucagccucauuggauagcagccaguauaauuuuggaauuuuucuugauaguguuguuaauccccgaaccugagaaacagagaacaccacaggauaaucaacuaacguaugucguaauugcuauucugaccgugguugcagccacaauggcuaacgaaaugggauucuuggagaaaacuaagaaagaccucggccuuggaucuauaaccacacaggaaagugaguccaacauauuggacauugaccuuagaccagcaagcgcauggacccuuuaugcuguggcaacaacuuuuguaaccccaauguuacggcacucuauagaaaauucaagcgugaauguuucgcuuacggcuauugcuaaucaagcuaccgugcuaauggguuuagguaaaggauggccuuuaucgaagauggacauaggcguaccuuuauuagcuauagguugcuauagccaaguaaacccaauuacucuuacggcugcucuauuguuacuuguggcacauuaugcaauaauuggaccggguuugcaagcaaaagcuacaagagaggcacagaaaagggccgccgcaggaaucaugaaaaauccaacaguagauggcauaacugucauagacuuagaaccaauuccuuacgaucccaaauucgaaaaacaacuuggacagguaaugcuucuaauucucuguguaacucaaguucugaugaugcgaacgacaugggccuugugcgaagccuuaacacucgcaacgggaccuaucucaacccuaugggaggguaauccaggacguuuuuggaauacaacaaucgcgguuucaauggccaauauauuccguggaucuuauuuagcuggugcagggcugcucuuuaguauaaugaaaaauacuacaaauacaaggcguggaacugguaauauaggugaaacauuaggagagaaguggaaaucaagguuaaacgcccuuggaaaaucugaauuucagauauauaagaaaagugguauucaggaaguugauagaacucuugcuaaagaagguauuaaacguggagaaacugaccaucaugcgguaagccgaggauccgcuaaacuuaggugguuuguagagcguaauaugguuaccccagaagggaaaguaguagacuugggaugcggucgaggagguuggucguacuauuguggcggacucaaaaacguacgugaagucaaaggucuuacaaaagggggacccggccaugaagaacccauuccaaugagcacauauggguggaaccuaguaagguugcagucaggaguagaugucuucuuuaccccuccggagaaaugugacacacuacugugcgauauuggagaauccaguccuaauccaacgauugaagccggaagaacgcuacgaguauugaacuuggucgaaaauuggcucaacaauaacacucaauucuguauaaaaguacuaaauccguauaugccaucggugauagagaaaauggaaacguuacaacguaaauacggaggagcacugguaagaaacccccuuagcagaaauagcacucaugaaauguauuggguauccaacgcgacuggaaacauaguguccucaguuaauaugaucucaaggaugcugauaaauagauuuacuaugaaacauaagaaagcaacauaugaaccagauguagacuugggcagugggacgcgaaauaucggaaucgaaagcgaaauucccaauuuggauauuauagggaaacgaauagaaaagauaaaacaagaacaugaaacgucauggcacuaugaucaggaccaucccuauaaaacaugggcuuaccauggcagcuacgagacaaaacaaacagggucugccagcucaaugguuaacgguguugucagauuauugacuaaaccaugggaugugguuccaaugguaacacaaauggccaugacagacacaacaccauuuggucaacaaagaguauuuaaggaaaaaguggauacacgaacacaggaaccaaaagaagguacgaaaaaguuaaugaagaucacugccgagugguuguggaaggaacucggaaagaagaaaacaccucguaugugcacacgugaagaauuuacucggaagguacgcagcaaugcugccuuaggugcaauuuuuaccgacgaaaacaaauggaagucagcgagggaagcuguagaagauggccgauuuugggaauuaguagauagagaaagaaacuuacaucucgaagguaaaugugaaacuuguguauauaauaugauggggaagcgggaaaagaaacugggugaguuugguaaggcuaagggauccagagcaauaugguacauguggcuuggugcaagauuucuagaauuugaggcguugggauuuuuaaaugaagaucacugguuuucaagaggaaacucgcuuucuggaguagagggggaaggcuuacaucggcucggauauauauuacgagauguaagcaagaaagaaggaggugcgauguaugcagacgacacagcugguugggauacgaggaucacuuuggaagaccugaaaaacgaggaaaugguaacaaaucacaugaaaggagagcauaagaaacucgcugaagcaauuuuuaaguuaacuuaccaaaauaagguaguaagagugcaacgaccaacuccucgggguacgguaauggauaucauuucucgccgagaccaaagggguuccgggcaaguagggaccuaugguuuaaacacauuuacaaacauagaagcacaacuuauaagacagauggaaggagaggggauauuuaagucaauccaacacuuaaccgcaacggaggagaucgcuguacagaauuggcuagcaagaguaggacgggaacguuuaaguaggauggcgaucucaggggaugauuguguaguuaagccaauagaugauagauuugcuucggcccugaccgcacuaaaugacauggggaaggugaggaaagacauacaacaaugggaacccucgagaggcuggaaugauuggacacaaguacccuuuugcucgcaccacuuucaugaacuugucaugaaagacggccgcguauuaguagucccuugucgaaaucaagaugaauuaauugguagagcacggauaagccaaggggccggguggucguuaaaagaaacagcaugcuuagguaaaagcuacgcucaaauguggacucuaauguauuuucaccgacgcgauuuaagacuugcggcaaaugcaauauguagugcuguaccaucucacuggguacccacuucacgcaccacguggucuauucacgcgaaacaugaauggaugacaacagaagauaugcuagcuguauggaauagaguauggauucaagaaaauccauggauggaggauaaaacuccaguagagagcugggaagaaguaccauaccucgguaagagagaagaccaguggugugguagucuuauaggucuaacaucuagagcaacaugggccaaaaauauacaaacugcuauaaaucaaguuagaucguuaauuggaaacgaggaguauacagacuauaugccaucaaugaaacgguucagaagagaagaagaagaagcaggaguauuaugguag

SEQ ID NO: 22293 - RNA, 9876 nt, Artificial Sequence
  derived and/or modified CDS sequence (opt6) from DENV-2__GQ868556__SS-prME
acugcaggcguuauuguaaugcuaauuccgacagcaauggcuuuucaccuuacgacacgaaacggggaaccucacaugauuguuggacgacaagaaaaagggaaaucguuauuauuuaaaacagaagauggaguaaacauguguacccucauggcuauagacuuaggagaacucugugaagacacuauuacuuacaaguguccucugcugaggcagaaugaaccagaagacauugauugcugguguaacuccacgaguacuuggguaacuuacggaacguguacgacuacuggugaacacagacgagaaaaacgauccguggcgcuggugccacauguaggaaugggcuuagagacacgaacugagacuuggaugucaucggaaggagccuggaagcauguacagaggauagaaacguggauauuacgacauccuggauucacgauaauggccgccauucuagccuauaccauaggaacuacucacuuccaacgugccuuaauauuuauucugcuaacggcaguagccccauccaugacaaugcggugcauaggcauaagcaauagagacuuuguugaaggagugucaggugguucauggguagauauaguuuuagagcacggauccugcguaacaacaauggcuaaaaauaaaccaacacuagacuucgaacuuauaaagacagaagcuaaacagccugcgacccuaagaaaauauuguauagaagcaaaacuuacaaacacaacuacugagucccgaugcccaacacaaggugaaccaagucuuaaugaagaacaagacaagagguuuaucugcaaacacaguaugguugaucggggauggggaaacgguuguggacuauucgguaaaggugguauuguuacgugugcgauguuuacaugcaaaaaaaauauggaggguaaagugguccaaccagaaaaucuugaauauacgauaguaauaacgccacacucaggagaagagcaugcaguuggaaacgauacagggaagcauggaaaagagauaaaaaucaccccacaaaguucaauuacagaggcagagcucacagguuacggaacggugaccauggaaugcaguccacguacaggucucgacuuuaacgaaaugguauuguuacaaauggaggacaaagcauggcugguacauagacaaugguuucuggauuugccacuaccauggcuuccaggggcagauacccaaggauccaauuggauacaaaaagaaacgcucguaacguuuaaaaauccgcacgcgaagaaacaagauguaguaguauuggguagccaggagggggcgaugcauacugcauuaacuggagcaacagaaauacagaugucuagcgguaauuuacuauuuacaggucauuuaaaaugccgacucagaauggauaaacugcagcucaaagguaugagcuauucuaugugcaccgggaaguuuaaaauagugaaagaaauugcagaaacucagcauggaacgaucguaauuaggguucaauacgaaggugacgguagcccguguaaaauaccguuugagauaaccgauuuggaaaaacgacacguacuuggucgacucauaacggugaauccgauaguaaucgaaaaagauaguccugugaacauagaggcagagccuccauucggggacucguauaucauaauaggaguagaaccuggacaauuaaaacuuaacugguuuaaaaaaggauccucuauaggacaaauguuugaaacgacaaugcgaggugcaaaaagaauggcuauauuaggagacaccgccugggauuucggaucucucggcggaguuuuuacuucuauaggaaaggcgcuccaucaaguauucggugcgauuuauggcgcugcuuucaguggcguaucuuggacgaugaaaauucuuauaggaguggucauaaccuggauaggcaugaauagccgcucgacaucacugucaguaucauuaguguuaguagggguaguaacauuguauuuaggugcaaugguacaggcggacucggguugugugguauccuggaaaaacaaagaacuaaaauguggauccggaauauuuauaacggauaacguucauacauggacagaacaguacaaauuccaaccagagucacccucgaaacucgcgucagcgauccagaaagcucaugaagaagggauuugugguauucgaagcgucacuaggcuagaaaaccuaauguggaaacagaucacaccggagcuuaaccacaucuuauccgaaaacgaagucaaacuuacaauaaugacaggagauacuaaagggaucaugcaagcgggcaagaggagucucagaccgcaaccgaccgaauuaaaauauucguggaaaacuuggggcaaagcaaaaaugcugaguacugaaucacacaaucagacuuuccuaauugauggacccgaaacugcugaauguccaaacacaaauagggccuggaauaguuuagaagucgaagacuauggauuuggcguauucacaacgaauauaugguuaaaauuaagagaaaaacaggauguuuuuugcgacaguaaacuuaugagcgccgcuauaaaggacaaucgagcaguucaugcugacauggguuauuggauugagagugcacuaaaugauaccuggaaaauggaaaaagcaucauuuauagaaguaaaaagcugccacuggcccaaaucgcauacuuuauggagcaauggaguucuugaaagcgagaugauaauaccaaaaaacuuugcggguccaguaagucaacacaauuauagaccagguuaucauacacaaacggcugggccuuggcaucuuggaaagcuagaaauggauuuugauuucugcgagggaacuacuguaguaguaacugaagauugcgguaaucguggaccuagcuuaaggacuaccacagccucuggaaaauugauaaccgaaugguguugccguagcuguacccuaccaccucuccgcuaucgaggagaagacggauguugguacggaauggagauaagacccuuaaaagaaaaggaagagaauuuaguuaauucacugguuaccgccgggcacggucaaauagauaacuucucauuaggaguauugggaauggccuuauucuuagaagagaugcugcgaacccgaguaggaacaaaacacgccaucuuacucgucgcuguaucuuucguaacucuaauaacagggaauaugagcuuuagagaucucggaaggguaaugguaaugguuggugccacuaugacggaugauaucgguaugggggucacauauuuagcuuuacuugcagcauuuaaaguacggcccacuuuugcggcugguuuacuauugagaaagcuaacuucaaaggaauuaaugauggcgacaaucggaauaacacuacucagucaaucuacgauuccggagaccauauuagaauugacagaugcguuagcgcuaggaaugaugguccuaaaaauugugcggaacauggaaaaauaucaacuagcugucacaauaauggcaauuaguuguguucccaaugcaguaauuuuaagaaaugccuggaaaguaucuuguacaauauuggcugcaguuagugugucgccacuuuuauugacaucuucucaacaaaaagcagacuggauaccacuagcacuaacgauuaaaggucucaauccgacggcaaucuuucuaacuacauugaguaggacaucaaaaaagcggucuuggcccuugaaugaagcgauuauggcaguaggaaugguaaguauauuagcaucuucuuuguuaaaaaaugacauucccaugacggguccacuaguugcuggggguuugcugacuguaugcuacguuuugacuggaagaagugcugacuuagaauuagaacgagcagcugaugucaaaugggaagaucaagcugaaauaucgggcaguuccccaauucucaguauaacgaucuccgaggauggauccaugucaauaaaaaaugaggaggaagagcaaacguuaacuauacuaauaagaacuggucuguuaguaauaucugguguuuuuccagucaguauaccuauaacugcggcugcuugguaucuaugggaaguaaagaagcaacgugcaggaguacuuugggaugucccaaguccaccaccgguugggaaggcagaauuagaagauggcgccuaucgaauaaaacagagaggaauucucggguauucacagauaggggccggaguauacaaagaagggacauuucacacgauguggcacguaacuagaggagccguucucaugcaccgaggcaaaagaauagaaccaaguugggccgaugucaaaaaagauuuaauaucauacgguggaggcuggaaacuagagggugaauggaaagaaggagaagagguucagguccucgcccuagaaccugggaagaauccgcgugcaguacagacaaaaccaggaaucuucaagacaaauacagguacuauaggugcaguuucucuugauuuuuccccugguacuagugguaguccaauuguugaccgcaagggaaaagugguaggguuauacgguaauggaguaguaacucgaucaggcgcguacgucucugcaaucgcgcaaacggaaaaaucgauagaggacaacccugagauagaagaugauauauuucggaaaaaaagauugacaauaauggacuuacauccuggggcugggaagacgaagcgcuacuuaccagcaauuguccgcgaggcaauuaagagaggauuacggacauuaauacuagccccaacgagagucguagcagcagagauggaggaggcguuaagaggccuuccgauccgguaucaaaccccugcgaucaaagcagagcauacggggcgagaaauagucgaccuaaugugccacgcgacauucacgaugagguuacuuucgcccguacgagugcccaauuauaacuuaauuauaauggacgaggcacacuucacagacccugccaguauagcagcaagaggauauauuucuacuagaguggaaaugggagaagcggccggcauauucaugaccgcuacucccccugguaguagggauccguucccccaaagcaaugcgcccaucauggacgaagaaagggaaauaccugaaagaucuuggaauucaggacacgagugggugacugacuucaagggaaaaacagucugguuugugccgucaauuaaagcuggcaaugacauagcggcauguuuaagaaaaaauggaaaaaaaguuauccaauuaucaaggaaaacauuugauagcgaauaugucaagacaagggcaaaugauugggauuuuguagugacuacagauauaagugaaaugggcgcaaacuuuaaagcggaacgcguaauagauccucguagaugcaugaaaccaguaauccuuacugauggggaagaacggguaauucucgccggaccaaugccaguaacccauagcagcgcugcccaaagaagaggccguauaggaaggaacccuaaaaacgagaacgaucaguauaucuauaugggagaaccacuagagaaugaugaggauugugcgcacuggaaggaagcgaaaauguuacucgacaacaucaauaccccagaaggaauaaucccgucaauguuugagccagagcgugaaaaagucgacgcaauagacggagaauauagguugcguggcgaggcgagaaaaacuuucguagaucuuaugaggcgaggagauuuaccgguaugguuagcuuauaagguagcugcagaagguauaaauuaugcagacaggaaaugguguuucgacggcaucaaaaacaaucaaauucuagaggaaaacguagaaguagagauuuggacaaaagaaggagaaagaaaaaaauuaaaaccccgcugguuggaugcucgaaucuauucagacccauuggcucuuaaagaguuuaaagaauuugcagccgggagaaaguccuugaccuuaaaucucaucaccgaaauggguagauuaccuaccuuuaugacucagaaagcccgaaacgcuuuagauaaccuugccguccuacauacggccgaagcuggaggcagagcuuacaaucaugcacugucggaacucccagaaacuuuagaaacccuauuacuauuaacauuacuagccacugugacuggcggaaucuuucuauuuuuaaugucagguaaaggaauaggaaagaugacauuagguaugugcugcauaaucacagcaucuguguuguuaugguacgcacaaauucaaccucauuggauagcugccuccauaaucuuggaauucuuccuaauuguacuacuaauaccagaaccagaaaaacaaagaacuccucaggauaaucaacuaacguacguagucauagcaauacuuaccguaguagcggcaaccauggcaaacgaaaugggauuucuagaaaagacuaagaaagauuuaggauugggcaguauaacaacgcaagaauccgagagcaauauucuugauaucgaccuuaggccagcuagugcuuggacgcuuuaugcgguagcaaccacuuuuguaacuccgaugcuacgacauucaauagaaaacucaucuguuaauguaucuuuaacagccaucgcaaaccaggccaccguucuaaugggauuaggcaaaggauggccuuuauccaagauggauaucgggguuccccuacuagcaauuggguguuauucacagguuaacccaauaacucugaccgcugcacuccuguugcucguggcacacuacgcaauaaucgggccggggcugcaagccaaagcaacacgagaagcucagaaaagagcggccgcagggauuaugaagaauccaacaguggaugguauaacuguuauagacuuagaaccuauucccuaugauccgaaguucgaaaagcaauuaggacaggugaugcuccuuauccuuugcgucacucagguucugaugaugagaacaacaugggcccugugcgaggcccuaacguuagcaacuggcccgauauccacucucugggaggguaauccagguagguuuuggaauacuacaauagcaguaaguauggcaaacauuuuuagaggaucuuauuuagcaggggcuggacuguuauuuagcauaaugaagaacacaacaaauacaagacgaggaacaggcaauaucggcgaaacgcuuggugaaaaguggaaaucacgguugaaugcuuuagggaaaucagaauuucaaauauacaaaaagaguggcauacaagagguagauaggacccuagcuaaagaaggcauaaaacgcggcgaaaccgaccaccaugcggucaguagagguucagcgaaacuuagaugguucguagaacgcaauaugguuacuccagaaggaaaaguuguugaucuaggauguggaagaggcggauggagcuacuauuguggcgggcuaaagaacguuagggaggucaaaggacuuaccaaaggcgguccuggacaugaggaaccuauuccaaugucaaccuacggcuggaauuuaguacgacuacagucagggguagauguuuuuuuuacgcccccugaaaagugugacacauuauuaugugauauuggcgaaagcaguccaaacccuacaauugaagcuggaagaacgcuaagggucuuaaauuuaguugaaaauugguugaauaauaauacacaauucuguauaaaagucuuaaauccguauaugccuaguguaaucgaaaaaauggaaacacuacaacguaaauauggcggagcauuaguuagaaaccccuuaucuagaaauucaacucaugaaauguacugggugucaaacgcgacuggaaauaucguuaguaguguaaauaugauuagucguaugcuuaucaaucguuuuaccaugaaacacaaaaaagccacguacgaaccagacgucgacuugggcagcggcacaagaaauauaggcauagagucugaaauucccaauuuagacaucauaggaaaacgcauagaaaaaaucaaacaggaacacgagaccucauggcacuaugaucaagaucauccuuauaaaacaugggcuuaucacgggucauacgaaacgaaacaaacuggcucugccucaucuaugguaaacggugugguaagacuucuaacaaaaccuugggacguaguuccuauggucacacaaauggcgaugacagacacuacgccguucggacaacaacgcgucuucaaagaaaaagucgacacaagaacucaagaaccuaaagaaggaacgaagaaauuaaugagaauaaccgcugaaugguuauggaaggaacuuggaaaaaaaaaaacuccacgcauguguacccgagaagaguucacacguaagguaagaucuaaugcggcacugggcgcgauuuucacagaugaaaauaaauggaaaagcgcaagagaagcaguagaagauggaagauuuugggagcuaguagauagggaaagaaaccugcaucuagaaggaaaaugugagacaugcguauauaauaugaugggaaaaagagagaaaaaacuuggugaguuuggcaaagccaaaggcucgagagcgauaugguacaugugguuaggagccagguuccuggaauuugaagcacugggauuccuuaacgaggaucauugguucaguaggggaaacagcuuauccggcguugaaggugagggucugcauagacuugguuauauccuacgggaugucgguaaaaaagaaggcggagccauguaugcugaugauacagcugguugggauacucgaauaacuuuggaagauuuaaaaaaugaagaaaugguaacaaaucacaugaaaggggaacacaaaaaacuagcugaagccauuuucaaacuaacuuaccaaaauaaaguuguacguguacaaagaccaaccccacguggaaccguaauggauauuauaucacgacgagaucaaagagguaguggccagguaggaacauacggcuuaaauacauucacgaacauggaagcucaauugauaagacaaauggaaggugaaggaauuuuuaagaguauacaacaccuaacagcgacagaggaaauagcuguacaaaacuggcuagcaagaguggggcgagaaagacugucaagaauggccauaagcggcgaugauugcguagugaaaccuaucgaugacagauuugcgagcgcauuaacagcuuuaaaugauaugggaaaaguaaggaaagacauucaacagugggaaccgucucgaggcuggaaugauuggacucagguuccauuuugcucccaucauuuucacgagcucguuaugaaagacggacgaguguuaguaguaccuugcagaaaccaagacgaguugauaggucgagcccguauuagccaaggugcuggcuggucguuaaaagaaacggcuugcuugggcaaaagcuacgcacagauguggacauugauguauuuucaccgccgagaccugagauuagcugccaaugccauauguucagcagucccaucgcauuggguaccgacuucaagaacaacguggucuauccacgcuaaacacgaauggaugacgacagaagacauguuagcuguauggaaucgaguauggauacaagaaaauccauggauggaagacaaaacgccaguugagucaugggaagaaguacccuaucuggguaagagagaagaccaaugguguggaucucugauuggauugaccagucgcgccacaugggcuaaaaacauccagacagcaauaaaucaaguacguuccuuaaucgggaaugaggaauauacugauuacaugccaucuaugaaacgcuuucgacgcgaagaagaagaagcaggaguccuaugguaa

SEQ ID NO: 22294 - RNA, 9876 nt, Artificial Sequence
  derived and/or modified CDS sequence (opt6) from DENV-2__GQ868557__SS-prME
accgcaggggucauagugauguuaauuccaacagcuauugccuuucacuuaacaaccagaaauggggagccucacaugauugugggaagacaggaaaaagggaaaagucuacuguucaaaacagaagaugggguuaauauguguacuuuaauggcgauugaucuaggagaauuaugugaagacacuauaacauauaaaugcccguuacuccggcaaaaugaaccagaagauauagacugcugguguaacagcacgucaacauggguuacguaugguaccuguaccacaacaggggaacacagaagggagaaaagaagcguagcuuugguaccccacgucgggaugggucuagaaacaaggacagagacuuggaugucaucagaaggcgcguggaaacacguacaacgaauagagacuuggaucuugagacauccuggauuuacaauuauggcugcuauauuagcauacacuaucggcaccacucacuuccaaagagcacuaaucuuuaucuuacugacugcaguugcaccuucuaugacuaugagguguauugggauauccaaccgagauuuugucgaagguguaucgggaggcucauggguagauauaguacuugaacacggcucuugcguuaccacuauggcaaaaaacaaaccaacuuuagacuuugaacuuaucaagacggaggccaagcaaccugcaacgcuaagaaaguacugcaucgaagcaaaacuaacaaacacuacuacagaaucucgcugcccaacucaaggugaaccaucucuaaaugaggaacaggauaaaagguuuauaugcaaacacucuaugguggauagaggguggggcaacgggugcggauuguuugggaaaggcgguauagugacaugcgcuauguuuacuuguaaaaaaaacauggaagggaaaguuguacaaccugaaaaucuggaauauacuaucgucauuacaccucauaguggagaagaacacgcuguugguaaugacaccggaaaacauggaaaggaaauaaaaauaacaccacaaucaaguaucacagaggccgaguugacugguuauggaacaguuacaauggaaugcagcccaagaaccggauuagacuucaaugaaauggucuuacuucaaauggaagacaaagcgugguuagugcaccggcaaugguuccuggaucuuccacuaccaugguuaccuggagcugauacucaaggauccaacuggauacagaaagagacauuaguuacauuuaaaaacccacaugccaaaaaacaggacgugguagucuuagggucucaggagggcgcuaugcacacugccuuaacaggagcgacagagauacaaaugaguucagguaauuuguuguucacagggcauuugaaaugucgacuccgaauggauaaacuacaacucaaagguaugucauacagcaugugcacaggaaaauucaaaauuguaaaagagauagcagaaacacaacaugguacuauuguaauaagaguucaauaugagggagauggcucaccuuguaagaucccauuugaaauaacugaccuagaaaaacgucacguauugggacgauuaaucacgguaaacccuauaguuacugagaaagauucaccugugaauauagaggcagaaccacccuuuggagacucauacauaauaauuggaguggaaccgggucaauuaaaacuaaauugguucaaaaaaggcuccucuauuggacaaauguuugagacaacgaugagaggagcaaaacgcauggcuauacuaggagauacagcaugggacuuugguucucugggcggugucuucacuucuaucggaaaagcacuccaccaaguguuuggagcuauauauggcgcagcauuuaguggagugucauggacaaugaagauucuaaucggaguuguaauaacguggauuggcaugaauaguaggaguacaaguuugucaguaucucuuguccuuguaggcguaguuacucucuaucuuggugcgaugguacaagcugauagcggauguguaguaucuuggaaaaauaaagaauuaaaguguggaucuggcaucuuuauaacugauaauguacauacuuggacagaacaauacaaauuucagccggagucuccaagcaagcuugccucugcuauacaaaaagcgcaugaagaaggaauaugcggcaucagaagcguaacaagacuagagaaucucauguggaaacaaauaacgcccgaauuaaaccacauacuaucagaaaacgaaguuaaguugacaauuaugacgggggacacaaaaggcauaaugcaagcaggaaaaagaagccugcguccccaaccuacggaauuaaaauacucuuggaaaacuuggggaaaagcgaagauguuaagcacugaaucacacaaucaaacguucuuaauugauggaccagagacagccgaaugucccaauacgaaccgugcauggaauagucuugagguagaagauuacggauucggagucuucaccacuaacauuuggcuuaaauuaagagaaaaacaggauguauuuugcgauaguaaauugaugucugcagcuauaaaagacaaucgagccgugcaugcggauaugggauacuggauugaaucagcucuaaaugacacauggaagauggagaaggccaguuuuauugaagugaaauccugccauuggccaaaaucucauacguuauggaguaauggagucuuagaaucagaaaugauuaucccuaaaaacuuugccggaccuguuagucaacauaacuauagacccggauaccauacacaaacggcagggcccuggcaucuaggcaagcucgaaauggacuuugaccuaugcgaaggaacuacuguuguugugacagaagacugcggcaaucgcggucccucuuuaagaacaacgacagcuucaggcaaauugauaacagaaugguguugucgcuccugcacuuugccaccgcugcgguacaggggagaagacggauguugguaugguauggagauaaggccacuaaaagagaaagaggaaaaucuaguuaauucacuaguuacugcaggacauggacaaauugacaacuuuucauuaggugugcuaggcauggccuuauuucuagaagagaugcuaagaacacgcguaggaacuaagcacgcuauacuauuaguagccgugucguuuguaacccuaauuacaggaaauaugagcuuccgagauuuaggaagaguuauggucaugguaggcgcaacaaugacagaugauauaggaaugggaguaacauauuuggcucuucuugcagccuuuaaaguacgcccaacauucgcagccggauugcuacuaaggaaacucacaucaaaggaauugaugauggcaacaauagggauagccuugcuuucacagaguacgaucccggagacaauacuagaacuaacggacgccuuagccuugggaaugaugguuuuaaaaauaguuagaaacauggaaaaauaccaauuagcaguuacaauuauggcuauaagcuguguucccaacgcaguaauacuaagaaacgcauggaaagugaguuguacgauacuugccgcgguuagcguaucgccucugcuucuaaccucaagucaacagaaagcugauuggauuccacucgccuugacaauaaaagguuuaaauccaacggcuauuuuccugacgacccugucaagaacaagcaaaaagagauccuggccccuuaacgaagcaauaauggcaguugggaugguuagcauacuugcaucgagccuccuuaagaacgauauucccaugacuggcccccuggucgcaggagguuuacuaacaguaugcuaugugcuuacaggaagaucugcugacuuagaacuugaacgagcagccgaaguaaaaugggaagaccaggcagaaaucucaggcucgaguccaauccugagcauaacaauuagugaagauggaucaauguccauaaagaacgaagaggaagaacagacacuaacaaucuugauccgaacaggauuacucguaauaucgggcguuuucccgguuucaauacccauaacggcagcggcaugguaucuuugggagguuaagaaacaaagagcagguguucugugggaugucccuuccccacccccaguaggaaaggcggaacuggaagauggcgcguauagaauaaagcaaagaggaaucuuaggcuauagucaaauaggagcugguguauacaaagagggcaccuuccauaccauguggcacgugacuagaggugcaguucucaugcauaggggaaaacguauagaacccucuugggccgacgucaagaaagaucuaauuucuuaugggggaggauggaaguuagaaggagaauggaaagagggcgaagagguacagguccuugcgcuggaaccgggcaaaaacccucgcgcgguacaaaccaaaccagguaucuucaagacaaacacaggcacaaucggugcggugucauuagauuuuuccccgggaacgucgggaagcccaauaguggauagaaaagguaaagugguaggucuuuacggcaauggaguaguaacaagaagcggugcauacguauccgcgauugcucaaaccgaaaaauccauagaagacaauccagaaaucgaagacgacauuuuuagaaaaaaacgucuuacaauaauggaucuacacccaggagcugggaaaacaaaaagauaucuucccgcgauaguaagagaagcgauaaaacgugguuugcgaacacuaauuuuagcuccaacacgaguuguagcagcugagauggaggaagcauuacguggguuacccauccguuaccaaacgcccgccaucaaagcagagcauacaggacgagaaauaguggaccuaaugugccaugcuacauucacuaugagacuacucagucccguucgcgugccgaauuacaaccugauaaucauggacgaagcccacuucacugaucccgcgaguaucgcggccagggguuacauaagcacacgaguggaaaugggggaggcagcugguauauucaugacagcaacgccuccggggagcagagauccauuuccgcaaagcaaugcaccuaucauggaugaagagcgagaaauacccgagaggaguuggaauuccggacaugaguggguuacugacuuuaaagggaaaacuguaugguucguuccaucgaucaaagccgguaaugauauugcagccugccuaagaaaaaacgguaaaaaggucauccagcuaucgagaaaaacauuugauagcgaauauguuaaaacaagggcuaacgauugggauuuuguagugacuacagauauaagugaaaugggcgcgaauuuuaaagccgaacguguaaucgaccccagaagguguaugaagccggucauacuaacagauggcgaagagagaguuaucuuagccggacccaugccuguaacucacucaucagcggcccagaggagaggacgcaucggucgaaauccaaaaaaugaaaaugaccaauacauuuacaugggugagccguuggaaaaugacgaagacugugcucauuggaaagaggcaaaaauguuacucgacaauaucaacacaccagaaggaauuauaccaucaauguucgagcccgagcgcgagaaaguagaugcgaucgauggagaauaccggcugaggggagaagccagaaaaacuuuuguagaucuaaugagaagaggugacuuaccaguaugguuggcuuauaaaguggcugcggaaggaauaaauuaugccgauagaaaaugguguuucgauggcauuaaaaauaaccaaauauuagaagaaaacguagaggucgaaaucuggaccaaagagggagaaagaaagaaacuaaaaccccgguggcucgaugccagaauuuauagugauccacuagcauuaaaagaauuuaaggaguuugccgcaggaagaaaaucacuaacuuugaaucuaauaacggaaauggguagauuaccaacauuuaugacccagaaagcgcguaaugcguuagauaacuuagcaguccuccacacagcugaagccggaggacgagcauacaaucacgcauugucagagcuuccugaaacucuagaaacauuauuauugcugacguuacuagcaacagugaccgggggaauuuuuuuauuccuaaugucaggcaaagggauuggaaaaaugacauuaggaauguguuguaucauuacugcuagcguauuauuaugguacgcccagauccaaccucauuggauugcggcuuccauaauacuugaauucuuccuuaucguacuacugauuccagaaccugaaaaacagaggacaccucaagacaaucaauugaccuauguaguuauagccauucuuaccguaguagcagcuacaauggccaacgagaugggguuccuagagaaaaccaaaaaagacuugggacucgggucaauaacuacacaggagucagaaaguaacauuuuagacauagaccuccguccagcguccgcguggacgcuuuaugcugucgcuacuaccuucguuacuccaaugcuccgucauaguauagaaaauaguagugucaauguaucccuaacggccauagcuaaucaggcaaccguucugaugggcuuaggcaaagguuggccguuauccaaaauggauauugguguucccuuacuugcaauaggcuguuauucucaagugaauccaauaacacuuacggcggcgcucuuacucuuaguggcacacuaugcaauaauagguccagggcuucaagcaaaagccacuagagaagcgcagaaaagagcagccgccggcauaaugaagaauccgaccguagacggaauuacaguaauagaccuugaacccauccccuaugauccaaaauucgaaaagcaauugggacaggugauguuauuaauucuaugugugacccaaguucugaugaugcgaacaacaugggcccuuugugaagcauuaacacuagcaaccggcccuauuaguacauuaugggaagggaauccuggucgauuuuggaauacuaccauugcaguauccauggcuaacauuuucaggggaucuuacuuagcaggggcagguuuacuauuuagcauuaugaaaaauaccaccaauacccgacgaggaacuggaaauauuggugagacacucggggagaaauggaaaucuagauuaaacgcauuaggcaagucagaauuucaaauauauaaaaagaguggaauucaggaaguagauagaacauuggcuaaagaaggaauaaagagaggugaaacggaccaccacgcaguuucucgaggcucagcuaaacuccggugguuuguugagagaaacauggucacuccugaagggaaaguuguagacuuggguugugggagaggugguuggucguauuacugcgguggccuaaaaaauguuagggaagucaaaggacuuacgaagggagguccaggccacgaagagccuauacccaugaguaccuaugguuggaaucuugucagacuucaauccggaguagauguauucuuuacccccccggaaaaaugugauacccuucuaugcgauauaggugagaguucaccaaauccaacaauagaagcaggccggacccuucggguauugaaucucguggaaaacugguuaaacaauaauacacaauucugcaucaagguccuaaacccguacaugcccaguguuauugagaagauggaaacgcuccagaggaaauacggcggggcauuaguucggaauccacugucucguaauuccacucaugaaauguacuggguaaguaaugcuaccgguaacauaguaucuagcgugaauaugaucagucggaugcuuauaaauagauuuacaaugaagcacaaaaaagccacauaugaaccagacguagaccuaggaaguggaacgagaaauauagggaucgaaagugaaaucccgaaucuggauaucauagguaagcggaucgaaaaaauaaagcaagaacaugaaacgagcuggcacuaugaucaagaccaccccuauaaaacaugggcuuaucacggcaguuacgaaacuaagcagacagggagugccaguucuauggucaauggagugguacgguuauuaacgaagccgugggacguggucccaaugguaacacaaauggcuaugacugauacuacuccauuuggucagcaaaggguuuuuaaagaaaaaguagauacgcguacccaggaaccaaaagaaggcaccaagaaauuaaugaaaauuacugcagagugguuauggaaagaacuagguaaaaaaaagacuccgcggaugugcacacgugaagaguuuacacgaaaaguacgcucuaaugcggcucucggagcuauauucacagaugaaaacaaauggaaaagcgcacgcgaagcaguugaggauggccgauuuugggagcuagucgacagggagcggaacuuacacuuagaggguaaaugugaaacauguguguacaacaugauggguaagcgagaaaaaaaacugggagaauucgguaaggcaaaaggaaguagggcuauuugguacauguggcuaggagcacgauuucuagaauuugaagcccuuggcuuuuuaaaugaagaucacugguuuaguagagggaauucauugaguggaguagaaggagaggguuuacaucgucuuggauacaucuugcgagacgugagcaaaaaagaaggaggagcgauguacgcagacgacacugccggcugggauacaagaaucacauuagaagauuuaaaaaaugaggaaauggugacaaaucauaugaaaggcgaacauaaaaaauuagcagaagcgauuuucaaacuaacauaucaaaacaaaguuguacgagugcaacgaccaacaccacgagguacaguuauggauauaaucucaagaagagaccagcgagguucuggccagguaggaaccuauggacuaaauacauucacuaauauggaagcccaacuuauuagacagauggagggugaggguauauuuaaaaguauacagcacuuaacggccacagaggagaaugcaguucaaaauuggcuugcuagagugggucgggaaaggcuaagcagaauggcaaucaguggagaugacugcguugugaaaccuauagacgauagguucgcuagugcacuaacagcacuuaaugauaugggaaaaguaaggaaagauauacagcaaugggaaccuucaaggggauggaacgauuggacacaaguccccuucugcagucaucauuuucaugagcucguaaugaaggacggacgaguauugguagugccuuguaggaaccaagaugaacuuauaggaagggcaaggauuucacaaggagcugguuggagucuaaaagagaccgcuugcuuagggaaaagcuacgcacaaauguggacauugauguauuuccaccgaagagaccuaaggcuagcggcaaacgcaauauguucugccguaccaagccacugggucccgacgucacgaacgacuuggucaauacacgcaaagcaugaauggaugacaacagaagauaugcucgcaguauggaacagaguauggauucaagagaacccguggauggaagacaaaacgccgguugagucaugggaggaaguaccuuauuuaggcaaaagagaagaucaguggugcgggucacuaauaggacucacuagcagggccacaugggcaaaaaauauacaaacagcgauaaaucagguuagaaguuugauuggaaacgaagaauauacagacuauaugccaagcaugaagcguuuucgacgagaagaggaagaagccggaguacuuugguag

SEQ ID NO: 22295 - RNA, 9876 nt, Artificial Sequence
  derived and/or modified CDS sequence (opt6) from DENV-2__GU131947__SS-prME
acugcaggaguaauuguaaugcuuauuccaacugccauagcuuuccaucuaaccacucguaacggagaaccgcacaugaucguggggcggcaagaaaaaggaaaaagucuacuauuuaaaacugaagacggaguaaacauguguacgcugauggcgauagaccuaggagaacucugugaagacacuauaacguauaaaugcccgcucuuaagacaaaacgaaccagaagacauagacuguuggugcaauaguaccuccacuuggguuacauauggaacuuguacaaccacuggugaacaucgaagagaaaaacguucgguagccuuagugccacacguaggaaugggucucgaaacaagaacggaaaccuggaugucaucugaaggggcauggaaacacguacaaaggaucgaaacguggauauuaagacauccaggauucaccauaauggcagcuauucuugcauauacaauugguaccacacauuuccaacgugccuuaauauucauuuuacuaacagccguagcaccgucaaugaccaugagauguauuggaaucucaaaucgugauuucgucgaagguguuucgggaggaagcuggguagauauaguccuugaacauggaaguuguguuacuacuauggccaaaaacaaaccaacguuagauuucgaacucauuaaaaccgaagcuaaacagcccgcuacuuuaagaaaauauuguauagaagcaaaacuaaccaacacuacuacagaaucccgaugcccaacgcagggugaaccgagcuuaaacgaagaacaggauaaacgauuuauaugcaaacauucuaugguagaucgcggguggggaaacggcugcggucucuucggaaaaggaggcauaguaaccugugcaauguucacauguaagaaaaauauggaagguaaaguagugcagccagaaaacuuggaauacacaauaguaauuaccccacauucuggagaggagcaugcaguaggaaaugacacugggaaacacggaaaagaaauuaaaauaacaccacaaucaaguaucacagaggcugagcucaccggauacggaacgguuacuauggaaugcucuccccguacuggguuagauuucaacgaaaugguucuguugcaaauggaagacaaagcguggcuuguacacaggcaaugguuccuagauuugccguuaccuugguugccuggggcagacacacaaggcagcaacuggauccaaaaagaaacguuagugacuuuuaaaaacccacacgcuaagaaacaggaugugguaguucucgguagucaagaaggagcuaugcauaccgcguugaccggagcaacggaaauacaaaugaguucgggaaaccuccuauucacuggacaucuuaaaugcagauugagaauggacaaauugcaauuaaaagggaugucuuacucuaugugcacugggaaauucaaaaucgugaaagaaauugccgaaacccagcacgguacaauaguaauuagagugcaauaugaaggagacgggaguccuuguaaaauuccuuuugaaauaacggacuuagagaaaagacacgugcucgguagacuaaucacuguaaacccuauagugacagaaaaagauucaccaguaaauauugaagcagaacccccauucggagacucauacauuaucauagguguagagccggggcaacuaaaauuaaauugguucaagaaagggucaucgauuggccaaauguuugagacuacaaugcgaggggcuaaaaggauggcgauucuuggugacacagcaugggauuucgggaguuuggguggcguguucacaaguauaggaaaagcucuacaucaaguauuuggagcuauuuauggugcugcuuuuuccggcguaaguuggacaaugaaaauacugauugguguggucauaacguggauugggaugaacaguagaucaacaaguuuaucaguaagucuagucuuaguagguguaguuacauuguaucuaggagcaaugguccaagcugauucggggugcguugucagcuggaaaaauaaagaacuaaagugcggaucggggauuuuuauaacggacaauguacauacauggacagaacaauauaaauuccaaccggaaucgcccuccaagcuagccucagcaauucaaaaggcucacgaagaggggauaugcgguauuagaucagugacacggcuggaaaaccugauguggaaacaaauaacaccggaacuaaaucauauauuaucagagaacgaaguuaagcugacuaucaugaccggggacacuaaaggaauaaugcaggcuggaaaaagaucucuuagaccucaacccacugaauugaaguauucuuggaaaacauggggaaaagcaaagaugcuaucaacugagucacauaaucaaacauuuuugauugauggaccggagacugcggaguguccuaacaccaaccgagccuggaauagucuggaaguggaagacuacggcuuugguguguuuacaacaaauauaugguugaaauuacgagaaaaacaagauguauuuugugacucaaaguuaaugagcgcugcgauuaaagacaauagagcuguucacgccgauaugggauauuggaucgagucagcuuuaaaugauacguggaaaauggaaaaggcaucuuuuauugaaguaaaaucaugccacuggccaaaaucccauaccuuauggucaaauggcguauuggaaagcgagaugauaauuccuaaaaacuuugcaggucccgugucucagcacaauuaccgccccgguuaccacacacaaacugcuggucccuggcaucuagggaaacuagagauggacuucgacuugugcgaggguacaacugugguuguaacggaggauugugggaauagaggacccagcuuacguacgacgacugcuucgggaaaacucaucacagagugguguugucguuccuguacguuaccaccauuaagguauagaggugaagacggauguugguacggaauggaaauuagaccguuaaaggagaaagaggagaauuuaguuaacucacugguuacagcuggacacggacaaauagacaacuuuucccuggguguauuaggcauggcacuauuucuugaagaaaugcuaagaacaagggugggcacuaaacaugcgauccuuuuaguugcagucucuuuuguaacguuaauaacggggaacaugagcuuuagagaccuuggcagaguaaugguuauggucggagcaacgaugacggaugacauuggaaugggcgucacuuacuuagcacuucuagcagcguucaaagucagaccaacguucgcagcggguuuacuacuuagaaaacuuacaucaaaggaguugaugauggccacaaucggaauugcauuacuaucacaaaguaccauaccagaaacaaucuuagaauuaacagaugcguuagcucuaggaaugaugguccuuaaaauagugcggaauauggaaaaauaucagcuggcugucacaauuauggcuauaagcuguguuccgaaugcuaugauucuaagaaaugccuggaaagucaguugcacuauccuggcggcagucucuguuucuccacuuuuguuaacaucuagccaacaaaaagcugauuggauuccauuggcacugacgauuaaggguuuaaacccaacagcaauauuuuugacaaccuuaaguagaacaagcaagaaacgcucuuggcccuugaacgaagcaauaauggcagugggaaugguaaguauacucgcgucaagucuacuuaaaaacgacauaccaaugacagguccccuaguggcgggagggcuacugaccguaugcuacguauugacuggccgcagcgcugaucuggaacuugaaagggcugcggaggucaaaugggaagaccaagcggaaauuagcggaagcucuccaaucuugucaaucacaauaagcgaagauggaucaauguccaucaaaaaugaggaagaggaacaaacgcuuacaauauuaauuaggacgggacuccucguaaucuccggaguauuuccaguaucgauuccaauuacagcagcggccugguaccuaugggaaguaaagaaacaacgggcaggcgucuugugggacgucccuucaccgccaccaguaggccgcgcagaauuagaagauggggcguaucguauaaaacagcgagggauacuaggcuauagccaaaucggagcggguguuuauaaagaaggaaccuuucauacgauguggcauguaaccagaggugcuguacuuaugcaccggggcaaacgaauugaacccucgugggcagaugucaagaaagaucugauaucauaugggggaggcuggaaguuagaaggggaguggaaggaaggagaggagguacaggugcuugcguuagaaccggggaaaaauccacgugcaguucaaacuaagccuggaauauucaagacaaacacagggacuauuggagccguuagucuagacuucucuccuggaaccucuggcucuccuauaguagaccgaaaagggaaaguuguaggguuauacggcaaugggguagugacgcgcuccggcgccuauguuucggcaauagcucaaacagaaaagaguauagaagauaauccagaaauagaagacgauauuuucagaaagaaaagacuaaccauaauggauuuacaccccggugcggggaaaacuaagagauaucuuccugcuauaguuagagaagcaauaaaacgaggacugagaacucugauauuagcacccacgagagucguagcagcagaaauggaagaggcauuacgaggguuaccuauacguuaccaaaccccagcaaucaaggcggaacauaccgggagagaaauuguagaucuaaugugccacgcuacauucacuaugcgcuuauuaucucccguucgaguaccgaacuauaaucuaaucauaauggaugaggcucauuuuacggacccagcuucaauugcagcgcgaggauacauaucaacacgagucgaaaugggggaagcggccgggauuuucaugacugcaacacccccaggcuccagagaccccuuuccccagucaaaugcaccaauaauggaugaagaaagagaaauuccugaacguucuuggaacucaggccaugaauggguaacagauuucaaaggaaagacuguaugguuugucccaucaauaaaagcugguaaugauauagcugcaugucuuaggaaaaauggcaagaaaguaauacaacuaucccgcaagacguucgauagcgaauacgugaaaacacgugcaaaugauugggacuuuguuguaacgacagacauuagcgaaaugggcgcuaacuuuaaagcggaacgaguaauagauccccgacgcuguaugaagccaguuauacuuacagacggagaagaacgcgucauacuagcuggacccaugccaguaacccauaguagugccgcacagagacgcggaagaaucggaaggaaucccaaaaacgagaacgaccaauauauuuacaugggagaaccguuggagaacgacgaagacugugcucauuggaaagaagcuaaaaugcuacuggauaauauuaauacuccagaagggaucauaccuucuauguuugagcccgaacgcgaaaaaguagaugcaauagacggagaauaucguuuaagaggcgaagcucgaaaaacuuucguggaccuaaugagaaggggagaucuaccaguuuggcuagcauacaaaguagcagcugaaggaauuaauuaugcggauagaaaaugguguuucgacggcaucaaaaauaaccaaauacuagaggaaaauguggagguggaaauuuggaccaaagaaggagaaagaaagaaauuaaaaccgagguggcucgacgcaaggauuuacucagacccguuggcacuaaaagaguuuaaggaguucgccgccggaagaaaaagccuuacguuaaauuuaauaacggaaauggguagauugccuacauucaugacccaaaaagcucgaaaugcgcuggauaaucuggcuguccugcauacagcagaagcugguggucgugcguacaaucaugccuuaagcgaacucccagaaacguuagaaacauuauuacuauugacacuauuagcuacuguuacggguggcauauuccuauucuuaaugucaggcaagggcauaggaaaaaugacgcugggaauguguugcauaaucacagcaaguguauuguugugguacgcacagauacaaccgcauuggauugcagcuaguauaauacuagaauuuuuccuaauaguacuauuaauaccggagccggagaagcaacggacgccgcaagauaaccaacuaaccuacguaguaauagcaaucuugacaguaguggccgccaccauggcaaaugaaaugggauuuuuagagaaaaccaagaaagauuuaggguugggcagcauaacuacccaagaaucugagucgaauauuuuagauauagacuuaaggccugcaagugcguggacucucuaugcaguagcgacaacuuucgugacgccaaugcuaaggcauaguauagagaacaguaguguuaauguuucuuuaacagcaauugcaaaucaagcaacgguccuaaugggacuaggaaaagguuggccguuaucgaagauggauauaggaguccccuugcuagcgauagguugcuauucacaaguaaacccuaucacuuuaacugcagcuuuacuuuuauugguggcacauuaugcgauaauagguccagguuuacaagcgaaagcaacgagagaggcucaaaaacgggcugcagccggaauaaugaagaauccgacuguagacgguauaacaguaauagauuuagaaccaauucccuacgauccaaaauuugaaaagcaauuaggacaaguaauguuauugauacuuuguguuacccaaguguugaugaugcguacaacaugggcccuaugcgaagcgcuuacauuggccacaggaccaauaucaacucuaugggaagguaauccaggaagguucuggaacacgacgaucgcagucucuauggccaacauauuuagagguagcuaccuugcaggcgcaggcuuacuauuuucgauuaugaagaacaccacaaauacaagacgugguacagguaacauuggagagacucuaggcgagaaauggaagaguagguugaaugcauugggcaaaagugaguuccaaauauauaagaaaagcgggauacaggaagucgauagaacuuuagcuaaagaaggcauaaaaagaggggaaacagaucaucacgcgguaagucgaggaagugcuaaauuaagaugguuuguagagagaaacauggucacaccagaaggaaagguaguggacuuggguuguggcaggggugguuggaguuacuauuguggaggccucaaaaacgucagagagguaaaaggauuaacgaaagggggaccugggcacgaagaacccauacccaugucaacuuacggauggaauuuagucagacuccaaucaggaguagauguguuuuucacacccccagaaaaaugugauacguugcuaugcgauauaggagagagcuccccuaauccuaccauagaagcaggaagaacucuccgaguucucaauuugguugagaacuggcuaaacaacaauacccaguuuugcauaaagguauugaauccauauaugccaaguguuaucgagaagauggaaacuuuacaaagaaaguauggaggagcguuagugcgaaauccccuaucuagaaauaguacacacgaaauguauuggguguccaaugcgacaggaaacauagucucaaguguaaacaugauuagccgaauguugauaaauagauuuacuaugaagcacaaaaaggcaacuuaugaaccagacguggauuuaggauccgguacaagaaauaucggcauugaaucugaaauuccaaacuuggauauaauagggaaacggauagagaaaauaaagcaagaacaugaaacaaguuggcauuaugaccaagaccaucccuacaaaacuugggcguaucauggaaguuaugaaaccaaacaaacugguagugcaucuucuaugguaaaugguguaguucgacuacugacgaagccaugggacguuguaccaaugguuacacagauggcaaugacggauacaacaccauuuggacaacaaagaguauuuaaagaaaaggucgauacaagaacgcaggaaccaaaagagggcacgaaaaagcuaaugaagauaaccgcggaguggcuuuggaaggaauuaggcaagaagaaaacuccacggauguguacuagagaagaauuuacaagaaaaguacguuccaacgcggcacuaggagccauauucacagaugaaaauaaguggaagagugcacgagaagcgguugaagauggcagauuuugggagcuaguugaucgggaacggaacuuacacuuggaaggcaaaugcgagacgugcguguauaauaugauggggaaacgagagaagaaauuaggugaguucgguaaagccaaagguagccgagcaaucugguauauguggcuaggagccagauuucucgaguucgaggcacuaggauuuuugaacgaagaucacugguuuucucgagguaauucacuaagcggugucgaaggagaaggacuacaccgauugggcuauaucuuaagagaugucagcaagaaagaaggaggagccauguacgccgacgauacggcagguugggauacuaggauaacauuggaggauuugaagaaugaagagaugguuacgaaccauaugaagggugaacauaaaaagcuagcagaggcuauuuuuaaauuaacuuaucaaaauaagguaguaaggguacaaagaccuacaccucgcggaacaguaauggauaucauuagucggagagaucaaagaggcucuggacaaguagguacguacggacuaaauacguuuacgaauauggaagcacagcuaauaagacagauggagggggaagguauauuuaaaucaauucaacauuugaccgccauagaagaaauagcgguacaaaacugguuagcgagaguggguagagagagguugucucgcauggcgauuagcggagacgacuguguagugaaacccauugacgauagauuugcaucugccuuaacagcguuaaacgauaugggcaagguccgaaaggauauccaacagugggagccaaguagaggauggaaugauuggacacaggucccauucuguagucaucauuuccacgaauuagugaugaaggauggcagggugcucguaguaccauguaggaaucaagaugaauuaauuggccgagcucgaauaucccaaggagcagguuggaguuuaaaagaaacugcauguuuagggaaauccuaugcacagauguggacuuugauguacuuucauaggcgagaucuccggcuagcagcuaaugcaauuugcucggcaguuccaagucauuggguaccaacgaguaggacuacauggucuauacacgcuaaacaugaauggaugacuacugaagacauguuagcaguguggaaccguguguggauucaagaaaauccguggauggaagauaagacuccaguggagaguugggaagagguacccuacuugggaaaaagagaagaccagugguguggaucauuaaucggacugacaagucgcgcgacaugggccaagaacauacaaacagcaaucaaucagguuaggucauuaaucggaaacgaagaauacacugacuacaugccgagcaugaaacgauucagacgggaggaggaggaggcaggcgucuugugguga

SEQ ID NO: 22296 - RNA, 9876 nt, Artificial Sequence
  derived and/or modified CDS sequence (opt6) from DENV-2__GQ868558__SS-prME
acggcugguguaauuguuauguuaauaccuacugcaauagcauuucacuuaacaacgagaaauggcgaaccacauaugaucguaggaagacaggaaaaaggaaaaucacuucuguuuaaaacugaagaugggguuaauaugugcacacugauggcaauugaucuaggagaacuuugugaggacacuauuacauacaaauguccacuuuuaaaacaaaaugagccagaggacauagauugcugguguaauucuacauccacaugggugacuuauggaacguguacaacaacgggagaacaccgccgagagaaaaggaguguagcauuagugccacacgucggcaugggacuagaaacaaggacagaaaccuggaugucaagugaaggugcauggaaacaugugcagagaauagaaaccuggauacuaagacacccaggcuuuacaauaauggcagcuauucuagcauauacuauaggaacaacucauuuccaaagagcauugauauucaucuuguuaacggcugucgccccauccaugacuaugaggugcauugguauaucaaauagggauuuuguagaaggagucucaggagguuccuggguugauauaguauuagaacauggaucgugugucaccaccauggcgaaaaauaaaccaacguuagauuuugaauuaauuaaaacagaagcaaaacaacccgcgacuuuaagaaaauacugcauagaagcaaaacugacgaacacaacaaccgagagcagauguccaacgcaaggugagcccagucucaacgaggagcaagacaaaagauuuauauguaaacacagcaugguggaucgcggguggggaaauggauguggguuauuugggaaaggcggaauaguaacgugcgcaauguucacauguaagaaaaauauggaaggaaaagucguacaaccggaaaacuuagaauauacaauuguuauaacgccacacucuggcgaagaacacgcaguagguaaugacacagggaaacauggaaaagaaauaaaaauuacaccucaauccucaauaacugaagcugaguuaaccggauauggaacaguuaccauggaaugcaguccuagaacaggauuagauuuuaacgaaaugguacuucugcagauggaggacaaagccugguuagugcaucgacagugguuuuuggauuuaccuuuaccuugguuaccaggggcugacacacagggaaguaauuggauacaaaaagagacucucgugacauucaaaaacccgcaugccaagaaacaggauguaguaguccuaggaucccaagagggcgcuaugcacacagcacuuacgggcgcuaccgaaauacaaaugagcagcggaaaucugcucuuuacuggacacuuaaaaugccgucuuagaauggacaaacuucaacuuaaagggauguccuauaguauguguaccggcaaauucaaaauagugaaagagauagcagaaacacagcauggaacaauuguaauuaggguucaauaugaaggugaugguaguccgugcaaaaucccauucgaaauaacggacuuagaaaagcgucauguucuaggaagauugaucacaguaaacccaauagucacggaaaaggauucaccuguaaacauagaagcagaaccuccuuucggugauagcuauauuauaauaggaguagaaccaggacaacuaaaauugaacugguuuaagaaaggaucuagcauaggucagauguuugagacaaccaugaggggugccaaaagaauggcaauauugggcgauacggcaugggauuuuggcucucuugguggaguauucacaucaauagguaaagcacuucaccaaguguuuggugccauuuauggagcggcauucuccggagugucuuggacuaugaaaauacuaauagguguuguaauaacguggauagggaugaacuccagaucuacaagucuuucuguuucauugguauuggucggaguuguaacacucuaucuuggagcaauggugcaggcugauucaggguguguaguaagcuggaaaaauaaggagcuaaaauguggaaguggaauuuuuauuacagacaauguccacacauggaccgaacaauauaaauuucaaccggaaaguccgagcaaacuagcgagugcuauacaaaaagcacaugaagaggguauuugcgguauuagaucaguaacacgauuagaaaaucuuauguggaaacagauuaccccagaacuuaaucacauauuaucugaaaaugagguuaaguugacaauaaugacgggagauacuaaaggaauuaugcaagcggggaaacguucacuuaggccccaaccaacagaauuaaaauacucuuggaaaacaugggguaaagcaaagaugcacuccacggaaucgcauaaccaaaccuucuugaucgacggcccugaaacugcagaaugccccaacacaaaucgcgccuggaauaguuuggaaguagaagauuaugguuuuggcguauucacuacaaauauauggcuuaaguuaagagaaaagcaagauguguuuugugauagcaaacuaaugagcgcugcgauaaaagacaaucgugcaguccaugccgauaugggguauuggaucgagagcgcccuaaaugacacuuggaaaauggaaaaggcuucauuuauagaaguuaagaguugccacuggccgaagucgcacacauuauggucaaacgggguauuggaaucagagaugauaaucccuaaaaauuucgcgggcccgguuucacaacauaacuaccguccaggauaccacacgcaaacggcugguccuuggcaucuaggaaaauuggaaauggacuucgauuuaugcgaaggaacuaccguaguugucacugaagacuguggcaauagaggcccaucacucaggaccaccacagcuucaggaaaacucauuacggaaugguguugucguuccuguacuuugccuccauuacguuaucgaggggaagacgguugcugguacgggauggagauucguccgcucaaggagaaagaagaaaaucuagugaacagccuagugacagcaggucauggccaaauugauaacuucucauugggaguauuaggaauggcauuauuccuagaagaaaugcucagaacacguguaggaacaaaacacgcaauauugcuugucgcagugucauuuguaacuuuaauaacugguaauaugucuuuucgggaccugggacgaguaaugguuauggugggagccaccaugacagacgacauagguaugggaguaacguacuuagcuuuauuagccgcauucaaagucagaccuacuuucgcugcgggucuacuucuacgaaagcuaaccuccaaagaacuaaugauggccacaauuggaaucgcuuugcuaucucaaucaacgauaccagaaacuaucuuagaauuaacagaugcauuggcccugggaaugaugguacugaaaauaguacggaacauggaaaaguaucaauuggcaguaacaauuauggcuauaagcugcguacccaacgcaguuauuuuaagaaaugcauggaaagucucauguacuauauuagccgcuguguccgucucuccccuacuacugaccagcucacagcagaaagcggauuggauacccuuaguguuaacaauuaaaggauuaaaucccacagcgauauuucuuaccacccucagcaggacaagcaagaaaagaucauggccuuugaaugaggcaauaauggcaguagguaugguaagcauacucgcgaguagcuugcuaaagaaugauaucccuaugacgggaccauuaguagcaggcggacuauuaacuguuugcuaugugcuaacuggaagaagugcagaucuagaauuggaacgcgcugcugaaguuaaaugggaagaucaagcugagauaaguggcagcuccccuauacuuaguauuacgauuagcgaagacgguucaaugucuaucaaaaaugaagaagaagaacaaacauuaaccauccuaauacgaaccggccuccuaguaauuucuggaguauucccuguaagcauaccaauuacagcagccgcaugguaucuaugggaagugaaaaagcaacgggcagggguacuaugggauguaccgagcccaccaccgguagggaaagccgagcuagaagacggcgcauauaggaucaaacagcgcggcaucuuaggcuacucucaaauaggggcugguguguacaaggaagguacauuucauacgauguggcauguaacgagaggggcuguuuuaaugcaucgaggaaaacgcauugaaccaucaugggcugaugugaagaaagaucuaauaagcuauggugguggcuggaaacuagagggcgaauggaaagagggggaagaaguccaaguguuggcacuggagccugguaagaacccgagagcuguacaaacuaagccgggaauauuuaaaacaaacgcgggcaccaucggcgcagucucacuggacuucucuccgggaacauccgggucaccuaucguggauaggaaggguaaagugguaggacuguacggaaauggagucguaacaagauccggugcguacguaagugcaauagcgcaaacagagaaauccauugaagacaauccagaaauugaggaugauauuuuuagaaagaaaaggcucacuauaauggaucuacauccuggugccggaaagacuaagcguuacuuacccgccauaguaagagaagccauaaaacgggguuugagaacauuaauucucgcuccaacacgcguaguugccgcagagauggaagaagcucuaagaggguugccuauacguuaccagacuccagccauaaaggcagaacacaccggaagagagauuguagaccuuaugugucacgcgacuuuuacaaugcggcuccuaucaccaguucguguaccaaacuauaauuuaauaauaauggaugaggcacacuucaccgauccugccaguauagcagcucguggauauauuaguacgagaguagaaaugggagaagccgcugguaucuuuaugacugcuacaccaccaggaucucgcgauccauucccacaaucgaaugcaccaauuauggaugaagaacgugaaauaccggagagaucauggaauaguggucacgaauggguaacggauuucaagggaaagacagugugguucguaccuucgaucaaggcagguaacgacauagcugcaugccugaggaaaaauggaaagaaagugauacaacuauccagaaaaacguuugauagcgaguacguuaaaacacgagcgaaugauugggauuucgugguuacuacagauaucagugaaaugggggcaaacuucaaggcugagcgaguaauagaccccagaaggugcaugaaaccuguuauccuaacugauggugaggagcguguuauuuuagcagguccuaugccagugacccacaguucagccgcacagaggcgaggucgcauugguaggaaucccaaaaaugagaacgaccaguauauauauaugggugaaccacuggagaaugaugaagauugugcucacuggaaagaagcaaaaauguuauuagauaacauaaauacaccagaaggaauuauuccuucaauguuugaacccgagcgagagaaaguagaugccauagauggagaauaccgacuuagaggagaagcacgcaaaacauuuguggacuuaaugagacgaggagaucucccaguaugguuagccuauaaaguagcagcggagggaauaaauuaugcagauagaaagugguguuucgacgguaucaaaaauaaucaaauauuagaagaaaauguugaaguagaaauauggacaaaggagggggaaaggaagaaacugaaaccacgauggcuggaugcgcguaucuacucagauccauuagcauuaaaagaguuuaaggaguuugcagcuggaaggaaaucccuuacgcuaaaccuuauuacugagaugggaagguuaccuacuuucaugacacagaaagccagaaacgcuuuggauaauuuagccguuuugcauacagcugaggccggagggagggcauacaaucaugcacuaagcgaacuaccggaaacuuuagagacucuccuauuacugacacuacuagcgacuguaacgggaggcauauuuuuguuucuaaugucggggaaaggcauaggaaaaaugacacuggguauguguuguauuauaacugcaaguguauuacuuugguacgcacagauccaaccgcacuggaucgcagcaucaauaaucuuagaguucuuucugaucguccuacuaauccccgaacccgaaaaacaaagaacaccccaagacaaucagcucacguacguagucaucgcaaucuugacuguagucgcagcaacaauggccaaugaaaugggauuuuuggaaaagaccaagaaagaucuaggcuuaggaucaauaacuacucaagaaucugaauccaauauacuugauauugaucuacgaccagcaagugcguggacgcuuuaugccguagcaacaacauuuguaacgccuauguuaaggcacucaauugaaaauucuucggucaauguaucucucaccgcaauagccaaccaagcaaccguacuuaugggacuaggcaaggguuggccauuaucaaaaauggauauaggaguuccguuacuagcaauaggauguuauagccaaguuaauccaauaacccucacggcagcguuacuccuucucguggcucacuaugcaauaaucggaccuggccuacaagcgaaggccaccagagaagcucagaagagagcugcagccgggaucaugaaaaacccuaccguagacggaauaacuguuaucgaucuagaaccuauaccauacgacccgaaauucgaaaaacaauuaggucaaguaaugcugcucauucuuugcgugacccagguauuaaugaugagaacuacaugggcucuaugugaagcauugacgcuggcgacggggcccaucuccacauugugggaaggaaacccgggaagauucuggaauacaaccauagcuguaucaauggcuaacauauuuagaggaucuuacuuagcaggagcaggccuccuguucucaaucaugaagaauacuacaaacacucgcagaggcacggggaacauaggagaaacacuaggagaaaaguggaaaucaaggcuaaaugccuuggggaaaagugaguuucaaauauauaagaaauccgggauccaggaaguagaucgaacauuagcuaaagaaggcaucaaaagaggagaaacugaccaccaugcuguaucucgaggaucggcaaaacugcgaugguuuguagaaaggaauaugguaacaccagaggguaaaguuguagaucucggauguggucguggcggauggagcuauuacugcgggggccuaaagaacgugagagagguuaaaggcuugacaaaaggggguccagggcacgaggaacccauuccuaugaguacauacggauggaaccuaguaaggcuacaaagcggagucgacgucuucuuuacacccccugaaaaaugugacacgcugcuaugugacauuggagaaucaucaccaaacccaaccauagaagcggggagaacacuacgcguuuuaaauuuagucgaaaacugguuaaauaauaauacacaauuuuguauaaagguacucaacccguauaugccuucaguaauugagaaaauggagacacuacaaagaaaauacggaggagcucucgucagaaauccacuuaguaggaacucaacacaugaaauguauugggucucgaacgccacagguaauaucgucagcucaguaaauaugauuucgagaaugcuuauaaacagauucacuaugaaacauaagaaagcaacauaugaaccagacguugauuuggguagcggaacacguaauauagggaucgaaagugagauuccuaauuuggacaucauaggaaaaaggaucgagaaaauaaaacaggaacaugaaaccuccuggcacuaugaccaggaccaucccuauaaaacuugggcuuaucacgggucuuaugaaacuaagcaaacgggaagugcuagcucaaugguaaauggugugguuagauuacuuacuaaaccaugggacgucgucccuaugguuacccaaauggcaaugacggauaccacacccuucggucaacaaagggucuuuaaggaaaaagucgauacaaggacacaagaaccgaaagaaggcacuaagaaauuaaugaagauaaccgcagagugguuauggaaagaacucggcaagaagaaaacuccgagaaugugcacgagagaagaauuuacgagaaaaguuaggagcaaugcggcauuaggugcaauuuuuacugacgagaauaaauggaaaucagcgagggaagcuguagaagauggccguuucugggaauugguagauagggagaggaaucuccaccuagaagggaagugugagacgugcguauacaauaugauggggaaaagagagaagaaauuaggcgaguucggaaaagcaaaagguucgagagcuaucugguauauguggcuaggagcaagguuucuagaguucgaagcacuaggguuuuuaaaugaagaucauugguucagucgaggaaacucguuaagcggcguugaaggcgaaggauuacauagacuaggauauaucuuaagagaugucuccaagaaagaaggaggagcaauguaugccgacgacaccgcaggcugggacaccaggaucacgcucgaagaccuuaaaaaugaggaaaugguaaccaaucauaugaaaggagaacauaagaaauuggcggaagcaaucuucaaacugacauaccagaauaaaguagucagaguucaacgaccuaccccaagagguacaguaauggacauaauaucaagaagagaucaaagagggaguggccaaguaggaacuuauggacuuaauacuuuuacaaacauggaagcccagcugauuaggcaaauggagggcgaaggcauauuuaaaucaauccaacaccuaaccgcaauugaagaaauagcugugcagaauuggcuggccaaagucggucgagagaggcuuagccggauggccaucucuggugaugacuguguaguaaagccuauagaugauagauuugcgagugcgcuaacagcccuuaaugauauggguaaaguacgaaaggauauacaacaaugggagccguccaggggauggaaugacuggacccaagucccauucuguagucaccacuuucacgaauuaguaaugaaagauggcagaguucugguuguuccaugccgaaaucaggacgaacuaauuggcagggcacguauaagucagggcgcaggguggucgcuaaaagaaacggcuugccuaggaaaaagcuacgcucaaauguggacguugauguauuuucaucgccgagauuugcgguuggccgcaaacgcuaucuguagcgcugugccuucucauuggguuccaacgucaagaacaaccuggucaauacacgccaaacacgaauggaugacuacagaagacauguuagcgguauggaaucguguuuggauucaagaaaauccauggauggaagauaagacuccaguugaaucuugggaagagguaccguaucucggcaaacgugaggaccaauggugcgguucucuaauagggcuuacaaguagagccacaugggcgaaaaacauucagaccgcaauaaaccaagucagaucgcuaauuggaaaugaagaauacacugauuacaugcccuccaugaaaagguuucgucgagaagaagaagaagcuggaguucugugguga

SEQ ID NO: 22297 - RNA, 9876 nt, Artificial Sequence
  derived and/or modified CDS sequence (opt6) from DENV-2__KJ189305__SS-prME
accgcggguguaauaguuaugcugauaccaacugcgauggcauuucaucugacuacucgaaauggagaaccgcauaugaucguaggaagacaagaaaaaggaaaaagucucuuguuuaaaacagaagacgggguuaauauguguacauuaauggcgauugaucuaggugagcuuugcgaagauacuauaacuuauaaauguccucuacuacgacaaaaugaaccagaagauaucgauuguugguguaauaguacuucuacauggguaaccuacgguaccuguacuacuacaggagaacacaggcgagagaaaagaaguguagcauuaguuccacauguaggaauggguuuagaaacacggacagaaaccuggaugucauccgaaggagcauggaaacauguacaacgaauagaaacauggauucuacggcacccgggauucacaauaauggcugcaauauuagcguauacgaucggaacaacucacuuccagagagcucucauauucauauuauuaacagcaguagcuccaucaaugacgaugagaugcauaggaauuuccaaucgagauuucguagaaggaguaagcgguggauccuggguggauaucguuuuagaacauggaaguugcguaacgacaauggccaaaaacaaaccaacauuagacuucgaacuaauaaaaacagaagcaaaacaaccagcaacgcuacguaaauacuguauagaagcaaaauuaacgaauacgaccacugaauccagauguccgacucagggcgagccuucacugaacgaggaacaagacaaacgauucauaugcaaacacucaaugguagacagaggcuggggaaauggaugugggcuauuuggcaaaggagggaucgugaccugcgcaauguucaccuguaaaaagaauauggagggcaaagugguacagcccgagaaucuugaauacacaauuguuaucaccccacacucgggugaggaacaugcaguaggcaaugauacuggaaaacaugggaaagaaauaaaaauuaccccacaaucaucgauuaccgaagcugaacuaacagguuaugguacaguuaccauggaauguagcccaaggacaggccuggacuuuaaugaaaugguuuuauugcaaauggaagauaaggcuugguuaguacauagacaaugguucuuagaccuuccccugccauggcuuccaggagcugacacucaaggaucuaauuggauucaaaaagagacucucgugacuuuuaaaaacccacaugccaagaaacaggacguaguagucuuaggaagccaggagggugcaaugcacaccgcucuuacuggagcaacugagauacaaaugagcagugguaaccugcuuuucacaggucacuuaaaauguagauugagaauggauaaacuucaguuaaaggguaugucguauucuaugugcacuggaaaauuuaaaauuguaaaagaaauugcagaaacacaacauggaacaauugucauacgagugcaauaugaaggagacgguaguccaugcaaaauaccauucgaaauaacagacuuggaaaaacggcauguccugggaagacucauaacugucaauccaauuguuacggaaaaggauuccccagugaauauagaggcugaaccucccuuuggugacucguauauuaucauaggagucgagcccggacaacuaaagcugaauugguuuaagaagggauccucuauaggacagauguuugagacuaccaugagaggggcaaaacgaauggcuauacuuggagauacagcuugggauuuuggaucguuaggcggcguuuuuacgaguaucgguaaagcacuucaccagguguuuggugcuaucuauggcgcggcauuuucaggcgugagcuggaccaugaaaauucuaaucgguguuauaauaacauggauugggaugaacucacgcucuacuucacuaaguguuucauuaguucucgugggaguagucacucuauacuuaggugcaaugguacaggcagauuccgguugugucgucuccuggaaaaacaaagaacuaaaaugugguagcggaauuuuuauaaccgacaauguccacacuuggacggaacaguacaaauuucaaccggaaucucccagcaaauuagccucagcaauacaaaaagcacacgaagaaggaauuuguggaauccgguccguaacacgauuagaaaaucuaauguggaagcaaauaacgccugaacuuaaucacauacucuccgaaaaugagguaaaacuaaccauaaugacgggugacauaaaagggauuaugcaggcugggaaaaggaguuugagaccgcagccaacagaguugaaauauucauggaaaaccuggggaaaagccaagauguuaucuacggagucacacaaccaaacauuuuugauagacggcccugaaacagcagagugccccaacacaaaucgagcguggaacucgcuugaaguugaagauuauggauucgguguauuuacuacaaauaucuggcuaaagcucaaagaaaagcaagacguauuuugugauaguaaauuaaugagugcggcaauuaaagauaauagagccguacaugcagacaugggauauuggauugagucagcuuugaacgacaccuggaagauggaaaaggcuagcuuuauagaaguuaaaucuugccauuggcccaaaucccauaccuuauggaguaauggcguccuagaaagugaaaugauuauaccaaagaauuuugcugguccugcaagccaacacaacuauagaccaggauauuacacucagacagccgggccuuggcauuuagggaaacuugaaauggacuucgauuuuugcgaaggaacaacaguaguaguaacagaagauuguggaaaucgaggaccuagccuaagaacaacgaccgcaucgggcaaacugauuacagaauggugcugucgcagcugcacucugccgccacuacguuauaggggagaagauggauguugguacgguauggaaauucgaccccucaaggaaaaagaggaaaaucuaguaaacucucucguaacugcuggacauggucaaauugacaacuucuccuuggggguguuagguauggcauuauuuuuggaagagaugcuuagaacaagaguaggcacaaaacacgccauacuacuuguugcugucucauuuguaacauugauaacuggaaacaugaguuuccgggaccuggguagagucauggucaugguuggcgcuacgaugacagacgauauaggcaugggagucacauauuuagcauuacuagcagccuuuaaagucaggccaacauucgccgcaggauuacuuuuaagaaaauuaacgucaaaggagcugaugauggccacuauagggaucgcucuauuaucucaaucaacaauuccagaaaccauucuggagcugacugacgcacuugcgcuagguaugaugguucugaaaauaguuagaaacauggaaaaauaccagcuagcagucacuaucauggcaauuucuuguguacccaacgcaguaauacuacaaaacgcuuggaagguaucuuguaccauuuuggcugcgguaucaguaucaccucuauuauuaacgucuucgcaacagaaagcugacuggaucccccuagcacucacaauuaaaggucucaauccaacagcaauauuuuuaacgacguuaucaagaacaaguaagaaacgguccuggccucucaaugaagcaauaauggcaguggguaugguaucaauucuagcaagcucccuucucaaaaaugauauuccaaugacuggucccuuaguagcgggaggucugcuuaccgucuguuauguguuaacuggaaggucagcagacuuagaauuagaacgagcagcggacguuaaaugggaagaucaagcggaaauuucagguuccucuccgauuuuaucaauuacgauuucagaagacgggagcaugucaaucaaaaaugaagaagaagaacaaacucuaacaauacuaauccggaccggacuauuaguuauaucaggaguuuuuccuguuucaauuccaauuacagccgcugcgugguaucuaugggaaguuaagaaacagagggccgguguuuuaugggacguaccgucuccuccacccguuggaaaagcugaacuggaagauggggcauauagaauaaaacaacguggaauacuugguuauagucagauaggcgcugggguauauaaagaagguacauuucauacgauguggcacguaacuagaggggccguccuuaugcauaggggcaagaggauagaaccaucaugggcugaugucaagaaagauuugauuucguauggaggaggguggaaacuggaaggcgaguggaaagaaggagaggaaguccaaguacuggcucuagaacccggcaaaaauccccgugcaguacaaacgaaacccggaauauuuaagacaaauacagguacuaucggagcagugagcuuggacuuuucaccuggcacguccggaucuccaauaguggauaagaaaggcaaaguuguugguuuguaugguaacggcguaguaaccaggagcggugcuuaugugucggcgauugcucaaacagagaaaaguauugaagauaauccagaaauagaggaugauauuuucaggaagaaaagguuaaccauaauggaccugcauccaggugcggguaaaacgaaacguuacuugccugcaaucgucagagaagcaauaaagagaggauugagaacucucauuuuggcgccaaccagaguagucgcugcugaaauggaagaagcauuaagaggacuucccauacgauaccaaaccccagcaauaaaggcggaacauacuggcagggaaauuguugaucugaugugccacgcaaccuuuacuaugcgucuuuuaagcccagugcguguuccgaacuauaaucuaauaauuauggaugaagcacacuuuacggaucccgccucgaucgcagccagagguuauauaucuacaagagucgaaaugggugaagcggcuggaauauuuaugacggcaacuccuccaggcucccgcgauccauuuccucaaucaaacgcaccgauaauggacgaagaacgagaaauaccagaaagaucuuggaacucuggacaugaaugggugaccgacuucaaagggaagacagugugguucgugccuucuaucaaagcuggcaaugacauagccgcaugcuugagaaagaauggcaagaaagugauacaauuaucacgaaagacauuugacucagaauaugugaagacgcgugccaacgacugggauuuuguaguaacaacagacauaagugagaugggggccaauuuuaaagccgaacgagugauagacccgagacgauguaugaagccuguuauacucacagauggagaagaaagagugauacucgcagggccgaugccgguuacccacagcucagccgcccagaggagaggccggauaggacggaaucccaaaaaugaaaaugaucaauacaucuauaugggagaaccauuagagaaugaugaggacugugcucacuggaaggaggcaaagaugcuucucgauaauauuaauacaccagagggaauuauuccaaguauguuugaaccugaaagagaaaaaguagaugccauugauggggaguauagacuuagaggugaagcucguaagacuuuugucgacuuaaugcguagaggcgaccucccggucuggcuagccuacaaaguggcagcagaggggauuaauuaugcugacaggaaaugguguuuugacgguaucaaaaacaaucaaauauuggaagaaaacguagaggucgagaucuggacaaaagaaggugaaagaaagaaacugaaacccagauggcuggaugcacgaauuuacucugauccccuggcgcuuaaagaauuuaaagaauuugcagcagggcggaaaucacuaacauuaaaucuuaucacugaaauggggagguugccuacauuuaugacacaaaaggcacggaaugcccuugacaaucuugcagugcuucauacagcagaagcagggggcagagcauacaaccaugcauugucagaacuccccgaaacuuuagaaacuuuacuucuacuuacauuacucgccacuguaaccggaggcauuuuccuguucuugaugucagguaaggggauagguaaaaugacucucggaauguguuguauaauaacagccucuauauuauuaugguaugcucaaauacaaccacacuggaucgcagcuaguauaaucuuagaguucuuuuugauuguauugcuuaucccagaaccagaaaaacaacgcacaccucaggauaaucaguuaacuuacgugguaauugcuauacuaacagugguagccgcaacaauggcuaaugagauggguuucuuagaaaagacgaagaaagaccuaggucuaggaucgauaacuacacaggaaagugaauccaacauacuagauauagacuuacgaccggcauccgccuggacucuauaugcaguggcaacgacauuuguaacuccuaugcuacgacauuccauagagaacucaucaguuaaugugagucucacagcuauugccaaccaggcuacuguacugaugggacuagggaaagguuggccuuugucgaaaauggauaucggagucccauuacuagcuauagguugcuacucccagguaaauccaauuacgcuuacggcagcauuacugcuauuaguugcccauuaugcaaucauuggccccggucuacaagcgaaagcuacaagagaagcucaaaaacgagcugcagcuggaauaaugaaaaauccuacgguugauggaauaaccguuauagaucuagagccuauacccuacgauccgaaauucgaaaagcaguugggacagguaauguuacuaauauuaugcguaacacaaguauuaaugaugaggacaacuugggcacucugugaagcacucacauuggcgacaggccccauuaguacacuaugggaaggcaacccuggaagauuuuggaacaccacaauagccgucucuauggccaacaucuuucggggcucguaucuugcuggggcuggguuauuauuuucaauaaugaaaaauacuaccaauacacgaagagguacagguaauauuggagaaacacuuggggaaaaauggaagucucgucuaaacaccuuaggaaaaucggaauuucaaauauauaagaaauccgguauacaggagguagauagaacauuagcgaaagaaggcauuaagagaggagaaacggaucaucacgcgguaaguagggguucagccaaacuucgaugguuuguugaacggaauaugguaacaccggaggggaaagucguagaucucggauguggccgugguggauggucauauuacuguggcggauugaaaaacguaagagagguaaaaggacuaacgaagggaggaccgggacaugaagaaccgauaccaaugaguacauaugguuggaaucuuguuagacuacaaucagguguugauguuuucuuuacgccuccugagaagugugauacauuacucugcgacauaggcgaaucaaguccaaacccuacuauugaagcgggucggacacugagaguguugaaucuaguugaaaacugguuaaauaacaauacucaauuuuguauaaaaguguuaaauccauauaugccuagcguaauagagaaaauggaaacacuucaaagaaaguaugggggagcacuuguccgaaaucccuuaucuagaaauuccacacaugagauguauuggguaucgaaugcgacaggaaacauagugaguaguguaaacaugauaagccgcaugcuuauaaaccgguucacaaugaaacauaaaaaggcuaccuaugagccagacguagacuugggauccggaacacgcaacauagguauagagagcgaaauuccgaauuuagauauaauugggaaaaggauagagaaaauaaaacaagaacaugaaacaagcuggcacuacgaucaagaucacccuuauaaaacaugggcauaccacggaagcuacgaaacaaaacaaacaggcucggcaaguucaaugguuaauggugucgugagauuguuaacaaaaccuugggacguggucccaaugguaacacagauggcaaugacagauacuacuccauuuggacaacaaaggguuuucaaagaaaaagucgauacuagaacccaggaaccgaaagaagggacaaagaaacuaaugaaaaucacagcagaguggcuauggaaagaauuggggaaaaagaaaacgccaaggaugugcacaagggaggaauuuacgagaaaagucagguccaacgcugcgcuaggugccauauucacagacgagaacaaauggaaauccgcacgcgaggcuguggaagacgguagguucugggaguugguggaccgugaacguaaucuacacuuagaggguaaaugugaaacaugcguauauaauaugaugggaaaaagagagaagaaacuuggagaauuuggaaaagcuaaagggucacgcgcuauaugguauaugugguugggagcacguuuccuggaauuugaagcgcucggauucuuaaaugaagaccacugguucucaagaggaaauucguuaucaggggucgaaggcgaaggauuacauagguuggguuacauucugcgagaugucgggaagaaagagggaggggcgauguaugccgaugauacagcggguugggauacucgaauaacucuagaagaucucaaaaacgaagaaaugguaacaaaucauaugaaaggggaacauaagaaauuggcggaggcaauauucaaauuaacauaccagaauaaggucguacgaguccaaagaccaacuccucgugguacagucauggauauaauaucacgcagagaccaaagagguucaggacaaguuggcacauacggguuaaauaccuucacaaauauggaagcucagcuuauccgucaaauggaaggugagggcauuuuuaaauccauacaacaccucacagcaacugaagaaaucgcgguucagaauuggcuugcgaggguuggacgggaacgacugucaaggauggccauaucuggagacgacugcguuguaaaaccaauugaugacagauucgcaagugcguuaacugcgcuaaacgacaugggaaaaguacguaaagauauucaacaaugggaacccucgcgcggcuggaacgacuggacucagguaccguucuguagccaccauuuucacgaacuuguaaugaaagaugguagaguguugguugucccuugccgaaaccaggaugaacuaaucgguagggcaagaauuagucaaggagcuggcuggucguuaaaagaaacagcaugucucggaaaaucauaugcacagauguggacguuaauguacuuucauagacgugauuuaagauuagccgcuaaugcgaucugcuccgcagugccuagucauuggguucccaccucccguacaacuuggaguauucaugccaagcacgaauggaugacgacggaagacauguuagccguauggaauaggguauggauacaggagaacccuuggauggaagacaaaaccccaguagaaucaugggaagaaguacccuacuuaggaaaacgagaagaucaauggugcggaucuuugauuggauugacuagccgggcuacaugggccaaaaauauacagacggcaauaaaccaagugcguagucugaucggaaaugaagaauauacggauuauaugccaucaaugaagcguuuucgacgugaagaggaagaggcaggcgugcuuugguag

SEQ ID NO: 22298 - RNA, 9876 nt, Artificial Sequence
  derived and/or modified CDS sequence (opt6) from DENV-2__FJ898451__SS-prME
acugcggggguaauagucaugcuaauaccuacugccauggccuuccacuugacaacacgaaauggagaaccacacaugauuguuggaagacaggaaaaagggaaaucauuacuuuuuaaaacugaagauggaguuaauauguguacucuuauggcuauugacuugggggaacuaugugaagacacgauaacauauaaauguccacugcuacgccaaaaugaaccggaagauauagauuguuggugcaauucuacuuccacaugggugacauauggaacaugcacgacuacuggagaacaccguagggagaaaagaucgguugcccuaguaccucacguaggaaugggguuagaaacacguacggaaacauggaugucaagugaaggagcguggaaacauguacaaagaauagagaccuggauauuaagacauccuggauuuacgauuauggccgcaaucuuagcauacacaauuggaaccacccauuuucagagagcccugauauucauacuuuuaacagcaguagcaccaaguaugacgaugagaugcaucgggauaucaaauagagacuucguagaagggguaaguggaggaucguggguagauauuguuuuggaacaugguucguguguaaccacaauggcuaaaaauaaaccaacucucgauuuugaauuaauaaaaacugaagccaaacaaccggcuacgcugagaaaauacugcauagaagcaaaacuuacaaauacuacaacagaaagucgauguccaacucagggcgagccuucuuuaaaugaagaacaggacaaacgauucauaugcaaacacuccaugguagauaggggguggggaaauggcugcggucuauuuggaaaagguggcauagucacaugcgccauguucacuugcaagaaaaauauggagggaaaaauuguacagccggagaaucuagaauauacuauuguuauaaccccacacaguggggaggaacaugcaguaggaaacgauacggguaaacauggaaaagagauuaaaauuacuccgcaaagcaguacuacagaagcugaauugacaggauacggaacaguaacaauggaauguucuccccgaacgggccuugacuucaacgaaaugguacuuuuacagauggaagauaaagccuggcuuguucaucgacaaugguuucucgacuugccacucccuugguuaccaggggcagauacgcaagguaguaacuggauacaaaaagaaacucuagugaccuuuaaaaauccacaugcgaagaaacaggauguaguaguccuuggaucacaagaaggugcaaugcauacugcucucacaggcgcaaccgaaauacaaaugagcagugggaacuuacuauucacagggcauuuaaaauguagauuaaggauggacaaacuccagcuuaaagguaugucguacucaaugugcacuggaaaauuuaaaauugucaaagaaauugcugaaacacaacaugguacaauaguuauaagaguacaauacgagggagacggaucccccugcaaaauaccauucgaaaucacggaccucgagaaacgucauguauugggcagacuaauaaccguaaacccuaucguaacagaaaaagauucaccgguaaauaucgaggccgagccaccuuuuggagauucauacauaauaguuggaguugagccaggucaacuaaaauuaaauugguucaagaaagggucauccauuggccagauguucgaaacaacaaugagaggcgcgaaacgcauggcaauuuugggagauacagcaugggauuucgggucauuaggaggcguauucacuucaauaggaaaggccuugcaucaaguauuuggagcgauauauggugcugcuuucucaggugugucguggaccaugaagauauuaauaggcguaaucauaacuuggauuggcaugaacucacggucuacaagccuuucaguuaguuuaguccuagugggggugguaacccuauaucuaggagugaugguacaagcagacucaggcugcauuguuagcuggaaaaacaaagaguugaaaugugggagugguauauucaucaccgacaacguccacacauggacagagcaauauaaauuucagccggagaguccaucaaaacuagcaucagcuauacaaaaagcacaugaagaaggaaucuguggaauaagguccgucacaagacuggagaacuuaauguggaaacaaauaacaccugaacuuaaucacauauugagcgaaaaugaaguaaaauugacuauaaugacgggagauauuaaggggauaaugcaagcggggaagcggucauuacguccucaaccaacggaauuaaaguauagcuggaaaacaugggguaaggcuaagaugcuaucuaccgaaucacacaaccaaaccuuucuuauagauggacccgaaacagcggaguguccuaacacgaaucgggcauggaauaguuuagaaguugaagauuacggauuugguguauuuuccacaaauauauggcuaaaguuacgagaaaaacaggauguauuuugcgauucgaaacuuaugagugcugcaauuaaagacaauagagcaguacaugcugauaugggcuauuggauugaaaguguacuaaacgauacuuggaaaauggaaaaagcaucuuucauagaagugaagaguugucauuggccgaaaucucauacacuauggucaaacggcgugcuugagagugaaaugauuauacccaaaaauuuugcaggaccgguuagucaacauaacuaucgaccaggauaucacacccagacugccggucccuggcaccuuggaaaauuagagauggauuuugauuuuugcgaagggacaacaguagucguaaccgaagacuguggaaauagagggccuaguuuacgcacgacuacugcuucgggcaaauuaaucaccgagugguguugucguuccugcacucuaccaccucuaagauaucgaggagaagauggaugcugguaugguauggagauacggccacuaaaagaaaaagaagagaauuugguaaauucacugguuacagccggucauggacaaauugacaacuuuagucuggguguucuagggauggcuuuauuucuggaagaaaugcuaaggacuagaguaggaaccaaacaugcaauauuguuaguggccuuaaguuuuguaacuuuaauuacagguaauaugaguuuucgagacuuagggcgggugaugguuauggucggcgccacaaugacugaugauauugggauggggguuacuuauuuagcacuauuagcagcauuuaaagugagacccacuuucgcagccggauuacuauugagaaaacuaacaaguaaggaacugaugauggccaccauagguauugcuuuacuuagucaaaguaccuuaccagaaacaauacuagagcugacugaugcacuagcacugggaaugauggucuugaaaauaguuaggaacauggaaaaauaccaguuggcugugaccauaauggcaaucuccuguguacccaacgcagugauucugcaaaacgcuuggaaagucagcugcacuauacuugcggcaguuagugucucuccguugcuauuaacguccagccaacagaaagcagauuggauuccguuagcucuaacaauuaaaggacugaauccuacagcaauuuuccucaccaccuuaagucgaacaaguaagaagagaaguuggccacuaaaugaggccauaauggcagucgguaugguaagcauacuugcuaguucguuguuaaagaacgauauaccuaugacgggcccgcuuguagcgggagguuugcugacuguaugcuacguacuaacgggcagaagugccgaccuagaauuagagagagcagcagacguaaaaugggaagaccaagcagaaauaagcggaucgucgccaauuuuaucaauaacaauaucggaagaugguagcaugaguauuaagaaugaggaagaggaacaaacauuaacgauacuaauuagaacugguuuacucguuauaucgggaguauucccggucaguaucccuauaacggcugcugcgugguaucugugggaagucaaaaagcaaagagccgguguacucugggauguucccucgccuccaccugucgguaaggcugaacuggaagauggagcauaccgaauaaagcaaagaggcauucuagguuacucacaaauuggagccgggguuuacaaggaaggaacuuuucauacaauguggcauguaacgagaggggcaguucuaaugcacagagggaaacguaucgagccaucaugggcugacgugaagaaagacuugauaagcuaugguggugguuggaaauuggaaggagaauggaaagagggagaggaaguacagguccuagcucuggaacccggcaaaaauccaagagcaguacagacaaagccagguauauuuaaaaccaacacugguacgauaggagcaguuagcuuagacuucucgccggguacuucaggaucaccaaucguagauaggaagggaaaaguagucggccuguaugguaauggcgugguuacaaggaguggcgcguaugugagugcuauagcacaaacggagaaaaguauugaagauaaucccgaaaucgaagacgauauauucagaaagaaacgucuuacaaucauggaucuacauccaggagcagguaaaacgaaacgcuacuuaccugcuaucgugcgagaagcgauuaagcgugggcugcgaaccuuaauucuugcaccuacucgagugguagcagcggaaauggaagaggcucucagggggcuaccuauacguuaucaaacaccggccauacgagcagagcauacagguagagaaauuguggacuuaaugugccaugccacauucacgaugcgauuacuuagcccagucagaguuccgaacuacaauuugaucaucauggacgaagcccacuuuacugauccagcaaguaucgcugccagaggguacauuagcacucgcgucgaaaugggagaggcugcaggaauauuuaugacagccacaccaccuggcucgagggauccauucccucaaaguaaugcaccuauuauggaugaagagagggagauuccagagcgaaguuggaacuccggacaugaauggguaacugacuuuaaagggaaaacaguaugguucguucccaguauuaaagccggcaaugacauugccgcuugcuugcgaaagaacggcaaaaagguuauacaauuaucgagaaaaacauuugauucggaauacguuaaaacaagggcaaaugauugggauuuuguuguaacaacagacauaagcgaaaugggcgccaacuuuaaagcagaacguguaauagauccuagacgcuguaugaaaccuguaauucucacugauggggaagaacgggucauuuuagcaggcccuaugccugugacgcacucaagcgccgcacaacgacgagguagaauaggaagaaaccccaaaaaugaaaaugaucaauacauauauaugggcgaaccauuggagaacgacgaagauugugcacauuggaaagaagcaaaaaugcucuuagauaacauuaacacuccggaagguauuaucccaagcauguuugaaccagaaagagaaaagguggaugcuauugacggggaauaucgucuacgaggugaagcucgaaaaacauuuguugaucuaaugcggcggggagacuuaccaguaugguuagccuauaaagucgcagcugaggguauuaacuaugcggaccgcaaauggugcuuugauggcauaaagaauaaucagauauuagaagaaaauguagaaguggagauuuggacaaaagaaggagaacguaagaagcucaaaccgcggugguuagaugccagaauauauucagacccacuugcacuuaaagaguucaaagaauuugcugcgggacguaaaucgcugacccugaacuugauaacggaaauggguagauuacccacauucaugacacaaaaagcaagaaaugcacuagacaaucucgcuguccuacauacagcagaaguagggggacgagcauauaaucaugccuuaucugaacuaccagaaacucuugaaacuuuacuacuacuuacauuauuagcaacggugaccggaggcaucuuucuauuucuaaugucuggaaaagguauagguaagaugacccuugggauguguuguauaauuacggccucuauacuguuaugguaugcacaaauacagccgcacuggauagcagcaucaaucauucuggaauuuuucuugauaguuuuguugauaccagaaccagaaaagcagaggacaccacaagacaaucaauuaaccuauguaguaauugccauacuuacuguugucgcagcgacaauggcuaaugaaauggguuucuuagagaaaacuaagaaagaucuaggcuuugggucuauaacgacacaagagucagaaucaaauauucuagacauugacuuaagaccagccucggccuggacuuuauaugccgucgcaacaacauuugucacaccuaugcuccgacacucgauagaaaacucuucaguuaacguaaguuugacagccauagcaaaucaagcuacgguccucauggguuuagggaagggauggccauugucuaaaauggauauagggguaccguugcuugcuauugguugcuacucgcaggucaauccgauaacacuaaccgcugcauuacuacuguuaguugcucacuaugcuauaauagguccaggacuucaggcaaaagcuacacgugaagcacaaaagcgagccgcagccgguauaaugaaaaauccuacagucgacgguauaacaguaauagauuuagagccgauacccuacgauccaaaauucgaaaaacaauugggucaaguuauguuguuaauacuguguguuacacaaguacuuaugaugcggacuacaugggccuuaugugaagcauuaacccuugcuacugguccuauuucuacucuuugggaagguaaucccggaagauuuuggaacaccacuauugcaguaucaauggcaaauaucuucagaggaucuuaucuggcaggagccggacuacuauuuucgauuaugaaaaauacuacuaacacuagaagagguacuggaaauguaggugagacacuaggagaaaaguggaaaaguagacuaaaugcacuugggaaaagcgaauuucaaauuuacaagaaaagugggauucaagaaguggauaggacccuagcaaaagaggguauaaaaaggggagaaacagaucaccacgcaguaaguagaggaucugcaaaauuaagaugguucgucgaacguaauauggucacaccggagggaaaagugguagaucuaggauguggacgaggaggaugguccuauuauugcgguggacucaaaaauguaagggaaguaaaaggccucacuaaaggagggccggggcacgaagaaccaauaccgaugaguacauauggauggaaucugguaagauuacagagcggaguagacguauucuuuacgccgccagaaaaaugcgacacguuacuuugcgauauaggugaaucuucaccaaauccuacuauugaagccggcagaacauuaagaguucugaaccugguggaaaauuggcuuaacaacaacacucaauuuugcauaaagguacuuaacccuuacaugccaucagugauugaaaagauggaaaccuuacagcgcaaguacggcggagcgcuggugcgaaauccguugucaagaaauucaacacaugaaauguauuggguaagcaacgcgacgggaaauauugucucgagcguaaauaugauaucaagaaugcuaauaaaucgauucaccaugaaacacaagaaagcaacauaugagccagauguagauuuaggcucaggcacgcgaaacauugggauugagagugaaauaccaaaccucgacauaaucggaaagcgaauagagaaaauuaaacaagaacaugaaacaagcuggcacuacgaccaggaucauccauauaagacuugggcauaucacgggagcuaugagaccaaacaaaccgguucagcuucaucaaugguaaacggcgucguaagacugcucacgaaaccuugggauguagugcccauggucacacagauggccaugacugacacaacuccuuucggacaacagagaguguuuaaggagaagguagauacuagaacucaggaaccaaaggaaggaaccaagaaacuuaugaaaauaacggccgaauggcuguggaaagaacuagguaaaaagaaaacgccgagaaugugcacgagagaagaguuuacacggaaaguaagaagcaaugcagcacuaggagcuauuuucacagacgaaaauaaauggaaaucugcccgagaagcugucgaggaugguagguucugggaacuuguugaucgagaacggaaucuccauuuagaaggaaagugugaaacaugcgucuauaauaugaugggcaaaagagagaagaaacuaggggaguuugguaaagcaaaggguucacgagcaauaugguauauguggcugggagccagguuucuagaauuugaggcuuuaggguuucuuaaugaggaucauugguucucuagaggaaauucacuaucaggaguugaaggggaagggcugcauagauuaggcuacauacugcgggagguaggcaagaaagaagguggcgccauguaugcugaugacacugcaggaugggacacaagaaucacauuagaagaccuuaagaacgaagagaugguaacaaaccauaugaagggggagcauaagaaacucgcggaggcaauauuuaaauuaacguaucaaaauaaagucgucaggguacaacgaccaacuccaagagguaccgugauggauauuauuagcagaaaagaccagagagguagcggccaaguuggaacguauggauugaacacuuuuaccaacauggaagcacaguuaaucagacagauggaaggugagggaauauuuaaaucuauacaacaucuaacugccacggaagagauugcagugcagaauugguuggcacgcgucgguagggaacguuuaagccgcauggcuauuucaggugacgauuguguugugaaaccuauagaugaucgauuugcuagugcacuuacagcgcucaacgauaugggaaaggucagaaaagacauccaacaaugggaaccuaguaggggauggaaugauuggacucagguuccuuucuguagucaccauuuccaugaauuagugaugaaggauggaaggguauuaguuguuccuugucguaaucaagacgaauugauuggucgagcacgaauaagccagggagcgggguggagcuuaaaggaaacggccugcuuggggaaaucauacgcucaaauguggacccuaauguacuuccaccggagagaccuacgucuagcugccaaugcaaucugcucugcagucccaagucauugggucccgacaucaaggacuacguggucuauucaugcgaaacacgaauggaugacaaccgaggauaugcucgcuguuuggaaucgagucuggauacaagaaaauccauggauggaggacaaaacaccgguagagucaugggaggaaguaccauaucuuggaaaaagggaagaucaaugguguggcucucuuaucggucuuacaagccgagcaaccugggccaaaaacauccagacggcuauaaaucaaguuaggucacucauuggaaacgaagaguacacggacuauaugccaagcaugaaacgcuuucgaagagaagaggaggaggcgggaguauugugguaa

SEQ ID NO: 22299 - RNA, 9876 nt, Artificial Sequence
  derived and/or modified CDS sequence (opt6) from DENV-2__HM488257__SS-prME
acugcagggaucauaauaaugaugauuccgacggugauggcuuuucaucuaacuacacggaacggcgaaccacacaugauaguuagccggcaagaaaaaggaaaaucauuacuauuuaaaaccgaaaauggagugaauauguguacucugauggcaauggacuuaggcgaacuaugugaagacacuauaaccuauaauugcccauugcuacgacagaaugaaccagaagauauugauugcugguguaauucaacgucaacguggguaacauaugguaccugcacaguaaccggcgaacaucggagagagaaacgaucuguagcauugguaccacacguaggaaugggucuagaaacaagaacggaaacauggaugucaagugaaggggcauggaaacaugcucagagaauugaaacuuggguauugcgucauccaggauuuacuauaauggcagcaauacuagccuacacaaucggaacaaccuacuuucaaagaguauuaauuuuuaucuugcuaacagccguggcaccaaguaugaccaugagauguaucgguauuaguaaccgugauuuuguagaaggaguuuccggcgguucguggguagauauaguacuugaacauggaagcugcguuacgacaauggcuaaaaauaaaccaacucuugauuuugaacuaauuaaaacugaagcaaaacauccggcaacacuaagaaaauacuguauagaagcuaaauuaacgaacacaacaacggcuucccgaugcccaacgcagggugaaccaucacucaacgaggagcaagauaaacgauucguuuguaaacacagcaugguagacagaggguggggcaauggauguggguuguucggaaaaggcggaauagugacaugugcuauguucacuuguaagaaaaauauggaagguaagauagugcagccagagaacuuggaauauacaauagucauaacuccacauucgggugaagaaaaugcuguaggaaaugacacagguaaacacgggaaagaaauuaaaguaaccccucaaagcucaauaaccgaggcagagcuaacgggauacgggacuguaacaauggaauguucuccuaggacaggacuugauuuuaacgaaaugguacuauugcaaauggaaaauaaagcaugguuagugcaccgucagugguuccuugaucuuccacuuccuugguuaccaggggcagauacgcaagggucaaacuggauacaaaaagaaacgcucguaacauuuaaaaacccccacgccaaaaagcaagauguuguagucuugggcagucaagaaggagcaaugcauaccgcacuaacaggagcaacagaaauacaaaugaguaguggaaauuuacuuuuuacgggacauuuaaaauguagacugagaauggacaaauuacaacugaaaggcauguccuauaguaugugcacgggcaaauuuaaagucguaaaggagauugcugaaacacaacaugguacaauagugauacgggugcaauaugaaggugauggcuccccauguaaaaucccuuucgaaauuauggacuuagagaaaagacaugucuuaggcagacuuauaaccgugaacccaauuguaacagaaaaggauucaccuguuaacauagaggcagaaccgccguucggggauaguuacauuauugucgguguggaaccuggucaacuuaaacuaagcugguuuaagaaagggaguucaaucggacaaauguuugaaacaacaaugaggggagcaaaaagaauggcaauacuaggggacacugcgugggacuuuggaagucuaggagggguguuuacuucuauagguaaagccuuacaccaaguuuucggugcaauauacggagcugccuuuucaggggucaguuggacaaugaaaauacuaauaggcguuguaauaacguggaucgggaugaacagcagaucaacuucucucagcgucagcuuaguccugguugggguagucacacuguauuuaggagugaugguucaagcugacaguggauguguaguauccuggaaaaacaaagaauuaaaaugugggaguggcauauuuauuacugauaauguacauaccuggacugaacaauacaaauuucaaccagagaguccaucuaaguuagcuagugcuauacaaaaggcccaugaggaaggcauauguggaauccguucugucacucggcuagaaaaccuaauguggaaacagauaacuccagagcuaaaucacauucuuagugaaaacgagguuaagcugacaauuaugaccggagauauuaaaggaauaaugcaggcugggaaaagaucacuuagaccacaaccgacagaauuaaaguauucguggaaggcuugggguaaagcaaaaaugcuaucuacggaguugcacaaucauacuuucuugaucgaugggcccgaaacagcggaguguccaaauacuaaccgagccuggaacucauuagaaguagaagacuacggauuuggaguauucacuacaaauauauggcuuaaguugaaggagagacaagacguauuuugugauagcaaacuuaugucugcagcaauaaaggauaauagagcgguccaugcugauauggguuacuggauagaaagcgcucuuaaugauacauggaaaaucgaaaaagcuagcuucauagaagucaaaucuugccauuggccaaaaagucacacucucuggucuaaugguguucuagaaagugaaaugauaauacccaaaaauuuugcaggcccaguuagccaacauaauuaccgaccagguuaucacacucaaaccgcaggaccguggcaccuaggacgacucgaaauggacuucgauuuuugcgaaggaacuacaguaguaguuacggaagauugcgguaauagaggaccgagucuaaggacgacgacugcuucuggaaaguuaauuacugagugguguuguagauccuguacucuaccaccacuaagauacagaggagaagacgguugcugguacgguauggaaauaagaccuuuaaaagaaaaggaagaaaaucuuguaaauagccuugugacugcaggacauggccagaucgauaacuuuagucuaggugucuugggcauggcucuauuucuagaagaaaugcugaggacuaggguggggacaaaacaugcaauucuccuuguugcugucuccuuuguaacauugaucacaggcaauaugagcuuucgagauuuaggaaggguaaugguaaugguaggcgcaacaaugacugacgauauaggaaugggaguaacauaucuagcgcuacuggccgcuuuuaaaguccgaccaacauacgcugcagggcuacuucuucguaaacugacauccaaggaguuaaugaugacaacuauagguauuguucuauuaucacagaguacaauaccagaaaccauuuuagagcuuacggaugcauuggcauuggguaugaugguauugaaaauuguacggaacauggaaaaauaucaauuggccguaacaauuauggcuauacuaugugugccaaacgcaguaaucuugcaaaacgcuuggaaaguuucuugcacuacucuugccauggucucaguuaguccauuguuguugacaaguucucagcaaaaagccgauuggauaccuuuggcauuaacaauaaaaggauuaaauccuaccgcuauuuucuuaacaacacucucacgcacgucaaagaagcgaucauggccacugaacgaagcaauaauggcugucgggaugguauccauauuagcauccagucuauugaaaaacgauauuccaaugacggguccguuaguagcuggcggacuuuugacgguguguuaugucuuaacaggucgaagugcugaccuugaacuagaaagagcagcugauguccggugggaagaacaagcagaaaucagcgguaguucaccgauucucucuauuacaauuucugaagauggcaguaugucuauuaaaaacgaggaagaagaacaaacgcuuaccauacucauaaggacuggacugcugguaauaucagggcuauuucccguuaguauuccgauaacagcagccgcaugguaucucugggagguuaaaaagcaacgagcaggcguacuuugggacguaccaaguccgccaccagucggaaaagccgaauuagaagacggggcauacagaauaaaacaaaaaggcauacuuggguauucucagauaggcgcugggguauauaaggagggaacauuucacacaauguggcacguuacuagaggagcgguauuaaugcacaagggaaaaagaauagagccaaguugggcggacgucaagaaagacuuaauaucguauggaggcggauggaagcuagagggagaguggaaagagggcgaagaaguccaggugcuugcauuagaaccugguaaaaauccaagagcuguucaaacgaaacccggcuuguucaaaacaaacacugguacaauaggagcagucaguuuagauuuuucucccggaacaaguggaucgcccauaguagauaagaaaggaaaaguuguaggucuuuacggaaauggaguaguaacacguucaggaaccuacguguccgcuauugcacaaaccgaaaaguccauugaggauaauccagaaaucgaggacgauauauucagaaagaaaagacuuacuauaauggaucuccacccaggagcgggaaaaacaaaaagauauuugccagccaucguaagagaagcuauaaaaagaggacugaggacacuaauacuugcuccuaccagaguaguugcagcagaaauggaagaagcgcucaggggucuaccaauaagauaccagacaccagcaauuagagcugaacacacgggaagggagaucgucgaucuaaugugucaugcaacuuuuacaaugcggcuacuaucaccuauaagaguaccaaauuauaaccuuauaauaauggacgaagcgcacuuuacugauccagcaagcauugcggcuagggguuauauaucaacuagaguggaaaugggcgaggcugcaggaauauucaugacggcuacaccacccgguucaagggauccuuuuccacaaaguaacgcaccuauaauggaugaagaacgagagauaccugagaggucuuggaauaguggucaugagugggucacagauuucaaaggaaaaaccguaugguucgucccuuccaucaaggcugggaacgauauagcagcaugccugaggaaaaauggcaagaaaguaauucaguugucgagaaagaccuuugauuccgaauauauaaaaaccagaacaaacgacugggauuuuguaguaacaacggauauaucagaaaugggagcaaacuuuaaagcugaaagaguaauagaucccagaagauguaugaaaccaguuauauuaacagauggagaggaacgagugauauuagcagguccuaugccaguaacucauaguucggccgcacaacgucgaggucgagucgggcguaacccgaaaaaugagaaugaccaauauaucuauaugggugagccucuugaaaaugacgaagauugugcucacuggaaagaggcuaaaauguuacuggauaauauuaauacaccugaagggauaauaccaucuauguuugaaccugaaagagaaaaaguagaugcuauagauggagaguaccgacuucguggugaagcgcggaaaacauuuguggaucuaaugagaagaggcgauuuacccgucuggcuggccuacagaguggcagcagaagguaucaauuaugcugauagacguugguguuuugauggugucaaaaauaaucagauccuagaagaaaauguagaaguugaaauuuggacaaaagaaggcgagagaaagaaauuaaaaccucgcuggcuggaugcgcguauuuauagugacccauuggcacuaaaagaauuuaaggaauuugcagcuggucgcaaaaguuuaacguuaaauuugauaacugaaauggguaggcuaccgacuuucaugacgcaaaaggccaggaacgccuuagacaaccuugcaguccuacacacagcagaagcaggagggagagcauacaaucaugcucuguccgaauuaccagaaaccuuggaaacauuacuacuucuaacccugcuugcuaccguaacaggagggauauuuuuauuucucaugucuggaaagggcaucgguaagaugacauuagguaugugcuguauuauaacagcaucuauccugcuaugguacgcccagauccagccacauuggauugcugcaucgauaauuuuagaauuuuucuuaauaguuuuacuaauaccagagcccgagaaacagaggacaccgcaggauaaucaacuuacauacguaguuaucgcaauacuuacgguuguagcggccacaauggcgaacgagauggguuuucuagagaaaaccaagaaagauuucggacugggaucaauuacaacacagcaaccagagaguaacauucuagauauagauuuaagaccugcaucggcauggacacuguaugcgguagcuacaacauucauuaccccaaugcuaagacauucaauagaaaauucauccguuaauguaagucucacagcgauugcuaaccaagcuacaguacuuauggggcuaggcaaaggauggccucuaaguaaaauggacauuggcguuccuuuacuagcuauaggauguuauagucagguuaauccuauaacgcuuaccgcagcuuuacuauuacucgucgcccauuacgcuauuaucggacccggacuccaagcuaaagccacaagggaagcucaaaagcgggcagcggcuggaaucaugaagaauccaacugucgacggcauuacugucauagaccuagauccaauccccuacgauccuaaguucgaaaaacaauugggucaagucaugcuacucguucuaugcguaacccaaguacucaugaugcgaacaacuugggcuuuaugugaagcauugacacuggcgacggguccgauaucgacacucugggaggggaauccaggucgguuuuggaauaccacuaucgcgguauccauggcaaauaucuucagaggcucguaucucgcgggcgcaggacuacuauuuucuaucaugaagaacacagcuaauacaaggagagguacuggcaacacaggcgaaacauuaggugaaaaguggaaacaucgacuaaaugcguuagguaaaagugaguuccagauauacaagaaaucgggcauacaagaaguggauaggacauuagcgaaggagggaauuaaacguggagaaaccgaucaccaugcuguuucaaggggcuccgcaaaacugaggugguucguggaaaggaauuuaguaacaccagagggcaaaguaguagauuugggaugcggccgcggagguuggagcuauuacugcggaggacucaaaaacgugaaagaaguuaagggacucacuaaaggcggaccagggcacgaagaaccaauaccgaugaguacauacggcuggaaccuggugagauuacagaguggaguagauguauuuuucacaccuccagaaaaaugcgauacauuacuaugugacauuggcgaaaguucgccgaauccuacuguggaagccggucguacucuaagggugcuaaauuuaguugaaaacugguuaaauaacaacacucaguucuguaucaaaguauuaaauccauauaugccgucggugauugaaaagauggaagcauuacaacgcaaguauggcggagccuuaguaagaaauccauuaaguagaaauucaacgcacgaaauguacugggucucaaacgcaagcggaaauaucguaucuucuguaaacaugaucucacgaauguuaaucaaccgauuuacuaugcgucacaagaaagcaacguacgaaccagauguugaccuggguucagggacccgcaacauaggaauugaauccgaaaccccaaaccuggauauaauugguaaaagaauugagaaaauuaaacaagagcaugaaacaucuuggcauuacgaccaagaucauccuuacaagacaugggccuaucacggaucauacgaaacuaagcagaccggaucggcuuccucuauggugaauggggugguaagacuacuaacaaaaccaugggauguuauaccaaugguaacucaaauggcgaugacagauacaaccccuuucggccagcaacggguuuuuaaggaaaaaguagauacgaggacgcaagagccaaaagaagguacuaaaaagcuaaugaaaauaacagcagaaugguuauggaaagagcuggguaagaagaaaacacccagaauguguacacgcgaagaauuuacacgaaaaguacgaaguaacgcagcauuaggcgcaauauuuacagaugaaaacaaauggaagucagcacgagaggccguugaagacagugguuucugggagcuaguggacaaagaaagaaaccugcacuuggaaggcaaaugugaaacgugcguguauaacaugaugggcaaacgagagaagaaacuuggugaguuugggaaagcaaaaggcuccagagcgauaugguauauguggcuaggugcaagguuucuggaauuugaagcauuaggcuucuuaaacgaagaccauugguuuucgaggaaaaauucucuuagcggcguugaaggagaagggcuccauaaacuaggguacauacuaagagauguuagcaagaaagaaggcggagcaauguaugcugacgacacagcugggugggauacuagaaucacucuagaggacuugaaaaaugaggagauggugaccaaucacauggaaggugaacauaagaaacuugcugaggccaucuuucgauugacauaucaaaacaaaguuguacguguucaacguccuacaccaaggggaacuguaauggauauaaucucucgacgagaccagagagguaguggucaaguuguaacauauggacugaauacuuuuacaaacauggaggcacaguugauucgacaaauggaaggugaggggguauuuaaaucaauccaacacuugacagcaacugaggagaucgcaguaaaaacuugguuaguaagggucggcagggaaagacugucucguauggcaauauccggugacgauuguguugugaaaccucucgacgaucgcuuugccagugcauuaacagcacuaaaugacauggggaaagugagaaaagacauacaacaaugggaaccgucgcggggauggaaugacuggacacaagucccguuuuguucacaucacuuccaugagcuaauuaugaaagauggccgaguauuagucguucccugcagaaaucaagaugaguugauagggcgagccagaauaagccaaggugcgggcuggaguuuaagagaaacagcaugccuagggaaaucauaugcacaaauguggagucuuauguauuuucaccgacgggaucuccgacuagcagcaaacgcaauuuguucggccguuccaucucauuggguuccgacaucccggacgaccuggucaauacaugcgacacaugaauggaugaccacugaagauauguuaacgguguggaaccguguuuggauccaggagaaucccuggauggaggauaaaacuccgguugaaucuugggaggaaauacccuauuugggcaaacgugaagaucaauggugcggcucuuuaauuggguuaacuucucgagccacaugggcgaaaaacauacagaccgcaauaaaccagguaagaagccugaucggaaaugaagaauauacggauuacaugccuucgaugaaacgcuuucgaagggaagaggaagaagcaggaguacugugguaa

SEQ ID NO: 22300 - RNA, 9876 nt, Artificial Sequence
  derived and/or modified CDS sequence (opt6) from DENV-2__HQ999999__SS-prME
acagcugggguaauaguaaugcuuaucccgacagcgauggcauuucauuuaaccacaaggaacggagaaccacauaugauugucggaagacaagaaaaggggaagucauuacuuuucaaaaccgaggacgguguaaacauguguacgcuaauggcuaucgaccugggggaauuaugugaagauacaauaacauauaaauguccauugcuccgacaaaacgagccagaagauauagauuguugguguaauucuacaucaacuuggguaacuuauggcacguguacuacuacaggagaacaucgacgcgaaaaaagaagcguagcacuuguuccccauguaggaaugggacuugaaaccaggacagaaacauggauguccucagagggcgcguggaaacauauucaaaggauagaaacuuggauucuaagacauccuggcuucacaauaauggccgcaauacuggcauacacuauaggaacuacacauuuucaacgggcucuaauuuuuauuuuauuaacugcuguagcgcccaguaugacuaugcguugcauagguauaucaaaucgcgauuuuguggaagguguauccggaggaaguuggguagauauugucuuagaacauggcucauguguaacgacuauggcaaaaaauaaaccaacauuagauuucgaacuaaucaagacagaagcgaaacaaccugcaacacuuagaaaauauugcauagaagcuaaacuaaccaacacuacaaccgagucgagaugcccaacgcaaggagaacccucucugaacgaagaacaggacaaacgauuuauaugcaaacacaguaugguagauagaggcugggggaacgguuguggacucuucggaaaaggaggaauuguuacaugcgcaauguuuacaugcaaaaaaaauauggaaggaaaaguuguucagccugagaaccuugaauacaccauugugauuacuccacauucuggugaagaacaugcaguagguaaugacacugguaaacaugguaaagaaauuaaaauaacaccccagaguuccauaacagaagcagaauuaacugguuacggaacaguaaccauggaaugcucacccagaacgggauuagauuuuaaugagauggucuuauugcagauggaagacaaagcauggcuaguccaucggcaaugguuuuuagaucuuccucucccauggcuuccuggugcggacacucaaggaucaaauuggauacaaaaagaaacuuuaguuacuuuuaagaacccucaugcaaaaaagcaggauguugucguccuagguucccaggaaggugcaaugcacaccgcucuaacuggcgcaacggaaauccagaugucauccgguaacuuauuguuuaccgggcacuugaaaugucgucuacggauggacaaguuacaacuaaaaggcaugaguuauucaauguguaccggaaaguuuaaaaucguaaaagagauagcugaaacucaacacgggacaauagugauccgaguucaauaugaaggagaugguucgccguguaagauucccuucgaaauaacagaucuagagaaacgacacguccuagguagacuuauuacaguaaauccuauaguaacugaaaaagauucuccaauaaacaucgaagcugaaccgcccuucggugacucuuacauuaucauaggaguagaacccggccaacuaaaacucaacugguuuaagaaaggaucauccaucggccagauguucgagaccacgaugcguggagcaaaaagaauggcuauauuaggugacacugcaugggauuuuggaagcuuggggggaguauuuacaucuauaggaaaggcccuucaucaaguuuucggugcaauauacggugcagcauuuagcgguguuucauggacaaugaaaauacuaauagggguuaucauaacuuggauaggaaugaacagucgcaguacuagucucagcguaagccuaguacuugucggugucgucaccuuauauuugggggcaaugguacaagcagacucagguuguguagucaguuggaaaaacaaagagcuuaagugugguagcgguauauucauuacagauaauguucacaccuggacagagcaguauaaauuccaaccugaaaguccgaguaaauuagcaucagcaauucagaaagcucaugaggaagggaucuguggaaucagaucugucacaagacuugaaaaccuaauguggaaacaaauuacuccugaacuaaaucauauucuuucagaaaacgaaguuaaacugaccaucaugacaggugacauaaaagguauaaugcaggcagguaaaagaagucuucgaccacaaccaacugaauuaaaguauucauggaaaacgugggguaaagccaagaugcuuagcaccgaaagccauaaucaaacauuucuaaucgacggaccugaaacugcugaguguccuaacaccaauagagcguggaauagucuagaagucgaggacuauggcuucgguguauucaccaccaacauuuggcuaaaacuaaaggaaaaacaagauguauucugcgauucgaaauuaaugagcgcagcuaucaaagauaauagggcugugcaugcugacauggguuauuggauugaaucagcccucaaugacacauggaaaauggaaaaggcaucuuuuauagaaguaaaguccugccacuggccgaaaucgcauacucuauggucaaauggcguauuagaaucugaaaugauaauuccgaaaaacuucgcagggcccguaucgcaacauaacuaucguccagguuaucauacucaaacagccggucccuggcaccuggggaaauuagaaauggacuucgauuuaugcgaagggacuacaguagucguaacggaagacuguggaaacagaggaccuucuuuaagaacaacaacugcaucaggaaaauugaucacagaaugguguuguagaucuugcacauuaccgccacuacgauaccggggcgaggacgguugcugguauggaauggagauaaggccauugaaggaaaaagaagagaacuuggugaauucucuaguuacagcagggcauggccagaucgacaacuuuaguuuagguguuuuggguauggcauuguuccuugaggaaaugcuucggacacguaucgggacaaagcaugcgauucuccuuguagcuguaucauuugugacacuaauuacugguaacaugucuuuccgugauuuaggacgcgugaugguaauggugggagcuaccaugacagaugauauaggcaugggaguaacuuauuuggcauuacuagcagcguucaagguacgaccgaccuucgcggcagggcuucuuuuaaggaaacuuacgucaaaagaacuaaugauggcaacuauuggaauagccuuacuaagccaaagcaccauaccagagaccauccuagagcugacugaugcuuuagcauuaggaaugaugguacuaaaagucguuagaaauauggaaaaauaccaacuagcgguaacgaucauggcaauuaguugugugccaaacgcaguaauauuacaaaacgcauggaaagucagcugcacaauacuugcugcaguaucugugucuccgcuucuuuuaacgucuucucagcagaaagcagauuggauaccacuagcacuaaccaucaaaggacuaaauccuacugccauuuuccucacuacauuaagccguacgucuaccaaacgcucguggccucuuaacgaggcaauaauggcaguggguaugguaagcauauuagccucuucacuauugaagaaugauauuccaaugacuggcccuuuaguugcagguggccuucucacuguauguuaugugcuaacaggucguucggcagaccuggaacuugaaagagcagcagacguaaagugggaagaccaagcugagaucagugguaguagcccaauccucucuauuacgaucagcgaagauggaucgauguccauuaaaaacgaggaggaagaacaaacauuaacuauccucauuaggacaggucuuuuaguaauuagcgggguuuuuccaguaagcauaccaauuacggccgcagcgugguaucuaugggaaguuaaaaagcaaagagccggaguacucugggacguaccaaguccaccaccuguagagaaagcugaauuggaagauggcgcguacagaauaaagcagcgaggcauucuuggguauucgcaaauaggagccgguguauauaaagaagggacguuucauacgauguggcacguaacgcguggugcaguacuaaugcaccgugggaaaaggauugaacccaguugggcugauguuaagaaggaucuaauaaguuacgguggaggauggaaacuagagggagaguggaaagagggagaggagguccaaguucuagcacucgaacccggaaaaaaucccagagcaguacaaaccaagcccgguaucuuuaaaacaaauacuggaacaauuggugcaguaagccuggacuuuagcccagggacuucaggcagucccauaguugacagaaaggguaaggucgucggauuauacggaaauggcguuguaacuaggucaggggcauaugucucugcuauagcucaaacagaaaaauccauugaagauaauccagagauagaagacgacauuuucagaaagaaaagauuaacaauuauggauuuacacccuggagcaggaaagaccaagagguaucuacccgcaaucguuagagaggcgauuaagaggggguuaaggacucuuauucuagcuccuacaagagucguagccgcagagauggaggaggcccuucguggucuaccuauucgauaucaaacacccgcaauaaaaacagaacauacaggcagggaaauuguggaccuuaugugccaugcaacuuuuacaaugcgacuucucagcccugugagaguuccuaacuacaaccuaauaauuauggacgaagcacauuucacggauccggcaucgauugcagcucgaggauauauaaguacacguguugaaaugggggaagcggcgggaauauucaugacagcgacaccuccuggcagccgagauccguucccucaaaguaaugccccaauaauggaugaagaacgagagauaccugaaagaaguuggaacucggggcaugaaugggugacugauuucaagggaaaaacaguaugguuuguaccaucaaucaaggcuggcaaugauauugcagcaugccucagaaaaaaugguaagaagguaauacaacuuucucgcaaaacuuucgauagugaauauguuaagacgcgagcaaaugacugggauuucguaguuacaacggauauaagcgaaaugggagccaauuucaaagcagagagggucauagauccacgaagguguaugaaaccaguaauucuaacagauggugaggaacgcguaauacuugcuggaccaaugccaguaacacacucaucagccgcgcaaaggagaggacgcauugguagaaauccaaaaaaugagaaugaucaguauaucuauaugggugagccucuagaaaaugaugaagauugcgcacacuggaaggaggcaaaaauguugcucgacaacauaaacacaccagagggaauuauaccaucaauguuugaacccgagcgugagaagguggaugcuauagauggagaguauagguuaaggggagaagcuagaaaaaccuuugucgauuuaaugcgccgaggugaucuaccuguaugguuagcauacaaaguagcagcagagggaauaaauuacgcagauaggcguuggugcuuugacggaauuaaaaacaaccaaaucuuggaggaaaacauggaaguagaaaucuggacuaaagaaggcgagaggaagaaguuaaaaccucguugguuagaugcccgcaucuacucugaucccuuagcccuaaaagaauuuaaagaguuugcagcagguaggaaaagccuuaccuugaaucuaauaacugaaaugggaaggcucccaacauuuaugacucagaaagcacguaaugcuuuagacaauuuggcagucuuacauacugcagaagcggggggacgagccuacaaucaugcguuaagcgaacuaccagagacgcuugaaacucuuuuauuacugacccugcuagcaaccguaacuggggggauuuuuuuguuuuuaaugucuggaaaaggaauuggaaaaaugacguugggaauguguugcauaaucacugcuucgauucugcuaugguaugcacaaauacaaccucacuggaucgcagcguccauaauccuagaauucuuccuaauaguucuucuaauuccggaaccagaaaaacaaagaacgccacaagauaaucaauuaacuuacgugguaaucgcaauauugacuguagucgcagcaacgauggcaaacgagaugggguuucuagaaaaaacgaaaaaagauuuaggacuaggaaguaucacaacccaagaaagcgaaucuaacauccuugauauagauuugcgcccggcgucugcuuggacccuauaugcgguagcuaccacauuccugacaccaauguuaagacacaguauugaaaauaguucaguaaacguaagucuaacugccauugcaaaucaagcgacaguccuaauggguuuaggaaaaggcuggccacuuucgaagauggauauuggagcaccauuauuagcaauagguugcuauucucaagucaauccuauaacacuaaccgcugcuuuacuauuacugguagcucauuacgcaaucauuggaccgggacuucaagcgaaggcaacacgagaggcacaaaaaagggcggcagccggcauuaugaaaaauccuacuguugauggaauaacggucauagaccuagauccaauaccguacgauccaaaauuugaaaaacaacuugggcagguaaugcuauugauauuaugugugacacaaguccugaugaugcggacaacgugggcauuaugugaagcauuaaccuuggcaacaggacccaucaguacauugugggaagguaacccagggcguuucuggaacacuacaauugcagucagcauggcaaauauuuucagagguucuuaccuugcaggagcgggacuauuauucucaauuaugaagaauaccaccaguacccguagaggcacggguaauaucggcgagacauuaggagagaaauggaaaaguagauuaaaugcauuggguaaaagcgaguuccaaauauacaaaaaaucuggaauacaagaaguugauaggaccuuggcaaaggaggguauaaaaaggggagagacagaucaccacgcaguuucgagaggcagugcuaaauuacgcugguucguugaacguaauauggugaccccggaagggaaagucguggaucuggggugugggcgcgguggcuggagcuauuauugugguggacuuaagaauguaagagaggugaaggguuugacaaaaggcggcccaggacaugaggaaccaauaccgaugagcaccuacggcuggaauuugguacgacuucaaucugggguggacguguucuuuacaccccccgaaaaaugugacaccuugcuaugugacauuggagagucaaguccgaacccuacaaucgaagcaggacggacucuaaggguuuuaaaccuuguugaaaacuggcuuaauaacaauacgcaauucugcauaaaaguacuaaaucccuacaugccaagcgucaucgaaaaaauggaggcucugcagaggaaauaugggggugcucuaguacguaauccauugucgcgcaauucaacacaugaaauguacuggguaucaaaugcaacuggaaauauuguuucaucuguaaauaugaucucucgaaugcuuauaaacagauuuaccaugaagcacaaaaaagccacguaugaaccggauguugacuuaggcaguggaacacgaaauauugguauugaaagugaagucccuaaucuagauauuauagggaaaaggauugaaaaaaucaaacaagaacaugaaacaaguuggcauuaugaucaagaccacccauacaagacaugggcauaccacggaaguuacgagacaaagcaaacgggauccgcgucuaguaugguuaacggaguuguacgacuccuuacaaaaccaugggaugucguuccgaugguuacucaaauggcaaugacagauacaacaccauuugggcagcaaagagucuuuaaggaaaaaguagauacaagaacccaggagccgaaagaaggaaccaaaaaacuaaugaaaaucacagccgagugguuguggaaagaguuaggcaaaaaaaaaacaccacguauguguacucgagaggaauuuacaagaaaaguacguaguaaugccgccuugggcgcuauauucacugaugaaaauaaguggaaaucggcucgagaagcuguugaagacggacgcuucugggaacugguagauagagaaagaaaccuccaucuggaagggaaaugugaaacgugugucuauaauaugauggguaaaagagaaaaaaaacuaggugaauuuggaaaagccaagggcagccgugcgauuugguauauguggcugggagcacguuuuuuagaauuugaggcauuagguuuccuuaaugaagaccauugguucucuagaggaaacucacuaaguggcguagagggcgaagguuuacacaggcuaggauacaucuugcgagaaguaucaaaaaaagaaggcggggcgauguaugcggacgacacagcaggcugggacaccaggaucacacuugaagacuuaaaaaaugaagaaaugguaacuaaccacaugaaaggcgagcacaagaaauuagccgaagccauuuucaaauugacuuaccagaacaaagugguucgcguacaaaggccaacaccccgcggaacuguuauggauaucauaagucgacgggaucagcgaggaaguggucagguagguacauacgggcuaaauacauuuacaaacauggaagcacaauuaaucagacagauggaaggagaaggaauauucaaaucaauccaacauuugacagcaacggaagagaucgccguccaaaauugguuagcacgcgucggcagagaaagauugucucgcauggcgauaagcggagaugacuguguuguuaaacccauagaugauagauucgcuagugcacuuacagcacuaaacgauauggguaagguaagaaaagauauucaacaaugggagccaucucguggauggaacgacuggacacagguaccuuucuguucccaucacuuucaugaauuaguuaugaaagacggucgagucuugguaguuccguguaggaaccaagaugaacuaauuggucgagcuagaauuucccaaggagcaggauggagcuuaaaagaaacagccuguuuggguaaaucuuaugcgcaaauguggacgcugauguacuuucacagaagagaccuaagguuagcugcaaacgcuaucuguagugcugugccaucccacugggugccaacaucaagaacuacuuggucaauacaugcaaaacaugaauggaugacaacagaagauauguuagcgguauggaaucgaguuuggauucaggaaaauccuuggauggaagauaaaacacccguggaguccugggaagaaguaccauaccuggggaagagagaagaccaaugguguggaucguugauagguuuaacaagcagagccacuugggccaaaaauauucaaaccgcuauaaaccagguaagaagcuuaauagggaaugaagaauacacggauuacaugccuagcaugaaaagauucagaagagaagaagaagaggcagguguacugugguag

SEQ ID NO: 22301 - RNA, 9876 nt, Artificial Sequence
  derived and/or modified CDS sequence (opt6) from DENV-2__FJ898449__SS-prME
acugcaggcaugauaauaaugcucauaccuacuguaauggcauuucaucucacgacucgaaacggugaaccacauaugaucguaagcaggcaagaaaaagguaaaagucuacucuuuaaaacuaaagacggaacuaacauguguacacuuauggcaauggacuuaggagaacuuugcgaagauacaauaacuuauaaauguccauuucucaaacaaaacgaacccgaggauaucgauuguuggugcaauagcaccaguaccuggguaacauacggcacuugcacgaccacgggagagcaccgaagagaaaaacgcucaguagcacuuguuccucacguaggaauggguuuagagacuaggacugaaacauggauguccagcgaaggagcauggaaacacgcgcaaagaauugaaacguggauccuaagacauccgggguuuacgaucauggccgccauccuagccuauacaauaggaacuacgcauuuccaaagaguuuuaauuuuuauucuauugacagcgauagcaccuucaaugaccaugcgauguauagguauaaguaauagagauuuuguagaaggaguaagcggggguuccugggucgacauaguauuggaacaugguucauguguaacaacaauggccaaaaacaaaccaacguuagacuuugaacucauaaaaacagaagcgaaacaaccugcaacucuuagaaaauacuguauagaagcuaaauuaacgaauacuacaacagauucaagauguccuacacaaggcgaaccuacccuuaacgaagaacaagacaaaagauucguaugcaaacauaguauggucgauagaggaugggggaacgguuguggcuuauucggaaaaggagggaucgugaccugugcaauguucacauguaagaaaaacauggaaggaaaaauuguccaaccggaaaaucuagaauacacgguaguaaucacaccacacuccggugaggaacaugccgucggaaaugacacaggcaaacauggaaaagaggugaaaauuacaccccaaucguccauuaccgaagcagaacuaacgggguauggaacgguaacuauggaaugcucaccacggacuggacuugauuucaaugaaaugguuuuacuacaaauggaggacaaagcauggcuagugcaccgacaaugguuucuagauuuaccucuaccaugguuacccggcgcagauacacaggguucgaauuggauccaaaaagaaacauuagucacguucaaaaauccccacgcaaagaaacaagacgugguuguacuuggaucgcaagaaggagcuaugcauaccgcccuaacuggagcuacagaaauccaaaugagcuccggaaauuuauuauuuacaggucaccuaaaauguagacuucggauggauaaacugcaacuaaaaggaaugucguauagcaugugcacaggcaaauuuaaaaucguuaaagagauagcagaaacccaacauggcacuauuguaauucguguucaauacgaaggugauggaucgccuugcaaaauaccauucgaaauaauggaucuggagaaacgacauguacuggggcgauuaauuacuguuaauccuauaguuacagaaaaggauaguccugugaacauagaagcugagccaccauucggugacagcuauauaauaauagggguagaaccuggucaauuaaaauuggacugguuuaagaaagguaguucaauuggccaaauguuugagacaacaaugcguggugcuaaacguauggcaauuuuaggugauacggcuugggauuucgguucacugggaggcguuuucacaucaauagggaaagcacuucaccaaguuuuuggagcaauauacggagcagcuuuuuccggagucuccuggacaaugaaaauauuaauaggagugaucaucacauggauugggaugaacagcagaucuacaucccugucuguaucacuuguucucguaggcaucguuacacuuuaccucggaguuaugguacaagcagacuccggauguguugucaguuggaaaaauaaagaauuaaaaugcgguucagggaucuucguaacugauaauguacauacauggacugagcaauacaaauuccagccagaauccccaucuaaacuugcgagugcuauacagaaagcucaugaagaaggaaucugugggauccgcuccguuacuaggcuagaaaauuugauguggaaacaaauaacaagugagcuaaaucacauacugucggagaacgaaguaaaguuaacaauuaugacuggagacaucaagggaauaaugcaaguagguaaaaggagccuacggccccagcccaccgaguuaagguauucauggaagaccuggggcaaagcuaaaaugcuaagcacagaacuccauaaccaaacguuuuugauagacgguccagaaacugcagaguguccaaacacaaaccgagcguggaacucacuagaaguggaagacuauggcuucgggguauuuacuaccaauauuuggcuaagacuucgggaaaaacaggacguauuuugugauucaaaauuaaugucugcagccauaaaagauaacagagcaguacacgcagacauggguuauuggauugaaucggcacuaaaugauacauggaaaauugagaaagcuaguuuuauagaaguaaaaagcugucauuggcccaaaucacacacuuuauggucgaaugggguauuagaaucugaaaugauuauaccgaaaaauuuugccggaccgguaucacaacauaauaaccgaccuggcuaccacacgcaaaccgcaggaccguggcaccuagggaaacucgaaauggauuuugacuucugugaagguacaacaguuguaguaacagaggaguguggaaaccgaggaccaucgcuacgaacgacaacugcaagugggaaauugauuacagaauggugcuguaggagcugcacacuuccuccgcuuagguaccgaggggaagauggguguugguaugggauggaaauucgaccccuuaaagaaaaagaagaaaacuuaguaucaagucuaguaacugccggccauggacagauagacaacuuuucauuggguauacuagggauggcucuguucuuggaggaaauguugcguacacgggucggcacuaaacaugcuauauugcuuguggcgguauccuuugucacauuaauuacaggaaauauguccuucagagaccuaggucgcguuauggugauggucggugcaacaaugacagaugacauaggcaugggggucacauacuuagcgcuacucgccgcuuucaaagucaggccaacauucgcagccggccuacuacuuagaaaauugacaaguaaagaauugaugaugacaaccauaggaauuguccuucugucccaaagcuccaucccagaaacaauauuagaacuaacagaugcauuagcuuuaggaaugaugguucuuaaaaugguuaggaauauggaaaaauaucagcuugcuguaaccauaauggccauacuuuguguuccgaacgccgugauucugcaaaaugcauggaaaguaucuuguacgaucuuagcgguggucucaguuaguccauugcugcugaccucuagccagcaaaaagcagauuggauuccgcucgcacugacgauaaaaggauuaaaucccacggcgauauuucuaacaacguugucaagaaccucaaagaaaagaucauggccucuaaaugaggcgaucauggcagugggcaugguaucaauuuuagcuucuagucuacugaagaaugauauuccuaugacagguccauuaguugccgguggcuugcuaacggucugcuacguacuuacaggaagaucagcagaucuagaguuagagcgagcaacagaugugaaaugggacgaccaggcagaaaucucuggaucauccccgauuuuaucaauaaccaucucagaagacggaagcaugagcauuaagaacgaagaagaagaacaaacuuuaacuaucuugauaagaacagguuuacuugugauuagcggguuguuuccuguaagcaucccuauaacagcagcagcuugguaccuuugggaagucaagaaacaacgcgcuggcguauuaugggacguaccaucaccgcccccgguaggaaaagcagaacuagaagauggagcauauagaauaaagcaaaaaggaauccucgguuacagucaaauaggugcagggguauauaaggaaggcacuuuucauacaauguggcacgugacuaggggugcaguauuaaugcacaaaggcaaacgaauagaacccucuugggcagacgucaagaaagauuuaauaagcuauggagggggcuggaaauuggaaggcgaauggaaggaaggcgaagagguccaagugcuagcuuuagaaccaggcaaaaacccgagagcaguacaaaccaaaccgggucuguuucgaacgaauacgggaacaauaggagcuguuucgcuggacuuuucgccaggaacgucggguagucccaucguagauaagaaaggaaaaguagucggauuguauggcaacgguguagugacacgcaguggggcuuaugugagugcaauagcacaaacagaaaagucaauugaagauaauccugagauugaggaugauauauuuaggaaaagacgccuuacaauuauggaucugcacccaggugcaggcaaaacuaagaaauaccuaccggcuauaguaagagaggcuauuaaaagaggacuacgaacacuaauuuuagcgccaacgagagugguagcugccgaaauggaggaagcguugcgaggauuaccuaucagauaucaaaccccugcuauccgagcugaacacacuggaagggaaaucgucgauuuaaugugccacgcaacuuucacaaugagacuguugagcccaauacguguaccuaauuacaaccuaaucauaauggaugaagcccacuuuaccgacccugcaucuaucgcagcucgagguuacaucagcacacgaguggaaaugggagaagcagccgguauauucaugacugccacaccgccgggaucaagagacccauucccgcaaagcaacgcuccgauuauggaugaggaaagagaaauuccagaaagaaguuggaacucaggacacgaaugggugaccgauuucaaaggaaaaacagugugguucguccccucaauuaaaaccggaaaugacauagcugccuguuuaaggaaaaauggcaaaagggucauacagcuaagucguaaaaccuucgauucagaauauguaaaaacaaggacuaaugauugggauuucguggucacaacugauaucagugaaaugggagccaauuuuaaagcugaaagaguaauugauccacguagaugcaugaaaccuguaauucuuacugauggcgaagaaagaguaaucuuagccgggccaaugccaguaacacauucgagugcugcacagcgcaggggaagaaucggucguaauccgagaaaugagaaugaucaguauauauauaugggugaaccauuagaaaaugaugaagauugugcccacuggaaagaggcuaagaugcucuuagacaauauaaacacaccugaggggauuaucccuucaauguucgagccugaaagggagaaaguagaugcuauagacggagaauaucgguuacguggagaagcuagaaaaacauuuguagaccuuaugcgacguggggauuuaccagucugguuagccuauaaaguugcaagugaagguaucaauuacgcagaucguagauggugcuuugauggaacgagaaacaaccaaauacucgaggaaaacgucgaaguagaaauauggacaaaagaaggagaaagaaagaaacuaaagccacguugguuagacgcucgcauauacucggacccguuagcucuaaaagaauuuaaagaauuugccgccggucgaaaaucucugacauuaaauuuaauaacagagaugggacgacucccuacuuuuaugacucaaaaggcgagagaugcucuagacaaccuagcaguauuacacacggcagaagcagggggaaaagcauauaaccaugcguuaucugaauuaccagaaacauuggaaacacuucuccuauuaacuuuacuugccaccguaaccggaggcaucuuuuuauuuuugaugaguggaagagggauaggcaagaugacacuugguauguguugcaucauaacugcuucaauucuacugugguaugcacagauacaaccccauuggauagcagccucuauuauccuggaguucuuucucauaguacucuuaaucccagaacccgaaaagcaaagaacuccacaagauaaccaacuaacuuauguaauuauagcaauuuuaacagugguagccgcuaccauggcgaacgaaaugggguuuuuggagaaaacaaagaaagaucuaggguuagggcauauagcuacccagcaacccgaaucaaauauuuuagauauagaucuccgcccagcuucugcguggacauuauacgcuguugcaacaacguuuauaacaccgaugcuaagacauucaauagaaaauucaucuguaaaugucagccuaaccgcgauagcuaaccaagcaacgguauugaugggucuagguaaaggcuggccacuaucgaagauggauauaggugucccauuacuagcgauagguugcuauucacaagugaacccuauaacguuaacugccgcucuuuuacuguuaguugcucacuacgcgauuauaggcccaggguuacaagcuaaggcaacaagagaagcacagaaaagggcagcggcuggaauaaugaaaaauccaacgguggacgguauaaccguuaucgauuuagauccaaucccauaugacccuaaauucgagaagcaauuaggacaaguaauguuauugguacucuguguaacccaggugcuuaugaugcgaacaacaugggcauugugcgaagcacuaacacuugcuacugguccgguuucuacucuaugggaagggaauccgggacguuucuggaauacaacuaucgcugucucaauggcaaauauuuuuagaggaucguaccuagcgggggcaggccuucucuuuuccauaaugaaaaauacaacgucaacacguagaggaacaggaaacauuggagaaacauuaggagaaaaauggaaaagcagauuaaacgcauuaggaaaaagcgaauuucaaauuuacaagaaaucagggauccaagagguagaucgaacguuagcaaaggaagguauaaagcguggcgagacagaucaccacgcaguaucucgaggaagcgccaaauuaaggugguuuguagaaagaaaucuuguuacucccgaaggcaaggucgucgauuuaggauguggacguggcgguuggucauacuauugugguggguuaaagaaugugcgugagguuaaaggacuaacaaagggcggaccaggccaugaagaacccauacccaugucaacauaugguuggaaucuugugcggcugcaaaguggaguagauguauucuuuguuccgccggagcgaugcgacacacuuuugugcgauauuggcgaauccaguccuaauccaaccguagaagcuggaagaacacuaagaguauugaaccuugucgaaaacugguuaaauaacaauacucaauucugcgucaaaguccuaaauccauauaugcccagcguuauugaacguauggaaacacuacaaaggaaauacggaggagcccugguaagaaauccccugucaagaaauucaacgcaugaaauguacuggguaagcaaugcaucaggaaauaucguaaguucaguaaacaugauaucaagaauguugauaaauagguuuacaaugagacauaagaaagccaccuacgaacccgauguugauuuaggcucuggcacgagaaacaucgggauugaaagcgagacaccaaaucucgauauaauuggcaagcgaauagagaaaauaaagcaagaacaugaagcaaguuggcauuacgaucaggaucacccauacaagaccugggccuaucacgguaguuacgagaccaaacaaaccggaagugcaaguucaaugguaaacggaguuguacgacucuugaccaaaccaugggacguuguuccuaugguaacacaaauggcaaugacggauacaacaccauuuggacagcaacgagucuuuaaggaaaagguugauacgagaacucaggaaccaaaggaggggacaaagaaauuaaugaaaauuacagcugaaugguuauggaaagaauuaggaaaagagaaaacgccccguauguguacucgagaagaguucacuaagaaaguuaggucaaaugcugcccuuggugcaauuuucacagaugagaauaaauggaaaagcgccagggaagcaguagaagauaacagguucugggaauugguagauaaagaacgcaacuuacaucuagaagguaaaugugaaacgugcguuuacaauaugaugggaaaaagagaaaagaaacuaggcgaguuuggaaaggcuaaagguucaagggcuauaugguauauguggcuuggugcucgauuucuagaguuugaagcgcuaggcuuccucaacgaagaucauugguucagcagggagaacaguuugucagguguagaaggagaagggcugcacaaacuuggauacauuuuaagggaaguuucgaagaaagaagguggugccauguacgcggaugacaccgcgggaugggauaccagaauuaccaucgaagaccuaaagaaugaagaaaugauuacuaaccauauggccggagaacauaaaaagcuagcggaagcuauuuuuaaauuaacauaucagaauaagguaguuagagugcaacguccuacgccuagagguaccguuauggacauaauaagucgcagagaucaacggggaagcggccaggucggcacauauggacuuaacacauucaccaauauggaagcccaacucauacgucaaauggaaggugaagggauuuucaaaaguauucaacacuugacugcgucagaggagauugcagugcaagauuggcucguuagggucgguagggaaaggcucucccgaauggccauaucaggggacgauugcguaguaaaaccucuagacgaccguuucgcuagggcucuuaccgcacugaaugauaugggcaagguacggaaggacauccagcaaugggagccaucuagaggauggaaugauuggacacaaguacccuuuugcucucaccauuuccacgagcuuauaaugaaagacggccgaacucuaguuguaccauguagaaaccaggaugaacuaauagggagagcuagaaucucucaaggugcuggauggagcuuacgugaaacugcauguuuagguaaauccuacgcacagauguggucacuaauguauuuccauaggcgcgauuugcguuuagcugccaaugcgauuuguucagcaguucccagucauugggucccaacaaguagaacgacauggaguauucaugcaucgcacgaauggaugaccacagaagacaugcucacgguguggaacagaguauggauccuggaaaauccauggauggaagacaaaacaccaguugaaaguugggaagaaaucccauaccuuggaaaaagagaagaucaauggugcggaaguuugauuggacucacaaguagagcuacgugggcuaaaaauauacagacagcgauaaaccaaguaagaucacuaauagggaaugaagaauacacugauuauaugccaagcaugaagagauuuagaagagaagaggaagaagcggggguucucugguag

SEQ ID NO: 22302 - RNA, 9876 nt, Artificial Sequence
  derived and/or modified CDS sequence (opt6) from DENV-2__FJ906966__SS-prME
acagcugggaugauaaucaugcuaauuccuacuguuauggcauuucacuuaacaacaaggaauggugaaccacauaugauaguuucccgucaagaaaaagggaaaucauuauuguuuaaaacagaagauggggugaacauguguacauuaauggcuauggacuuaggcgaauugugugaagauaccauaaccuauaaauguccguuccuuaaacaaaacgaaccugaagauauagacuguugguguaacaguacuuccacauggguaacguauggcacauguacuacgacuggagaacacagaagagagaaaagaucaguugcacugguuccgcauguaggaaugggacuagaaacacgaacugaaacauggaugucuagcgaaggagcauggaaacaugcgcaacgaauugaaacuuggauacugagacaccccggcuucacaauaauggcugcaauccuagcauacaccaucggaacaacucacuuccaaagggcucuaauauuuaucuuacuuacagcaguagcacccucaaugacaaugagguguauagguauuucaaacagagauuucguagaaggcguaucugggggcaguuggguagauaucguacuugaacacggcucauguguuacaacaauggcgaaaaacaaaccaaccuuagauuucgaacuaauaaaaaccgaagcaaaacaaccggcaacccuuagaaaauacuguauagaagcaaaacuuacgaauacgacaacggauaguagauguccaacccagggugaaccuucuuugaaugaagaacaagauaaaagguuuguaugcaaacauaguaugguggaucgagguuggggaaaugguugugguuuguuuggaaaaggagggauugucaccugugcaauguuuacgugcaagaaaaauauggaaggaaaagucguccagccugaaaaucuagaauauacaauugugaucacaccccacagcggagaagaacaugcuguagggaacgacacaggaaaacauggaaaagaaauaaaaauaacaccccagucgaguauuacagaagcugaauuaacuggauauggaacuguaaccauggaaugcucuccuaggacuggguuagauuuuaacgaaaugguauuacuacaaauggaaaacaaagcgugguuaguacaccgacagugguuccuugauuuacccuuaccauggcugccuggagcugacacacagggccuuaauuggauccaaaaagaaaccuuaguaacauuuaaaaauccccaugccaagaaacaagauguaguaguuuuaggcagucaagaaggagcaaugcacacugcgcuaacgggugcaacagaaauacaaaugagcagugguaaucuacucuuuacugggcaucucaaaugcagauuacgcauggacaaguuacaauuaaaagggaugucauauagcauguguacagguaaauuuaaaguaguaaaggagauagcagagacacaacauggcacaauaguaauacgaguacaauacgagggggauggguccccuuguaagauaccauuugaaauaauggaccuagaaaaacgucacguucugggccgauugauuacagucaauccgaucgucaccgaaaaagauuccccaguuaauauugaggcagagccgcccuuuggugacagcuacauaauaauagggguugaaccaggccaauugaaauuaaacugguucaagaagggaucaagcauaggucaaaugauugaaaccacuaugagaggagcaaaacgaauggcaauauugggagauacagcuugggauuucgguagcuugggagguguauuuacuagcauagggaaagcucuccaccagguauuuggggcgaucuauggcgccgcguuuagcgguguuagcuggauuaugaaaauacuaauugguguuauaauaacauggauagguaugaacucucgauccacauccuugagugugucacuugugcuaguuggcguaguuaccuuguauuuaggaguaaugguccaggcagacucuggauguguugucagcuggaaaaauaaggagcugaaaugcggaaguggaauauucauaacagauaacguucauacguggacagaacaauacaaguuucaaccagagucaccaucuaagcuagccagugccauucagaaagcacacgaagaagguauauguggaauuagaagcgugacuaggcuagaaaaccugauguggaaacagauuacucccgaauuaaaccauaucuuaagugaaaacgaagugaaauugacaauaaugaccggagacauaaaaggaauaaugcaagcuggcaaaagaucgcuacaaccgcaacccacagaauuaaaguacucuuggaagaccuggggaaaagcuaaaaugcuaaguaccgagucucauaaccaaacuuuucuaauagacgggcccgagacggcagaauguccaaauaccaaccgcgcuuggaacucauuagaagucgaagauuacggcuuuggugucuucacuacaaacauuugguuaaaguuaagagaaaaacaagauguauuuugugauucgaaauugaugucagcggccauaaaagauaacagagcaguccacgcugauaugggcuauuggauagagagcgcacucaacgauaccuggaaaaucgagaaagcaaguuuuauagaagugaaaucgugucauuggccgaagucccacacguuguggaguaaugggguguuggagagugaaaugauuauaccgaaaaauuucgcugggccaguuucccagcauaauuaucguccaggauaucauacacaaaccgccggacccuggcauuuaggaaaauuagaaauggacuucgacuuuugcgaggggacaacugugguugugacagaagauugcggaaacagaggaccuaguuuaagaacuaccaccgcaaguggaaaauuaaucacggagugguguugucgaucguguacauuaccaccccuacgauaucgcggugaagacgguugcugguacggcauggaaauaagaccgcuaaaagagaaagaagaaaaucuaguaaauucccuaguuacggcaggacauggacaaauugauaauuucucucuagguguucuagguauggcauuguuucuggaagagaugcuacggacacggguaggaacuaaacaugcaauacucuuggucgcagucagcuuuguaacuuugaucacugggaauaugucauucagagacuuaggcagagugaugguuaugguaggagccacgaugacagacgauauuggaauggggguaacguaucuggcgcuucucgcugcguucaaaguuagaccgacuuucgccgcaggacuacuacugagaaaauugacuucuaaagaacugaugaugacaaccaucggaauaguauuguuaucacaaucuacaauaccggaaaccauucuugaauuaaccgaugcacuagcauuaggaaugaugguauuaaaaauggucagaaagauggaaaaauaccaacucgcuguuacaauuauggcaauccuguguguaccuaaugcaguuauuuuacagaaugcauggaaagucaguuguaccauauuggccguugugaguguuuccccacucuuccugacgucuucacaacagaaagcagacuggauaccacuagcguuaacuauaaaaggucuaaauccuacggcuauauuucuuacaacuuuaagucgcacgaacaagaaaaggucguggccauuaaacgaggcaauaauggcagucgggaugguaaguauuuuagcaucaucauuguugaaaaacgacauuccuaugacuggcccgcuaguggcugguggccuacuaacgguauguuauguuuuaaccggucgcucugcggaccuagaguuggaacgagcugcagacguuaagugggaagaccaagcugagauauccggaaguucuccaauacuuaguaucacaauaagugaagacggaagcaugaguaucaaaaaugaagaagaagaacaaacauuaaccaucuuaauacggacagguuuauuaguuauaucaggcuuauucccuguauccauuccaauaacagcugcugcgugguaucuaugggaaguuaaaaagcaaagagcuggagugcuaugggaugugcccaguccuccaccaguaggcaaggcggaauuagaagacggugcauacagaauuaaacagaagggcauucuaggguacucgcaaauuggugcuggaguauauaaagaaggcaccuuucacacaauguggcaugucacacgaggugcaguucucaugcacaaagguaagagaauagaaccgagcugggcugaugucaagaaagaucuuauuucguacggaggggguuggaaauuggagggggaauggaaagagggggaagaaguacaaguauuagcuuuagagccagguaaaaacccaagagcugugcagacaaaacccggccuuuucaaaacgaaugcggguacgauuggggccgugucauuggauuucucuccagggacguccggaaguccgauaaucgauaaaaagggcaaagucgugggacuguacgguaauggaguagugacaagaucaggugcuuacguaucugcaauugcacaaacugagaaaucaauagaggauaacccugaaauagaggacgauauuuuucgaaagaggaaacucaccauaauggauuuacaucccggagccggcaaaacuaaaagauaucugccggcuauaguucgagaagcaauuaaacgcggacugcggacccuaauacucgcaccaacuagaguagucgccgcggagauggaggaagcccuccgcggacuaccaauuagauaccaaacgccagcaauacgagcagaacacacgggcagagaaauuguagauuugaugugccacgcuacauucacuaugaggcuacuuucaccgguucgaguaccgaauuauaacuuaauaauuauggacgaggcacauuuuacagaucccgcaagcauugccgcucguggcuauauuaguacucgugucgaaaugggcgaagcagcaggaauauuuaugacagcaaccccacccggaaguagagacccauuuccgcagucaaaugcgccaauaauggacgaggaacgagaaauuccagagagaucuuggucaucuggucaugaaugggucacagauuuuaagggaaagacagugugguuugucccaucaauaaaagcugggaaugauauugcggcaugucugaggaaaaacggcaagaaagugauacaauuaucacgaaaaacguuugauucagaauacguaaaaacucgcaccaaugauugggauuuuguagugacuaccgauauaagcgagaugggugcaaacuucaaagcggagagaguuauugacccuaggagguguaugaaacccgucauucuaacugauggcgaagaacgaguuauacuagcaggaccaaugccgguaacucauaguagcgcagcgcaaagacgagggcgaauuggaaggaacccgaagaaugagaaugaccaauacaucuacaugggagaaccuuuggaaaacgaugaagauugcgcacacuggaaagaagcaaaaaugcucuuagacaacauuaauacgccagaaggaaucauacccucaauguucgagccggagagagaaaagguugacgcaauagacggagaauauagacuaagaggagaagcacgaaaaacauuugucgaucucaugaggaggggagaccugccaguguggcuagcuuauagaguagcugcugaggguaucaauuacgcugaucgacgauggugcuuugauggaauaaagaacaaccaaauauuagaagaaaacguagagguagaaauauggacuaaagaaggcgaacguaaaaaguuaaaaccaaggugguuagacgcacgaaucuacagugacccauuagcuuuaaaagaguucaaggaguucgcugcgggaaggaaaucccuaacucuaaauuuaauaacugaaauggguaggcuaccaacuuuuaugacacaaaaagcacgagaugccuuagauaaucuagcaguauuacauacugcggaggccgggggucgagcauauaaccaugcgcuaagugaauuaccugagaccuuggaaacccuauuauuauuaacuuuauuagcgacugucaccggaggaaucuuucuuuuccucauguccggacgaggaauagggaaaaugacacuaggaaugugcugcaucauuacagccucgauucucuuaugguacgcacagauccaaccacacuggauugccgccucaauuauuuuagaauuuuuccuuaucguucuacuaaucccggaaccugagaagcaaagaacaccccaggacaaucaauuaacguauguaguaauagcaauacuaaccgugguugcagccaccauggcaaaugaaauggguuucuuggagaaaacuaagaaagauuuaggacugggaucuauaaccacccaacaaccagaaucaaacauacuagacaucgaucuucgacccgcuucggccuggacacuuuaugcaguagcgaccacauuugugacgccgaugcugcgacacaguauugaaaacucaagcgugaacguuucacugacggccauagcuaaucaagcuacaguauuaaugggucuaggaaagggguggccauuauccaaaauggauauaggugugccauugcuagcaauugggugcuacagccaagucaauccaauuacguuaacagcugcacucuuucuccuaguggcacauuaugcuauuauuggaccuggauugcaagcuaaggccacacgggaggcgcagaaacgggcagcagcuggaauuaugaagaauccaacaguagaugguauaaccgucauagaccuggacccgaucccguaugaccccaaauuugaaaagcaacuugggcaagugauguugcucguacuaugcguuacccaaguucuaaugaugagaacuacuugggcuuuaugcgaagcgcuaacauuagcgacagggccaauuuccaccuuaugggagggaaauccaggucgauucuggaacaccacgauagccgugucaauggcuaauaucuuuagagguucauaccuugcuggagcgggucugcuauucucuauaaugaaaaauaccacaaauacgagaagaggaacuggcaauauaggagaaacacuuggggagaaauggaaaucucgacugaaugcacucgggaaaucagaguuccaaauauauaaaaagucgggaauacaagaaguagaucguacgcuagccaaagaagggauaaagagaggggaaacugaucaucacgcugugucaagagggucagcaaaauuacgaugguuuguagaaagaaacaugguaacaccugaaggaaaagucguugaucuaggcugcggucgggguggguggagcuacuacugugggggacucaaaaaugucagagaaguaaaaggauugacaaaaggagguccgggacacgaagaacccauaccaaugaguacauaugguuggaacuuaguaagacuacaaagugguguugacguauucuuuacaccuccugaaaaaugcgacacacuccuuugugacauuggggaaaguucaccuaaccccacggucgaagcaggucgcacgcuacguguguuaaacuuagucgagaauugguugaacaacaauacacaauuuuguaucaaggucuuaaaucccuauaugccaaguguuauagaaaagauggaagcacuacaacguaaauauggaggggcccuagugagaaacccccuaucacguaauucuacacaugaaauguauuggguuaguaaugcaucggggaauaucguaucaaguguuaacaugauaucaaggauguugaucaacagguuuacaaugagacacaagaaagcuacauacgaaccggauguggauuugggaagcggcacaagaaauauuggcauugaaagugaaaucccuaauuuggacauuauuggcaagagaaucgaaaagauuaaacaagaacaugaaacaucauggcauuaugaucaagaccauccauacaaaaccugggcguaucacgggagcuaugagacaaagcaaacggguucagcaaguaguauggugaauggaguuguucguuuauugacaaaaccgugggauguaguuccaaugguuacucaaauggccaugaccgacacaacgccguuuggucagcaaagaguauuuaaagagaaaguagauacaagaacucaagaaccaaaagagggaaccaaaaagcucaugaaaaucacagcagagugguuauggaaagaacuuggcaagaagaaaacaccacgaauguguaccagacaagaauuuacuagaaaaguucggucaaacgccgcccuuggagcaauauuuacugaugaaaauaaauggaagagugcccgugaggcaguagaagacucgcgauucugggaauugguagacaaagagcgaaaucuccauuuagagggcaaaugcgaaacuuguguauacaacaugaugggaaagagagagaagaaacuuggagaguuugggaaagcaaaggggagccgagcaauaugguauaugugguuaggagcucgcuuccuugaguuugaggcguugggauuccuaaaugaagaucacugguuuucaagggaaaauucuuuaaguggcguagagggagaaggacuucauaaacuuggcuauauuuuaagggaugugagcaagaaagaaggaggagcaauguaugcugacgauacagcugggugggacacaagaauaacuuuagaggaucugaagaaugaagaaauggugaccaaucacauggaaggugaacauaaaaaguuggcugaagcaauauucaagcuaacguaucagaacaaggucgugagaguccagcgaccaacuccacgaggcacaguuauggauaucaucuccagaagagaucaacgcgguucuggacaaguagggacuuauggauuaaauacguuuacgaauauggaagcccaauuaauacgucaaauggaaggggaaggcguauucaaguccauacaacaucuaacugucacugaggaaauugcagugcaaaauuggcuagccaggguaggucgcgaaagacucagccgaauggccauuucuggagaugacugcguuguaaaaccucuugaugaucgcuuugcgucagcacucacugcucugaacgauauggguaagguuagaaaagacauccaacaaugggagccgagcagagguuggaaugacuggacacaaguaccauuuuguucucaccacuuccacgaacucaucaugaaagauggaagaguacugguaguaccaugucgcaaccaagacgaacuuauaggaagggcaagaauuucucaaggggccggcuggagucucagggagacagcaugcuuaggaaaaucauacgcucaaauguggagucuuauguacuuucacaggcgugauuuacgauuagcagcaaacgcaaucuguucagcagucccaucgcacuggguuccaacaucuagaacuacauggucuauacaugcaaagcaugaauggaugacuacugaagacaugcuuacgguauggaaucgcguuuggauccaggaaaauccuuggauggaggauaaaacuccaguagaauccugggaggaaauaccuuauuuagggaaacgagaggaccaauggugcggaucuuuaauagguuugacaaguagggcaacgugggccaaaaauauacaaacagcaauuaaucaaguacgaagccuuauugggaaugaagaguauacagauuacaugccgucaaugaagagauuuaggagagaagaagaagaagccggugugcuaugguaa

SEQ ID NO: 22303 - RNA, 9876 nt, Artificial Sequence
  derived and/or modified CDS sequence (opt6) from DENV-2__FJ906968__SS-prME
acagcaggaaugauuauaaugcuaauucccacggucauggcauuccaccuuacaacaagaaauggagaaccucauaugauuguuagcagacaggaaaaaggaaaaagucuccuuuuuaaaacugaagaugguguuaauauguguacucuuauggcuauggauuugggcgaacuuugcgaagauaccauaacauacaaauguccauuucugaaacaaaacgaacccgaagauaucgacugcuggugcaacucuacaucaacguggguuacauacgguaccuguacgacaacaggagaacaucgacgugaaaaacgaucaguagcucugguuccccaugugggaaugggcuuagaaacaagaacagaaacauggaugagcucugaaggagcauggaaacacgcacaaagaauugaaacguggauucugagacauccaggcuucaccauuauggcagcaauuuuagcguauacuauagguacaacacacuuucaacgagcuuuaauuuuuauacuacucaccgccguagcgcccucgaugacuaugagaugcauuggaaucucgaauagagacuucguggaaggggucaguggagggucauggguagacaucguauuagaacauggaaguuguguaaccaccauggcuaaaaacaaaccuaccuuagauuuugaacugauuaaaacugaggcaaaacaaccugcaacauugagaaaauauugcaucgaagcaaaacuaacaaauaccacgacugacucacguuguccuacacaaggagagccaagccucaacgaggagcaggauaaacgcuucguauguaaacacagcaugguagauagaggauggggcaauggaugcggucuuuucggaaaaggugggaucguaaccugugcaauguuuacuugcaagaaaaauaugaaagggaaagucguucaaccagagaaccuagaauacacuauagucauaacuccacauuccggcgaagaacacgcugucggaaaugauacuggaaaacaugguaaagaaauaaaaauaacaccucaaaguagcauaacagaggcugagcuuacaggguacgggacuguuaccauggaauguucacccagaacuggucucgacuuuaaugaaaugguuuuacuccagauggaaaauaaagcaugguuaguucaccgacaaugguuccuagaucuaccacuaccauggcuuccgggagcggauacccaaggaaguaauuggauccaaaaagaaacauuggugacguucaaaaacccacacgccaagaaacaagacguuguuguacuaggaucucaggaaggugccaugcauacggcuuuaacaggcgccacggagauacaaaugucuagcggcaacuuacucuucacuggccauuuaaaauguagauuacgaauggauaaauuacaauuaaaaggcaugagcuacucgauguguacaggcaaauuuaaagucgugaaagagauugcagaaacucaacacgguacgauuguaauaaggguccaauaugagggagacggaucaccgugcaaaauaccuuucgaaauuauggaccuugagaaaagacacguucuggguagguuaauuacaguuaauccuauaguaacugagaaagauucaccagugaauauagaagcagagcccccuuuuggagacucauacauaauuaucggcguugagcccggacagcuuaaacuuaauugguucaagaaaggcagcaguaucggacaaaugauagaaacgacuaugcggggagcaaaaaggauggcgauuuuaggugauacagcaugggauuuugguagucuaggagguguauucacaaguauagggaaagcgcuacaucagguuuuuggugcaaucuauggagccgcguuuucaggagucaguuggaucaugaaaauauuaaucggaguaauaauaacauggauugguaugaacucaagaagcacaucuuuaagugucucguuggucuuaguaggaguaguaacccuuuauuuaggaguaaugguccaggcagacagugguuguguaguaaguuggaaaaacaaagaauuaaaaugcggaaguggcauuuuuauuacagacaacguucauacauggacagagcaauauaaauuucagccugaaaguccuucaaaauuggcaucagcuauccagaaagcucacgaagaaggaauauguggaauaagaucaguuacacguuuagaaaaucuuauguggaaacaaauuacacccgaguuaaaucauauauuaucugaaaaugaaguuaaacuaacuaucaugacaggggacauaaagggcauuaugcaagcgggaaaaagaagucuucaaccgcaaccgaccgaauugaaguacucuuggaaaacauggggaaaagcuaagauguuaucaacggaaucccacaaccagacauuuuuaauagacggaccagaaacagcagaauguccaaauacaaauagagcguggaacucacuagagguggaagauuauggguuuggaguauuuacuacgaauauauggcucaaguuacgggagaagcaggauguauucugcgacaguaaacuaaugucagcugcgaucaaagacaauagggccguucaugcagauaugggauauuggauugaauccgcauuaaaugacaccuggaaaauagaaaaagcgucguucauagaaguaaaaucuugucacuggccuaagagucacacauuauggagcaaugaagugcucgaaagugaaaugauuauacccaaaaacuuugcgggaccugugucucaacacaacuacagaccuggcuaucauacacaaacggcugggccauggcauuugggaaaauuagaaauggauuucgauuuuugcgaagguacgacaguagugguuaccgaggauugcggaaauaggggaccuucgcuaaggacaacaacugcgucaggaaaacucauaacugaaugguguugcaggucgugcacauuacccccauugcgauaccgaggagaagauggauguugguacggaauggagauacgaccucugaaagaaaaagaagaaaauuuagugaacucgcuagucacggcuggccaugggcaaauagauaauuucucacuaggaguucuaggaauggcgcuguuccucgaagaaaugcuaagaacgagaguuggcacgaaacacgcuauucugcucguagcgguguccuuuguaacccuaauaacuggcaacaugucauuccgcgaccucgggagaguaaugguaauggucggagcaacgaugacagaugacauaggcaugggcguaacauacuuagcucuuuuggccgcauuuaaaguuaggccgacauucgcagcuggauuacuacuaagaaagcugacaagcaaagaguuaaugaugacaacgaucgguaucguacuauuaucacaaucaacuauaccggaaacaauacuagaauuaacagaugcauuagcccugggaaugaugguauuaaaaauggugagaaaaauggaaaaguaucaauuagcggucacaauaauggcgauccuuugugugccgaacgcgguaauccuccaaaacgcuuggaaaguaucauguacaauucuagcaguaguaucugugucccccuuauuucuaaccucaucgcagcaaaaggccgauuggaucccauuagcacuaacgauuaaaggacuaaauccuacagccauuuucuuaacgacauuaucacguacaaacaagaaaagaagcuggccacuaaaugaagcaauaauggcagugggcaugguaaguauuuuagcaaguucgcuuuuaaagaaugacauaccaaugacuggcccacugguagcugguggguugcuaaccguaugcuauguauuaaccgguagaucugcggacuuagaauuggaaagagcagcugacguaaaaugggaggaucaggcagagauaaguggaagcucuccaaucuugagcauuacaaucucagaagacggaucgaugagcaucaaaaacgaagaagaagaacagaucuuaacaauucuuauacgcacgggauuauuaguuauauccggccuauuuccgguaucgauaccgaucacggcagcagcauggugcuuaugggaggucaagaaacaaagagcggguguacuaugggauguaccaaguccgccuccaguaggaaaagcugaauuagaggauggagcauaucgaauuaagcaaaagggcauuuugggauauucgcaaauaggcgcaggaguuuauaaggaaggaacauuccauaccauguggcauguaacaagaggagcgguacuaaugcacaaaggcaaacgaauagaaccuucuugggcagauguuaagaaagauuugauauccuacggggguggcuggaaauuagaaggggaauggaaagaaggagaagagguucaaguauuagcucuagagccugguaaaaauccaagagccguccaaaccaagccaggauuauuuaaaacgaaugcaggaacaaucggagcgguuucucuggacuucucucccggcacaagcggaucuccuauuaucgauaagaaagggaaaguuguaggucucuauggaaauggagugguaacacgaagcggagcuuauguuagugccauagcucagacagagaaaaguauugaagauaauccagaaauagaagacgauauuuuucgaaagcguaaguuaacaaucauggauuuacauccuggagcaggaaagacaaaacgguaucuucccgcuaucguuagagaggcgaucaaacgaggacuucgaacauuaauacuagccccgacgagagugguugccgcagagauggaggaagcauuaaggggcuuacccaucagauaucaaaccccugcaauucgugcagagcauacggggagagagaucguugauuuaaugugccaugcaacuuucacaaugcgauuguugucuccuguacgaguacccaauuauaacuuaauuauaauggaugaggcucauuuuacagauccagcaucaauagcagcacgaggguauauuaguacccgcgucgaaaugggagaagcagcaggaaucuuuaugacugcuaccccaccugggaguagagaccccuuuccccaaagcaacgccccaauuauggacgaggagagagagauaccggaacgaaguuggucuaguggacaugaauggguuacagacuuuaaaggaaaaacagucugguuuguacccagcauaaaggccgggaaugauauugcagcgugccuaagaaagaacgggaagaaaguaauccaacucucccgaaagaccuucgauagugaauaugugaaaacaaggacaaacgacugggauuucguaguaacuacugacaucucagaaaugggugcgaauuuuaaagcagaaagaguaaucgacccuaggcgauguaugaagccuguuauauuaacagauggagaggaacggguuauucuagcagguccaaugccaguuacucauuccucugcagcacaaaggcgagggagaaucggacguaauccuaagaaugaaaacgaccaguauauuuauaugggugaaccacuugaaaaugacgaagacugugcgcauuggaaggaggcuaaaaugcuuuuagauaacauuaauacacccgaagguaucaucccuucaauguucgaaccggaacgcgaaaaagucgacgccauugauggcgaauaccgucuacguggcgaggcgcgaaagacauucguugauuugaugagacgaggcgauuuaccaguauggcuugcuuauagaguugccgcugagggaauuaacuaugcagacagacguuggugcuucgauggaauuaaaaacaaucaaauacuggaggaaaacgucgaaguagagaucuggacgaaagaaggcgagcguaagaaacuaaagccaagguggcuugacgcuagaauauauucugauccucucgcacugaaagaguucaaagaguuugcugcugguaggaaaucuuuaacgcuaaacuuaauaacagaaaugggaagacuacccacauuuaugacucagaaagcccgagacgcccuugauaaccuggcuguauuacauaccgcagaagccgguggaagggccuacaaucaugcccuuagcgaacuuccugaaacauuagaaacacugcuucugcucacccucuuagccacuguaaccggagguaucuuccuauuuuuaaugagcgggagaggaauagguaaaaugacccuuggaaugugcuguauuauaacugcaucaauauugcuaugguaugcgcagauacaaccucauuggauagcugcgucaauaauccuggaguucuuucuaauagucuugcuaauuccugaaccagaaaaacaaagaacgccgcaagauaaucaacugacauauguugugauagccauucucacuguuguugcagcuacgauggcuaacgaaaugggauucuuagagaaaacaaagaaagaucucggccugggaucaaucaccacacaacaaccagagucaaacauauuagauauugaccuaagaccugcaucagcuuggacccuauacgcuguugcaacgacuuuuguuacgccuaugcuacgccauucuauagaaaauaguucaguuaauguuucuuuaaccgcaauugcgaaucaagcuacagucuugauggguuuaggcaaagguuggccguugagcaaaauggauauaggaguuccacugcuagcaauaggaugcuacagucaagucaauccuauaacccucaccgccgccuuauuccuacuuguggcucacuaugcaaucauagggccuggauuacaagcgaaggcgacgagagaagcgcagaaaagggcagcugcuggaauuaugaagaaccccacuguagauggcauaacgguaaucgaucuggauccaauucccuacgaucccaaguucgagaagcaacuaggacagguaauguugcuaguucuaugcguaacucagguacuaaugaugagaacaacuugggcgcuaugugaggcuuuaacauuagcgaccgguccgaucucuacauuaugggaggguaaccccggcagauuuuggaauacaacaauugccguaucuauggcgaacauauucagggguucauauuuggccggugccggauuauuauuuaguauaaugaaaaauacgacuaauacaagaagagguacaggcaacauaggggaaacuuugggagaaaaguggaaaucacgccuaaaugccuuaggaaaguccgaauuucagauauacaagaaaucuggaauacaggaaguggaucguacauuagcaaaagaaggcauaaagcguggugaaacggaucaccacgcaguuucacguggaagugcaaaauuacguugguucguugaacgaaacaugguaacaccagaaggaaagguuguagauuuagguugcggcaggggcggguggucguacuacuguggaggacuaaagaacguccgcgaaguuaaaggauuaaccaaagggggcccuggacaugaagaacccauuccuaugaguacuuacggauggaacuuagugcgauugcaaagcgguguugacguuuucuuuacaccaccagagaaaugcgauacacuucuuugcgacaucggagagucuaguccaaaucccacuguagaagcugguagaacauuacgcgucuuaaaucuaguugaaaacuggcugaauaauaauacccaauuuugcauuaaaguacuaaauccuuacaugccauccguaauagaaaagauggaagcacuccaaaggaaauaugguggugccuuagugaggaacccccuaaguaggaauaguacucacgagauguauuggguuucaaaugccagcggaaauauaguaucgagcguaaacaugauaucaagaaugcugauaaauagguuuacgaugagacacaagaaagcaacuuaugaacccgauguugaucuuggcucugguacccgcaauaucggcauagagucagaaauaccaaauuuagacauuaucggaaaacgcauugagaaaauuaaacaagaacacgagacuagcuggcacuaugaucaagaccaccccuacaagacaugggcguaccauggcucauacgaaaccaaacaaacaggcagugcuucuagcaugguaaauggagucguucgcuuauuaacaaaaccgugggacgugguaccaaugguuacccaaauggcaaugacagauacuacacccuucggacaacagaggguguucaaggaaaaaguugacacucgaacucaagaaccuaaagaagguacgaagaaacuuaugaaaauuacggccgaauggcucuggaaagaguuagggaaaaagaaaacuccgagaauguguaccagggaagaauuuacacggaaagugagaagcaaugcagccuugggggcgauauucacagacgaaaacaaauggaaaagcgccagagaagcgguugaagauaguagauucugggagcuaguagauaaagaacgaaaccuacaucucgaggguaaaugugaaacaugugucuacaacaugauggggaaaagagaaaagaaguuaggcgaguucgguaaggcaaagggaucucgagcaauaugguauauguggcuaggcgcacgcuuucucgaauuugaagcacuaggauuccuaaaugaggaucauugguuuucacgugaaaacaguuuaucaggaguagagggugaagguuugcacaaguuaggcuacauacugagagacguuuccaagaaagaagguggagccauguacgcagaugauacagcgggaugggacacaaggauaacucuagaagacuugaaaaaugaggaaaugguaacaaaccacauggaaggagaacacaagaaacuagcugaagcuaucuucaaguuaacauaccagaauaaaguuguccgcgugcaacgaccaacuccuagaggaacaguaauggacauaauuucuagaagagaucagaggggcucaggacagguaggaacauauggacuaaacacuuuuaccaauauggaagcucagcuuauucgucaaauggaaggugagggaguguucaaaagcauacaacacuuaacaguaaccgaagaaauagcaguacagaacugguuagcuagaguagggcgcgaacgacugagucggauggcuauuaguggcgacgauugcguaguaaagccgcucgaugauagauucgcaucagcacuuaccgcccuaaaugauaugggaaaaguaagaaaagauauacagcaaugggagccaagucggggauggaaugacuggacucaggucccuuuuuguagucaucacuuucaugagcuaauaaugaaagauggacgugugcuaguaguuccaugucgcaaccaagaugaacuaauaggacgggcacggauuucucaaggagcuggcuggagucuucgagaaacagcuuguuuagguaaauccuaugcucagaugugguccuuaauguauuuucaccgucgcgauuugcgacuugcagcaaacgcuauauguucugccguuccaagucauuggguaccaacaaguaggacaacauggucuauccaugcaaagcaugaguggaugacuacagaggauaugcuuacagucuggaaccggguguggauacaagagaaccccuggauggaagauaaaacuccaguggaaucuugggaggaaauuccuuacuuaggcaaacgcgaggaccaauggugugguucgcugauagguuuaacaucaagggcaaccugggccaaaaauauacaaacugcaauuaaccaagucaggagcuuaaucgguaaugaagaauacacagacuacaugccguccaugaaaagauuucgaagagaagaggaggaagcgggugugcuaugguag

SEQ ID NO: 22304 - RNA, 9876 nt, Artificial Sequence
  derived and/or modified CDS sequence (opt6) from DENV-2__FJ906969__SS-prME
acugcagguaugauuauaaugcuaauaccgacaguuauggccuuccacuuaacaacacgaaauggugaaccucauaugauaguaucuagacaagaaaaaggaaaaucuuugcuuuucaaaacagaagacggcguaaauaugugcacacugauggcuauggauuuaggcgagcuaugugaagauacaauuacuuacaaaugccccuuucuaaaacaaaacgaaccagaagauauagauuguugguguaacucgacgucuaccugggugaccuaugggacauguaccacaacuggggagcaccgacgcgaaaaacguaguguagccuuaguaccgcacguuggaaugggucuugaaacaagaacagaaacauggaugucaucugaaggugcauggaaacaugcccaacgaauagaaacauggauucuaagacauccaggauucaccauaauggcagccauucuugcauauacaaucgguacaacgcacuuucaaagagcacucauauuuauccuacuaacugcaguggcccccagcaugaccaugcgauguauaggaauaucaaauagagauuuuguagaaggcguuucaggcgggucguggguggacauaguccucgaacaugggagcuguguaacaacgauggccaaaaacaaaccgacauuggacuucgaauuaaucaaaacagaagcaaaacagccagcuacacuaagaaaauauuguaucgaggcaaaauuaacaaauacaacaaccgauucaagauguccgacacaaggggaacccagccuaaacgaggagcaggauaaacgauuugucuguaaacauagcaugguggaccgaggcuggggaaacggguguggguuauucgguaaagggggaauuguaacaugugcaauguucacgugcaagaaaaacaugaaagguaaaguaguccaaccagagaaccuggaauauacaauaguaauaacaccucauaguggagaagaacaugccguagguaaugacaccggaaaacauggcaaagagauaaaaauaacaccccaaaguagcauuacugaagcugaacuaacgggcuaugguacaguuacuauggagugcagcccaagaacggggcuggauuuuaaugaaauggugcuauuacagauggaaaacaaagcauggcuuguacaucgccaaugguuucuagauuuaccccucccauggcuuccgggugcagacacacaaggcucaaauuggauucaaaaagaaacucuuguaacuuucaaaaauccucacgcaaagaaacaagauguggugguacuugggagucaggaaggagcuaugcacacugcuuuaaccggcgcaacugaaauccaaaugucgucgggaaaucugcuuuucacaggccaccuaaaaugccguuuaagaauggauaaauuacaacucaaaggaaugucuuacucaauguguacaggcaaauuuaaagugguaaaagaaauagcagaaacucaacacgggaccauagucauacgaguucaguacgaaggcgacggaucuccaugcaaaauaccauuugaaauuauggaccuugagaaacggcauguuuuaggucggcucauaacuguaaauccaaucguuacagaaaaagacucacccguaaacaucgaagcagagccaccuuuuggugauucauauauaauaauuggggucgagccgggucagcuaaaacuaaauugguuuaagaaaggaucauccauaggacaaauguuugaaacgacuaugcgaggcgcaaaaagaauggcaauacucggagauaccgcaugggacuucgguucuuuaggcggugucuuuaccucuauaggaaaagcguuacaccaaguauuuggugcuauuuacggcgccgcauuuucuggagucaguuggaucaugaaaauauuaauuggcguuauuaucacauggauagguaugaauagccguucuacaucacuuucuguuagcuuaguauugguagguguaguaacauuauaucuaggaguaaugguccaagcagacaguggaugcguugugucguggaaaaauaaagaacuaaaauguggauccgggauauuuaucaccgauaauguacauaccuggaccgaacaguauaaauuccagcccgagaguccuucaaaacucgcaucggcgauccaaaaagcacaugaagaagggauaugugguauacgaucagucacgagacuugaaaauuugauguggaaacagauuacuccggaauuaaaucauauacugucagagaacgaagugaaacucacaauuaugacaggcgauauaaaaggcaucaugcaagcuggcaaacgaucguuacagccucaacccacggagcuuaaauauucuuggaaaacauggggaaaagcuaaaaugcuaagcacagaaagccauaaucaaacauuucuaauagauggaccagaaaccgcugaaugcccaaauacaaaccgcgcauggaacuccuuagaaguugaggauuauggauucgggguauuuacgacaaauauuuggcuaaaacucagggaaaaacaagaugucuuuugugauucaaaacuaaugucugcugcgauaaaagauaauagagcgguccacgcagauaugggguauuggauagaguccgcauuaaaugauacguggaaaauagaaaaagcauccuucauagaaguaaaaagcugccauuggccaaaaucacacacauuguggagcaauggaguucuagaaucagaaaugaucauacccaagaauuucgcaggacccguaucucaacacaauuacaggccuggauaccacacacagacggcugguccguggcacuugggaaaacuagaaauggacuuugauuucugugaagggacaacaguuguaguuacugaggacugcgggaaucguggaccuaguuuacggaccacaacagccucaggaaaauuaauuacugaauggugcugucgaucguguacgcuuccuccauuaagauauagaggcgaggacgguuguugguacggaauggaaauacggccacuuaaggaaaaagaagaaaauuuaguaaacagucuuguuacggcagggcauggacaaauagacaauuuuucacugggcguacuggguauggccuuauuuuuagaggaaaugcuacgaacacgaguagguacaaaacaugcaauauuacuugucgcaguaucauucguaacucuuauuacuggaaacaugagcuuucgagaucuggguagaguaaugguuauggucggagcaaccaugacagaugauauagguaugggaguaacauaucuagcguuacuagcagcuuuuaagguuaggccuaccuucgcugcuggauuauuauuacgaaaacuaacgagcaaggaauugaugaugacuacuauagggauaguauuguugucucagaguacaaucccagagacuauauuggaauuaacggacgcauuggccuuggggaugaugguuuuaaaaaugguaagaaaaauggagaaauaccaacuagcugugacaauaauggcuauauuauguguacccaaugcaguuauacuacaaaaugcuuggaaaguaaguuguaccauauuagcugugguaucaguuucaccccuuuuccuaacuucaagucagcaaaaagcagauuggauaccauuagcguugacuauaaaaggacuaaaccccacagccauuuuucucaccacucuaaguagaacaaauaagaaaagauccuggccacuaaacgaagcaauaauggcugucgguaugguaaguauuuuagcauccucucuccucaagaacgauauaccuaugacuggucccuugguagcagggggcuuacuaacaguuugcuacguacuaacaggacgcagugcugauuuagaauuagaaagagcggcagauguaaaaugggaagaccaagcggaaauuuccggcuccucuccaauccugucaaucacuauaagugaagacgguucaaugaguaucaaaaacgaggaagaagaacaaaucuuaacaauauuaauaagaacagguuuauuagucauaaguggcuuauucccgguauccauacccauaaccgcugcagcguggugucugugggaagucaaaaagcaacgggccggaguucuaugggacgucccaagcccaccucccguaggaaaagcugaauuagaagauggagcauaccgcauaaaacaaaaaggcaucuugggauauucgcaaauaggggccggagucuacaaagagggcacguuccauacuauguggcacguuacuagaggggcggugcuaaugcauaagggcaaaaggauagaaccaaguugggcggacguuaagaaagaucugauaaguuauggugguggauggaaacuggaaggugaauggaaggagggugaagaaguacaaguguuagcgcucgagccagggaagaacccucgagcuguacaaacaaaaccuggucuuuucaaaacgaaugcuggaacaauuggcgcaguaucccuagauuuuucuccugggacaaguggaagcccgauuauagauaagaaagguaagguaguaggguuguauggcaauggaguugucaccagaagcggagcuuaugucagugcgauagcacaaacagagaaauccauagaagauaaucccgaaauugaggaugauauauuuagaaaaagaaaacuaacaauaauggauuuacacccgggcgcagguaaaaccaagcgauacuuaccugcaauuguuagggaggccauuaaaagagguuuacgcacacugauacuagccccuacccgaguuguggcagcggagauggaagaagcucuacgcggucuacccauuagguaccaaaccccagcgauacgagcggaacacacagggcgagaaauaguagauuugaugugucaugcuaccuucacaaugagacuauuaucaccuguucguguaccuaauuacaaucugauaaucauggacgaagcucauuucacagauccugccucaauagcagcccgugguuauauaucaacucgcguggagaugggagaagcagcagguauauucaugacagcuacaccacccgguuccagagauccuuuuccgcagucgaacgcgccuaucauggacgaagaacgugaaauaccggaaaggucguggaguucaggacaugaauggguaaccgacuuuaaaggcaagacugugugguucgugccaucaauuaaagcaggcaaugauaucgcagcaugccuccggaaaaacgguaagaaaguuauacaacucucacggaaaacauuugauagugaauauguaaaaacccgaacaaacgauugggauuuugugguuacaacagauauaucagaaaugggcgcaaauuucaaagccgaaagagugaucgacccuagaagguguaugaaaccaguaauccuaacagauggugaggaacguguuauauuagccggaccgaugccuguaacacacucaucggcugcccagagaagaggucgaauagguagaaacccuaaaaaugaaaaugaccaauauauauacaugggugaacccuuagaaaaugaugaagauugugcucauuggaaggaggcaaaaaugcugcucgacaauaucaauacccccgaaggaauaaucccaucaauguuugaacccgaacgugagaaaguugaugccauagacggggaauaccgacugaggggugaagcacgcaagacauucguugaucuaaugagaaggggagacuugccagucuggcuagccuaucgaguugccgccgagggaauuaacuacgccgaucgcagauggugcuuugaugguauuaaaaauaaccagauuuuggaagaaaauguggaaguugaaauauggacuaaagaaggugaaaggaagaaacuaaaaccucgaugguuagacgcgagaauuuacucggauccauuggcauuaaaagaauuuaaagaguucgcggcuggacgcaaaagucuuacucucaaucugauaacggaaauggggcgccuucccaccuucaugacacagaaggcccgugacgcgcuggauaauuuagccguacuacauacagcagaggcaggaggucgggccuauaaccaugccuuguccgaauugccagaaacacucgaaacguugcuauuauuaacuuuacuagcuacgguuacgggaggaauuuuucuuuuccuuaugaguggccgugggauagguaaaaugacuuuagguaugugcuguauaauaacagcaaguauuuuacuuugguaugcucaaauccagccacauuggaucgcagccucaauuauuuuagaguucuuucuaauagugcuauuaauuccagaaccugaaaaacaacguacaccgcaagauaaucaauuaaccuacgugguaauugcuauauuaacagucguugcggccacuauggccaaugaaaugggauuucuagagaaaacaaagaaagaucuaggacugggaucgauuacaacacaacaaccggaaucaaauauucuagauauugacuuaagaccugcuucggcauggacucucuaugcagucgcaacaacuuuuguaacacccaugcugagacauagcauugaaaauagcucagucaaugugucuuugacagcaaucgccaaucaggcaacugugcuaauggguuuaggcaaaggauggccauuguccaaaauggauauaggagugccucuuuuagcgauaggcugcuauucacaggugaacccuauaacacugacagcagcauuauuucuauuaguugcccauuaugccauaaucggucccggacuacaagcaaaagcaacaagagaagcucaaaagagagcugcagcugguauaaugaaaaauccaacuguggacgguauuacagucauagacuuagaucccauacccuacgacccaaaauuugagaagcaguuaggacaaguaauguuguuaguacugugcguuacacagguccuaaugaugagaacuacaugggcacuaugcgaggcccuaacucucgcgacaggaccuaucucuacgcuaugggaaggaaauccuggccgauucuggaauacaacaauagcuguaucaauggcaaauauauucagaggaaguuaucuagcuggagcuggacuacuauucaguauaaugaaaaauacuacuaauacucgccggggaacagguaacauaggcgaaacucugggagagaaauggaaaucccgacugaaugcucuuggaaaaagugaauuucagauauauaagaaaucaggaauacaagaaguagaucguacucuugcaaaagaaggaaucaagagaggagaaacugaucaccaugcgguuucacgggguagcgcuaaauugcgcugguuuguugagcguaacaugguuacaccagaagggaaagucguagaucucggauguggaagagguggcuggucauauuacugcggcgggcucaaaaauguucgggagguuaaagggcuaacaaaggguggaccgggucaugaagaacccauaccgaugucaacauauggcuggaaccucgucagauugcaaagugguguugauguguucuucacaccuccagaaaaaugugacacccuucuaugugauaucggagaaucauccccaaacccuacaguugaagcuggcagaacacuaagaguacuaaauuuaguugaaaacuggcuaaauaacaacacacaguuuuguauuaagguauuaaauccauauaugccauccgugauugagaaaauggaggccuuacagcgaaaguacgguggggcuuugguucgaaauccucuuaguagaaauucaacacaugaaauguacuggguaucaaacgcuuccgguaauauuguuucuucgguaaacaugauaagucgaauguuaauaaaccgauucacgaugagacacaagaaagcuacauacgagccagacguugacuuaggaaguggaacccgaaauauaggaauugaaucagaaauuccuaaccuugauaucauagggaaacgaaucgagaaaauaaagcaagaacaugaaacgucauggcauuacgaucaagaccauccuuauaaaacaugggccuaccauggaaguuacgaaacgaaacagacagguucagcaaguucgauggugaacggagucguaagauuauuaacaaaaccaugggacgucgucccaaugguaacgcaaauggcuaugacagauacuacaccguucggucaacaaagaguauucaaagaaaaaguggauacccgaacucaagaaccaaaggaaggcacuaagaaguuaaugaagauaacagcagaguggcuauggaaagaauuaggcaagaagaaaacaccuagaaugugcacacgcgaggaauuuacacgcaagguacggaguaaugccgcuuugggcgcgauauucacagaugagaauaaguggaaaagcgcacgagaagcaguagaagauucuagauuuugggaacuuguggauaaagaacguaaccuacaucuggagggaaagugugagacaugcguauacaauaugaugggcaagagagaaaagaaguuaggggaauuuggaaaagcaaaggggucuagagcaauuugguacauguggcuaggugcaagauuccuagaauuugaagcguuaggguuucuaaacgaggaccacugguuuucaagagaaaauucacucaguggugucgagggugaaggacuacauaaauuaggauauauauuacgugauguuagcaagaaagaaggaggagcaauguaugcugacgauacagcgggcugggauacacguaucacacuagaggaucucaaaaaugaggaaaugguuacuaaucacauggaaggagaacauaagaaacucgcugaagcuauuuuuaaacuuacuuaucaaaacaaaguaguaaggguucaacgcccaacuccaagaggaaccgugauggauauaauaucucguagagaccaaagaggaucuggacaaguuggaaccuacggcuuaaauacguucacuaacauggaagcacaacuaauaagacagauggaaggcgaagguguuuucaagucuauucaacaucuaacuguaaccgaagaaauugcuguacaaaauugguuagcacggguaggaagagaacgucucagucgcauggcaauuucaggagaugacuguguuguuaaaccacuagacgauagauucgcuagugcacucacagcacugaacgauaugggcaaagugcggaaagauauucaacagugggaaccgucucgcgguuggaaugauuggacgcagguucccuucugcucgcaucacuuucacgaacuaauaaugaaagauggaaggguucugguagucccuugcagaaaccaagaugaacugauugguagagcaagaauaucacaaggugcaggauggucucuccgggaaacugcgugucuggggaaaaguuaugcucaaauguggucacuuauguauuuccauaggagagaucuucgauuagcggcuaacgcaauauguagugccguuccuucacacuggguaccaacaucaagaacaacgugguccauacaugcaaaacaugaauggaugacaaccgaggauauguugacaguauggaaucgaguauggauacaagaaaauccauggauggaagauaaaaccccuguggagaguugggaggagauucccuaccuuggaaaacgcgaagaucaaugguguggaaguuuaauaggcuugacuucacgagccacuugggccaaaaauauucaaacugcaauuaaucaagucaggucacuuaucgggaaugaagaauauaccgauuauaugccaagcaugaaaagguucaggagggaagaagaagaagccggaguucucugguaa

SEQ ID NO: 22305 - RNA, 9876 nt, Artificial Sequence
  derived and/or modified CDS sequence (opt6) from DENV-2__FJ898454__SS-prME
accgcuggagugauaauaaugcuuauuccaacagcgauggcuuuucaucuaacgacucgaaauggagagccacacaugauaguaagucgacaagaaaaagggaaaucacuucuauuuaaaacugaggauggaguaaauaugugcacacuaauggcgauggauuugggugaguugugugaagauacuaucacguacaacugcccacuuuuacggcaaaacgagcccgaggauauugauugcugguguaacucaacaucaacauggguaacuuauggaacuugcacagcaacuggggaacaccgacgggagaaacguucaguagcuuuaguaccacacguagguaugggucuugagaccagaacggagacauggaugagcucagaaggagcauggaaacaugcacaaagaauugaaacauggauuuuaagacacccaggauuuacaauuauggcugccaucuuagcguauacuaucggaacuacuuauuuucaacgcguguuaauauucauauuacugacggcaguggcuccaucaaugacaaugcgauguaucggaaucaguaauagggauuuuguggaagguguaagcgggggaucuuggguagauauaguucuugaacacggguccugugugacuacaauggcgaaaaacaaacccacauuggacuucgaacuaauaaaaaccgaggcgaaacaaccugcaacucuuaggaaauacuguauugaagcaaaauuaacaaauacuacgacugcaucacgauguccaacccagggugaaccaucucuaaaugaagaacaggacaaaagguuuguauguaaacauuccauggucgaucgaggaugggggaacgguuguggacuuuuuggaaaaggaggcauaguaacaugugccauguucacuugcaagaaaaacauggaaggaaaaauaguacaaccugaaaauuuggaauauacaauaguaguuacuccccauaguggagaggagaacgcugucgggaacgauacgggcaaacaugguaaagaaauaaaagucaccccacaaagcucaauuaccgaagcugaauugacggguuaugggacagucacaauggaguguaguccgaggaccggacuagauuuuaaugagaugguguuguugcaaauggagaauaaagccugguuaguacaccggcaaugguuuuuagacuuaccacuaccuuggcuaccgggggcugauacccaggguaguaacuggauucaaaaagagacgcuugucaccuuuaaaaauccacaugccaagaaacaagacguaguaguacucggcagucaagaaggagccaugcacacagcguugacuggcgccacagagauccaaaugaguagugguaauuuacuuuucacgggucacuuaaaauguagacuuaggauggauaaacugcaacuaaaaggcaugucauauuccauguguacaggaaaauuuaaaguggugaaagaaauagcggaaacacagcacggaacaauaguuguacgaguccaauaugaaggugacgguaguccgugcaaaauaccuuucgaaaucauggauuuagagaaacgacacguuuuaggcagauuaaucacugugaacccaauaguuacagaaaaagacucucccgucaauaucgaagcagaaccuccuuucggagauucauauauaauuauaggcguugagccaggacaauugaaacucucgugguucaagaaagggagcucaauaggacaaauguucgaaacuacgaugagaggggcuaaaagaauggccauacuaggagacacagcgugggauuucggcagcuuaggaggcguuuuuacaaguaucggcaaagcucuacaucaaguauuuggggccauauauggggcggcguuuucagguguaucauggacuaugaaaaucuuaauagggguuguuauuacuuggauuggaaugaauaguagaucuacaucauugagugucucacugguccuaguugguguaguaacuuuauacuuggggguuaugguacaagccgacucgggguguguuguuucauggaaaaacaaagagcuaaagugugguuccggaauauuuauaacggacaacguacacacuuggacagaacaauacaaauuucaacccgaaaguccgagcaaacuagcuucagcaauacaaaaggccuaugaggaaggaauaugcggcauucguucagucaccagauuggaaaaucuaauguggaagcagaucaccccagaauuaaaucauauacuuagcgaaaaugaagcgaaauuaacuauaaugaccggagacaucaagggaauuaugcaagcaggaaagcguagcuuaagaccgcaacccacugaauugaaauauucuuggaagacuuggggaaaagcuaaaaugcugucaacagagccacauaaccaaacauuucuaaucgacggaccugaaacugcagaauguccaaacacuaaucgugcuuggaauagcuuagaaguggaagauuacggauucggcguuuuuacaaccaacauuuggcucaagcucaaagaacgucaagacguguuuugcgacaguaaacuaaugucagcugcuauuaagaacaacagggcuguacacgcugacauggguuacuggauagaaucugcucuaaaugauacauggaaaauagaaaaagcgucauuuauugaagucaaaaguugccauuggccaaaaagucauacccuaugguccaacggaguacucgaaucugaaaugauaauuccuaaaaauuuugcaggaccaguaucucagcauaauuaucgcccaggcuaucauacucagacagcuggucccuggcacuuaggaaaacuagaaauggauuucgauuuuugcgaaggaacuacuguaguagucacagaggauuguggcaauagaggaccaucauugcggacuaccacagcuucagggaaacuaauuacagaaugguguugcaggucgugcacauuaccaccauuacguuaucggggugaagacggaugcugguacgggauggaaauuagaccccuaaaggagaaagaagagaauuuaguaaauagcuugguaacggcaggucaugggcagaucgauaauuucagcuuaggugucuuaggaauggcucucuucuuagaagaaaugcuacgcacaagaguuggaacaaagcacgcaguccuacucguagcaguaucuuuuaugacuuuaauaacugggaacauguccuuucgcgauuuagggagaguuaugguaauggugggugcugcuauaacagaugacauaggaaugggggugacauaccuagccuuacuagcagcauucaaaguacgcccaacguuugcugccggccugcuauuacguaaauuaacaucuaaagaacucaugaugacuaccauaggaauugucuuguuaucucaaagcacaauacccgaaacaauucuugaguuaaccgaugcucucgcgcucggaaugaugauacuaaagauaguacguaauauggaaaaauaccaauuagcugugacaaucauggcgacucuauguguaccuaaugcuguaauauuacaaaacgcauggaaaguaagcuguacgauacuggcaguaguaagugucaguccacugcuauuaacuucuucacaacaaaaagcagacuggauuccauuagcauuaacuaucaaaggucucaauccaacagcuauauuuuugacuaccuuaucuagaaccaauaagaaaagaaguuggccguuaaacgaggccauaauggcaguaggaaugguuaguauauuggcuaguaguuuacugaaaaaugacaucccaaugacuggcccauuaguugccggcggcuuauuaacaguuugcuauguucuuacgggacgaucagcugacuuagaacuagaaagagccgcagaugugagaugggaagaucaagcugaaauaucaggaucauccccaauacuuucuauaacaaucagugaggauggaucuaugucgauuaaaaaugaggaagaagaacaaacgcuuacgauacucaucagaaccgggcuguuaguaauuuccggguuguucccaguuucuauaccaauaacagcggcugccugguauuuaugggaagucaagaaacaaagggcaggcguauuaugggaugugccauccccgccgccggucggaaaggcugaacuagaagacggcgcguauagaauuaaacagaagggaauauuaggauacagccaaauuggagcuggcguauacaaggagggaacauuccacacaauguggcacguuaccagaggagcaguacucaugcauaagggaaaaagaauagaaccaaguugggcagauguccgaaaagaccuaauuucguacgggggugguuggaaauuagaaggagaguggaaagaaggagaagaaguacaaguccucgccuuagaaccggguaaaaauccuagagcuguacaaacaaaaccaggucuguuuaaaacaaacacgggaacgaucggugcuguaucucucgauuucucuccaggcacgaguggaucucccauuguagauaaaaagggaaagguagucggauuauaugguaaugggguuguaacaagauccgggacuuauguuucggccauugcacaaaccgagaaaucuaucgaagauaacccagaaauugaagacgacauauuuagaaagaaacgccuuacuauaauggauuuacacccaggagcaggaaaaacuaaaagauaccuaccagcuauaguaagagaagccaucaaaagaggacuaagaacguuaauuuuggcaccuacgaggguagucgcagccgaaauggaagaagcccuaagaggauuaccgauaagguaucagaccccugcuauacgggcggaacauacagggagggaaauaguggauuuaaugugccaugcaacauuuacaaugcgccuacucagcccagugagaguacccaacuacaaccuaauaauaauggaugaagcccauuucacagacccagcaucuauagcugcaagaggauauaucucaacacgaguagaaaugggagaggcagcagguauuuucaugaccgcaacuccuccggguucaagagacccauuuccacaauccaaugcaccgaucauggaugaggaacgugaaauacccgaaagauccuggaacucuggacaugagugggucaccgauuuuaaagggaaaacagucugguucguacccucgaucaaagcagggaaugacauugcagcauguuuaaggaaaaauggaaagaaagucauacaacuuucaaggaaaacuuuugauagcgaauauauaaaaacacguacaaacgacugggauuucguuguuacaacggacauuagcgaaaugggagcgaauuucaaagcggaacgagugauugacccaagaaggugcaugaaaccaguuaucuuaacugauggcgaagaacguguaauacuagcaggccccaugccgguuacccauucuucagcggcccaaaggagaggccguauaggucggaaucccaaaaacgagaacgaucaauauauauacaugggagaaccacucgaaaaugaugaagacugugcacacuggaaagaagccaaaaugcuuuuagacaacauuaauacgccugaagggauaauuccaaguauguuugagccagaacgcgaaaaaguggacgcaauagacggagaauauagacuacgaggcgaggcaagaaaaacguucgucgacuuaaugcgaagaggagaccuaccugugugguuagcauacaggguugcagcggaagguauaaauuaugcagacagacggugguguuuugacggaauuaaaaacaaucaaauacuagaagaaaauguagaagucgaaauuuggacuaaagaaggagaaaggaagaaacuaaaaccgagauggcuugaugcuagaauuuacagcgacccauuagcauugaaagaguuuaaagaguucgcagcugguagaaagagcuuaacgcuaaauuuaauuacggagaugggcagauuaccaacauuuaugacccaaaaagcacguaacgcauuagauaauuuagcgguguugcacacugcggaagcgggaggacgagcauauaaucaugcacucucugaacuccccgaaacacuagaaacauuauuauuauuaacauuacucgcaacuguuacgggcggaaucuuuuuauuucuaaugaguggaaaaggaauugguaaaaugacucuagguaugugcugcauuauaacugcaucaauacuacuaugguaugcucaaauccaaccacauuggaucgcggcuaguauaauacuagaguucuuucuuauaguucuauugauaccggaaccagaaaaacagaggacaccacaagacaaucaauuaacauauguaguaauagcgauucuuacggucgucgccgcaacgauggcaaaugaaaugggguuucuagagaaaacaaagcgcgauuuuggacugggcucaaucgcuacccaacaaccugaaucgaacauccuagacauagauuuaagaccagcuuccgccuggacuuuauacgcgguugccacaaccuuuauuacgccaaugcugaggcauucaauagaaaauucaucagucaaugucucauuaacugcgauagccaaucaagcuacugucuuaaugggauuaggaaaggguuggccacucucaaaaauggacaucggaguaccuuuauuggcaaucgguuguuacagucagguaaauccaaucacccuaacggccgcccuacuuuugcuaguagcucauuacgcaauaauaggcccuggccuacaagcgaaagcaacaagggaagcccaaaaacgagcggccgcagguauaaugaaaaauccuacggucgacggaauaacaguaauagauuuagacccuauaccauacgacccgaaguuugaaaaacaguuagggcaaguuaugcuguuggugcuuuguguuacacaaguacuuaugaugagaacuacuugggcccuaugugaagcgcugacuuuggcaacaggaccaauuucaacuuuaugggaagguaauccaggucgauucuggaauaccacgauugccguaaguauggcaaauaucuuucgaggguccuaucucgcgggugccgguuuacuauuuagcauaaugaaaaauaccaccaacacccgaagagguacaggaaacacuggagaaacacuuggugaaaaguggaagaauaggcuaaacucguuaggcaagagugaguuucaaauuuacaaaaggucuggcauccaagaaguugacagaacucuagcuaaagaagguauaaagagaggagagacagaucaucacgcuguuuccagaggaucagcaaaacugcgcugguuugucgagcgaaaucucguaacaccagaggguaaggucgucgacuuaggcugcgggcguggaggcuggucuuauuacugugguggacucaaaaauguaagggagguaaaagggcucaccaagggaggccccggccaugaagaaccuaucccaaugucuacuuacgguuggaaccucgugcgcuugcaaucgggagucgacguauucuuuacuccuccagaaaaaugugacacacuccuaugugauauaggagaauccucuccaaauccgacaguggaggcggguaggacauuaaggguacuuaaucuagucgaaaauugguuaaauaacaauacacaauuuugcauaaaaguacugaacccauauaugccgucgguaauagagaaaauggaaacgcugcaacgaaaauauggaggugcccugguaaggaauccauugagcagaaauucuacgcacgagauguacugggugucaaaugcgucgggcaauaucguuucaucuguuaacaugauaucgcgcaugcucauaaaucgguuuacgaugcgccacaagaaagcaaccuaugaacccgacguggacuuagguaguggaacaagaaacauaggaauugagagugaaacgccuaaccuugacaucaucggaaaaagaaucgaaaagauuaagcaagagcaugaaacuucauggcauuaugaccaagaucauccauauaaaacaugggccuaucauggaucuuacgagacuaaacaaacuggcuccgcuagcucgauggucaauggaguaguuagguuacuaacuaaaccaugggauguaauacccauggugacgcagauggcaaugacagacacaaccccauucggccaacaacgugucuucaaagagaaaguagauacaaggacccaagaacccaaagaggguaccaagaaauuaaugaaaaucaccgcugaauggcuuuggaaagaacuuggcaagaagaaaacaccaagaaugugcacuagagaagaauuuacaagaaaaguucgaaguaaugcagcuuugggagccaucuucacagaugaaaacaaguggaaaucugcaagagaggcaguugaagacucuagauuuugggaauuaguagauaaagaacgaaaucugcaucuagaagggaaaugcgaaacaugcgucuacaacaugaugggaaaaagagagaagaaaauaggugaauuugguaaagcuaaggggagcagagcgauaugguacauguggcuuggugcaagauuccucgaauuugaagcacuaggguuuuuaaacgaagaucauugguuuucgcgcgaaaauuccuuaucagguguugagggagaaggcuugcauaaauuaggauauauucuuagagagguguccaagaaagaaggaggagccauguaugcagacgacacagcugguugggacacucgcauaaccuuagaagaucucaaaaaugaggagaugguuacaaaucacauggaaggagagcacaagaaauuagcagaggcuaucuucaagcuaacuuaccagaacaaaguuguaagaguacaacgcccaacaccuagagggacggugauggacaucauuuccaggcgagaucaaagaggcaguggacaaguuggcaccuauggacuaaauacuuuuacuaacaugggagcccaacuuauucgucaaauggagggggaagggguguucaaaggcauccaacaucuaacagcuacggaagagguagcuguacaagacuggcucgcuagaguaggcagagaaagacuuucaagaauggcgauaaguggggaugauuguguaguaaagccauuagaugaccgauuugcgagcgccuuaaccgcauuaaaugauaugggcaaaauccgaaaggauauacagcagugggaaccgagucgcggcuggaaugauuggacacaaguaccguuuuguucucaucauuuccacgagcuuaucaugaaagaugguagaguacuggucguaccgugccguaaccaagacgaacuaaucggccgugccaggauaucccaaggcgcaggcuggucuuugcgcgagacagcaugucuagggaaaaguuaugcacaaauguggucacucauguauuuucacaggagagaccuaagauuagcagcaaaugcuauuugcagcgcaguccccucacauuggguuccaacuagccgaacuacuuggucaauacaugcgaggcaugaauggaugacaacagaagauaugcuuacaguauggaauaggguauggauacaggaaaauccauggauggaagauaaaacgccgguagaaucaugggaagaaaucccguaccuagguaaaagggaagaccaaugguguggcucacuuauaggucuaacuucacgagcaaccugggccaaaaauauacaaacagcgauaaaucaaguacguucacuaaucggcucagaagaauacacagacuacaugccauccaugaaaagguuuaggcgcgaagaagaagaggcaggaguccucugguga

SEQ ID NO: 22306 - RNA, 9876 nt, Artificial Sequence
  derived and/or modified CDS sequence (opt6) from DENV-2__JQ922551__SS-prME
acaguaggaaugauaauuauguugaucccaacagcuauggcuuuccaucuaaccacacguaauggugaaccccauaugaucguaucacgacaagaaaaaggaaaaucguuacucuuuaaaacagaagacggaguuaauaugugcacguuaauggcgauggauuugggggaauuaugcgaagauacaauuacguacaacugccccuuacucaaacaaaacgaacccgaagacauagauuguuggugcaauaguacauccacauggguuacuuacggaacauguacggcaacaggagaacaucggcgagaaaaacgcagcgucgcauuaguuccucauguagggauggggcuagaaacaagaaccgaaacauggaugucgucagaaggagccugcaaacaugcacagcgcaucgaaacauggauauuaagacauccaucauuuacaauuauggcagcaaucuuggcguauaccauugguacuacuuacuuucagcgggucguguuccuaaugguccuaacagccguggcucuuucaaugacuaugagaugcaucgguaucucaaaccgugauuuugucgaaggagucucgggaggaucauggguugacaucguuuuagaacaugggucauguguaacuaccauggcuaaaaauaaaccuacccuagauuuugaacuuauaaaaacugaagcaaaacaacccgcuacacuucgaaaauacugcauagaagccaaacucaccaacacaacuaccgcaagcagauguccuacacaaggagaaccaagucugaaugaagaacaagauaaaagauuuguuagaaaacauucgaugguggaccgaggguggggaaauggauguggacuuuuuggaaaaggugguauuguuacgugugcaauguucaccuguaagaaaaauauggaggggaaaauaguccaacccgaaaauuuagaauauacuuuagugauaacgccccacucuggcgaagaaaaugcagucgguaacgauacaggcaaucauggaaaagaaauuaaaguaacaccgcaaaguagcauuacugaagcugcacucacuggcuacggcacugucacaauggaauguagcccaagaacugguuuaaacuuccaugagaugguaagucuucccauggagaacaaagcguggaugguccauagacaaugguuucuugaccuacccuuaccuuggcucccaggcgcagauacacaaggaagcaauuggauccagaaagaaacccucgucacauuuaaaaauccgcacgcuaagaaacaagacguuguaguguuaggaucacaggagggcgcgaugcauacagcacuaacaggugcaacugaaauacaaaugucgagcggcaauuuauuauucaccggucaucugaaaugccgacuacgaauggacaaauuacagcuuaaaggaaugucguauuccauguguacgggcaaauucaaagugguauggggaauagcacguacucaacaugggacaaucguacaucgaguacaguacgaaggagacggcucaccauguaaaauuccguuaaacaucauggguuuagagaaaaggcauguuuuaggaaggccgauaacaguaaauccuauagucacagguaaagauucaccaguaaacaucgaagcagaaccaccuuuaggggacucguauauaauaaucggaguagaaccaggccaggucaaacugacauguucgcaaaaagguagcucaauagggcaaauguuugaaacuaccaugcgaggcgccaaaaggauggccauuuuaggggauacagcuugggacuuuggcagcuuaggaggaguuuucacuucgauuggaaaagcauuacaccaaguauuuggagcgaucuacggugcagcauuuucagggguaucguggaccaugaaaaucuuaauagguguaguaauaacauggauaggaaugaacagcagauccacuucucuguccguuagcuuaguauuaguaggggugguaacgcuguauuuaggagugaugguacaagcugacucagguugugucguauccuggaaaaacaaagaacugaaauguggaaguggaauauucguaacagauaauguucacaccuggacggagcaauauaaauuucaaccagaaagucccagcaaacuugcaucggcaauacaaaaagcccacgaagaaggaaucugugguauccgaagcgugacuaggcuagagaauuuaauguggaaacaaaucacucccgaauugaaucauauacucucugagaaugagguaaaauuaacuaucaugaccggcgauauaaaaggaaucaugcaggcgggaaagcggucacuucgcccgcaacccacugaacuaaaguacucauggaaaaccugggguaaagcgaagaugcuaaguacagaaccacacaaccagacguucuuaauagauggaccagagacagcugaaugcccgaguacuaacagagcuuggaacucgcucaagggaggggauuauggauucgguguauucacuacuaacauauggcuuaaauuaaaagaaagacaggacguuucaugugacagcaaguuaaugagugcggcaauuaaggacaaccgggccgugcaugcagauauggguuacuggauagaaagcgcucuuaaugauacauggaaaauugaaaaggcuucguuuauagaggugaaaagcugucacuggccuaaaucacauaccuuauggucgaacggcguauuggaaagcgagaugaucauuccuaaaaacuuagcagggccaguaucccaacacaauuaucgacccggauaucacacucaaacagcuggaccuuggcauuuaggcaaacuagaaauggauuuugaucuaugcgaaggaacaacaguagucgugacugaagacugugggaaucguggacccagucuacgaacaacaacagcuuccgguaagcuaauaacugaaugguguugcagaucgugcacacuaccaccacuaagguaccgaggcgaagauggauguugguacggaauggaaauuagaccauuaaaagagaaggaagaaaauuuaguaaauucccugguuacggcagagcaugaacaaauagacaacuucagccugggagucuuaggaauggcucuguuucuagaagaaaugcugagaacucgcgucgggacaaaacacgcaguacugcuaguggcgguauccuuuaugacacuaaucaccgggaacaugucauuuagagauuuaggaagaguuaugguaauggugggggcggcaaugacagacgacauagguaugggaguaacauacuuagccuuacuggcagcguuuaagguaaggccaacauuugccgcgggauuacuacuccgaaaacucacgucuaaagaacuaaugaugacaacaauaggaauagucuuacucagucaaucgacuaucccggaaacaauauuagaacugacagaugcguuagcauuggguaugaugauccuaaaaaucguaagaaauauggaaaaauaucaacucgcuguuacaauaauggcaauuuuguguguaccuaaugcaaugauacuacagaacgcauggaagguguccugcacuauuuuggcgguaguaucagugucuccccuauuauuaacaaguucgcagcaaaaggcagauuggauuccauuagcguugacgauaaaaggacucaacccaaccgcuauauuucuuaccacccuaagucggacaaacaagaaaagauccuggccccuuaaugaagcaauaauggcaguagguaugguuuccauacuagcgucgucacuucuaaagaacgauaucccaaugacaggaccauuaguagcgggagguuuacucacaguuugcuaccuguuaccggggagaagcgcugaccuagaauuagagcgggcagcagauuuaagaugggaagaccaggcggaaauuagcggguccagcccaauuuuaucaauuacuauuuccgaagacggaucuaugucgauuaaaaaccaggaagaaaaacaaaccuugacuauauuaauuaaaaccggucuguuaguaauuucagagcuauuuccuguccaaauuccuaucacggcugccgcaugguauuuaugggaaguaaagaaacaacgcgcuggaguauuaugggaugucccaucucccccaccgguaggaaaagcagaacuagaagacggagccuauggcauaaaacaaaaaggcauucuuggguauagucaaauaggugcgggaguauauaaagaagggacauuucauacgauguggcauguaacacgcggcgcuguauuaaugcauaaaggaaaaagaauagaaccaucaugggcagacguaagaaaagauuugauaaguuaugguggaggauggaaauuggaaggggaguggaaggaaggggaagagguucaagucuuagcguuagaacccgggaaaaaccccagagcaguacagacgcggccaggacuuuuuaaaacgaacacagguacuauuggcgcaguuucccuagacuucuccccugguacauccggaagcccaaucguagacaagaaaggaaaagugguaggauuauauggcaacggagucguaacacggucagguacuuauguaucugcaauagcgcaaacagaaaaaucaauagaagauaauccugaaauugaagacgacauuuucaggaagaaacgacuaaccauuauggaccuccauccuggagcagguaaaacuaaaagguacuugccugcuauuguuagggaagccauuaaaaggggguuacgaacauuaauauuagcaccaacuagaguuguugcagcugaaauggaagaggcccugagaggcuuaccaauuagauaucaaaccccugcgauaagggccgaacauacugggagagaaaucguggaccuaaugugucaugccacauuuacuaugagacuacuaaguccagugagaguaccuaacuacaauuuaaucaucauggaugaggcccauuucacagauccugcaucaauagcggcgaggggcuacauuuccacacggguugagaugggagaggcggcagguauauuuaugacggcaacuccacccggaucaagagacccuuucccgcaaaguaacgcgccaaucauggacgaagaacgggaaauaccagaacguagcuggaacucaggucaugagugggugacggauuucaaaggcaaaaccguaugguuugucccuagcauaaaagcugguaaugauauagcagcauguuuacguaaaaaugguaagaaaguaauccaguugagcagaaagaccuuugauucugaauauauaaaaacucggaccaaugauugggauuucguuguaacaaccgauauaagcgaaaugggggcaaacuuuaaagcugaacgagucaucgacccuagacguuguaugaagccaguuauacugaccgauggagaagaacggguaauuuuagcagguccuaugccaguuacucauaguuccgcagcucaacggagagggcggauaggccgaaacccaaagaaugaaaacgaucaauauauuuauaugggugaaccacuugagaaugacgaagacugcgcccauuggaaggaagccaaaauguuguuagauaauauuaauaccccggaaggaauaaucccaucgauguucgaaccugaaagagaaaaaguagacgcaauagacggagaauauagguuaagaggcgaagcucgcaaaacguucguagaucucaugagaagaggagaccuaccuguaugguuggcguacagaguugcggcugaagggauaaauuacgcagacagaagguggugcuucgacgggaucaaaaauaaucaaauauuggaagaaaauguagaagucgaaauauggaccaaagaaggugagaagaagaaacugaagccaagguggcucgacgcacgaaucuauagugauccgcuggcacuuaaggaguucaaagaguucgcagcggggagaaaaucacuuaccuuaaaucuuauaacugaaaugggccggcuaccaacuuuuaugacgcaaaaagcaagaaaugcacuugauaaccuagcgguacuccacacagcugaagcuggcggacgagcguacaaucaugcccucuccgaacuaccggagacacuugaaacucuccugcucuugacuuuauuagcaacagucacgggaggaauauuccuuuuucucaugucaggaaaaggaauaggaaaaaugacucuaggaauguguuguauuaucacggcgaguauuuugcucugguaugcccaaauacagccacacuggauugccgccucgauaauacuagaguucuuuuugaucguguuacucauaccggaaccugaaaaacaacguacuccucaagacaaucaacuaaccuacguaguuauugccauucucacugcuguugcggcaacuauggcuaaugaaaugggguuuuuagagaaaacaaagaaagacuuuggucuaggaucaaucgcuacucaaccaccugaaucuaacauacuugacaucgauuuacgaccggcaagugcuuggacccuauacgcagucgcuaccacuuuuauaacaucaauguuaaggcauucuauugaaaacagcucuguuaaugucucacucacugcaauugcuaaucaagcaacaguccucaugggguuggguaaaggauggcccuuaucaaaaauggacauuggugucccacuacuagcuauaggauguuacucucaagucaacccuauaacucuaacggccgcauuacuacucuuaguagcacauuaugcuauaauuggaccaggauuacaagcgaaggcuacacgugaagcacaaaaacgagccgcagcugggauuaugaaaaauccgacuguggaugggauaacaguaaucgauuuagauccuaucccguacgauccaaaguuugaaaaacaauuaggucaagucaugcuauuagucuuaugcgucacacaaguuuuaaugaugaggacaacaugggcauugugugaagcucuaacacuagcgacgggaccaauaucaacuuugugggaagguaaucccgguagguuuuggaacaccacgauagccguaagcauggccaauauuuucaggggaucauaucuagcaggcgccggcuuacuauucagcauaaugaaaaacaccacgaacacuaggagagguacugguaauacgggugaaacacuuggcgaaaaauggaagaauaggcuaaaugcgcucggaaaaagugaauuucaaaucuauaagaaaucuggaauacaagaaguugaccguacccuagcaaaggaaggcauuaaaagaggagaaaccgaccaucacgccgugaguagaggaagcgcuaaauugagaugguucguugaaagaaaucuaguuacccccgaagguaaagucguugacuuaggaugcggaagaggaggauggaguuacuauugcggaggucugaagaacguacgagaagucaagggucucacuaagggcggcccuggacaugaagaaccaaucccgaugucaacguacggguggaacuuggucagacuucagucuggcguagauguauucuucacuccaccagaaaagugcgacacacuguugugcgacauaggugaaagcucaccuaacccgacuguggaagcaggcagaacgcuucgaguucuuaacuuaguugaaaauugguuaaauaacaacacccaguuuuguguuaaaguucuuaaccccuacaugcccucaguuauagagaaaauggaaacacuccagcgaaaguacgguggugcauuaguuagaaauccuuuaucaaggaauaguacgcacgaaauguauuggguaucuaaugcgucugguaacaucgucucuucagucaacaugauaagccguauguuaaucaacagauuuacaaugagacacaagaaagcgacuuaugaaccggacguugaucugggcucagggacgcgaaauauaggaauugaaucggaaacaccaaaccuagacauuauuggcaaaagaaucgagaagauaaaacaagaacaugaaacauccuggcauuacgaucaggaccauccauauaaaacgugggcauaucacggaaguuacgagacaaagcagacgggaucagcuucaucgaugguuaacggaguaguucgcuuauuaacuaaaccuugggacgucauaccaaugguaacccagauggcuaugacagacacaacuccauuuggacaacaaagaguauucaaggagaaaagugauacaagaacucaggaaccaaaggaagggaccaagaaacuuaugaaaauaacaccaaaguggcuauggaaagaguuagguaagaagaaaacuccgcgaauguguacacgggaggaguucacuagaaagguacgaucuaaugcagcgcuuggcgcuauuuucacugaugagaauaaguggaaauccgcaagagaggcaguagaggacucaagguuuugggaacucgucgauaaagagcguaacuuacaccuagaaggaaaaugugaaacauguguauacaauaugaugggaaaaagagagaagaaauuaggggaguucgggaaagcuaaaggcagcagagcgauaugguacauguggcuuggagccagauucuuagaauuugaagcauugggauuucuaaacgaagaccauugguuuagucgagaaaauucacucucagggguugagggugaaggccuacauaaauuaggcuacauccuucgugacguaucaaagaaagaaggaggcgcgauguaugcagacgacacagcgggcugggauacgagaauaacuuuagaagaucugaaaaacgaagaaaugggugcaaaucaucuggagggggagcccaagaaauuauaugaggcuauauuuaaacuuacauaccaaaauaaagggguucgaguucaacggccaacuccaagaggaccacuuauggauauuauccuaagacgagaucaaggggguucgggacagguaggaaccuacgggcuaaauacauuuacaaauaugggagcacagcuaauuagacaaauggaaggagaggggguuuucaaagguauacagcacuuaauugcaacagaagagaucgcaguccaagacuggcuagcccgagugggcagggaaagauuuuccagaauggcuauuucuggagaugacuguguaguaaaaccgcuagaugauagauuugcgucugcuuuaacagccuuaaacgauauggguaaggaaaggaaaguucuucaacaaugggaacccucaagagaguggaaugauuggacucaaguacccuucuguucgcaucauuuucaugaauuaauuaugaaagauggaagagugcuaguuguaccaugcagaaaccaggacgaguuaauaggucgagcgcgaauaagccaaggagcaggauggagccuaagagaaacggccugccuaggaaaaaguuaugcacagauguggucgcaaauguacuuccauagaagggaucuacgauuagcagcaaaugcuauaugcucugcagucccaucacauuggguaccuacaagcaggacuacuuggucgauacaugcacgucaugaauggaugacuacugaagauaugcuaacagucuggaaccguguguggauacaggaaaacccguggauggaagauaaaacaccugucgaaaguugggaagaaaucccauaccuaggcaagcgugaagaucaaugguguggaucgcucauagggcucacuagcagagcaacuugggcgaaaaauauacaaacagcaauaaaccagguaagaagucuuauaggaaacgaagaauacacagauuauaugcccucaaugaaacgcuuccgucgugaggaggaagaagcgggcgugcuaugguaa

SEQ ID NO: 22307 - RNA, 9876 nt, Artificial Sequence
  derived and/or modified CDS sequence (opt6) from DENV-2__JQ922550__SS-prME
acgguuggaaugauaauuauguuaaucccgacaguuauggcuucacacuuaacgacucgcaauggggguccgcauaugauaguuauaggacaacagaaacguaaaacgagcuucuuuaaaaccaagaaaggacacgauaugugcacacuaauggcgauggccuucggggaauuuugugaaaacacuaucacauauaaauguccauuccucaaacaaaaugaaccagaagacauagauuguugguguaauucaacaucaacguggguuacuuauggaaccuguacaacaacaggugaacauagaagggagaaaagaagcgucgcccuagucccacauguaggaaugggauuagaaacgagaaccgaaaccuggaugucgagcgaaggagccuggaaacaugcccaaaggauagaaacguggauucugaggcauccggguuuuacaaucauggcagcaauauuggcuuacacgauaggaacaacucauuuucaacgaguccucauauuuauacuacuuacugccaucgcaccaagcaugacaaugcguuguauugggauuuccaaucgcgauuucguugaagguguuaguggggguuccuggguugauauaguguuggaacacgguagcugugucacaacaauggccaaaaauaaaccaacauuggacuuugaauuaauaaaaacugaagcaaaacaaccggcaacauuacgcaaauacuguaucgaagcaaaacuuaccaacaccacaacggauaguagguguccaacacaaggcgaaccaacauuaaacgaagaacaggacaaaagauucguuuguaaacauagcauggucgaucgugggugggguaacggguguggguuauuuggaaaagguggcauagugaccugcgcaauguuuacuuguaagaaaaauaugaaaggaaaaaucguccaaccugagaaucuagaauauacgguuguaauaacuccacauucaggagaagaacaugcugugggaaacgacaccggcaaacacgguaaagaaguaaaaauuacaccacaaaguaguauaacugaagcagaauuaacuggauacgguacgguuaccauggaguguagcccaagaacaggccuggacuuuaacgaaaugguacucuuacaaauggaagauaaagcauggcuaguacaccggcagugguuucuagaucugccacuacccuggcuuccaggagcugacacacagggcagcaacuggauccagaaagagacucuaguuacuuuuaagaauccacaugcaaagaagcaagauguuguaguauuaggcucucaagaaggagcaaugcacacggccuuaaccggcgccacugaaauacaaaugucgagcgggaauuuauuauuuacaggucauuuaaaaugcagauuacgaauggauaagcugcaacugaaagguaugaguuacagcauguguacgggaaaauucaagguugugaaggagaucgccgaaacccagcacggaacuauaguaauaagaguucaauaugaaggagacgguaguccgugcaaaauaccauucgaaauuaaagauuuagaaaagcgacauguucucggaagauuaaucacuguuaauccaauagugacagaaaaagacucaccuguaaauauagaggcagaaccgccccugggcgacucauauauaauaauuggaguugaaccaggacaguugaaguuggacugguuuaagaaaggcucaaguauuggacaaauguucgaaaauacgaugagaggagcuaagcggauggcgauuuuaggcgauacagcaugggacuuuggcaguuugggaggcguauucaccaguauaggcaaggcgcuacaccaaguuuucggugcaaucuacggcgcagcuuucuccggagugagcuggacuaugaaaauuuuaaucgggguaaucauaacauggauugguaugaacagcagaaguacaagucuaucuguaucccuuguauuggucgggaucguaacccuauaucucggugucaugguccaagcagauucuggauguggcggaugugaacgcaaaacgaaaacaaaauguggcucuggcauauucgugacggauaauguacauacauggaccgaacaguauaaguuccaaccagaaucgcccagcaaauuagcuucggcgauucaaaaggcgcaugaagaggguauuugugggauucggucaguaacucgguuagagaacuuaauguggaaacaaauuacuccugaacuuaaucauauacuaucagaaaaugaaguuaaguuaaccauuaugacaggagacauaaaagguauaaugcaagccggaaagagaucccuaaggccccaacccacagaauuaagauacuccuggaaaacauggggcaaggcaaaaauguuaucaacugaauuacauaaucaaacguuuuuaaucgacggucccgaaacagcggaaugucccaacacaaaucgagcuuggaacucacucgagguagaagauuauggauuugguguguuuacuacaaacauuuggcuucggcuacgagaaaaacaagaugucuuuugugauucaaaauuaaugucagcagcuauaaaagacaacagagcaguacacgcugacauggguuacuggauugaauccgcucuuaacgauacauggaaaauagaaaaagcaaguuucauagaagugaagucaugccacuggccaaaaagucacacacuuuggggaaauggcguguuagaaagugaaaugguuauuccgaaaaauuuugcaggaccaguaucccaacauaauaacagaccagguuacuauacacaaaccgcgggacccuggcacuuagguaaacuggaaauggacuucgacuuuugcgaaggaacgacugucgugguaaccgaggauuguggcaauagggguccuucacuaaggaccaccacagcuucagguaaauuaauaacagaguggugcugcagaagcugcacuuuaccaccaccuaaguacagaggagaagauggaugcugguacggcauggaaauacggccacugaaagaaaaggaagaaaauuuaguuucaagccuugugacagccggucaugggcaaauagauaacuucucauuaggcauacuugguauggcacuguucuuagaagaaauguuaaggacuagaguaggaacuaagcacgccauauuauugguagcgguaucauucgugacacuaauaacaggaaacaugagcuuuagggauuugggucgaguaaugguaauggugggagcgacgaugacagacgauauaggcauggguguaacauacuuagcacucuuagcagccuucaaaguucgaccaacauuugccgcaggacuuuuacuucguaaacuaacuagcaaagaacucaugaugacaacaauaggaauuguucucucaucacaauccucaauuccagagacaauacuagaguuaacagaugcacuugcccuaggaaugaugguucucaaaauggugaggaacauggaaaaauaucaacuugcgguaacgauaauggccauauuauguguacccaacgcaguaauacuccaaaaugcauggaagguuucauguacuauuuuagcuguuguaucggugaguccuuuacuacuaacauccucacagcaaaaagcugauuggauaccccuagcauuaaccauuaagggacuuaauccaacugcaauauuuuuaacuacccuuagcggaacguccaaacgaagaagcuggccuuuaaacgaagcaauaauggcgguuggcauggugagcauauuagcuagcagcuuacuuaaaaacgacauuccuaugaccggcccguugguugccggaggauuguuaacuguauguuacguguugacgggacgaucggcagaucucgaacuagaaagagcaacugacguuaaaugggaugaccaagccgaaauauccgggucguccccgauuuuaagcaucacuauaagugaagacggcucgaugaguauuaagaacgaagaagaagaacaaacgcugacuauacuaauuagaacaggccucuuagucauuucugggcuauucccggugaguauacccaucacugcagcugcaugguauuuaugggaagucaagaaacaaagggccgguguucuaugggauguacccucacccccauuggucgguaaagcggagcuagaagacggagcuuacagaauaaagcaaaaaggaauacuaggguacagccaaauaggagcgggcguauauaaagaagggaccuuucauacuauguggcaugucacccguggugcuguuuuaaugcauaaaggaaaaaggauagaacccagcugggcagauguuaagaaagacuuaauuaguuacggaggaggguggaaauuagaaggcgaguggaaagaaggugaagaaguccaaguguuagcccucgaaccagguaagaauccccgagcaguccaaacaaaaccuggauuguuucgaaccaauacaggaacuaucggggcaguuucucucgacuuuagccccggcacaucugggucuccaaucguagauaagaaagggaaaguaguaggucuuuauggaaacgguguugucacuaggucuggagcauacguuagugcuauagcacaaacugaaaaaucaaucgaggacaacccggaaaucgaagacgacaucuuccggaaaagaaggcuuacuauaauggaucuucacccuggcgccggaaaaacaaaacgauauuugccagcuauaguacgagaggcaaucaagcgaggacuccgaacuuuaauacucgcaccaacuagaguaguugcagcagaaauggaagaggccuugaggggauuaccgauaagauaccagacuccagccauuagagcugaacauaccggucgagagauaguagaccuuaugugucaugcuacauuuacuaugagacuauugaguccuauuaggguaccgaauuacaauuuaauaauuauggacgaagcucauuuuacggacccugccagcauagcagccagaggcuacaucaguacuagaguagagaugggggaagcagcagguauauuuaugacagcaacaccuccaggaucuagggauccauuuccccagagcaacgcaccaauaauggaugaagaaagggagauaccugaaaggucauggaacucuggccacgaaugggucacagacuucaaaggcaagacagucugguucguacccucaauaaagacugguaacgauauagccgcauguuuacguaaaaaugguaaacgagugauacaacucagucgcaaaaccuucgauagugaauauguaaagacaagaacgaaugacugggacuucguuguaaccacugacauaucagaaaugggagcaaacuucaaagccgagcgcguuauagacccgcgccgauguaugaaacccguaauacuaacagauggugaggaaagggugauccuagcugggccuaugccaguuacgcacaguagcgcugcacagaggagaggcagaauaggccguaacccuaaaaacgaaaacgaucaguacauauacaugggugaaccucuagaaaaugacgaagauugcgcacauuggaaagaagcaaaaaugcugcuugauaauauaaacacgccugaggguaucauaccuucuauguuugaaccugaaagagagaaaguggacgcaaucgauggagaguaucgacucaggggugaagcaagaaagacauuacucgaauugauuagaggcggcccuaucccuguauaucucggcuacaaauggccaggugagggcauaaacuaugcagacagccguuuaugugucggucgcacgcaaaacaaccaaauauuagaggaaaacguagaaguagaaauauggaccaaagaagggaagggaaagaaguuaaaaccaagauggcuugacgccagaauauacucagauccguuagcacuaaaagaauuuaaagaauuugcugcugggagaaaaucacuaacuuugaaucugauaacagaaauggggagacuuccaacuuuuaugacucaaaaagcuagggaugcucuagacaauuuagccguguuacauacagcggaggcuggagggaaagcauauaaccaugcacuuuccgaauuaccagaaacuuuagaaacucuguugcuccuuacguuauuggcaacaguuacuggagggaucuucuuauuuuuaauguccggccguggaauaggaaaaaugacucuaggaaugugcugcaucauuaccgcaucuaucuuacuaugguaugcucaaauccaaccucacuggauagcggcuucaauaauccuugaauuuuuccuaaucguauuauuaaucccagaaccggaaaagcaacgaacuccccaagacaaccagcuaacauacguaauuauugcaauacucaccguugucgcagccacuauggcaaaugaaaugggauuucucgagaaaaccaagaaagaccuaggacuaggaaacaucgcgacccaacagccugaaucuaauauauuagacauagaucuuagaccugcaagcgcauggacacuauaugccguagcuaccacauuuaucacaccaaugcuccgacauagcauagaaaacagcaguguuaacguaucgcuaacggcgauugcuaaucaagcaacuguucuaaugggacuaggaaaagguuggccuuuaucaaaaauggauauugggguuccucuacucgcaauagguuguuacucccaaguaaacccaauuacacugacugcugcacuuuugcuauuaguagcacauuaugccaucauuggaccaggauugcaagccaaagcuacuagagaagcccagaaacgggccgcagcgggaauuaugaaaaauccuacggucgauggaaucacugugaucgacuuggacccuauuccuuaugauccaaaauuugaaaaacagcucggacaaguaaugcuacuuguccuaugcgugacccagguucucaugaugcgcacaaccugggccuugugcgaggcuuugacccucgcuacagguccugucucaacacugugggagggaaacccagguagauuuuggaacacuacuauacugauacaaauggcaaauauuuugagaggcaguuauuuagcaggcgcgggaccuuuguuuagcauaauggagaauacaacuggaccuagacguagaaccggacaguuaggucgagaguuguugaggagguggaaaaguagauuaaaugcguuaggaaaaagugaauuucagauauauaaaaagaguggaauacaggaaguagaccguacacuagcgaaagaaggaauuaagcguggagagacugaccaccaugcaguaaguagaggcuccgcgaaauuacguugguucguagaaaggaauuugguuacuccugaaggcaaaguggucgaucuugguuguggaagaggugguuggucauacuacugcggaggauugaaaaacguaagagaagugaagggguuaacuaaaggagguccggggcacgaagaaccuauacccaugucuacguacggauggaacuugguaagauugcaaucaggcguagacguauucuuuauaccuccagagaggugugauacacuucucugugauauuggagaaucgucuccaaacccuacaguagaagcagguaggacauugaggguccuuaaccuaguagaaaacuggcuaaauaauaauacucaauucugcaucaaagugcuaaaccccuauaugcccuccguuauugaaaagauggagacauuacagaggaaauacgguggugcuuugguucguaacccccuuucgaggaacucgacacaugaaauguacuggguuuccaaugcaagcggaaacauugugucuucagucaacaugauaucucgcauguuaauaaacagauuuacuaugagacacaaaaaggcaacuuacgaaccagauguugauuuaggauccgguacacggaauauuggaaucgaaagugaaauacccaaccucgacauaauagggaaaaggauagagaaaauuaaacaggaacacgaaacaaguuggcauuaugaucaagaccauccauauaaaaccugggccuaccauggcuccuacgaaacaaaacaaacagguucugcaucauccaugguaaauggggucguucguuuauuaacuaaacccugggauguagugccaaugguuacacagauggcaaugacugauaccacaccguuuggacaacagcggguauuuaaagaaaaaguagauacacguauccaagaaccgaaagaaggaacaaagaaauuaaugaaaaucauggcagaguggcuauggaaagaauuaggcaagaagaaaacgccucggaugugcacuagggaagaauuuacgaagaaaguacggucuaaugcugcacuaggugcaauauuuacagaugagaacaaguggaaaucggcacgugaggcgguagaggauggaagauuuugggaauuaguagacagggaacguaacuuacacuuagaagggaagugcgaaacaugugucuacaacaugauggguaagcgggaaaagaaacuaggugaauuugggaaagcuaaaggaucuagagcgauaugguacaugugguugggggcgcgauuucuagaguucgaggcccuuggauuuuugaacgaagaccauugguucagucgagaaaauucucuuucaggcguagagggagaaggcuuacauaaacuuggauauauacuaagggaagugagcaagaaagagggcggagcaauguaugcggaugauacagcuggaugggauacgagaauaacucuaggggcuuuaaagaaugaaagaaaauguacagaacauauggagggggaaccgagaaaaccgggaagaggucacuuuaaauggagaaaucaaaacagaguaguagggguucaaggcccaacaccuggagggacuguaauggacauaaucucccguaaaaaucaaaggggcagcggacaaguagggaccuacggauugaacaccuuuacuaauauggaggcccaauuaauaagacaaauggaaggugaaggcuucuuuauugaacaccaacaucucacugcaucagaagaaaaugcgguacaggacuggcuagcacguguuggaagagaaaaagucucaagaaugccaauaucaggagaugacugcguaguaaagccacuagaugaccguuuugcgagagcacuaaccgcacucaaugauauggguaaaguccguaaggacauccaacaaugggaaccgucucgaggguggaacgauuggacacaaguaccuuucuguucccaucauuuucaugaacuaauuaugaaagaugguagaacucuaguagucccgugcaggaaccaagaugaacuaauagggcgcgcaagaauuagccagggagcaggcuggucguucggugaaacagcaugucuggggaaaagcuacgcacaaauguggaguuuaauuaauuucaggauucccgauuuacgccuagcagccaacguaauauguagcguaguuccgucacauugggucccaacaucucguaccacauggucuauucaugcuaaccacgaguggaugacgacagaagauauguuaacgguauggaauagagucuggauacuagaaaacccauggauggaagauaaaacaccgguggaaucgugggaagaaauuccguauuuagagaaaagggaagaccaaugguguggaaguuugauaggguugacaccacaacccccuugggccaaaaacauagagaccgcaauaaaccaaguaagaaguuuaauugguaaugaggaauauauugauuaucuuccgucaaugaaaagauucaggaucgaagaagaagagucuggcuuccuaugguaa

SEQ ID NO: 22308 - RNA, 9876 nt, Artificial Sequence
  derived and/or modified CDS sequence (opt6) from DENV-2__JQ922553__SS-prME
acagcaggaaugauuauaauguuaauaccuacaguaauggcauuucacuugacaaccagaaauguugaaccuccuaugauauuuucaagacaagaaaaaggaaaaaguuuccuuuuuaaaacaaaagauggucacgauaugugcacuuucauggcaauggauuuaggugaacugugugaagauacuauuacauauaaauguccguuucugaaacaaaacgaaccugaagacauagauuguuggugcaauaguaccaguacuuggguuacauauggaacauguacuacaacaggcgaacauagaagggagaaaagaucaguugcccuaguaccgcacguaggcaugggauuagaaacuagaaccgaaacauggaugucauccgaaggagcauggaaacauguacaaaggaucgaaacauggauacuucgucauccaggauucaccauaauggcugcaauucuagcuuacacgauugguacuacucauuuccaaagaguuuuaauauuuauucugcuaacgggagucgcgcccucaaugagaaugagauguauagggauaagcaauagggacuuugucgaaggagugucaggcgguuccuggguagauauaguguuagaacacgggucauguguaaccacaauggccaaaaacaaaccaacacucgaucuagaacuaaucaaaaccgaagcaaaacaaccugccacccucagaaaauauuguaucgaagccaaauuaacaaauacgacaaccgauaguagauguccaacacaaggagaaccuaccuugaacgaggagcaggacaaacguuucgucugcaaacacucgaugguugauagagguugggguaauggcuguggauuauuuggaaaaggugcaauuguaacaugugcgauguuuacauguaagaaaucgaugaaaggaaaaauuguucagccagagaaccuugaauauacaguaguuauuacaccacacuccggcgaagaauaugcaguagguaaugauacggguaaacaugggaaagagguaaagauuacuccccaaagcagcauaacagaagcagaacuaacgggguauggaacuguaaccauggaauguuccccucgaacuggauuagacuuuaaugaaaugguauuauuacagauggaggauaaagcauggcugguacacagacagugguuuuuagaucuccccuuaccgugguuacccggcgcugauacacaaggcucaaacuggauacaaaaagagacucuggucacguuuaaaaacccccacgcgaaaaagcaagaugucgucguauuagggagccaagaaggugcaaugcacacugcacuuacaggugccacugaaauccaaauguccucaggaaaccugcuuuucacgggacacuuaaaaugccgauuaagaauggacaaauuacaacuaaaaggaaugucuuacaguauguguaccggaaaguuuaaagugguaaaagagauugcggaaacacagcaugggacaauaguaauaagagugcaauacgaaggugacggaaguccuugcaaaauaccguucgagauaauggaucuugagaaaagacaugugcuuggaagauuaauaacagugaauccgauugucacagagaaggauaguccaguuaauauagaagcugagccacccuuuggcgacaguuacauaauaauaggaguggaacccggacaguuaaaacuagacugguuuaagaaaggaucaaguauaggacagaugcuugaaacaacaaugcgcggagccaaacgaauggcuaucuuaggcgacacagcuugggauuuugguucauuagguggaguauucacgaguauuggaaaagcacuacaucagguuuuuggagccauuuauggcgccgccuuuuccggaguaucauggacaaugaaaauuuuaauuggagucaucaucacauggauuggaaugaacucucgaaguaccucguuauccguaagucuuguauuaguugguaucguuacacuguauuuagguguaaugguucaggcugauagcggauguguggugagcuggaaaaacaaagaauuaaaauguggauccgguauauucguuacugacaauguccauacuuggacugaacaguacaaguuucaacccgagucacccucuaaacuggcauccgcaauucagaaagcccacgaagaggguauuuguggcauucgcagugucacgagauuggagaaccuaauguggaaacaaauuacacuagaauugaaucacauucugagcgagaaugaaguaaagcuaaccauuaugacaggagauauaaaaggaauuaugcaagucggcaagagaucauuacgaccgcaaccaacugaauuaagguauuccuggaaaacauggggaaaggcaaaaaugcuaaguacugagcuccacaaccagaccuuccucauugacggaccagaaacugccgaguguccaaaugcaaauagagcauggaacagucuggagguagaggacuacggguuccguaaauauaaaacuaagauuuggccuacauuaaaagaauggaggaagguauucugugauaguaaauuaauguccgcugccaucaaagauaacagagcaguucacgccgauauggguuacuggauugaguccgccuugaacgacaccuggaaaauagagaaagcaucauucauugaagucaagaguugccacuggccaaaaucucacacccugugggguaauggaguucaagaaucagaaaugguaaucccgaaaaacuucgcggguccuguaucccaacacaacaacagaccaggauacuauacacagacugcgggucccuggcaucuugguaagcucgagauggauuucgacuuuugugaagguaccacagugguagucacagaagauuguggaaaccgaggaccgagcuugaggacgacaacugccucagggaaguugaucacagaauggugcuguagaagcuguaccuuacccccauuacgguacagaggcgaagcggguuguugguacuggauggacaucagaccacuuaaggaaaaagagaaaaaucuagugagcagucuagugaccgcaggacaugggcaaaucgauaacuuuaguuugagaauauuaggaauggcuuuguuccucgaaaagaugcuuaugacacggcuaggaacuaaacacgcuauauuacucguugccgucagcuucguuacuuuaauaacaagaaauaugaguuuuaaggaccuaggacguguuaugguaauggugggugccacaaugacagacgacaugaggaugggcgugacuuaccuagcauugcugccagcuuuuaaaguacggcccacauuugcuacaggucucuuauugagaaaacuaacuagcaaagaauuaaugaugacgacgauagguauaguacuauuuucacaauccucuauaccugaaaccauacuagaguuaacugaugcacuugcguuaggaaugaugguauuaaaaaugguucggaauauggaaaaauaucaauuggccgugaccauaauggcaauacuauguguuccaaacgcagucauauugcaaaaugcuuggcgagucagcuguacgauacuugcaguuguaucuguuagucccuuauucuuaacaaguaguagacaaaaagcagacuggauaccauuagcacugacuauuaagggccuuaauccaaccgcgaucuucuuaacaacacuaucgagaacuagcaaaaagcgaaguuggccauuaaaugaagcaauaauggcgguuggcauggugagcauacuggccucaagucuacucaagaaugauauaccgaugacugguccauuaguugcaggaggccuuuuaacagucugcuauguucucacaggcagaucagccgacuuagaauuggaacgagcagcugauguaaaaugggaugaccaagccgagauaucuggcaguaguccgauacugaguaucacuauaucugaagauggaagcauguccauaaagaacgaggaggaagaacaaacguuaacuauuuuaauacguacaggauugcuuguaauuucaggacuguuucccgugagcauccccauaaccgcagcagcuugguauuuaugggaggucaagaaacaaagagccggcguuuugugggacguuccaaguccaccgcccguugggaaagcggaauuagaggauggugcauauaggauucaacaaaaaggaauuuucggauacucacagauaggugccgggguauacaaggaaggaacauucccuacuauguggcauguuacaaggggagcaguccuaaugcauaaaggaaaaagaauagaaccuucaugggcagacgucaagaaagaucuaauuucauauggaggcgguuggaagcuagagggagaauggaaagaaggugaagagguacaaguucucgcgcuagaaccaggaaagaacccuagagccguacaaacuaagcccggacuauucaaaacaaauacugggacaauuggcgcugugagucucgacuuuaguccgggcaccucuggcucaccaauaguggauaaaaagggcaagguaguaggcuuguauggcaauggcguuguaacaagaucaggugcauauguuagcgcaauagcccagacugagaaaucaauagaagauuauccagaaguugagauggacauauuuaggaaaaagcggcuaacaauaauggauuuucaccccggcgcuggcagacagaaaagauacuuuccggcaaucguaagagaagcaauuaaaagaggguuaagaacucuaauucucgcccccacacgaguaguugcagcugagauggaagaagcauugcgcggauugccaauuagauaccaaacgccggcaauaagagcagaacacaccggaagggaaauaguggacuugaugugucacgcaaccuucacgaugcgucuacuaagcccaauccgagucccgaauuauaauuuaauuauuauggacgaggcacauuucacagacccagccuccaucgcugcaagaggauauaucaguacgagaguagaaaugggcgaggcggcuggaauauucaugacugccacuccucccggaucccgagauccguucccacaaucaaacgcgccaauuauggacgaagaaagagaaauaccggagcgaagcuggaacucaggccacgaaugggugacagacuuuaaagguaaaauaguuugguucguuccaaguuuaaaaacaggcaaauauauugcugcgugcuugaggaaaaauggaaaacgcguaauccaacucucaagaaaaaccuuugauucagaauauguuaagacaagaaccaacgauugggauuucguuguaacuacggacauaagugaaaugggcgcaaacuuuaaggcugaaagaguaauagaucccaggcgauguaugaagccagugauacugacugauggggaagaaagaguuauccucgcaggaccaaugccaguuacacauucaagcgcagcgcaacgacgggggcgaauuggucggaauccgaaaaacgaaaaugaucaauauauauauaugggagaaccccuagagaaugaugaagauugugcgcauuggaaagaagcuaaaauguuacuggauaauaucaauacucccgaaggaaucauaccuucaauguucgagccugaaagagaaaaaguagaugcgaucgacggcgaauacagguuaaggggugaagcgcgaaaaacucucuuagaacucauaagaggugggccaauacccguauacuuaggauauaaauggccaggugaaggaauuaauuacgcagacucuagguuauguuucgacgggauuaaaaacaaccaaauauuagaggagaauguugagguagaaauauggacuaaggaaggagaacgaaaagaauuaaaaccucguuggcucgaugcccgaauauacagcgacccgcuugcgcuuaaagaauuuaaggaguuugccgcggguagaaaaagccuaacccuuaacuuaauuaccgaaauggguaggcuccccaccuucaugacacaaaaagcgagaggggcacuugcaagccucaugguguuacacacagccgaagccgguggacgagcuuacaaucaugcgcucagugaacuaccugaaacccuggaaaccuuauugcuauuaacauuauuggcuacaguaacuggcgguaucuuucuguuuuuaaugucugguagggguauagguaagaugacuuuggguaugugcugcauaauaacggccucuauacuucugugguaugcacaaauccaaccacacuggaucgccgcuucuauaauauuagaguucuuuuuaacaguacuguuaauacccgaacccgaaaaacaaaggacaccacaagacaaucaacuaacuuacgucauuauagcuauuuuaacaguaguugcagcaacaauggcgaacgaaaugggauucuuagaaaagacuaagaaagaucuuggacuagguaacauugcuacccaacagaguuguaagaaaauuuuagauaucuacuugggaccagcacuaccuuggaaacucuacgcaggcggaaccacauucauaacaccaaugcuaagacauaguauagaaaacucuagcguaaacguuuccuugaccgcaauagcuaaucaggcuacagugcuuaugggguuagguaaagguuggccucugucaaaaauggauaucggaguaccgcuuuuagcuauuggaugcuauucacaaguaaacccaauuacgcuuacugccgcgcuauuuuuauuaguagcucacuaugccauuauaggaccaggacuacaagccaaaccaacacgagaagcacaaaagcgugcagcugcuggaauaaugaaaaaucccacuguagacggcauuacagucaucgacuuagacccaauaccuuaugauccuaaauuugaaaaacagcuaggccaaguaaugcuuuuaguacuaugugugacacaaguguugaugaugagaacaacaugggcauuaugugaagcucucacccuugcgacuggaccuguaucaacacugugggagggcaacccuggacgcuucuggaacaccaccauagcaguuucgauggcuaauauauuuagaggcucauaucuagcaggagcaggucuucucuucaguaucaugaaaaacacuacgagcacgaggcguggcaccggaaacauaggugaaacuuuaggggaaaaauggaaaagucgacucaacgcauuaggaaagucggaguuccaaauauacaagaaaucaggaauacaagaagucgauaggacccuagcuaaagaaggaaucaaaaggggcgagacugaccaucacgccguaagucgcgguuccgcuaaguugagaugguuugacgaaagaaaucuaguuacgccagaaggaaagguagucgaucuagggugcggucgaggcggguggucguucuuuugcggcggacugaaaaauguaagggagguuaaggcacuaacaauaggagguccaggucacgaagaaccuaucuuaauguccaccuacggucgaaaccugguacgcagccaaucuggcguuguaguguuucauacuccaccagaaaaaugugacacaucauuaagagauauaggagagucaaguccuaauccuaccguagaagcuggaaggacuuuaaggguacuaaaccucguggaaaauuggcuuaauaauaauacacaauuuugcaucaaaguuuugaauccguauaugccaucaguaaucgagaaaauggaggcauugcaacggaaauacggaggcgcacuuguucgaaacccucuaagccgaaauuccacccacgaaauguauugggucucuaaugcaucaggaaacaucguuucuagcgugaauaugauaucccguauguuaauaaaccgguucacuaugagacacaagaaagcuacauacgagccagacguugaucuaggaaguggaacgagaaauauuggaauagaaucugaaacgccaaaccuagauaucauagguaaacgaauagagaaaauaaaacaagaacacgaaaccucguggcacuaugaccaagaucauccuuacaaaacuugggguucucauggcucguaugaaacaaaacagacagguucagcuaguuccauggucaauggaguaguacgucuauuaacaaaaccaugggauguuguuccaauggugacccaaauggccaugacugauaccacucccuucgggcaacagcguguguuuaaagagaagguagacacucggacgcaagaaccuaaagaagguacuaagaaacuuaugaaaauuacagcagaaugguuauggaaagaauuaggaaagaagaaaacuccacgaaugugcacaagagaagaauuuauaaagaaaguucggucaaaugccgcauuaggagcaauauuuacagaugaaaacaaauggaaaagcgcgagagaggcagucgaagacggacguuuuugggaguuaguugacaaagaacggaauuuacaucuugaaggaaaaugugaaacaugcguuuacaacaugauggggaaacgagagaagaaacugggggaauuugguaaagcuaaaggaaguagggcgauuugguacauguggcugggagcaagauuccuggaguucgaagcccuagguuuccuaaaugaagaccauugguuuucaagagaaaauagucuaaguggcguugaaggggaaggauuacacaaauugggcuauauucucagagaaguaagcaagaaagaagggggagcuauguaugcugacgacacggcagguugggacacaaggauaacacuugaagaccucaaaaaugaagaacgcaagacgaaccacaugggaggagaacaucggaaauuggcgaggggaauauucaaaaugaaucuuacaaacaaaguuguacgagugcagagaccgacaccgggaggcacacugauggacauaauaucucgaaaaacacaaagaggaucagaacaaguagggacauacggguugacuacacucacaaaucucgaggcgccaccaauaagacaaauggaagggaagggggucuucaagggccaccaacauagaacugcuagcgaagaaaaugcagugcaggauugguuagcuagaguuggcggagaaagauugucgcgauuagcuauuucuggugacgauugcguaguuaaaccauuggaugaucgguuugcuagggcccuaaccgcuuuaaaugauaugggaaaagucaggaaagacauucaacaaugggagccaucaagaggguggaacgacuggacacaaguaccauucuguagucaucacuuccaugaguugauuaugaaagauggaagaacauugguuguaccaugccguaaucaagacgaacuuauaggacgagcaagaauaucacagggagcgggauggucauuaagggaaacagcaugccuugguaaauuuuaugcccagagauggucacuaauguauuuucaucguagagaucuuaggcuggcaccaaacgcgauauguucagcaguucgcacacauuggguuccaacaucacgaaaaacauggcccauucaugcaagccaugacuggaugacuacugaaguaauguuaacaguuuggaauaaacugugguuccaagaaaauccuuggauggaagacaaaacaccagucggauuuugggaagagaucccauucuuagaaaaagggaaagaucaauggggcggaaguuuaauaggcuugacuucuaggccaccaugggccaaaaauuuucagccggcaauuaaucaagugcggucauugcuauguaacgaggaaagcgcggauuucaugccaagcaugaagcgcuuucgacgagaagaagaggaagcugguguacuaugguag

SEQ ID NO: 22309 - RNA, 9876 nt, Artificial Sequence
  derived and/or modified CDS sequence (opt6) from DENV-2__JQ922549__SS-prME
acggcuggagucauaauuaugcugauaccgacugcuauggcauuucaucuuaccacucgaaacggggaaccacauaugauaguaucaagacaagaaaaagggaaaagucuccuauucaaaacggaagaugguguaaauaugugcacccuaauggcuauggacuuaggugaacugugugaagauacuauuacauauaacuguccucuucugagacaaaacgaaccagaagacauagacuguugguguaauuccaccagcacauggguaacguaugguacauguaccgccccgggggaccaccgaagggaaaaacggaguguggcccuuguaccacacguagggaugggucucgaaacacgaacagaaacauggaugucaucagaaggagcauggaaacacgcacaaagaauugaaacauggauauuaagacacccuggauucacuauaauggccgcaauccuagcauauaccauuggaaccacauacuuccaacggguucuaauuuuaauauuacuaacugcagucgcucccucaaugaccaugcgaugcauaggcauaaguaaucgugauuuuguggaaggaguuaguggcgguucauggguugauauuguacucgaacacggaucauguguaaccacuauggcgaaaaauaaaccgacguuagacuuugaacuuauuaaaacugaagcuaaacagcccgccacccuuacaaaauauuguauagaagcgaaauugacaaacaccacaacggcuucaagaugccccacgcaaggagaaccgucauugaaugaagaacagcauaaaagauucguaugcaaacacucaaugguugaccguggaugggguaaugguugcgguuuauucggcaaaggugguauugugacgugugcuauguuuacgugcaagaaaaauaugaaagggaaaauagugcaaccugaaaaucuugaauauacaauaguagugacaccccauucaggcgaagaaaacgccguuggaaacgacacaggaaaacacggaaaagaaauaaaagugcgcccucagagcucgaucaccgaagcugaacugacaggguaugguaccguaacaauggaauguagucccaggacaggcuuugcguucaaugaaaugguccuauuacaaauggaaaauaaagcauggcugguccacagacaaugguucuuagaucuuccauuaccuuggcuaccuggagcggacacacaaggcucaaauuggauccagaaagaaacacugguaacuuuuaaaaauccacacgcgaagaaacaagaugucguaguauugggaucgcaagaaggugcaaugcauacagcucuaacuggugcgacugaaauacaaaugaguaguggcaaucuacuuuuuacaggacacuugaaauguagauugagaauggacaaauuacaacucaaagguaugaguuauucaauguguaccgguaaauuuaaagucguuaaagaaauugccgagacacaacacgguacuauaguaauucgaguccaauaugagggggaugggaguccgugcaaaauuccauuugaaauaauggaucuagagaaacgauuaguuuuaggaagacugauaaccguaaauccgauaguaacugaaaaagauagcccaguaaauauagaagcagagccucccuuuggugacuccuauauaauaauuggugucgaaccuggccaguugaaacccucaugguucaagaaagguaguagcauaagacagauguuugaaacuacuaugagaggggcaaaaagaauggcuauucuaggcgauacagcaugggacuuuggaucauuaggagguguuuuuacguccauaggaaaagcacuacaucaagucuuuggggccauauauggugccgccuuuaguggaguuucguggacgaugaaaauacucauuggcgucguaauaacguggauaggaacaaacucuaggucaacaucauuauccguaucccuaguccuaguuggcguaguaacgcucuaucuaggcgugauggugcaagcagacagcgguuguguaguauccuggaaaaauaaagaauugaaaugugguuccggaaucuucaucacagauaacguacauaccuggaccgagcaauacaaauuucaaccagaaagcccaucaaaacuagcuucugccauccaaaaagcacaugaagagggaauauguggaauuagaucagucacacgacucgaaaaucugauguggaaacaaaucacacccgaacuaaaccacauacuaucagaaaaugagguaaagcuaacgauuaugacaggcgacauaaaaggcauaaugcaagcgggcaaaagaaguuuacguccacaaccaacagaacuaaaauauaguuggaaaacauggggaaaagccaaaauguugucgacggaaccccauaaccaaacuuuccucaucgggggcccagaaacagcagagugucccaauaccaauagagcguggaacucuuuggagguggaagacuaugguuuuggcgucuucacuacgaacauaugguuaaaauuaaaggaacgacaagauguauucugugacucuaaauuaaugagugcagcaauuaaagacaauagagcuguacaugcugauauggguuauuggauugaaucugcacuaaacgauacguggaagaucgagaaagccaguuucauagaaguaaaaaguugccauuggccaaaaucccauacuuuauggucaaauggcguucuagaaucagaaaugauaauaccuaaaaacuucgcggggccaguuagucagcauaauuacaggccagguuaucacacacaaacagccgggccauggcaccuggggaaacuagaaauggacuuucauuuuugugaaggcacaacugucguuguuacugaggacuguggaaaccguggcccuucauuaagaaccacaacagcuagcgguaaacuaauaacagaaugguguugccgauccugcacacucccacccuugagauauagaggagaggauggcuguugguacgggauggaaauuaggccuuuagaaggagaagaaggagacuugguucauucccuugucacagcuggacacggccaaauagacaacuucuccuuggguguucucgggauggcguuguuccuggaagagauguuaaggacccgagugggaaccaaacaugcaguccucuuaguagcaguaucauuuaugacacuaauaaccgggaacaugagcuuuagagaucuagggaggguaaugguuauggugggugcagcaaugacugacgauauugguaugggcguaacauaucuggcacuucuagcagcauucaaaguacgaccuacauuugcugcaggacucuuacuccggaaauuaacaucuaaagaacuaaugaugacuacaauagggauuguacuccuaucacaaagcacuauaccugaaacaauuuuagaauuaacagaugccuuagcacuaggucgcaugauucuaaaaauaguuaggaauauggagaaauaucaauuggcagucacuauuauggcaaucuuauguguaccaaaugcuguuauacuccaaaacgccuggaaaguauccugcacaauauuagcaguaguuucaguaucaccacuguuacugacgagcagccaacaaaaagcggacuggauaccauuagcucuuacuauuaagggauuaaacccaacugcuauauucuuaacuacgcuaaguagaacaaauaagaaaagaaguuggccguuaaacgaagcuauuauggcaguagggaugguuucuauucuggcuaguagcuuguuagaaaaugauauaccgaugaccgggccauuaguagcggguggauuauuaacuguauguuauguacucacaggaaggucugcugauuuggaauuggaaagggcugccgauguacguugggaagaucaagcggagaucucgggcucaagcccgauucucaguauuaccauuucagaagauggaagcauguccauaaaguaugaagaagaggaaccuacccucaccauucuaauucgaacgggcuugcuuguaauauccggauuguucccaguuuccauuccaauuacagcugcugccugguaccuuugggaagugaagaaacaacgggcugguguacucugggacguccccagcccuccaccaguuggaaaagcagaguuagaagacggagcuuauaggauaaagcaaaaggguauacuaggauccagucaaauuggagcuagagucuauaaagaaggaacauuccauacuauguggcaugugacucgaggagcaguucugaugcauaaaggaaagaggauagaaccguccugggcagauguaagaaaggaucuaauuucguacggagguggcuggaaguuagaaggugaauggaaagagggugaagaagugcaggucuuggcauuagaaccaggcaaaaauccaagagcaguacagacaaaaccuggacucuucaaaacaaauacagggacaauagguacuguaagccuagacuuuucgcccgguacaucagaaucaccaauaguugauaaaaagggaaaaguagucggacuguaugggaauggcguaguaacaagaucgggaacauauguuucugcuauagcucagacagagaaaucgauagaagauaacccagaaaucgaggaugacauauuuaggaagaaacgacuaacgaucauggaucuucacccaggggcugggaaaaccaaaagauaccuaccagccaucguacgcgaggcgauaaaacgcggauuacgcacauuaauauuggcuccuacacgaguaguagcagcagaaauggaagaggcauugcgaggacuaccaauacgauaucaaacaccagccauaagagccgaacacaccggaagagaaauaguagaucuaaugugucacgcuacguuuacaaugcguuuauuaucaccaguuagagugcccaacuauaaccuuauaauaauggaugaagcgcauuuuacugaccccgcauccauugcagcaagaggauacauaucuacuagaguggaaaugggugaagcagcagguauauucaugacagcaacaccuccagguucgagagauccuuucccccaaaguaaugcaccuauuauggaugaagagagggaaauaccagaacgaaguuggaauagcggacacgaaugggugacagacuuuaaaggaaaaacaguuugguucguaccuucaauuaaagcaggaaacgauauugcggccugcuuaaggaaaaauggcaaaaagguaauucaacuaucgagaaagacuuuugacucugaauauauuaaaacacgcacaaaugauugggauuuuguuguaaccacagauaucucagagaugggugccaacuucaaagcagaacgagucauagacccgagaagauguaugaaacccgucauauuaacugacggagaagagaggguaaucuuagcuggacccaugccggucacacacucuuccgcugcacaacgaagaggaagaaucggucgaaacccuaaaaacgagaacgaccaauauauuuacaugggugagccucuagagaaugaugaggauugcgcccacuggaaggaagcuaagaugcuacuagauaauauuaauacgccggaggguauuauuccgaguauguucgagccggagcgcgaaaagguagacgcuauugauggagaauacagacuuagaggugaggccagaaagacguuuguagacuuaaugagaaggggagaccuacccguaugguuagcauauagggucgcagcugagggaaucaauuaugcggaccgacgaugguguuucgauggcaucaaaaacaaccaaauacucgaagaaaauguagagguggaaauuuggacaaaagaaggcgaaagaaagaaauuaaagccccguugguuggaugcacgaaucuauagugauccgcuagcacucaaggaguuuaaggaguuugcugcaggaagaaaaucacuaaccuuaaaccuaauaacugaaaugggaagacuaccgacauuuaugacucaaaaagcacgaaaugcacuagacaaucuagcgguccuucacacagcugaagcaggagggcgagcauauaaccacgcacucagugaacuaccggaaacauuagaaacccuucuacuauuaacauuacuagcgacgguuacaggagggauauuucuauucuugaugucgggaaaaggaauuggcaagaugacccucgguaugugcuguauaauaaccgcuucgauacuacuuugguaugcacaaauacaaccccacuggaucgcagcaaguauuauacuugaauuuuucuuaauaguauuacucauaccagaaccggaaaaacaacggaccccacaagacaaccaacuuacauauguaguaauugcgauccucacaguaguagccgcuacaauggccaaugagaugggguuucuagagaaaaccaagaaagacuucggauuggggucaauagcuacacaacagccagaaucuaauauucuugacauugaccuucguccagccucggcguggacacuauaugcaguugcgaccaccuucauaacacccauguuaaggcauucaaucgagaacaguccagugaaugucucguuaacagcaaucgccaaucaagcaacaguccuuaugggucucgggaagggguggccacuguccaaaauggauauaggcguaccuccccuagcuaucggaugcuauucccaggugaaccccaucacucuaaccgcagcucuuuugcuacuuguagcccauuaugcgauaauaggaccaggauuacagguaaaagcuacacgugaagcgcaaaaacgagcggccgccggaauaaugaagaauccaacggucgauggaauaacaguaauagaccucgauccaauucccuacgauccuaaguuugaaaaacaacuaggucagauaaugcuuaggguacucugcguaacacagguuuuaaugaugcgaacgacuugggcauuaugugaagcucuaacucuugcaaccggacccauaucaaccuuaugggaaggaaauccaggaagguuaggaaacaccacgauugcuguaucaauggcaaauaucuuucgaggaaguuacuuagcuggugcaggguuacuauuuaguauuaugaaaaauacgacgaacacucgcagagguacaaguaaucugggcgaaacguuaggugaaaaauggaaaaaccgacuuaauagucuugguaaauccgaauuucaaauauacaagaaaaguggaauacaagaaguagaucguacacucgcuaaggaagggaucaagaaaggagaaacagaccaccacgccguuucuagaggaagcgcgaaacuaaggugguucguugagcgaaaucuagugaccccagaggguaaggucguagauuugggcugcggaaggggaggauggaguuauuauugugguggauuaaagaauguucgagaagucaaagguuugacuaaaggggguccagggcacgaagaacccauuccgaugucgacuuauggcuggaauuuagucagacuacaaucuggcgaggauguauucuuuacacccccugagaaaugcgauaccuuauuaugugacauaggggaaagcagcccaaauccaacgguagaggcgggcagaacucuaagaguguuaaauauggucgaaaauugguuaaacaacaauacucaauuuugcauuaaaguuuuaaauccuuauaugccaucgguuauagagaaaauggaggcacuucaacgaaaguauggaggagcauuagugagaaauccacuuucuaggaacaguacucaugaaauguacuggguaagcaacgccucggguaauaucguaucuucaguuaauaugauaagucguauguuaauaaauagauuuaccaugagacauaagaaagcuacguaugaaccagacguugaccuagguucgggaacaaggaauaucggcaucgaaucagagacgccaaauuuagauaucauagggaaaagaauugagaaaauaaaacaggagcacgaaacaucauggcacuacgaccaggaccacccguauaaaacaugggcuuaucauggaucguacgagacaaagcaaacaggaagcgccucuucauuaguuaacggugucguuagauuacucacaaaaccaugggaugugauaccgaugguaacgcaaauggcaaugaccgauacuacuccguuuggccagcaaagaguauucaaggaaaagguagauacgaggacucaagaaccaaaagaagguaccaagaaauugaugaaaaucacugcagaguggcuuuggaaagaacugggcaagaagaaaaccccucgaauguguacuagagaggaguucagcagaaaaguccgcucgaaugcugcccugggagcaauuuuuacagaugaaaacaaauggaaaucagcacgcgaagcuguugaagauggcagauuuugggaacugguagauaaagaaaggaucuuacacuuagaaggaaaaugcgaaacuuguguauauaauaugaugggcaaacgcgagaagaaaauaggagaauuuggaaaagcuaaagguucccgagcuaucugguacaugugguugggagccagguuuuuggaguuugaggcuuuaggauuucuuaacgaggaucacugguuuucacgagaaaauuccuugucaggcguagaaggggaaggacuucauaaacuaggguacauuuugcgagaaguaagcaagaaagaaggcggugcuauguaugcagaugacacggcagguugggauacucgaauaacuuuggaagaucuuaaaaaugaagaaaugguaaccaaccauauggaaggcgagcauaagaaacuggcugaagcaauuuuuaaacucacauaccaaaauaaaguaguucgagugcaaagaccuacaccucgagggaccguaauggacauaauaucaagaagagaccaaagagguaguggucaaguaggcacuuauggauuaaacacuuuuacuaacaugggcgcacaacuaauucgucaaauggaaggagaaggcguauucaaagggauccaacaccuaacagccacggaggagauagcaguucaagauugguuagcuagagugggucgagaacgacuaucuaggauggcgauuucgggugacgauugcguuguuaaaccauuagaugaucgcuucgccucagcacuaacugcacucaaugauauggguaagguuagaaaagauauccagcaaugggaaccaucccgaggauggaaugauuggacccaaguucccuuuuguucacaucauuuccacgaacuaauuaugaaagauggucgcgugcuagugguuccuuguaggaaucaggaugagcuaauuggacgagcucguaucucacaaggggcaggcuggucacuuagagagacugcaugucuagggaaaucuuacgcucaaauguggagucuuauguauuuucacagaagggaucucagacuugccgcaaaugcgauaugcucagcaguaccuagucacugggucccaacaucucgaacgacuagauccauacaugcgcgccaagaauggaugaccaccgaaguuauguuaacaguuuggaacaggguauggauacaggaaaacccguggauggaagacaaaacgccaguagagaguugggaagaaauuccguauuuagguaaacgagaggaucaaugguguggaagucuaauaggauugacaaguagagcgacgugggccaagaacauucaaacagcuauuaaucaaguaagaucacugauaggauccgaagaauauacugacuauaugccuagcaugaaacgguucaggcgagaagaagaagaggcugguguacucugguag

SEQ ID NO: 22310 - RNA, 9876 nt, Artificial Sequence
  derived and/or modified CDS sequence (opt6) from DENV-2__JQ922552__SS-prME
acugcuggaaugauaauaaugcuaauuccaacgguuauggcguuccauuuaacaacaagaaauggugaaccaccgaugauugugucccggcaagaaaaaggcaaauccuugcuauuuaaaaccgaagauggugucaauaugugcgcucuuauggcgauggaccugggugaaagaugcgaagacacaauaacauauaauuguccgcuauugaaccagaaugaaccagaagauauagacugcuggugcaacucaaccucuacuugggugacauacggaacguguacaacuacgggagaacuaagacgggagaaaauuagcgucgcacucguuccgcauguuggaauggggcuagaaacuagaaccgagacguggaugucuucggaaggagccuggaaacaugcacagagaauagagauuuggauacuacgacacccggguuuuacuauuauggccgcaauuuuagcauauacaauugguacgagucacuuccagcggguauuaauauuuauuuuacuaacagcgauugcaccaucuaugacaaugagauguaucggaauaucaaaucgugauuuugucgaaggugucaguggcgggucuugggucgacaucguuuuagaacacggaagcugcguuacgacaauggcgaaaaauaaaccaacguuggauuuugaauuaaucaaaacggaagcuaaacaaccggccacucuuaggaaauauugcauagaagccaaacuaacaaacaccacuacagauaguagaugcccuacccagggcgagccaacucuaaacgaggagcaagacaaaagguuuguguguaaacauagcaugguagauagaggauggggcaacgggugcggucucuuugguaaaggaggaaucguuacuugugcaauguucacauguaagaaaauaaugaaaggcaaaauaguccaaccagagaauuuagaauauacaguaguaaucacaccucacucuggugaagaacaugcagucggaaacgauacugguaaacacgggaaggaaguaaaaauaacaccucaaaguucaaucacugaggccgaauuaacgggauacggcaccguuacuauggaguguagcccccgaaccggucuggauuuuaaugaaaugguauuacuacaaauggaggauaaagccugguuaguacaucgucaaugguuuuuagaucugccguuaccaugguugccaggcgccgauacucagggcaguaacuggauucaaaaggagacacuuguaacauuuaaaaauccucacgcuaagaaacaagacguuguaguuuuaggaagucaggaaggagcuaugcauaccgcauugacaggagcaaccgaaauucaaaugucuagcgggaacuuauuauuuacggggcaucugaaaugucgauuaagaauggacaaacuucaacugaaaggcaugagcuacuccauguguacugggaaauuuaagguuguaaaagaaauagcagaaacacaacauggcacgauuguaauuagaguacaguaugagggugaugguucuccguguaaaauaccuuuugaaauuauggaucuggaaaaacggcacguauuagguagauuaauaacaguaaauccaauaguuacugaaaaagauucaccgguuaauauugaagcugaaccuccguucggcgacucuuauaucauaauuggcgucgagcccggucaauuaaaacuuaacugguuuaagaagggaucaaguauaggucagaugcuggaaacaacuaugagaggcgcaaaaagaauggcuauccuaggugauaccgccugggauuucggaucacucgguggaguauuuaccaguauuggaaaagcauuacaccaaguauuuggagcgaucuacggagccgcauuuaguggcguaucguggacuaugaaaaucuuaacgggaguuaucaucacguggauuggcaugaacagucgguccacuagccuguccgucucucuagugcuagucgggaucguaacauuauaucuagguguaaugguccaagcugauaguggauguguaguuucauggaaaaacaaggaacuuaagugugguucaggaauauuuguaacugacaauguccacacauggacagaacaauacauguuccaacccgaaucccccucaaaguuagcuucggcaauacaaaaagcacacgaggaagguauaugugggauucggucaguaacaaggcuagaaaacuuaauguggaaacaaauuacaccugagcucaaccacauacucagcgaaaaugaaguaaagcuaacaauaaugacuggagauauaaaaggaauaaugcaaguagguaaacguucauuaagaccacaaccaacagaacuaagauacucuuggaaaacaugggggcagccaaagauguuaucacccgaauuacaccaccaaacuuuccuaaucgacggaccagaaacugcagaaugcccaaacaccaaucguacuugggauucguuagaaguagaagauuacggauuugguguauucacaacaaaaauuuggcuacgucuucgcgagaaacaagauguauuuugugauucuaaauugauguccgcagcuauuaaggauaauagagcaguucacgcagauauggguuacuggauugaaucugcucuaaaugacaccuggaagaucgagaaggcuucuuuuaucgaaguaaaaagcugucacuggccgaaaucacauacauuguggucuauggggguauuagaaucagagauggucauaccaaagaauuuugcugguccagugagccagcacaaucaucgacccgguaucccaacacaaacagcagguccauggcaucugggcaaacuugaaauggacuuugacuucugcgaagggacaacagugguuguuacggaggacuguggaaauagagguccaucgcuaagaacuucuacggcuucagguaaguugauaaccgagugguguuguaggucaugcacacuuccuccauugagguacagaggggaagacgggugcugguaugguauggaaauuagaccacuaaaggagaaagaggaaaacuuagucagcucacugguaacugccggacauggacagauagacaacuuuagucuaggaauauuagguauggcauuguuuuuagaagaaauguuaagaacaagaguugguacuaagcacgcaauacucuuaguugccguauccuucguuacuuuaaucacaggaaauaugagugguagagaucucggaagagucaugguuauggugggcgccacgaugaccgaugauaucggcaugggaguaacuuauuuagcauuauuggcugccuuuaaaguaagacccacauucgcagcaggacuccuacuaagaaaauuaacaaguaaggaacucaugaugacaacuauugggaucguacuguugagucaaagcucuaucccagaaacaauucuagaauugaccgacgcacuagcucuuggaaugaugguuuuaaagauggugcgaaauauggaaaaauaccagcuggcaguuacgauaauggcaauucuauguguuccaaaugcaguuauacuucagaacgccuggaaaguauccuguacaauacuggcguuaguaucggucagcccccuguuucucacuucaucacaacaaaaagcugacuggauaccccuagcgcuaacaauaaaaggccuaaacccuacagcaaucuuuuuaacaacacuaucacgcaccuccaagaaacguuccuggccucuaaaugaagcaauaauggcagucgggaugguaucgauacuagcgaguucacuuuuaaagaaugacauaccuaugacugguccguuaguagcaggaggauuacugacgguuugcuauguauuaacagguagaucagcggacuuagaacuagaacgagccgcagacguuaaaugggaugaccaagcugaaauuucaggaucgucccccauauuguccauaacuauaucggaagauggaaguaugagcaucaagaacgaagaggaagaacagacucuaacaauucucauacggacugaauuacuuguuauaagcggguuauuccccauuaguauuccuauaacagcggccgcaugguacuuaugggaaguuaagaaacagagagcaggaguacuaugggauguaccuaguccaccacccguaggaaaagcagaauuggaagauggagcuuacagaaucaaacaaaaaggcauucucggauauagccaaauuggcgcgggaguauacaaggaggguacuuuucauacaauguggcacguaacccgaggcgcaguauugaugcauaaaggaaaaaggauagaaccaucaugggcagacgucaaaaaggauuuaauuuccuacgggggcggauggaaauuggaaggcgaguggaaagagggagaagaaguccaagucuuggcacuagaaccuggaaagaauccccgagcuguacagacaaaaccgggauuauuuaaaacaaacacuggcacgauaggugccguaaguuuagacuuuucaccggggacaagcggaagcccuauaguugauaagaaaggaaaaguagucgguuuauacggcaacggcguuguaacuagaaguggugccuauguaucugcaauugcucagacugaaaaauccauagaagauaauccggaaaucgaagaugacauauuuaggcggaagaaauuaacuaucauggacuuacauccuggagcgggaaagacaaagcguuacuugccagcaauaguacgagaagccauuaaaagaggacuuagaacauuaauucuagcaccuacaaggguaguugcggccgagauggaagaagcgcugaggggguuaccgauaagguaccaaacaccagcaauuagggccgagcauacaggaagggaaauaguagauuuaaugugucaugcaacuuucacaaugcgucuccuaaguccuaucaggguaccuaacuacaaccucauaauaauggaugaggcucacuucacagauccugcaaguauagcagcucguggauauauaagcacucgagucgaaaugggggaggcagcugguauauucaugaccgcaacaccuccaggaucccgagauccuuuuccacaguccaaugcaccaauaauggaugaagaaagggagauaccagagagaucuuggaacucaggacacgaauggguuaccgauuuuaagggaaaaaccguuugguuuguuccaaguauuaaaacugguaacgacauugcagcaugcuuacgcaaaaauggaaaaagaguaauacaguuaaguagaaaaacuuuugacucugaguauguaaaaacuaggacuaacgacugggauuucguagugacaaccgacauaagcgaaaugggagcaaauuuuaaggcugagagaguaauagauccacgacgaugcaugaaaccggucauauuaacagacggagaggagaggguuauccuggcaggacccaugccgguaacccauuccagcgcugcgcaaagaagagguaggaucggcaggaauccuaaaaacgagaacgaccaauacaucuauaugggagaaccauuagagaaugacgaagauugugcgcacuggaaagaagcaaagauguugcucgauaauauaaacacacccgaagggaucauuccaucgauguucgaaccugaaagagaaaaaguagaugcuauagacggugaauacagauuaaggggagaggcucggaaaacauucguggaccugaugagaagaggugaccugccuguauggcuugcauacagggguccagcggaggguauaaauuaugcagaccgccgaugguguuuugauggaaucaaaaauucccaauuuuuagaggaaaacguugaaguugaaauauggccgagcggaggcgaaaggaaagagcuuaaaccaagauggcuugaugcaaggauauacagcgacccauuagcauugaaagaguucaaagaguuugcggcaggccgcaaaucucucacuuuaaauuuaauaacugaaaugggucggcuacccacauucaugacucagaaagcaaggaacgcucuugauaaccuugcuguacuacauacugcagaagcagggggacgcgcguauaaucaugcauuaucugaauuaccagagacacuagagacacuucucuuguuaacucugcuugcuaccgugacaggggguauuuuucuuuuccuaaugucagggagaggaauagggaaaaugacucugggaaugugcuguauuauaacggcaaguauauuacucugguacgcccaaauacagccacauuggauugcagcuagcauaauauuagaguucuuuuuaauuguacucuuaauuccugaaccagaaaaacagagaacuccgcaagauaaucaauuaacuuacguaauuaucgcuauauuaacggucguagcagcaacgauggcaaaugaaaugggauucuuggagaaaacuaagaaagaucuaggcuuaggaaacauagucacacaacaaccugagucuaauauauuagauauagaccuuaggccagcaucagcauggacguuauaugcagccgcaaccaccuucaucacaccaauguuaagacacucgauugaaaauaguucaguuaacaugucacuaacggcaaucgccaaucaggcuaccguucucaugggguuaggcaaaggguggccccuaaguaaaauggauauaggaguaccauuguuagcaaucggauguuauagccaaguaaauccgauuacccugacugcagcgcuuuuucuuuuaguagcucacuacgcaaucaaaggccccggauuacaggcaaaagcaacuagggaagcucaaaagcgugcggccgcggguauaaugaaaaauccaaccguagauggaauaacggucauugaucuagauccaauaccauaugauccaaaguucgaaaaacaacuuggccagguuaugcuauuaguacucuguguuacucaagucuugaugaugagaacgacaugggcacucugugaagcacucacacuggccaccgguccaguaucaacacucugggagggcaauccagguagauucuggaauacuacgauagcaguuucuauggcgaacauuuucagaggcucguauuuagcgggaucaagucagguguggccaucaauaaacaauuuaaaaggugggaggcgcgguacuggugcucaaggagaaacauuaggcgaaaaauggaaacggcaacuuaaucaguugucgaaaucugaguucaauacauauaaaagaucuggaauaauggaaguagauagaagugaagcaaaagaaggucucaaacguggcgaaacaacuaaacacgccguaagucgaggcacugcgaaacucagaugguuuguggaacgaaauuuggugaaaccugagggaaaaguuauugaucuaggcuguggccgaggagguuggaguuacuauugugccggacuuaaaaagguuacagaagucaagggauacacuaaaggugggccuggacaugaagaacccauaccuauggcuacauauggguggaaucuuguaaaacuucauaguggaaaagacguauuuuucacaccgccugaaaaaugcgauacguugcuaugugauaucggggagucgucucccaacccaacaguagaggcagggaggacucugaggguauuaaaucuaguugaaaacuggcugaauaauaauacccaauucugcauuaaaguauugaaccccuacaugcccagugucauugagaaaauggaaacguuacagaggaaauauggcggcgcguuaguacgcaauccauuaagcagaaauaguacucaugagauguauugggucucuaaugccagugguaauauuguaucuagcguaaacaugauaagucgaaugcugauuaacagauuuacuaugagacacaagaaagcgacauacgagccggauguugauuuaggcaguggcacacguaacaucgggauagaaucagaaacaccgaauuuagauauaauaggaaaacgaauugagaaaauuaaacaggagcacgaaaccaguuggcacuaugaucaagaccacccuuacaaaacuugggcuuaccacggauccuacgaaacaaaacaaaccggcucugcuucuucaaugguaaacgguguuguaaggcuuuuaacaaaaccaugggacguuguuccuaugguuacucagauggcaaugacagauacgacuccuuucggacaacaacgcguauucaaagaaaaagucgauacgcguacucaagaaccuaaggagggaacgaagaaauugaugaaaauaacugcugaaugguuauggaaagaauuagguaaaaagaaaacgccgaggaugugcccaagagaagaauuuacgaaaaaggucagaucaaacgcugcuuugggugcaaucuuuacggaugcaacuaaguggaaaucagcgagggaagcuguugaagauggaagauuuugggagcuuguagauaaagaaagaaaucuucaucucgagggaaaaugcgaaacaugcguauacaauaugaugggaaaacgugagaagaagcuaggagaguucggaaaggcaaaaggcagccgagcgauaugguauauguggcuaggagcaagauucuuagaguuugaagcucucggauuuuuaaaugaagaucauugguuuagccgagaaaauucauuaagcgguguagaaggcgagggacugcacaaauuggguuacauacuaagagaaguucguaagaaagaagguggagcgauguaugccgaugauucagccgggugggauaccaggauuacgcuugaagauuugaaaaaugaagaaagaauaacgaaucauauggaaguggaacacaaaaagcuggcaguuggccauuuuauccuaaccuauccaaacaaaguaguaaggguacagagacccacaccaguagggaccguaauggauauaauauccaggaaaagucaaagggguucgggacaaguagggacguacggauuaaacacguuuaccaacuuagaaggaccucgcauaagacaaauggaaggugaagagucuuucaagucccaccaauuacaaacagcuacugaacgaaaugcgguccaagauuggcuugcaagagucggucgagaacgguuaucgcggauggcaauaaguggagaugacuguguaguaaaaccuuuagaugaccgauuugcgcgcgcucucacagcccugaaugauauggguaaagugagaaaagacauucaacagugggaaccgagcagagguuggaaugacuggacucaagugccauuuugcucucaucauuuccaugaguugauuaugaaagauggaagaacacuuguaguucccugcagaaaccaagacgagcuuauuggcagagcaagaauuucucagggugccggguggucucuaagagaaacugccuguuuaggaaaaucguacgcucagauguggucauuaauguauuuccauaggagggaccuccgauuagcagccaaugcuauauguucagcugugccgucccauuggguaccgaccagcagaacaacuuggaguauacacgcaucacaugaauggguugcuacagaagauaugcuuacuguauggaaccgagucuggauucaagaaaauccguggauggaagacaaaacuccaguugagaguugggaggaaauaccauauuuagggaaacgggaagaucaauggugcggcuccuuaauaggguuaacuucgagagccacuugggccaaaaauauacaaacugcaaucaaccaagugagaucgcuaauuggaaacgaggaauacacagacuauaugccauccaugaaaagauuuagaagagaagaggaagaagcaggagucuugugguaa

SEQ ID NO: 22311 - RNA, 9876 nt, Artificial Sequence
  derived and/or modified CDS sequence (opt6) from DENV-2__GU131896__SS-prME
ucagcaggaaugaucaucauguuaauuccuacuguaauggcuuuucacuuaacaacccggaacggagaaccucauaugauaguaggcauacaagaaaaagggaaaagccuucuguuuaaaacagaagauggcguaaacaugugcacacuaauggcaauggaccucggcgaacuaugugaagauacuauuacguacaaauguccacuacugcgucaaaacgaaccagaagauauagacugcugguguaauucaacaucaacauggguuacuuauggaacuugcaccacuacaggggaacauagaagggagaagcgauccgucgcucucguuccacauguaggaaugggccucgaaacucgaacugaaaccuggaugucuucagaaggagcguggaaacacgcgcagagaaucgaaacuuggauauuaagacacccaggcuuuacaauaauggcugcgauucuggccuauacaaucgggacaacucacuuucaacgagcacuuauuuucauacuucugacggccguggcgccaaguaugacuaugagguguaucgguaucucuaaucgugacuuuguugagggaguaaguggcggaagcuggguggacauaguacuggaacacggaucaugcguaacgacaauggcgaaaaauaaaccgacguuagauuuugaacugauaaaaaccgaagcuaaacagccugcaacucuccgaaaauacuguauugaagcaaaacuuacuaacacaacuaccgaaucaaggugccccacgcagggagaaccaaguuuaaaagaggagcaagauaaacgauucguuuguaaacacucuaugguagauagagguuggggaaacggaugcggacuuuuuggaaaaggggguauaguaaccugugcaauguuuacguguaagaaaaauauggaaggaaaaauuguacaaccugagaaccuggaauauacaaucguuguuacaccucacagcggugaagaacaugcaguagggaaugauacagguaaacacgguaaagaaauaaaagugacaccucagagcagcaucaccgaagccgaacuaacaggcuacgggacuguaaccauggaauguucacccaggacaggguuggacuuuaaugaaaugguguuacuucaaauggaaaacaaagcauggcugguucacagacaaugguuccuagacuugccuuuaccuugguuaccuggagcugauaaacagggaucuaauuggauccaaaaagaaacacuggugacuuuuaaaaauccccaugccaagaaacaggauguaguaguccuugggucccaagaaggugcgaugcauacagcucuaacgggcgcaacagaaauacagaugucaaguggaaauuuauuauuuacuggacacuuaaaaugcagauuaagaauggacaaacuacaacuaaaaggcaugucauauuccauguguacuggaaaauuuaaagugguaaaagaaauagccgaaacccaacaugguacgauaguaauuaggcuacaauacgaaggagauggaucuccgugcaaaauuccauuugaaauaauggaucuugaaaaacguuauguacuggguagacugaucacaguaaauccuauaguuacagaaaaagauagcccagucaauaucgaagcugagccaccuuuuggagacucauauauaauaauaggcguugagccuggucaacuaaaguuaaacugguuuaaaaagggaagcuccauaggccagauguuugaaacaacaaugcguggugcgaaaagaauggcgauuuuaggagacacagcaugggauuucggaucauuaggagggguauucacauccguaggaaaggcccuccaucaaaucuuuggagcgaucuauggugcagcuuuuagcgguguuucuuggaccaugaagauauuaauaggagucauuauuacauggaucggaaugaacucgcgaucaacuucucuaagcgucagcuugguacugguugguauugugacccucuaucuugguguuaugguacaggcugacaguggaugugucguaaguuggaagaauaaagaacuaaaguguggaucaggcauauuuaucaccgacaauguccauacguggacagagcaguauaaauuucaaccagaaucaccuucaaaacuugcauccgccauucagaaagcgcaagaggaaggaauaugcgguauacguucuguaacucgacuagagaaccucauguggaaacagauaacaccugaguugaaucacaucuuggcagaaaacgaagugaaacuaaccauaaugacaggcgauauaaaaggaauaaugcaagcugggaagagaucucuacguccacaaccgacagaauugaaauauucauggaaaacaugggggaaagcuaaaaugcuaucaacagagagucacaaucagacuuucuuaaucgauggcccagaaacugcugagugcccgaacacuaacagggcauggaauagucuugaaguugaagacuauggauucggcguguuuacaacaaacauaugguugaaauuaaaagagaagcaggacgcauuuugugacucaaaacucaugucagcagcgauuaaagacaaccgugcuguucaugcugauaugggcuauuggauagaaucugccuugaaugacacuuggaaaauagaaaaagcgaguuuuauagaagugaaaaauugucacuggccaaaaucacacacacuaugguccaaugggguacuggaaagcgaaaugauaaucccuaaaaaccuagcugggcccgugagccaacauaauuaucgaccaggcuaucacacacaaacggccgggcccuggcacuuagguaaauuagaaauggauuucgacuuuugcgaugguacuacgguaauaguuacugaagauuguggcaauagagguccaucacuaaggacuacuacggcuucaggaaaacuaauaaccgaauggugcugucguagcuguacacucccaccacuucguuaucggggagaagacgggugcugguauggaauggaaauucgcccgcugaaggaaaaagaggaaaaucuuguaaauucuuuaguaacagcgggacacggccagguugauaauuuuucguuaggcguauuagguauggcuuuguuccuggaagaaauguugaggacacgcgucggaacaaaacaugccauucuauuaguagccgucagcuucguaacgcuaauuacugguaauaugucuuucaaggauuuaggccgagucgucguaaugguuggagcgacuaugaccgacgacaucgguauggguguuacuuaccuugcucuauuggcugcguucaaaguucguccaaccuucgcagcaggauuauuacucagaaaacugaccucaaaggagcucaugaugacaacaauagggaucguauuauuaucacaaucgacgauaccugaaacaauacuagaauuaacagaugcccuagcacugggaaugaugguauuaaaaauagugagagauauggagaaauaucaacuagcagugaccauaauggcaauacuaugugugccgaaugcgguaauucuccaaaaugcuuggaagguaaguugcacaauacucgcaguaguuaguguuaguccauugcugcuaacaaguucacaacagaaaaccgacuggauaccauuagcucuuacaauaaaaggccuaaauccaacugcaauauucuuaaccacauugucgcguaccaauaagaaacggaguuggcccuuaaacgaagcaaucauggcagugggaaugguauccauuuuagcgaguagcuuacuaaagaaugauauaccuaugacaggaccacucguugccggaggccuucuuacggucuguuacguguugacgggacggagcgcagaccuggaacuagaacgcgcaacagauguaaaaugggaagaccaagcugagauuucaggaucaagcccgaucuuaucuauuacaauaagugaagauggauccaugaguauuaaaaacgaagaagaagaacaaacauugacaauacugauccguacagguuuauuaguaauaucaggacuguuucccgugagcauacccaucacggcugcugcgugguaccuaugggaggucaagaaacaacgagccgguguauuaugggacgugcccucaccuccaccaauggguaaggcggaacuagaagacggagcauauagaauaaaacaaaagggcaucuuagguuacagccaaauuggcgcgggggucuauaaagaaggaacauuucacacuauguggcaugucacaaggggagcuguauugaugcauaaaggaaaaagaauagagccgucaugggcagacguuaagaaagauuugaucucuuauggagggggauggaaguuagaaggagaguggaaagaaggugaagaaguucagguguuagccuuagaaccgggcaaaaauccaagagcgguccaaacaaaacccggucuauuuaagacuaauaccggaaccauaggugcaguaagucuggauuucaguccuggaacaucuggcucaccuauuauagauaagaaagguaaaguuguaggcuuauacgguaaugggguaguaacucgcuccggagcauauguaucugcuauugcgcaaacugagaagucgauagaagauaauccagaaaucgaagacgauauauuccgaaaaaggagacucaccauaauggaccuucacccaggagcaggaaaaacuaaaagauaucuaccagcaauagugagagaagcgauuaagagagguuuacggacucuaaucuuggcacccacaaggguaguagcugcagaaauggaagaagcucuacgugguuuacccauccgcuaucaaaccccagcaaucagggccgaacauacgggacgggagauagucgaccuaaugugccacgccacuuucacuaugcgucugcuuucuccugugaggguucccaacuacaaucuaaucauuauggaugaagcccauuuuacggacccugccagcauagcugcaagaggauauauaaguacgagaguugaaaugggagaagcugcagguauuuucaugacagcaaccccgcccgguagcagagauccauuuccacaaucuaacgcucccauaauagacgaagaacgggaaauacccgaacgaagcuggaacucaggccacgaguggguaaccgauuucaaggggaaaacaguuugguuuguaccuucaauaaaagcugggaacgacaucgcagccuguuuaaggaaaaauggcaagaaaguuauucaacuaucucguaaaacguucgauagcgaauacgugaagacaagaacaaaugacugggauuucgucguuacgacagacauaagcgaaaugggagcaaacuuuaaggcugauagggucauagacccaagaagaugcaugaagccagucauauugacagacggcgaagaacgaguuauccucgcgggcccuaugccaguaacccauucuagugcagcccaacgaaggggaagaauaggaaggaauccgaaaaaugagaaugaucaauauauauauaugggagaaccucuagagaaugacgaagacugcgcucauuggaaagaagcaaaaauguuauuagauaauauaaacacgccggaggguauaauaccaaguauguuugaaccagaaagagagaaggucgacgcuauugacggugaauaccguuugcguggcgaagccagaaagacguucguugacuuaaugagaagaggggacuuacccgucugguuagcauacaagguagcagcugaaggaauaaacuaugcugauagacgaugguguuucgauggcauuaaaaauaaccaaauucuagaagaaaauguagagguugaaaucuggacaaaagaaggcgagcguaaaaaguuaaaaccgagguggcuagaugcucgaauauauuccgauccauuggcacuaaaagaauuuaaagaauuugcagcagggcguaagagcuuaacucuaaauuuaauuacagaaaugggucgucuccccacauuuaugacucagaaaacgagagaugccuuagauaauuuggcgguuuuacauacugcagaagccgguggacgagcauauaaucaugcgcucagcgaauugccagagacuuuagagacauuacuucuacugacauuauuagcuaccguuacaggaggaauuuuucuguuucuaaugagcggacgcgguaucgguaaaaugacguugggaauguguugcauaauuacugccucaauauuacuaugguaugcgcaaauacaaccucacuggauugcagcaucgauaauacuagaguucuuuuugauaguauuauuaaucccggaacccgaaaaacaaaggacgccacaagauaaccaguuaacuuacgugguaaucgcgauccucacaguagucgcugccaccauggcgaaugagaugggguuucuagagaaaaccaagaaagauuuaggauuaggcucaauagcaacacaacaaccagagucuaauauauuagacauugauuuaaggccagccagcgcuuggacgcuguacgcaguugcaacaacuuuuguuaccccaaugcucagacacagcauagaaaacaguaguguaaacgugagucuaacugcaauagcaaaccaagcuacgguucuaaugggccuaggaaagggguggccacuaagcaaaauggauauaggugugccgcuguuagcgauuggauguuacagccaaguaaauccgauaacgcuaacagcugcacucuuauuauuagucgcacacuacgcuaucauagguccaggauugcaagcuaaagcuacaagagaagcacaaaaacgugcagcugcaggaauaaugaaaaauccgacugucgaugguauuacgguaauagacuuagauccuauuccauaugauccaaaguucgaaaagcaauuaggccaagugaugcuuuuaauacugugcguuacccaaguccucaugaugcguacaacuugggcauuaugcgaagcauuaacccuagccacugguccaaucucaacacuaugggaggggaauccagggagauuuuggaauacgacaauugcaguuucgauggcuaacaucuucagaggaucguaucuagcuggugcaggacuuuuguucagcauaaugaaaaauacuacaaacacacgcagagggacagguaauauaggugaaaccuuaggggaaaaauggaagagucgacuaaacgcucugggcaaaagcgaguuccagacguacaaaaagagcggaauacaagaaguugaucgaacuuuggcaaaagaaggaauuaaacgaggugaaacagaccaccaugcgguguccagggggucugcaaaacuaagaugguucgucgaaagaaacauggucacgccugaaggcaaaguggucgacuuagguuguggacgaggaggauggucauauuacuguggagggcuuaaaaauguuagagaaguuaaaggauuaaccaaaggaggaccgggacacgaagaaccuauuccuaugucuacauauggauggaacuuaguaagauuacaaucaggcguugacguauucuuuauaccaccagaaaaaugugacacacucuugugugacaucggugagucaagcccaaauccgacaguugaggcaggaagaacccucaggguacuaaauuuagucgaaaauuggcuaaauaauaacacccaauuuuguaucaaaguacugaauccguacaugccuucagucaucgaaaagauggaagcauuacaacguaaguauggaggugcacuggugagaaacccgcucaguagaaacucaacucaugaaauguauuggguuucgaaugccaguggaaacauaguaagcuccguuaacaugauuagcagaauguuaauaaaccguuuuacaaugagacacaagaaagcuacuuaugaaccagauguugaccuagguucggguaccagaaauauagguauugagucagaaauuccuaacuuagauauaauagguaaaagaauagagaaaauaaagcaagagcacgaaacgaguuggcauuaugaucaggaccauccauacaagacaugggcguaccacggcucauaugaaacaaaacaaacggggucagcgucgucaaugguaaacgguguuguaagacuacuaacaaaaccuugggaugucuuaccuacugugacgcaaauggcaaugaccgacaccacuccuuuuggucagcaacggguauuuaaagaaaaaguagacacaagaacacaagaacccaaagaggguacgaagaaacuaaugaaaauuacagcagaauggcucuggaaagaacucggcaaaaagaaaaccccaagaaugugcacccgagaagaguucacacguaaggucagaucaaacgcagcccugggagcaauuuuuacagacgagaauaaauggaaaagcgcgagagaagccguugaagauaguagguucugggagcuaguggauaaagaaagaaaccuacaccuagaagguaaaugcgaaacaugcgucuauaauaugaugggaaaaagggagaagaaacuuggcgaguucggaaaggcuaaaggaagcagagcgauuugguacauguggcugggugcaagauuuuuggaauuugaagcacuugguuucuugaaugaggaccauugguuuucaagagaaaauucacucucagggguagaaggggagggucuacauaaauugggcuauauauuaagagauguguccaagaaagaaggaggagcaauguaugcagacgauacugcgggcugggauacacguaucacauuagaggaucucaaaaaugaagagaugguuacuaaucacauggaaggggaacacaagaaacuagcagaggcuauuuuuaagcugaccuaccaaaauaaaguaguuaggguacagaggccuacaccucguggaaccguuauggacauaauaucgaggagagaucaacgaggaagcggccaaguuggaacguauggauuaaauaccuuuaccaauauggaagcgcaacugauaagacaaauggagggagaagguguuuuuaaaaauauucaacaucuuaccgcuacagaagaaguagccguacagaauugguuggcccgaguaggacgagagcgucugagcagaauggcuauaaguggagacgauugcguaguaaaaccuuuggaugacagauuugcgaaugcacuaacagcauuaaacgauaugggaaaaauucgcaaggauauacaacagugggaaccaagcaaaggauggaaugacuggacccaagugccauuuugcagccaccauuuccaugaauuaauaaugaaagaugggcgaguacucgucguuccaugcaggaaccaagaugagcuaauaggacgcgcaagaauuagccagggagcaggauggagucuuagagaaacagcuugucuaggaaaaucguacgcccaaauguggagccugauguauuuucaucggagggauuuacgauuagcagcuaacgcuauaugcuccgcugucccaucacacuggguaccaacaucuagaacuacguggucuauacacgcuaaacaugaauggaugacaacugaagacaugcugacuguguggaaucgaguuuggauccgugaaaaucccuggauggaagauaaaacaccuguggaaagcugggaagagauuccuuaucuaggcaaaagagaagaucaguggugcggaagucucauaggacuuaccagucgugcgacuugggccaaaaauauucaagcggcaauaaaccaaguuagaagucuaauaggcaaugaagaauauacggacuauaugccaaguaugaagagauucagaagggaagaagaagaagcugggguucuaugguga

SEQ ID NO: 22312 - RNA, 9876 nt, Artificial Sequence
  derived and/or modified CDS sequence (opt6) from DENV-2__GU131897__SS-prME
ucagcagggaugauaauuaugcucauuccaaccguaauggcuuuucaucugaccacccgcaauggugaaccacacaugauuguugggauacaagaaaaagguaagagcuuauuauuuaaaaccgaagacggaguaaauauguguacguuaauggcaauggaccuaggagaauugugcgaagacacgauaacauacaaauguccacuauuacgucaaaaugaacccgaagacauagacugcuggugcaauaguacuucaacauggguaacuuacggaaccuguacuacaacgggggaacaccgucgcgaaaaacggucagucgcauuaguuccacauguagggaugggucuugaaacuagaaccgaaaccuggaugaguuccgaaggggcauggaaacacgcucaacgaauagaaacauggauuuugagacauccaggcuuuacaaucauggcagcuauacuagcauacacaauaggaacuacacacuuucagcggguucuaauauuuauuuuacucacagccguagcaccuagcaugacaaugcgcugcauagggauaucaaaccgagauuuuguagaaggagugucgggcggaaguuggguugacauuguauuagaacauggcuccugcgugacuacaauggcgaaaaauaaacccacuuuagacuucgaacuuauaaaaaccgaagcaaaacaaccagcuacccuaagaaaauauuguauagaagccaaauuaacaaacaccacaaccgaaagccguuguccaacucaaggcgaaccaucccugaaagaagaacaagacaaacgauuuguauguaaacacaguaugguugaucgagggugggggaacggauguggucuauucgggaaaggaggaauaguaacuugugccauguuuacguguaagaaaaauauggaaggaaaaauuguccagccggaaaaucucgaauauacaauagugguaaccccacauaguggagaagaacaugccguaggaaaugacacagguaaacauggaauggaaauuaaagugacaccacaaaguucaauuacagaagcugaguuaacuggauaugguacuguaacuauggagugcaguccucgaacuggacuagacuuuaaugaaaugguauugcuacagauggagaacaaggcuuggcuaguacaucgacaaugguucuuagauuuaccccuacccugguugccaggagccgauaaacaagaaaguaacuggauacaaaaagagacguuagucacauuuaaaaacccgcacgcuaagaaacaagacguagugguacuagguucacaagagggugcuaugcacacagcacuaacgggcgcgacagagauucagaugaguucaggaaaccuucuguuuacuggccaucuaaaauguagacuaagaauggauaaauuacaacucaaaggaaugucauauucuaugugcacugguaaauuuaaaguagugaaagaaaucgcagagacccaacauggcacaauagucauucgcguccaguaugaaggagaugggagcccuuguaaaaucccuuucgagauaauggaccuggagaaaagauacguauuaggaagacuuauaacgguuaacccaauugucaccgaaaaagauucaccaguuaauauugaagcagagccaccuuuuggagacuccuauauaauaauuggaguagaacccggccagcuaaaauuaaacugguuuaagaaaggaucaagcaucgggcaaauguucgaaacaacgaugagaggugcuaaaagaauggcaauauuaggagauaccgcaugggauuucgggagcuuaggaggcguuuuuaccagcauagguaaagcacuacaucaaguguuuggagcaauauacggagcugcguuuucagguguuucauggacaaugaaaauccucauaggugucauaauaacauggauuggaaugaacucacggagcaccucccuaucuguuucucuaguccuaguaggcauagucacauuauaucuuggcguuaugguucaagcggacucgggauguguggugagcuggaaaaauaaagaacucaaaugcgguucgggcaucuuuauuacagauaaugugcacacauggacugaacaauauaaauuccaaccagaaaguccuuccaaauuagcuagugcaauucaaaaggcccaggaggaaggaauuugcggcauacgcaguguaacacgauuagaaaauuuaauguggaaacaaaucacaccagaacuaaaccauauauuggcugaaaacgaaguaaaacugacuauaaugaccggcgauaucaaagguauaaugcaagcugggaagaggucacuucgaccucaaccaacugaauuaaaauacaguuggaagaccuggggcaaagcuaaaauguuaaguacagaaaguuacaaccaaacauuucuaauugacggacccgaaacugcggaaugucccaauacaaacagagcguggaacucccuagaagucgaagacuacgguuucggaguauucacaacuaauauuuggcuaaaacuaaaagagaaacaggaugcguucugcgacuccaaacuaaugagugcggccaucaaagauaaccgagcaguucaugcugauaugggauauuggauagagagugcacuaaaugacacauggaaaauagaaaaagccagcuucauagaggucaaaaauugucauuggccgaaaagucacacucuuuggaguaacggaguauuggaauccgaaaugauaauacccaagaauuuagcagguccgguaagccaacacaauuaucgaccuggauaccauacucagauugccggacccuggcaucuuggaaaacuggaaauggacuuugauuuuugcgaugguacuacaguuauaguaacagaagacuguggcaacagaggaccgucucugagaacaacaacagcuucugggaaacuaauaacugaauggugcugucgauccuguacauugccaccauuacgauaccggggugaagacggaugcugguauggaauggaaauaagaccccuaaaggaaaaagaagaaaaucugauaaauucguuagugacagcagggcacggacaaguagauaacuucaguuuaggaguacuaggaauggcauuauuucuggaagagauguuaaggacucgagugggcaccaaacaugcgauacuccuaguagcaguuuccuucgucacacuaauuacuggaaacauguccuuuaaagaucuuggacgggucguagugauggugggagcuacaauggcggaugacauaggcaugggagucacauauuuggcucuauuagcggcguuuaagguuaggcccacauuugcugcgggacuauuauugcgaaaacucacaaguaaagaauuaaugaugacuacuauaggaauuguauugcucucacaaaguaccauucccgagacagugcuagaauugacggaugcguuagcauuggguaugaugguucuaaaaauaguuagaaauauggaaaaauaccaacuggcagucacuauaauggcaauacuuuguguuccgaacgcugucauacugcagaaugcauggaaaguaaguugcacaauucucgcagucguaucagugucaccucugcuacuuacaaguagucaacagaaaacugauuggauuccuuuagcgcuaacgauaaaagggcuaaacccuacugcaaucuuucuuacgacccugagccgaacuaauaagaaacgaucuuggccucuuaacgaggccauaauggcuguaggaaugguaucaauuuuggcaucgucgcuccuaaagaaugacauacccaugacaggcccccuaguggccggaggguuauugacaguaugcuauguguuaaccggccgaagugcugauuuagaacuugagcgagcaacagacguaaaaugggaagaccaagcagaaauaagugguagcucaccuaucuuaagcauuacuauaagcgaggauggaucgaugucuauuaagaaugaggaagaagaacaaacacuaacuauacuaauaagaacgggucucuuaguuauaucugggcuauuuccuaucagcauuccaauaacugccgccgcuugguauuuaugggaagucaagaaacaaagagcaggggucuuaugggacgugccaagcccuccgcccauggggaaagcugaacuagaagauggcgcuuaucgaauaaaacaaaaagggauucuaggauauucgcaaauaggggcuggaguauauaaagaaggaaccuuccauaccauguggcacguuacccggggcgccguucuaaugcauaaagggaaacguauagagccaucuugggccgauguaaagaaagauuuaauaucauauggaggaggauggaaauuggaaggagaguggaaagaaggggaagagguacaaguccuugcauuagagccaggcaaaaauccgagagcaguacaaacuaaacccgggcucuuuaaaacaaauacuggcacaaucggagcagugucuuuggauuuuaguccagggacgaguggaucacccauuauagacaagaaaggaaaggugguuggauuauauggcaauggagugguuacuagauccggagcauaugugagcgcuauagcgcaaacugagaaguccauugaagacaaccccgaaauagaagaugauauauuuaggaaacguaggcucacaaucauggaucugcaccccggugccggaaaaacuaagagauaccucccagccauaguuagagaagcgauaaaaagaggcuuacguacacuaaucuuggccccgacaagaguaguagcggcugaaauggaagaagcauuaagagguuuaccaauuagauaccaaaccccugcgauacgagcggaacauacuggaagggaaauaguugaccuuaugugucaugcgaccuucacaaugcgauuacuuagcccagugcgcguuccaaacuauaaccucauaaucauggacgaagcgcauuuuacagauccugcauccaucgcagcaagaggguauauauccacucgcguagagaugggugaagcggcuggcaucuucaugacagcaacacccccaggcucucgcgacccauucccacagaguaaugcuccgaucauugaugaagaaagggagauaccggaaaggucauggaacucgggacaugaauggguaauggauuuuaaaggcaaaacaguaugguuuguaccaaguauaaaagcuggcaaugauauugcagcuuguuugaggaaaaauggaaagaaagucauucaacuuucacggaaaacauuugauucugaauaugucaaaacaagaacaaacgacugggauuuuguaguuacaacagacaucucagagaugggugcaaacuuuaaagcggaaagaguaauagacccuaggcgauguaugaaaccagugaucuugacggauggcgaggaaagagugaucuuagccggacccaugccaguaacacacucaucagccgcucaaagacgcggucgcauagggcgaaaucccaaaaacgaaaaugaucaauauauauauaugggagaaccacucgagaaugaugaagauugugcacauuggaaagaagcaaagaugcuauuagauaauaucaauaccccagaaggaaucauacccagcauguucgaacccgaacgagaaaaaguagaugcgauagacggggaguaucgguuaagaggggaagcccgaaaaacuuuuguagauuuaaugagaaggggagacuuaccaguauggcuagcguauaaagucgcagcggaaggcauuaacuaugcugaucggcgauggugcuucgacggaauuaaaaauaaucaaauacuugaagaaaauguagaaguagaaauuuggacgaaggagggcgaaaggaagaaauuaaaaccucgcugguuagacgcuagaauauauucggaccccuuagcacuuaaagaguuuaaagaauuugcggcagggcgaaaaucuuugacacugaacuuaauuaccgaaaugggaagacugccaacauucaugacacaaaagacacgugacgcuuuggacaauuuggcaguccuccacacagcagaagccgguggucgugcauacaaucaugcacuuagugaacuuccggaaacucuugaaacccuauugcucuuaacguugcuugcgacagucacggguggaauauuuuuguuuuuaaugucuggccgugggauagguaaaaugacuuuaggaaugugcuguaucauaacagcgucuauacuacuaugguacgcucaaauccagccacacuggaucgcagcaucaauaaucuuggaauuuuuccugauuguguuacuuauuccagaaccggaaaagcaaagaacaccacaagauaaccaauuaacuuacgugguaauagcaauacuaacuguaguugcagcaaccauggccaacgaaaugggauuuuuagagaaaacaaagaaagaucuuggauugggguccaucgcaacacagcaaccagagaguaauauccuagauauagacuuaagaccugccucagcauggacucuuuaugccguagcaacaacauucgucacaccuauguugagacauucaaucgaaaacuccucaguaaacgucagccucacugccaucgcaaaucaagcuacuguauuaaugggauuaggaaaagguuggccauugucuaagauggauauaggcguccccuuacuagcaauagguuguuauagucaaguaaauccaauaacucuaacugcugcccuguugcuucucgucgcacauuaugcgauaauagggccuggucuacaagcuaaggcuacccgugaggcgcagaaaagagccgccgcugggauaaugaagaacccgaccgucgacggaauaacgguaauugaccuggacccgauccccuacgacccuaaguuugagaaacaauuagggcaaguuauguuauuaaucuuauguguaacccaaguucucaugaugcguacaaccugggcauugugcgaagcgcuuacacuagcuaccggaccaauaaguacacuaugggagggaaauccaggaagguuuuggaauacuacgaucgccgugucaauggcaaauaucuuuagaggaagcuaccuugccggugcgggacuauuauucaguaucaugaaaaauacaaccaauacacgucgagggacaggcaauauuggugagaccuuaggagagaaauggaaaagccgacuuaacgcacucggaaagucugaguuccaaauauacaagaaaaguggcauacaagaaguagaucgaacauuggccaaagagggaauuaagcggggagagaccgaccaccaugcuguuagccgaggaucggcuaaauuacgaugguuuguagagagaaauauggucacuccagaaggaaaagugguagaucuagguugcggccgaggaggcuggucauacuauugugguggauuaaagaaugugcgagaaguaaaaggauuaacuaaaggaggcccaggucacgaagaaccgauaccaaugagcacguaugguuggaaucucguuagacuucagucagguguagacguuuucuucauaccuccagaaaaaugugacaccuuacugugugacauaggagaaagcucaccaaauccuacagucgaggcagguagaacacuccgaguacugaaucugguugaaaacuggcucaacaauaauacgcaauuuuguauaaaagugcugaaccccuauaugcccucaguuauugagaaaauggaggcuuuacagaggaaauauggaggugcccuaguuagaaauccgcugagucgaaacaguacacacgaaauguacuggguaucaaaugccagcggaaacauagucucauccgucaacaugauuuccaggauguuaauaaauagguuuaccaugaggcauaagaaagcaacguaugaaccagauguagaucucgguucaggaacacgcaauauaggcaucgaaucugaaauuccuaauuuagauaucauagguaaaagaauugagaaaauuaaagaagaacaugaaacaucuuggcacuacgaccaagaccaucccuacaaaacgugggcuuaucacggcucuuacgagacuaaacagacggguagugcaucaucaaugguuaauggugucguuagauuauuaaccaagccuugggauguucuuccuaccguaacacaaauggcuaugacugauacaacaccuuucggccagcaacguguauuuaaagaaaaaguagauacaaggacgcaagaacccaaagagggaacuaagaaacuaaugaaaauaacagccgaauggcuguggaaagaauuagguaaaaagaaaacaccgagaauguguacaagagaagaguucacacggaaaguaagaucuaaugcagcgcuaggagcuaucuuuacagaugaaaacaaauggaaaagcgcaagagaggcuguagaagauucaagauuuugggaacuuguagauaaggaaagaaauuuacaccucgaggggaagugugagacaugugucuauaauaugaugggaaagcgugagaagaaacucggagaguucggaaaagccaaggggucuagagcaauuugguacaugugguuaggagcgcgauuucuugaauuugaggcuuuggguuuccuaaaugaagaccacugguucucgagagaaaacucacuauccggaguugaaggggaagggcuucacaaauuaggguauauccuacgggacgugagcaagaaagaaggaggugcaauguacgccgaugacaccgcaggaugggacacuagaauaacucuugaagaccucaaaaacgaagagaugguaacaaaccacauggaaggagagcacaagaaacuagcagaagcaaucuucaaguuaacauaccaaaacaaaguuguucgcguucaaagaccgacgccuagaggaacaguaauggacauaauuucacgucgggaccaacggggcaguggccagguuggaacuuacggguuaaauacauuuacaaauauggaggcacaacuaaucaggcagauggaaggggaagggguauuuaagaacauacaacaccuuacgguuaccgaagaggcagcuguccaaaauuggcuagcaagggucggaagagaaagguugucaagaauggcuauaucaggagaugauuguguaguaaaacccuuagacgaccgauuugcaaaugcucucacggcucuaaacgauauggggaaaauucgaaaggacauccaacaaugggaacccuccaaaggcuggaaugacuggacucaagugcccuuuuguagccaucacuuccacgagcuaaucaugaaagacgggcguguauugguugucccuugucgaaaccaagaugaacuuauaggacgagcaaggauaucgcaaggcgccgguuggucacuaagagagacugcuuguuuaggaaaaucuuaugcacaaauguggucacuuauguacuuccauaggcgagauuugcgacuagccgcuaaugccauuugcucugcgguucccucacacugggugccaacauccagaacuacauggucgauccaugccaaacaugaguggaugacaacagaagauaugcuaacugucuggaaucggguauggauccgagagaauccuuggauggaagauaaaacacccguggaaagcugggaagaaauucccuaccuagggaaaagagaagaucaaugguguggcaguuuaauagggcucaccaguagggcgacaugggcuaaaaauauccaagcugcaauuaaccaaguaagaucguuaauaggaaaugaagaauacacagauuacaugcccaguaugaaaagauuuaggagagaagaggaggaagcaggaguccuaugguag

SEQ ID NO: 22313 - RNA, 9876 nt, Artificial Sequence
  derived and/or modified CDS sequence (opt6) from DENV-2__GQ868631__SS-prME
agugcaggaaugauaauaaugcuaauacccacaguaauggcauuucaucuuacaacgagaaacggagaaccucacaugauaguugguauacaagaaaaaggaaaaucgcuucuauuuaaaacugaagauggaguaaauauguguacacuuauggcaauggaucucggugaauugugcgaagauacaauuacguauaaaugcccacuacuaagacaaaacgaaccggaagauauugacuguugguguaauucaacaucaacauggguuaccuauggaacauguacaacuaaaggugaacacagacgagaaaaacgaaguguagcacuuguuccacacguuggaauggguuuagaaacccggacagaaacauggaugagcucggagggagcguggaaacaugcacaaaggauagaaacguggauacuaagacaccccggauuuaccauuauggcugcaaucuuagcuuauacgauagguacaacccauuuccagcgcguucuaauuuucauauuacugacagcaguagcaccuaguaugacaaugcggugcauugguauaucgaauagagauuuuguagaggggguuaguggcggcagcuggguugauauuguucucgagcacgggagcugugucacgacaauggccaaaaauaaaccaaccuuggauuucgagcugaucaaaacggaggccaaacagccagcgacgcuuagaaaauauuguauugaagcgaaacugacgaacaccacuacggaauccagaugcccuacacagggugaaccaagucuaaaagaagaacaagauaaacgauuuguaugcaaacauucuauggucgaucggggauggggaaauggaugcggauuguuuggcaaagguggaauuguaacuugugccauguucacuugcaagaaaaacauggaggguaaaauaguucagccagaaaaucuagaauauacaaucguggucacaccacauaguggagaggagcacgcgguaggaaacgauacagguaaacauggaauggagauaaaagugacgccccaaagcucgauuacugaggccgaguugaccggcuacggaacaguaacgauggaauguucgcccagaacaggacuggauuucaaugaaaugguucuacuccaaauggaaaauaaagcguggcuaguucaucgccaaugguuucuagaccuuccgcuaccuuggcuacccggagcagauaaacaagaaucuaacuggauacagaaagaaacccuaguaacauuuaaaaacccacacgccaagaaacaggauguagucguucuaggcucgcaagaaggugcaaugcauacugcucucacgggugcaaccgagauacagaugucaagcggaaaucuacucuuuacuggacaccugaaaugccgauuaagaauggacaaacuacaguuaaaaggaaugucauacuccauguguacaggaaaauuuaaaguagucaaagaaauagcagagacucaacacgguacgauuguaauaagaguacaauaugaaggagacgguucuccuuguaaaauaccauucgaaaucauggaccuagagaaaagauauguauugggacgucuaauuacaguuaauccaaucguaacagagaaagauagcccuguuaacauugaggccgaaccaccuuucggagacucguauauaaucauuggcguagaacccggccaauuaaaauuaaauugguucaagaaagguucgagcauuggucaaauguuugaaacaacaaugagaggagcaaaaagaauggcuauuuuaggugacacggcaugggauuucgguucucuaggaggcguauuuaccuccauaggaaaagcacuacaucaaguguucggcgccauuuauggagucgccuucaguggcguuaguuggacuaugaaaauucuuaucgguguaauuauuacuuggaucgguaugaacucucgaucgaccaguuugaguguuaguuuaguguuaguagguauugugacacuauaucuaggaguaaugguccaagccgacaguggauguguugucucguggaaaaauaaagagcuaaaaugcggaucggguauauucaucacagacaauguucauacauggaccgaacaauauaaauuucagcccgagaguccgucaaaacucgcuagugcaauacaaaaggcccaagaagaggguauuugcggaauaaggaguguaacucgacuggaaaauuuaauguggaagcaaauaacaccagaauugaaccauauucuagccgaaaaugaagucaaacuuacgauuaugacaggagauaucaaaggaauaaugcaggcaggaaaacguagccuuaggccucaaccuacagaauuaaaguacaguuggaagacaugggguaaagccaaaaugcucucuaccgagaguuauaaucaaacauuucuaaucgacgggcccgaaacugccgaauguccaaacacaaaucgcgcauggaacucgcuugaggucgaagacuauggguuuggugucuuuacuacuaacauauggcuuaaacuaaaagagaaacaggaugcguucugugauaguaaacuuauguccgccgcaauuaaagacaacagagcgguacaugccgacaugggcuacuggauagagagcgcguuaaacgauacguggaaaauagagaaagcaaguuucauugaaguaaagaauugucacuggcccaagagucacaccuuaugguccaaugggguucuagagagcgaaaugaucauacccaaaaaucuugcgggaccugugucgcagcauaauuacaggccgggcuaucacacacaaauagcuggccccuggcaucugggaaaacuggaaauggauuuugauuuuugcgaugguaccacaguaauagucacagaggauuguggaaaccgggguccaucauuacgaaccaccacagcaucagguaaacuuauaaccgaaugguguuguagaucuuguacauuacccccguuacgauaccgaggagaggauggcugcugguacggcauggaaauacgaccccuaaaggaaaaagaagaaaaucuuguaaauucauuaguaacugcggggcacggucaaguggauaauuucagccuaggaguuuuaggcauggcuuuguuuuuggaggaaaugcucagaacuagaguuggaacaaaacaugccauauuacuuguggcgguuaguuuuguaacuuuaaucaccggaaacaugucuuuuaaggaccuugguagggucguaguaaugguaggugcuacaauggcugaugacauuggaauggguguaacauaucuagcacugcuagcugcguuuaagguacggccuacauuugcagccggucugcuacuuagaaaauuaacaucaaaagagcuuaugauggcaacaauaggcauuguccuauugucccaaucaacuauuccagagacuguccucgaguugacugaugcauuggcacuuggcaugauggcguuaaagaucguaagaaauauggaaaaauaccaauuagcggucacaauuauggcaauacuuugcgugccgaacgcggugauucuacaaaaugcuuggaaggucucuuguacuauacuugcaguagugucuguauccccacuccuucuuacaagcucgcagcagaagacugauuggauuccacuggcauuaaccauuaaaggacuaaacccgacagccauauuuuuaacgacccuauccagaacaaauaagaaacgaagcuggccucuaaacgaagcaauuauggcagucggaaugguaucuauauuggcuucgucacuuuuaaagaacgauauaccuaugacgggaccuuuaguggcugguggacuucuaacuguauguuauguuuugaccggaaggucagcagacuuagagcuagaaagagcgacagaugugaaaugggaggaucaggcagaaauuucagggucgaguccaauacuuaguauaaccauaagcgaagacgggucaaugucuaucaaaaacgaagaggaagaacaaacauugacaaucuuaauaagaacgggacuauuaguaauaucaggacucuucccuauuaguauuccuauuacugccgcagccugguaucuuugggaagucaagaaacagagagcgggaguauuaugggauguacccucuccuccuccgaugggaaaagcugagcucgaagauggggcauacaggauuaaacaaaaagguauacucggguacucucagauaggcgccgguguauauaaagaagggacuuuccauacaauguggcacgucacuagaggggcaguucuuaugcauaaaggcaaacgaauugaaccgucaugggcggauguuaagaaagaucugauaucguauggagggggcuggaaacucgagggagaauggaaggaaggcgaagaaguucaaguacuggcacuagaaccaggcaaaaauccucgcgcaguacaaacuaaaccaggucucuucaaaaccaauacaggcacaauuggagcgguaucgcuagacuuuaguccugguacaucaggaagcccaauuauagauaagaaagggaaaguaguaggguuauauggaaauggcguuguaacaaggagcggagcauaugugucagcuauagcgcaaaccgaaaaauccauugaagauaacccggaaauagaagacgacauauucagaaaaagaaggcuaacaauaauggauuuacauccuggcgcgggcaagacgaaaagguaccuaccagcaauuguacgcgaggcaauaaaaagaggucuacguacacucauuuuagcuccaacaagaguaguagcggcagaaauggaggaagcccuaagaggguugccuaucagguaucaaacgccagccauaagagcagaacacacaggaagagaaauuguugauuuaaugugccaugcuacauuuaccaugagacuucuuucaccgguuagagugccuaauuauaaccucaucauaauggaugaagcgcacuuuacugauccugcaucaaucgcugcaagaggauauauaagcacaagaguugagaugggugaagcagcaggcauuuuuaugacagcaaccccaccugggagcagggauccuuuuccucaaucgaaugcccccauuauagaugaagaacgggaaauaccugaacgauccuggaacucaggacaugagugggugaccgauuuuaagggaaaaacuguaugguuugugccuucuaucaaagcaggaaaugacaucgcggcaugucuucgcaaaaaugggaagaaaguuauucagcucaguagaaaaacguucgacucagaauacguaaaaacaaggaccaaugacugggacuucgucguuacaacggacauaagcgaaaugggggcgaacuucaaagccgaaagagugauugacccuagacguuguaugaaaccuguuauccuuacggauggugaggaaagggucauuuuagcaggaccaaugccaguuacacacuccucugcagcccaacgaagagguagaauaggcagaaacccuaaaaacgagaaugaucaauauaucuauaugggggaaccacuagagaaugaugaagacugugcccauuggaaggaagcaaaaaugcuauuagauaacauaaacacgccugaagggauaauaccguccauguuugagccggaaagagaaaaaguggacgcgauugauggcgaguauagauuaagaggggaagccagaaaaacuuuuguagaccuaaugcgacggggcgacuuaccaguuugguuagcuuacaagguugcagcagaagguaucaauuacgcugauaggcgauggugcuuugacggaaucaaaaauaaccaaauucuugaggagaauguggagguggaaauauggacuaaggaaggcgaaagaaagaaacugaaaccaagaugguuggacgcaagaaucuacuccgauccguuagcguuaaaagaauuuaaggaguuugcagcagguaggaagucauuaacucucaauuugauaaccgaaaugggaagacuaccgacauuuaugacucagaaaacaagagacgcuuuggacaaccuugcaguacuccacacagcagaggcgggcggucgagcguacaaccaugcauuaagcgaacuuccagaaacguuagaaacgcuuuuguuauuaacucuuuuagcgacugugacuggcggaauauuucuauuuuugaugucaggaagaggaauuggaaagaugacacugggaauguguuguauuaucaccgcgaguauuuugcuuugguaugcucaaauacaaccccauuggaucgcagcaaguauuauauuagaauuuuuccuaauugugcuacucauaccagagccugagaagcagaggacgccgcaagacaaccaauugacauaugucgugauugcaauccucacgguuguagcagcaaccauggcaaaugagaugggauuccucgagaaaaccaagaaagaccucggcuugggaaguauagcgacccagcaaccggaguccaauaucuuagacaucgacuuaagaccggcaagugccuggacuuuauaugccguagcuacaacauuuguuacaccgaugcuaagacacucaauagaaaauucaagcguaaacguaagccuaaccgcaaucgcaaaccaagccaccguucuaaugggacuaggaaaaggcuggccguuaaguaagauggacaucggugucccauuacuagcaaucggauguuacagccaaguaaacccgauaacgcuuaccgccgcuuuguuguuacucguagcucacuaugcaauuaucggcccugggcuccaagcgaaagcaacucgagaagcgcaaaagagagcggcagcaggaauaaugaagaauccuacaguugauggaauaacaguaauugauuuggauccaaucccauaugacccaaaauucgaaaagcaauuaggacagguaauguuauuaaucuuauguguaacccaaguccuaaugaugagaacuacuugggcucuuugugaagcucugacauuagcaacuggaccaauaucgacacucugggaaggaaauccggguagauuuuggaacacaacuauagcugucucaauggcuaacauuuucaggggaaguuaccuggcaggagcuggguuauuguuuucaauaaugaaaaauacuacaaauacacgacggggcaccggaaauauaggagagaccuuaggagaaaaguggaaaagucgucuaaaugcucuaggcaaaagugaauuucaaaucuacaagaaaucuggcauucaagaaguggauagaacucuagcuaaagaaggaauaaagagaggagagacugaucaucaugcaguuucaagaggaagugcaaaacuaagaugguucguggaaaggaacaugguaacaccagaaggaaaaguaguggauuuaggaugcgggcgagguggcuggucauacuacugcggcggucuuaagaacguacgugaggugaaggggcuaacaaagggaggucccggucacgaagaaccaauacccaugaguacauauggguggaacuuaguaagacuacaaucagguguagauguauucuuuauaccaccggaaaagugcgacacacuuuuaugcgacauaggagagucuucacccaaucccacuguagaggccggaaggacacuacgcguccuaaacuuagucgagaauuggcuuaacaauaauacucaauuuugcaucaaaguccuuaaucccuauaugccgagcguuaucgagaaaauggaagcaaugcagcgcaaauaugguggugcccuagugagaaauccauugagccggaauaguacacaugaaauguacuggguuucgaaugcaaguggaaauauuguuaguagcgugaacaugauaucaagaaugcuuauuaaucgauucacgaugagacauaagaaggccaccuaugaaccagauguggauuuaggcucugguacacguaacauagguaucgaaagcgaaauuccaaauuuggauauaauaggaaaaagaauagagaaaauaaaagaggaacaugaaacaucauggcauuacgaucaagaccauccguacaaaacgugggcuuaccacggcucuuaugagacaaaacagacgggaagugcaucaagcaugguaaacggagucguaagacuuuuaaccaaaccaugggacguuuuacccacggucacucaaauggcaaugacagauacuacuccguucggacaacaacggguuuuuaaagagaaaguagauacaagaacccaggagccgaaagaaggaacgaagaaauuaaugaaaaucacagcagaguggcuauggaaagaauuaggcaagaagaaaacaccgcgaauguguacaagagaggaauuuacccguaagguacgaucuaaugcagcacuuggggcaaucuuuaccgacgagaauaaauggaaaucagcaagagaagcuguggaggacucccguuucugggagcuaguugauaaagagcguaauuuacauuuagaaggaaaaugugagaccugcguauauaacaugaugggaaagagagagaaaaagcuaggugaguuuggcaaagcaaaaggaucaagagcaaucugguauauguggcuuggagccagauuucucgaguuugaggcccucggauuuuuaaacgaagaccauugguuuucuagggaaaauuccuuaucaggaguggaaggugaaggauuacacaaacuugguuauaucuuaagagauguaagcaagaaagaaggaggagcaauguacgcagaugacacggcgggaugggacacucggauuacccuggaagauuugaaaaaugaggagaugguuacuaaucauauggaaggugaacauaagaaacuagcagaagccauuuuuaaauuaacauaccaaaacaaggucguuagaguucaaagaccgacuccacguggaacuguaauggauauuauuucaagacgagaucaacguggcucaggacagguggguacauauggucuuaacacauuuacaaacauggaggcacaauuaauucgccaaauggaaggugaagggguuuucaagaacauccagcaucuaacagugaccgaggaagcagcuguucaaaacugguuagcaagaguagguagggagaggcuuucaaggauggcgauauccggugaugacuguguaguaaaaccucuugacgaucgguuugcaaacgcauuaaccgccuuaaacgacaugggaaaaauucguaaagauauacagcaaugggagccgucaaaagguuggaacgacuggacacaaguacccuuuugcucgcaucauuuucacgagcuuaucaugaaagaugguagaguuuuaguagugccaugucguaaccaagaugaacucauagggcgagccagaauuucucaaggagcaggcugguccuuaagagagacugcaugucucggaaaaucuuacgcucagauguggucacuaauguauuuccaccgacgcgaucucaggcuugcggccaacgcuauauguagugcaguaccgucgcauuggguuccaacgucucgaacaacuuggagcauacaugcaaaacacgaguggaugacaacugaagauauguuaaccguuuggaacagagucuggauucgcgagaacccuuggauggaagauaagacgccgguagaaaguugggaagaaauacccuacuuaggaaaaagagaagaccaaugguguggaagucuaaucggauuaacuucgagagccacuugggccaaaaacauacaagcggcuauaaaucaaguucgaucacuaauagguaaugaagaauauacugauuauaugccaagcaugaaaagauuccgacgggaagaagaagaggcaggagucuuaugguag

SEQ ID NO: 22314 - RNA, 9876 nt, Artificial Sequence
  derived and/or modified CDS sequence (opt6) from DENV-2__GU131899__SS-prME
agugcugguaugaucauaaugcuaauacccacgguuauggcuuuccacuuaaccacccgcaauggugaaccgcacaugauuguagguauccaggagaagggcaagucacuacuauucaagacagaagacggaguaaauauguguacguuaauggcuauggaucuuggagaguugugugaagacacuauuacauacaaauguccacuauuacgccagaaugaaccagaagauauugacuguugguguaauucaacgaguacuugggucacuuaugggaccugcacuacuacaggcgaacauagaagagaaaaaagaucugucgcacuaguaccacacguuggcaugggacuggagacacggacagagaccuggaugucuagcgaaggggcuuggaaacaugcccaacguaucgaaacguggauauuaagacauccaggauuuacgauaauggcggcaauccuagcuuauacgauaggaacuacucauuuccaacggguuuuaaucuucaucuuacuuacagccgucgcaccaaguaugacuaugcgauguauaggaauaucaaauagagacuucguagaaggugucaguggagggaguuggguagacauaguauuggaacauggcucaugcgugacgacaauggcgaaaaauaaaccaacacuagacuucgaauuaaucaaaaccgaagcgaagcaaccagcgacacugagaaaauacuguauagaagcgaaacuaacgaacacaacuacggaaagccgaugccccacccaaggagaacccagucuaaaagaggagcaggauaaaagauucguauguaagcacucaaugguggauagaggauggggaaauggcugcggucuauucgguaagggaggaauugugacgugcgcaauguuuacauguaagaaaaauauggaagggaaaauagugcaaccggaaaauuuagaauauacaauaguaguaacaccucauucaggggaagagcacgcuguagggaaugauacugggaagcacggaaaggaaauaaaagucacuccccaaagcucgauaacggaagccgaacucaccgguuacgguacugucacuauggagugcucuccuagaacgggguuagauuuuaaugagaugguauugcuccagauggaaaacaaagcauggcuaguacauaggcaaugguuucuugaucuuccgcuuccguggcuaccaggugcagacaaacaagaaucgaacuggauucaaaaggaaacuuugguaacauuuaagaacccgcaugcgaaaaaacaagauguuguaguccuugguucucaagagggagcaaugcauacugcccuuacuggugcaacagaaauucaaaugucgucaggaaauuuauuauucaccggucauuuaaaaugccgcuugcgaauggauaagcuacaauuaaaggguauguccuacaguaugugcacaggaaaauucaaaguaguaaaagaaauagcagaaacucaacauggcacuauagucauaagagugcaguaugaaggagacgguucuccguguaaaauuccuuucgagauaauggacuuagaaaagcgauauguccuugggagauuaauaacagucaauccaauugucacugagaaagacagucccguaaauauugaggcugaaccccccuucggagauucauauauaauuauaggggucgaaccuggucaacuaaaacuaaauugguuuaaaaaaggcucaaguauaggccaaauguuugagacuacuaugaggggugcuaaaagaauggcuauacucggcgauacagcgugggauuuugguucccuaggcggaguguucacaagcaucgguaaggcgcuccaccaaguauuuggagcaauauauggugcugcauuuagcgguguaucauggacgaugaagauauugauagguguaauuauuacauggauugggaugaauagcagaucaacuaguuugucagugucacuuguacuuguagggauagugacgcuguauuuaggcguaaugguacaagcagauucugggugcguuguuagcuggaaaaauaaagaauuaaaaugcggaagcgguauuuuuauaacggacaacguccauacuuggaccgaacaauacaaauuccaaccagaauccccgaguaagcuagcaucagcaauucaaaaggcccaagaagagggcauauguggcauaaggaguguaaccagacuagaaaaccugauguggaagcaaauaacuccagaacuaaaucacaucuuagcagaaaaugaaguaaaauuaaccauuaugacaggagacaucaaagguauaaugcaagcuggaaaaaggucauuacguccgcagccaacagaacuaaaauacucguggaaaacuuggggcaaagcaaaaauguugucaacugagucauauaaucaaacauuuuugauagaugggccagaaacagcagaauguccuaauacaaauagagcauggaauucauuagagguagaagacuacggauuugguguauuuacaacaaauauuuggcugaagcucaaggaaaaacaagaugcauucugugauaguaaacuaaugucugcagcgauuaaagacaauagagccguucacgccgauaugggauacuggauagagucagcgcugaaugauacauggaaaauagaaaaagcuagcuuuauagaaguuaaaaacugucacuggccaaaaucccauacacuauggucuaauggaguuuuagaaucggaaaugauuauuccaaaaaacuuggcuggcccugucucacaacauaauuaucgcccuggauaccauacccaaauagcggguccauggcaccuaggaaaacuagaaauggacuuugacuucugcgacggcacgacagucauagugacagaggauugugguaauagagguccuucacuuaggacgacaacagcuucaggcaagcucauuacagaaugguguugucggaguuguacguuaccacccuuaagauauagaggagaggaugguugcugguauggaauggagauccgaccuuugaaagaaaaggaagagaacuuagugaauaguuuagugacagcaggacauggucaaguugacaacuuuaguuuagguguucucggcauggcauuauuccuggaagagaugcuccgaacuagggucggcacgaaacacgcuauucuauuaguagcaguuaguuuugugacuuuaauuacuggcaacaugucuuuuaaagaucugggcagggugguaguaaugguuggugcgacgauggccgaugauauaggaaugggagucacauaucuggcauuauuagcugcguuuaaaguuaggccaacauuugcagccggauuacuauugaggaaacugaccucgaaagaacugaugaugacaacuauugguauaguuuuguuaagccaaagcacuaucccagaaaccguauuagaacuuacugaugcacuugcccuaggaaugaugguauuaaaaauuguaagaaauauggaaaaauaucaguuagcaguaacuauaauggccauccuuugugucccaaaugcaguaauacuacaaaaugcauggaagguguccugcacuauauuagccguaguuagcgugucuccuuuacuucuaacaucuucacaacaaaaaacagauuggauaccacuagcucuaacgauaaaaggccuaaacccgacugccauauucuuaaccacccuuucucguacuaauaagaagagaucauggccacuuaaugaagcuauaauggcgguuggaaugguuucaauacuagcuucuagcuuacuuaaaaaugauaucccaaugacaggaccauuaguugccggaggacuuuuaacaguuuguuauguauuaacaggccgaucugcagaucuugaacuagaaagagcaacggacguuaaaugggaagaucaagcugaaauaaguggcagcucucccauuuuaaguauaaccauuucagaagaugggaguaugagcauuaaaaacgaagaagaagagcaaacucugaccauauuaauaagaaccggauuauuaguuauaucuggacuauuuccuauuucuaucccagugacggcagcagcgugguaucuuugggagguaaaaaaacagagagcagggguuuuaugggacgugcccucaccccccccaauggguaaggccgaacucgaagacggggccuacagaauuaaacaaaaggguauacucgguuacucccaaauaggcgcagggguauauaaggaaggcacguuucauaccauguggcaugucacuaggggggcgguacucaugcauaaggguaagagaauagagcccucuugggcugauguaaaaaaggauuugauaucauacggggguggguggaaauuagaaggcgaguggaaagaaggagaagaaguucaagucuuagcacucgaacccgguaagaauccucgugcaguacaaacuaagccaggccuuuuuaaaacaaauaccgguacuauaggggcaguaagccucgacuucaguccuggaacaucagguagucccaucauagauaaaaaagggaaaguuguuggucuguauggcaacggagucguaacgcguucaggugcuuaugugucagccauagcccaaacugaaaaaucgauugaagauaauccagaaauagaagacgauauuuuuaggaaacgacgccuaacaauaauggauuuacauccaggagcaggcaaaacgaaaagguauuuacccgcuaucguuagagaggcaauuaaaagaggccuucgaacucuuauacuagcaccuacccgcguagucgcugcugagauggaggaagcucuacgggguuugccgauaagauaucagacaccggcaauucgcgcagaacacacugguagagaaauaguagaucuuaugugucacgccaccuucacaaugaggcuguugucaccagucagagucccuaacuauaacuuaauaauuauggacgaagcucauuucacagauccagcuucuauugcagcaaggggauauauuaguacaagaguagaaaugggagaggcggccggcauauucaugacagcgacuccaccugguagccgggacccauuuccacaaaguaaugcuccuauaauagacgaggaaagggaaauucccgagagaagcuggaacuccggucacgaauggguaacagacuucaaaggaaagaccguaugguucguaccuuccauaaaagcagggaacgauaucgccgcaugccuaagaaaaaauggaaaaaagguaauacaguuaucgagaaagacauucgauagcgaauaugugaaaacuaggacaaaugacugggauuuuguuguaacuacagauauuagugaaaugggagcaaacuuuaaggcagaaagagugauugacccuaggcgguguaugaaacccgugauucuaacugauggagaggagagaguaauucuugcugguccuaugccggugacacacucuucugccgcgcaacgcagaggaaggauaggaagaaauccaaaaaaugaaaaugaccaauauaucuauaugggugaacccuuagaaaacgaugaagacugugcacauuggaaagaagccaagaugcuacuagauaauauaaacacaccagaaggcauaauucccaguauguuugagccagaaagagaaaaaguagacgcuauugacggagaauauagauuaaggggggaagcucggaaaacauucguugaccucaugcgaagaggugacuugccaguaugguuagcuuacaaaguugcagcagagggaauaaauuacgcugacagaagauggugcuucgauggaaucaaaaacaaucaaauccuggaagaaaauauggaagucgagauauggacaaaagagggagagcguaagaaauuaaaaccgcggugguuagaugcaagaauuuacagugauccccuagccuugaaagaauucaaagaguucgcugcgggaaggaaaaguuugacguugaacuuaauaacagaaauggguagauuaccaacuuucaugacgcaaaaaacgagagaugcucuagauaaucuagcagucuugcauaccgccgaagcggggggccgcgcguauaaucaugcauuaagcgaguuaccagaaacuuuggaaacgcugcuauuacuaacgcuauuagcaacugugaccggcgggauauuuuuauucuuaaugagcgggcgagggauuggcaaaaugaccuugggaaugugcuguauaauaaccgcaucaauacuguuaugguaugcacaaauucaaccacauuggauagcagcaagcauaauacuagaguuuuuuuuaauaguacuauuaauuccggaaccugagaaacaacgaacuccacaagauaaucaauugacuuacgucguuauagccauacucacaguuguagccgcgacgauggcaaacgagauggguuuuuuagaaaaaacaaagaaagaccucggacuaggaagcauagcaacacagcagccugaaucaaacauacucgacauagaccucagaccggcgucagcauggacucucuaugccguagcgacuacguucguaacuccuaugcucagacauaguauugaaaauaguagcguaaauguaagccuaacagcaauagcaaaccaggccacgguauuaauggguuugggaaaggguuggccucuaucaaagauggauauuggcguaccucuucuggccauaggguguuacucacaaguuaauccgauuacacuuaccgcagcguuacuguugcuaguagcacauuaugcaauuauaggaccuggccugcaagcgaaagcuacccgagaagcacagaaaagagcugccgcagggauuaugaagaacccaacgguagacgguauaacggugauagacuuagaucccaucccauacgauccgaaauuugagaaacagcugggacaaguaaugcuauugauucugugugucacacaaguccuuaugaugcgaacuaccugggcacuaugcgaagcccuaacccuugcaacaggcccaauaucaacgcucugggaaggaaaucccggccgauuuuggaauacgacuauugcaguaucaauggcaaacauauuccgaggauccuauuuagccggggcuggacuuuuauuuagcauaaugaaaaacacaacaaauacacgaagagguacuggaaauaugggcgaaacgcuuggagaaaaauggaagagccggcuaaaugcccugggcaaaagugaauuccaaauauacaaacgaucuggaauccaagaagucgacaggacacuggccaaggaagguauaaaacgaggagaaacugaccaucaugcgguguccagagguucagcaaaguuaagaugguucguugaaagaaacaugguuacgccugaaggaaagguaguagauuuaggcugugguagagggggguggucuuauuauugcggugguuuaaaaaauguaagagaaguuaaaggccuaacaaaagguggaccaggacaugaggaaccaauacccaugucgacauacggauggaauuuaguucggcuacagucgggaguugacguuuucuuuaucccacccgaaaaaugugauacacucuuaugugacauuggagaaaguucaccaaacccaacuguagaagcggguaggacauuaagaguccuaaacuuaguugaaaauuggcuuaacaauaacacacaauuuuguaucaaaguuuuaaaucccuauaugccaaguguaauugaaaaaauggaggcauuacagcguaaauauggaggugcgcuagugaggaacccacuaucgaggaauaguacacacgaaauguauuggguuagcaacgcuagcggaaacauaguaucgucuguuaacaugauaagucguaugcucauaaacagauuuacgaugcggcauaagaaagccacguacgaaccggacguagauuuggggagugguacaagaaacauagguauugaaucugaaauaccuaauuuagauaucauuggaaaaagaaucgaaaaaauuaaacaagaacacgaaacaagcuggcacuaugaucaagaucauccauacaagaccugggcuuaucaugggagcuaugaaacuaagcaaacuggcucagcuaguaguauggucaaugguguaguccgacuauuaacuaaaccaugggacguacucccaaccguaacucaaauggcaaugacagauacgacacccuucggacaacaacgcgucuuuaaggaaaagguagacacacgaacccaagaaccgaaagaagguacaaaaaagcuaaugaaaauuacugcagaauggcuguggaaagaauuggguaagaaaaaaacgccaagaauguguacaagagaagaauuuacccgcaaaguaaggucaaaugcagcuuugggcgcgauauucacugaugaaaauaaauggaaaagugcucgugaagccguagaggacuccagauuuugggaacugguugacaaggaaaggaauuuacaucucgaagggaaaugugagacguguguuuacaauaugaugggaaaaagagaaaaaaaguuaggagaauucggaaaagcaaaagggaguagagccauaugguauaugugguuaggagcgcgcuucuuagaguucgaagccuuagguuuccuuaacgaagaucauugguucucgagagagaacagcuugagcgggguagaaggugagggucuacauaaauugggauauauacucagagacguuaguaagaaagaagguggugcuauguacgccgacgauaccgcggggugggauacgaggauaacacuugaggauuuaaaaaaugaagaaaugguaacaaaucauaugaaaggugaacacaaaaagcuagcugaggcuauuuucaaacuaaccuaucagaauaaaguaguccgggugcagagaccgacgccccggggcacgguaauggauauaauaucccggagagaucaacguggcucugggcaaguggggaccuacggucucaauacauucaccaauauggaggcccaacugauuaggcagauggaaggagaaggcguguuuaaaaacauucaacacuuaacaguuacagaagaagucgcgguacaaaauuggcucgcaagaguaggucgcgaacgguuaagcagaauggccauuucuggagaugauuguguaguaaaaccguuggacgaccguuuugcuaaugcccuuaccgcguugaaugacauggggaaaauuagaaaagauauacaacaaugggagccuucuaaggguuggaacgauuggacucaaguaccuuucuguucgcaucauuuccaugaacuuauaaugaaagauggaagaguauuggucgucccaugccgaaaccaagacgaacugauaggcagagcacguauaagccaaggggcagguuggucacuccgugaaacagcuugcuugggaaagaguuacgcccaaauguggagccuuauguauuuucauagacgagacuugcguuuagccgcaaaugcaaucuguucugcugucccuucacauuggguaccuacaucucgaaccacuuggucaauacacgcaaaacacgaauggaugacgacagaagauauguuaacagucuggaauagaguguggauacgugaaaauccguggauggaggacaaaacuccgguggaauccugggaagaaaucccauacuuggguaagcgugaagaucaaugguguggaagucuaauaggauuaacauccagggcaacaugggcgaaaaauauccaagcagccauuaaucaaguacgaaguuuaauaggcaaugaggaauauacugauuacaugcccaguaugaaaagauucagaagggaggaagaggaagcaggcguucuaugguga

SEQ ID NO: 22315 - RNA, 9876 nt, Artificial Sequence
  derived and/or modified CDS sequence (opt6) from DENV-2__GU131900__SS-prME
uccgcagguaugauaauaauguuaauaccuacaguaauggcguuucaccugacuacaagaaacggagaaccacauaugauuguaggaauacaggagaaaggaaagucucuccuuuuuaagacagaagacgggguaaauauguguacucugauggcaauggauuuaggagaacugugugaagacaccauaaccuacaaauguccauuacuacgucaaaaugaaccugaggacaucgacugcugguguaauucgacaaguaccuggguuaccuacggcacgugcacaacgacuggcgaacauaggcgugaaaaacgaagcgucgcgcuuguaccucauguagguaugggauuggaaacuagaaccgaaacauggaugucaagugaaggugccuggaaacaugcgcagcgaauagaaacuuggauccugagacauccgggauuuacuauuauggccgcuauacuggcguacacaauagguaccacacacuuucaacgcguauuaauauucauauugcugaccgcaguagcgcccagcaugacaaugcgauguauuggaauuucaaaccgggauuuuguggaaggaguaucaggcggaagcugggucgauauaguacuagaacauggaagcuguguuacuacaauggcuaaaaacaaaccuaccuuagacuucgaacugauuaaaacagaggccaaacagcccgccacgcugagaaaauacuguauugaagcuaagcucacgaacaccacuacugaaaguagaugcccaacgcaaggagaaccgucacucaaagaagagcaagacaagagauuuguuugcaaacacucuaugguggaccgaggcugggggaauggaugcgggcuguucggcaagggaggaauugugacaugugcaauguuuacuuguaagaagaauauggaaggcaaaauuguucaacccgaaaaucucgaauauacaauuguaguuacaccucacucuggagaagaacacgcuguaggaaacgauaccggaaaacacggaauggaaauuaaaguaacuccgcaaaguucuauaacagaggcugaacuuacaggauaugguacaguuacaauggaguguagcccuaggaccgguuuagauuucaaugaaaugguauuacugcaaauggagaauaaagcauggcuaguacacaggcaaugguuucuggaccucccacucccuugguuaccaggagcugauaaacaggaaaguaacuggauucagaaagaaacucugguaacauucaaaaacccacacgcuaaaaagcaagacguugucguuuuaggaucacaagaaggagcuaugcauacggcccucacaggagcaacagagauacaaaugucaucgggaaaccuccucuucacggggcauuuaaaaugcagguuaagaauggauaagcuucaacuaaaaggcaugagcuacucaaugugcaccgguaaauucaaaguggucaaagaaauagccgagacacaacauggaacgaucguuauucggguacaauaugagggcgauggaucgccaugcaaaauuccuuuugaaaucauggaccuagaaaaaagauauguccuaggccgacuaauaacugucaacccgauagucacugaaaaagauaguccagugaacaucgaagcggagccaccauuuggugauaguuacauuauaaucgggguagaaccuggucaacuaaaacuaaauugguuuaaaaaaggcaguagcauaggacaaauguucgagacgaccaugcgaggagcaaaaagaauggccaucuuaggcgauacggcaugggauuuuggcagcuugggaggggucuucacauccaucgggaaagcauuacaucaaguguuuggugcaauauacggugcagcauuuagugguguaucauggacgaugaaaauacucauuggaguuauuauaacauggauaggcaugaauucaagauccacaaguuuaagcguaucgcucguacuaguaggaauaguaacacucuaucucggaguuauggugcaggcggacucgggaugcguagugucguggaaaaauaaagaacucaagugcgguaguggaaucuucauuacugauaacguucauaccuggacagaacaguauaaauuucaaccugagagccccagcaaauuagccagcgccauucaaaaggcacaagaggaaggaauaugcggaauaagaagcgucacuaggcuggaaaaucucauguggaaacaaauaacgcccgagcuuaaucauauuuuagcugagaaugaaguaaaacuuacuauaaugacgggugacauaaaaggcauuaugcaagcugggaaacgcagucuuaggccgcaaccaaccgaacuuaaauacucauggaaaacgugggggaaagcaaaaaugcugaguacagagucguacaaccaaacauuccucauugaugggcccgaaacagcagaauguccaaauacuaaccgggcguggaauucuuuggaaguagaagauuauggauuugguguuuuuacgacuaauauaugguuaaaguuaaaggaaaaacaagacgcuuucugcgauuccaaauugaugucagccgcuauuaaagauaacagagccgugcaugcagacaugggauauuggaucgaaagcgcucugaaugacaccuggaagaucgagaaagcuucauucauagaggugaaaaacugucacuggccaaaaagucauaccuuauggagcaacggaguauuagaauccgaaaugaucauaccaaagaauuuagccggccccgugucucagcauaauuaucguccuggauaccauacucaaauugcuggaccguggcaucuaggaaagcucgaaauggauuucgacuucugcgacggcacaacggugauugucacagaagauugugggaaccguggaccaucacugcguaccacuacagcgucggggaaguugauaacagaaugguguugcagaagcuguacacuuccuccgcugcgguaccggggcgaagauggcugcugguacgguauggagauccgaccauugaaagagaaagaagaaaaucuugugaauagcuuaguaacagcuggucauggccaagucgauaacuuuagucuagggguccuugguauggcauuauuucuagaggaaauguuacguacaagagugggaacaaaacacgcaauucuuuuggucgcuguaucuuucguuacauuaauuacgggcaacaugucuuucaaggaucucgguagaguaguaguuauggucggcgcuacaauggcugacgauauuggcauggguguuaccuauuuagcauuauuggccgcauuuaagguacgcccaacauuugccgcgggauuauuacuucgcaaacugacgucaaaagagcuaaugaugacaaccauaggaauaguccuuuugucgcaaaguacuauaccagaaacuguacuggagcuaacggacgcacuagcccuaggaaugaugguacucaaaauaguacgaaacauggaaaaguaccaguuagcugucacuauuauggcgauacuuuguguaccuaaugcgguuauauuacagaacgccuggaaaguuucaugcacaauacuggccguaguaagcgugucgccacuucuacugaccucaucgcagcaaaagacagacuggauaccccucgcgcuuacaauaaaaggauugaaucccacggcgauauucuuaacuacguuaagucgcacaaauaaaaagagaagcuggccuuugaacgaagcaauuauggcagugggaauggugucaauacuugcuucuucucuccuaaaggaugacauuccuaugaccggaccgcuaguggcggggggucuacucacaguuuguuauguacucacuggacggagcgcagaucuugaguuagaacgagcaacugaugucaaaugggaggaucaagcugaaaucagcggaucgaguccgauucuaaguauuaccauauccgaagauggaagcaugucgauaaaaaacgaagaagaagagcaaacguuaacuauauuaauacggacgggucuauuaguuaucaguggcuuauucccuaucucaauacccauaacagcagcagcuugguauuugugggaggucaaaaagcaacgagcgggaguucugugggacguacccucaccacccccaauggggaaagcagaauuagaggacggggcauaucgcaucaaacaaaaaggaauuuugggcuacucacagaucggagcaggaguuuacaaggaaggaacguuccacacuauguggcacgugacuagaggagccguccuaaugcauaaagguaagagaauagaaccuaguugggcugacguaaagaaggaucuaauuucguaugguggagguuggaaacuggaaggagaguggaaagaaggugaagagguacaaguucuagcuuuagaaccaggaaaaaauccucgagcaguacaaacaaaaccagggcuauuuaagacaaauacaggaaccauaggcgcgguuucgcuggauuuuucaccugguacuagcgguucaccaauaauagauaaaaaggggaaaguagugggauuauacggcaauggcguagugacucgguccggagcauacguaucagcuauagcacagacugagaagaguaucgaagacaacccugaaauagaagaugauauauuuaggaaaagacguuuaacuaucauggaccuacacccaggagcaggaaaaacaaaacguuaucuuccagcuaucgugcgcgaagcuaucaaaagaggacuuagaacacuaauccuugcaccaacgcgaguuguugcugcugaaauggaggaagcuuuacgcggauuaccaauaagguaucaaacaccugcgauuagagccgaacacacggggcgcgagauaguagacuugaugugucacgcaacauuuaccaugagauuacucuccccaguucgugucccgaacuauaaucuaauuauaauggacgaagcacauuuuacagacccagcaaguauugcagcaagaggguacauaaguacuaggguagaaaugggggaagcggcuggaauuuuuaugacagccaccccaccuggaagcagagauccguuuccccaaucgaaugccccuauaauugaugaggaaagggaaauuccagagaggucuuggaacucaggacaugaguggguuacagauuucaaaggcaagacaguaugguuugugccuucuauaaaggccggaaaugauauagccgccuguuugagaaaaaaugggaaaaagguaauacaacuuucaagaaaaacuuucgacucagaauauguaaaaacucgaacaaacgacugggacuuugugguuacuacugauaucagugaaaugggagcaaacuuuaaggccgaacgaguaauugauccaagacgaugcaugaaacccguaauacucaccgauggggaggaaagagucauauuagccggcccgaugcccguaacacacagcagugccgcacaaagacgaggucgaauaggccggaaucccaaaaaugaaaaugaucaauacauauauaugggggaaccauuggaaaacgacgaggauugugcccauuggaaggaagcuaaaauguuacucgacaacauuaacacgccagagggaauuauuccuucaauguucgagccugaaagggaaaaagucgacgcgaucgacggggaguacaggcuaaggggggaggcaagaaagaccuucguugaccugaugagaagaggcgaccuucccguauggcuagcguauaaaguggcugcagaaggaaucaauuacgccgaucgaagaugguguuucgacggaauaaagaacaaccaaauacuagaagaaaauguagaaguugaaauuuggacuaaagagggugaacgcaaaaaacuaaaaccgcgaugguuggacgcucgaauauacuccgauccacuagcgcuaaaagaguuuaaagaauuugcagccggaagaaaaucauuaacucuaaaucugauaacugaaauggggagacuuccaacauucaugacccaaaaaacccgagaugcguuggauaacuuagcuguguugcacacagcugaagcaggcggucgagcuuacaaccacgcgcuaagcgaauuaccugagacccucgaaacauuacuguuauugacauuauuagcgacagugaccgggggcauauuucucuuuuuaaugucgggccgaggaauagguaaaaugacccuaggaaugugcugcauaauaacggcaaguauacuuuuaugguaugcacagauacaaccucauuggaucgcagcgucuauaauccuugaauuuuuucuuauaguguuacuaauccccgaaccagaaaagcaaagaacgccucaagacaaccaauuaacguauguaguuauagcaauauuaacuguaguagcugcaacaauggcgaacgaaaugggauuucucgaaaaaacgaaaaaggaccugggcuuagguucuauagcaacucaacaaccggaaaguaauauacucgauauugauuuacgaccagcgagcgcauggacacuauaugccguggcaacaaccuuuguaacuccuaugcuuagacauaguaucgagaauaguucgguaaauguaucgcuuaccgcuauagcuaaucaagcaacaguauuaaugggucuaggaaaaggauggccauuaucaaaaauggacauagguguaccucucuuagccauaggauguuauagucagguaaauccaauaacauuaacggccgcccucuuguuacuuguugcucauuacgcgauaaucggcccaggauugcaggcuaaagcaacacgagaagcacagaaacgagcugcggcaggaauuaugaaaaauccaacugucgauggaauuacagugaucgaccuagacccgauuccguaugauccuaaauuugaaaaacagcuaggccaagucaugcuauuaauacuguguguaacacaaguucucaugaugagaacgacaugggcauuaugugaagcccucacuuuagcaacgggcccaaucucaacauuaugggaaggaaauccgggaagauucuggaacacaacaauugcuguaagcauggcuaacauuuucagaggaucauauuuggcaggugcugggcuacuguuuaguauaaugaagaacacgaccaacacuagacgagggacgggaaacauaggggagacgcugggcgaaaaauggaaauccagauugaacgcucuugguaaaucagaauuccaaauauacaaaaagagcgguauucaagaaguugaccgaacuuuagcaaaagaaggaauuaaaagaggggagacagaccaccacgccgugucaagaggaucagcaaaacuuagaugguuugucgagcguaacauggugacuccagaagggaaagucguagaucugggauguggacggggagguuggaguuauuacugcggaggauuaaagaauguuagagaaguaaaaggucucacuaaaggaggcccuggccacgaagagccgauacccaugucaaccuacgguuggaauuugguaagguuacaaaguggaguagacguauuuuuuauaccaccagaaaaaugugauacccuacugugugauauaggagaaagcagccccaaccccacaguugaagcuggaagaacguuacgaguguuaaaccuuguagaaaauuggcuuaauaauaauacgcaguuuuguauaaaaguacuaaacccguauaugcccagugugauugaaaaaauggaggccuuacagagaaaauauggaggcgcacuugugagaaaucccuuaucaagaaauucaacccacgagauguauuggguuaguaaugcaucgggcaauaucguuucuagcguaaauaugauuucuaggauguuaauaaacagguuuacgaugcgucacaaaaaggcaacguaugaaccagacgucgaccuggggucaggcacgagaaauaucgggauugaaagcgaaauaccaaaccuagauauaauaggaaaacgaauugaaaaaauuaaagaggaacaugaaacuucguggcacuaugaucaagaccauccauauaaaacuugggccuaucauggcagcuaugagaccaagcaaacgggaucggccucaucuauggugaauggagucguaagguuguugaccaaaccuugggaugugcuuccuacaguuacacaaauggcaaugaccgauacuacuccauuugggcagcaaagaguuuucaaagaaaaaguagauacaaggacacaagagccuaaggaagguacaaaaaaacuaaugaaaauaacagcugaauggcuauggaaggaacugggaaaaaaaaaaacaccaagaaugugcacacgugaggaguucacaagaaaaguccguuccaacgcugcuuugggugcaauauuuacugaugaaaacaaguggaaaagcgccagagaagcaguggaagauucgagauuuugggaacuaguagauaaggaaaggaauuuacauuuagaagguaaaugugaaacauguguuuacaauaugauggguaagcgcgaaaaaaaauuaggagaauuuggcaaagcuaaaggaucucgagcgauaugguacauguggcugggcgcccgguuuuuagaauuugaagcucuaggguuuuuaaacgaagaccauugguuuucacgugaaaacagccuaaguggaguugaaggagaaggucugcauaaauuaggcuauauucuaagggauguaaguaagaaggaggguggugcuauguaugcagaugauaccgccgguugggauacuagaauaacacucgaggauuuaaaaaacgaagaaauggugacaaaucacauggaaggagaacacaaaaaauuagcggaggcaauuuuuaaacuaacauaucaaaacaaaguugugagaguucaacgaccaacaccaagggguacaguuauggauauaauaucucgaagagaucagagaggcuccggccaaguaggaacguauggauugaacacguuuacgaauauggaagcgcagcuuaucagacaaauggaaggagagggaguuuuuaaaaauauacaacacuuaacaguuacugaagaggcagcuguucaaaauugguuggcucgaguuggccgcgagagguuaucuagaauggcgauaucuggugaugauugcguugugaaaccucucgacgauagauucgcaaaugcauuaacagcauuaaacgauaugggaaaaauacgcaaagacauucaacagugggaacccuccaagggcuggaaugauuggacacagguaccguucugcagucaucauuuccaugaguuaauaaugaaagacgguagaguucugguuguaccguguagaaaccaggacgaacuaauuggaagagccagaauuagccaaggggcuggcuggagucugagagagacagcgugucucggaaaaaguuaugcucagauguggaguuuaauguauuuccaccgacgggaucuuaggcuagccgcaaacgcaauauguucugcaguaccaagucacuggguuccaacuucaagaacuacuuggaguauucaugcuaaacacgaguggaugacaacagaggacauguuaaccguuuggaauaggguauggauucgugaaaacccauggauggaggacaaaacaccaguagaaucaugggaagaaauaccauauuuaggaaaacgagaggaccaauggugugguagcuuaauuggacuuacaucgcgagcaacuugggcaaaaaauauacaagcagcaauaaaucaagugagaucauuaauagggaacgaagaauacaccgauuauaugccuagcaugaagcgauuccgaagagaagaagaagaggcaggaguguuaugguaa

SEQ ID NO: 22316 - RNA, 9876 nt, Artificial Sequence
  derived and/or modified CDS sequence (opt6) from DENV-2__GU131901__SS-prME
agcgcagguaugaucaucauguuaaucccaacaguuauggcauuucaccuaacaacaagaaauggagaaccucacaugauuguggguauucaagaaaaagggaaaagucuucuauuuaaaacagaagauggggugaacauguguacauuaauggcaauggaccuuggugaacuuugugaagauacuaucacauauaaaugcccucuacuacgucaaaaugaaccggaagacaucgauugcugguguaacucuacaucgacgugggucacuuauggaacuuguaccacgacaggagaacauagaagagagaaaagaagcguagcucuugucccgcauguugguaugggauuggaaacaagaacggaaaccuggaugagcucagaaggggcauggaaacaugcacaacgaauagaaacauggauacuccgacauccaggguuuacgauuauggccgcuauauuagcauauacaaucgggacaacccacuuucaacgaguccugauauucauucucuugacggcaguugcuccguccaugacuaugcggugcauuggaauuuccaaccgagauuuuguagaaggaguaucugguggcucauggguugauauaguccuggaacacgguuccugcgugacuacuauggccaaaaauaaaccuacguuggauuuugaauugauaaaaaccgaagccaaacaaccagcaacuuuacggaaauauugcauugaagccaaacuaacaaacaccacaacugaaagucgcugcccaacucaaggggaaccgucguuaaaagaggaacaagacaaacgauuuguauguaaacacagcaugguagacagaggaugggguaauggaugcggauuauucgggaaagguggaauaguaacgugugccauguuuacuugcaagaaaaauauggaaggcaaaauaguacaaccggaaaaucucgaauacacuaucguaguaaccccacacagcggggaagaacaugcagucggcaaugauacggguaaacacggaauggaaaucaaaguaacgccacaaagcuccauuacagaggcagaacugacuggauacgguacaguaacaauggagugcaguccacguacgggguuagauuuuaaugaaauggucuuguugcaaauggaaaauaaagccuggcugguacaucgucaaugguuuuuagaucucccacuuccuugguuaccuggcgcugacaaacaagaaucaaacuggauacagaaagaaacccucguaaccuucaaaaacccucacgcuaagaaacaggauguugucguauuaggaucacaagaaggggcaaugcacacggccuugacaggagcaacugaaauccaaaugucuucuggaaauuuacuuuuuacgggucaccuuaaaugcagauuaagaauggauaaacuacaacuuaaggggaugucauauucgaugugcacuggcaaauuuaaagugguaaaggagauugcagagacacaacacggcaccauuguaauacgcguacaauacgagggggaugggucuccguguaaaaucccauuugaaaucauggaucuggagaaacguuaugugcucggaagauuaauaacaguuaauccuauaguaacugaaaaggacuccccaguuaauauagaagcggagccaccauuuggagacagcuacauuauuaucggcguagagccgggacaauuaaaacucaacugguuuaagaaaggaucuaguauaggacaaauguuugaaacgacgaugagaggagcgaagaggauggcuauccuaggagacacggcgugggauuuuggaagucuaggugggguauucacuucgauugggaaagccuuacaccaaguauuuggggcaaucuacggagcagcguuuucuggaguaucguggaccaugaagauauuaauaggaguuauaauuacauggauuggcaugaacucccgaaguacgucucuuucgguuucauuaguucuaguuggaauaguaacauuauaucucggagugaugguucaagcagauagcggcuguguugucucauggaagaacaaagaacuuaaaugugggagcgguauuuucauuaccgauaauguucauacauggacagaacaauauaaguuccaaccagaaagcccaucaaagcuggcaucagcaauacaaaaagcacaagaagaagggauaugcggcauccggagcguaacucgauuagaaaaucugauguggaagcaaauaacaccugaauugaaucacauccuugcugaaaaugaagugaaacuaaccaucaugacaggugauaucaagggcauuaugcaggccggcaaaagaagucuacgaccacaacccacagaacuuaaauacuccuggaaaacgugggguaaagcuaaaauguuaucgacggaaucauacaaucaaaccuuucuaaucgauggaccagaaacagcagaauguccgaacacgaaucgcgccuggaacucgcuugaaguagaggauuacggcuucggcguguucacgacaaacauaugguuaaaauugaaagaaaagcaggacgcauucugcgauaguaaauuaaugagcgcagcaauaaaagauaacagggcagugcaugcggacaugggcuauuggauagaaucagcgcuuaacgauacuuggaaaaucgaaaaagcuaguuucauagaagugaaaaacugucauuggccaaagagucauacuuuauggucgaacgggguauuagaaucagaaaugauaauacccaaaaaucuagcagguccggugucucaacauaacuacagaccaggauaucauacacagaucgcuggaccauggcacuuaggaaaacuagaaauggacuuugacuuuugugauggcacaacuguaauuguuacagaagauugcggcaacagagggccuucucuacgaaccacaacagcuaguggcaaguuaauaacugaguggugcugcaggucuuguacucuuccaccacuaagauaucgcggagaagacggguguugguaugguauggaaauucgacccuugaaggaaaaagaagaaaaucuugugaacucuuuggugacugcgggacauggacaaguagauaacuuuuccuuaggcguguuaggaauggcauuauuucuagaagaaauguuacgaacuaggguuggcacaaaacaugcgauacuguuaguagcuguaaguuuuguuacucugauaaccgguaauaugucguucaaagauuugggacguguaguaguuauggucggugcgacaauggcggaugauauuggcaugggcgugacguauuuagcguuauuagccgccuuuaaaguuagaccgacauucgcagccgggcuacuauuaagaaaacucacaucuaaagaauugaugaugacgacgauagggauuguacuacuuucccaaucaacuaucccugaaacaguucuggaacuaacagaugcauuggcauuagguaugaugguauugaaaauaguuaggaauauggaaaaauaucaauuagcaguuacuauaauggcaauucuauguguaccaaacgcgguaauccuacaaaaugcauggaaaguaaguuguacaauacuagccguagugagcgugaguccccucuuauugaccaguagccaacagaaaacugauuggaucccucuugccuuaaccauaaagggacuuaacccgacagcaauauuccuaacuacucuuagcagaacuaacaaaaagaggucauggccacuaaacgaggcaauaauggccgucgguaugguaagcauacuugccucuucguuacuuaaaaaugauauaccuaugaccggaccacucguagcaggaggacuacugacgguguguuacguuuuaaccggccguagugcugaucuugaauuagagcgugccacugaugucaaaugggaagaucaggcggaaauuuccgggucaucacccauacuaaguaucacuauuagugaagacggaucuaugucaauuaaaaaugaagaagaagaacaaacacugaccauccuuauaagaacaggauuauuagucauaucaggauuauuucccauuucaaucccuauaacggcggcugcuugguaucugugggaaguuaaaaagcaaagggcggguguccuuugggaugucccuaguccgccgccaaugggaaaggccgaacucgaagacggagccuaucgaaucaaacagaagggcauccucgguuacagucaaaucggcgcugggguguauaaagagggcacguuccacacgauguggcauguaacgcgaggagcgguacucaugcacaaagguaagagaaucgaaccuagcugggcugaugugaaaaaggacuugaucucauauggagggggauggaaacuugaaggugaauggaaagaaggggaagaagugcagguacuagcauuagaaccggguaagaauccuagagccgugcaaacaaaaccaggacucuucaagacuaacacagguacuauuggggccguuucguuagacuuuagcccggguacaagugguuccccaauaauugacaaaaagggaaaaguaguugggcuguaugguaauggggucguaacaagaaguggugcuuacguaagugcuauugcacagacugaaaagucuauugaagauaacccagaaauagaggacgauauauuucgcaaacgcagacuuaccauaauggauuuacauccuggagccggaaagacaaaacgcuauuuaccggcaaucguaagagaggcuauaaaacguggguugagaacuuuaauacuugcuccuacccguguaguagcagccgaaauggaggaagcacuacggggucuaccgauccguuaucagacgcccgcaauccgagcagaacauaccgggagagaaaucgucgacuugaugugccacgcaacguuuacaaugcgucuuuuaaguccuguaagaguaccuaacuacaaccucauaauuauggacgaagcacauuuuacugauccagcaucgauagcugcaagaggauacauauccacaagaguggagaugggagaagcggcggguauauuuaugacggcaacgccaccuggcagucgagaucccuuuccacaaucaaaugcgccaauuaucgacgaagaacgagaaauuccagagagaaguuggaacucaggacaugaguggguuacugauuucaaagggaaaacaguaugguuuguaccuagcauaaaagcaggcaaugauauugccgccuguuuacgaaagaauggcaagaaaguaauccaacuaucacgaaagacauucgauagugaguaugugaaaacuagaaccaaugacugggauuuugugguaacuacggacauuucagaaaugggugcuaauuuuaaagcagaaagagucauugacccaagacgauguaugaagcccgugaucuugacagacggagaagaaagagucauacuagcuggaccuaugcccguuacucacagcagcgcugcucaaagaagggguagaauugggagaaaccccaaaaaugaaaacgaucaguauauuuacaugggagaaccuuuagagaaugaugaagauugcgcacacuggaaagaggcuaagaugcuucuugauaauauaaacacaccggaagggauuauaccaucaauguucgagccugaaagagaaaaaguagaugccauugauggagaauacagacuacgaggagaggccagaaaaaccuuuguugauuuaaugcgucguggagacuuaccgguauggcuagcauauaaaguugcugcggaggguaucaauuacgcugaucgaagguggugcuuugauggcauuaagaauaaccaaauccuugaagagaauguagaaguagaaauauggacaaaggagggggaaaggaagaaacuaaaaccaagaugguuagaugcacggaucuauucagauccuuuagcacuaaaggaauuuaaagaauuugcggcagggcguaaaucauuaacauuaaaccuuauuacugaaaugggucgucuuccgacauucaugacccagaaaacuagagacgcuuuagacaauuuagccguacugcauaccgcggaagcaggagguagagcuuacaaccaugcguuaagugaacuacccgagacauuggaaacucucuuacuucuuaccuugcuagcaacugucacaggaggaauauuuuuauucuugaugucugggagaggcaucgggaaaaugacuuuaggaauguguugcauaauuacagcgucuauucuccuaugguaugcacaaauacaaccucacuggauugcugcaaguauuauccuggaguucuuucugauuguccuuuuaauaccagaaccggaaaaacaaagaacaccucaggacaaucaacuuaccuacguuguuauugcaauucuaaccguaguagcagcuacgauggcaaaugaaaugggguuccuagagaaaaccaagaaagauuugggauuagggucaauagcuacccaacagcccgaaucaaauauacuagauauagaucugcgaccagcaucagcuuggaccuuauaugcuguagcgacgacguucguaacaccaaugcugcggcauucuauagaaaacaguuccgugaauguuucuuuaaccgcgauagcaaaccaagcaacgguccuuauggggcuuggaaaaggauggccuuuaucaaaaauggauauagguguaccguuauuggcaaucggcugcuacucgcaaguuaacccaauuacacucaccgcagcauugcuuuugcuuguagcucacuaugcaauuaucgguccuggauuacaagcgaaagcaacacgagaagcgcaaaaacgggcagcagcuggaauuaugaaaaacccaacaguagacggcauaacgguaauagauuuggauccuauaccuuaugauccaaaauuugagaaacaauuaggacaaguaaugcuacugauccuauguguaacacaaguauuaaugaugagaacaacaugggcauuaugugaggcuuuaacacuagccacgggaccaauaucaacucugugggaagguaaccccgggagauucuggaacacuacaauagcaguuagcauggccaauaucuuucgaggaaguuauuuagcaggggcuggacuuuuguuuucgauuaugaaaaauacgacaaacacacggcgcggaacuggaaauguaggggaaacacuaggcgaaaaguggaagucaagauugaacgcauuaggcaaaagugaauuucaaauuuauaaaaagucugguauucaggaaguggaucgaacccuagcaaaagagggcauaaaaagaggagagaccgaucaucaugcaguaaguaggggauccgcaaaacuacggugguuuguagaacguaauaugguaacuccagaagggaaaguaguggacuuaggauguggacgaggaggauggagcuauuacugcgguggucucaaaaacguacgcgaagugaaaggacugacuaaagggggaccuggacaugaagaaccgauuccaaugucaacuuauggauggaauuuaguuaggcuccaauccgguguagauguauucuuuauuccaccugaaaagugcgacacauugcuaugugauauaggagagagcaguccgaauccgaccgucgaagcagggaggacucuccgaguacuaaaccuaguagaaaauuggcuuaauaauaauacucaauucuguauaaaaguucuaaauccuuauaugccgucaguaaucgagaaaauggaagcauuacaacguaaguaugggggcgcucuaguaaggaacccacucagccgaaacagcacacaugaaauguauugggugagcaacgcaucaggaaauauugugucaagcguuaacaugauaagcagaauguuaaucaaucgcuucacaaugagacauaagaaagcaacauaugaaccagauguugauuuaggaaguggaacucguaauauaggcauugagagugaaauuccuaauuuagacauuauugggaaaagaauagagaaaauaaaagaagaacaugaaacaucauggcacuacgaccaagaucaucccuacaaaacuugggcauaucauggcucuuaugaaacaaagcaaacgggauccgcuaguucaaugguaaaugguguuguacggcuacuaacaaagccaugggacgucuugccaacuguaacacaaauggcaaugacggacacaacuccauuuggucagcagagaguuuuuaaagagaaggucgacacaagaacacaagaaccuaaagaagggacuaagaaacuaaugaaaauuaccgcugaauggcuauggaaggaacuuggaaagaagaaaacuccgagaaugugcacacgagaagaguucacaaggaagguuagguccaacgcagcucuaggcgccauauucacagaugaaaacaaauggaaaucugcuagggaagccguugaagacagucgguucugggagcuuguugacaaagagaggaaccuccaucuggagggcaagugugaaacuuguguauauaauaugaugggcaaaagggaaaagaaguuaggugaauuuggaaaggcuaaggguucaagagcuauaugguauaugugguuaggagcacgauucuuagaauuugaagcacuaggauuuuugaacgaagaucacugguuuaguagggagaauagucuuuccggcguagagggugaaggucuacacaaauuagguuauauacucagagacguaagcaagaaagaagguggagcaauguacgcggaugacacugcagggugggauacaagaauuacacucgaagaccuaaagaaugaggaaaugguuacgaaccauauggaaggggaacacaagaaacucgccgaagcuauauuuaaacuuacauaucagaauaaggucgugcggguacagcgcccaacuccgagagggacuguaauggacauaauaucaaggagagaucagagggguagcggacaagugggcacauacggucuuaacaccuucaccaauauggaggcccagcuaauccgucagauggaaggcgaagggguauucaaaaacauccaacaccuaacgguaacagaagaggcagcaguucaaaacugguuggcaagggucggcagagaacgacucagccggauggccauaucgggggacgauuguguagucaaaccguuagaugaucgauuugcuaacgcucuaacugcauuaaaugauaugggaaaaaucagaaaagacauucagcaaugggaaccgagcaaggguuggaaugacuggacucaagugcccuuuuguucucaccacuuucacgaacugauaaugaaagauggaagaguuuuagucguacccugcagaaaucaagaugaguugauagggagagcaaggauaagccaaggagcgggauggucauuaagagaaacugcaugucuugggaaaucauacgcccaaauguggagcuuaauguauuuccaccgaagggaucuaagguuagcagcgaaugcgaucugcucugcaguaccaagccauuggguuccuacuucacgaacaacauggaguauucacgcgaagcacgaauggaugacuacugaagauauguugaccguguggaauagaguauggaucagggaaaacccauggauggaagauaaaacaccaguggaaagcugggaggaaaucccguaucuaggaaaaagagaagaucaaugguguggcucccucauuggucucacaagccgagcaaccugggccaaaaauauacaagcugcaauaaaccaagugcgaucguuaauugggaacgaagaauauacagacuacaugcccaguaugaaaagauucagacgugaggaagaagaagcuggcguucugugguga

SEQ ID NO: 22317 - RNA, 9876 nt, Artificial Sequence
  derived and/or modified CDS sequence (opt6) from DENV-2__GU131902__SS-prME
uccgcuggcaugauaauaaugcuaauuccaacuguaauggcguuccaccuuacuacaagaaacggcgaaccacacaugauaguuggcauacaagaaaaaggaaaaucacugcuguucaaaacagaagauggaguuaauaugugcacacugauggcaauggaucuuggagaauuaugugaagauacaaucaccuauaaaugcccacuacuaagacaaaacgaaccggaagauauugacugcugguguaauucuacaucaacuuggguuacauacggaacgugcacaacuacaggugaacauagaagagaaaagagguccguagcauuaguaccacauguuggaaugggucuagaaacacgaaccgagacguggaugucauccgagggagcguggaaacaugcucaaaggauagaaacauggauacuacgacacccagguuucacaauaauggcagcaauacuggcauacaccauaggcaccacucacuuucaaagaguacuaauauucauacuacugacugcggucgcaccuuccaugacaaugcgguguauagguauaaguaacagagauuuuguggagggaguaagugggggaagcuggguggacauuguauuagaacaugguagcugcguaacgacaauggccaaaaauaaaccaacauuagauuucgaacuaaucaaaacggaggcgaaacaaccggcaacuuuaaggaaguacugcauugaagcgaaacuuacaaauacaacuacugagaguagguguccaacccaaggagaacccagcuuaaaggaagaacaagacaaaagauuuguauguaagcauucuaugguagauagggguuggggaaacggcuguggucuauucggaaaaggcgguauagugaccugugcaauguuuaccugcaaaaagaauauggaagggaagauagugcaaccagagaaccuagaauauacgauugucguaacaccucauucaggggaggagcaugcaguuggaaacgauaccgggaaacacgguauggaaaucaaggugacaccgcaaagcucaaucacugaagccgaauuaacaggcuacggaacuguuacuauggaauguagcccuaggacuggucuagacuuuaaugaaaugguauugcugcaaauggaaaauaaagcauggcuuguccaucggcaaugguuucuagacuuaccuuuacccugguuaccaggggcagauaaacaagagagcaacuggauccaaaaagaaacccuuguaacguucaagaacccucaugcuaagaaacaggacguagucguacuugggucccaggaaggagcaaugcauacagcacucacaggggcuacagaaauucaaaugucaagcgguaaucugcuuuuuaccggucauuuaaaaugcagauuaagaauggacaaacugcaauugaaaggcauguccuacucaaugugcacugggaaauucaaaguaguaaaggagauagcugaaacucaacacggaacaaucgugauaaggguacaauacgagggagacgggucaccuuguaaaauucccuuugagauuauggaucuagagaaacgauacguauuaggaagguugaucacaguuaauccaauaguaacggaaaaagacucaccugugaauauugaagcagagccaccuuucggugauucauauaucaucauuggaguagagccaggacaauugaaacugaacugguucaagaaaggaucaucuauaggucaaauguuugaaacgacaaugagaggggcaaaacguauggccauacuuggcgacacagcaugggauuucgggucacuuggaggcguauuuacgucuauuggaaaagcucuccaucaaguguucggagccaucuauggcgcugcuuucucaggaguaucuuggacuaugaaaauucucauagguguuaucauuacauggaucggaaugaacucccgaucaaccucccugucaguaagccuagugcuaguuggaauaguaacacuuuaucuaggaguaaugguccaagcugauuccgguuguguuguuucguggaaaaauaaagaguuaaaaugcggauccgguauauuuauaacagauaacguucauacauggacagaacaguacaaauuucaacccgaaaguccaucuaaauuagcuagcgcuauccaaaaggcacaagaagaaggaauaugcggcauucguucgguaacacgacuagaaaauuuaauguggaaacaaaucacaccugaacuuaaucauauacucgcagaaaaugaagugaagcuaacgauuaugacuggcgauauaaaaggcauuaugcaagccggaaagcguagcuuaagaccacaaccuacagaauuaaaauauuccuggaagacuuggggcaaagccaagaugcuaagcaccgaaucguauaaucagaccuucuuaaucgacggcccagaaacugcggaauguccaaacacgaauagagcuuggaacagccuagaagucgaagacuaugguuuugggguauuuaccaccaacauauggcucaaacugaaagaaaaacaagacgcuuuuugugauaguaaacugaugucagccgcaauuaaagauaaccgagcugugcaugcagauaugggcuauuggauagaguccgcccuaaaugauaccuggaaaauagagaaagcaucuuuuauagaagucaaaaacugccauuggccuaagucgcauacucucuggaguaacggaguacuagagagugaaaugauaauacccaaaaaucuugcgggcccagugucccaacauaacuacaggccagguuaccauacucaaaucgcaggaccauggcauuuaggaaaauuagagauggauuucgauuuuugcgacggcacaacaguaauagugaccgaagauugugguaaccgaggaccuucucuuagaacuacgacugcgucugguaaacugauagcugaauggugcuguagauccuguacauuaccacccuugcguuauaggggugaagacggcugcugguacggaauggagauaagaccucugaaagaaaaagaagaaaaccugguaaauagccuaguaaccgcaggacauggacagguagauaauuuuuccuuaggagucuuagggauggcacucuuccuugaagaaauguuaagaacgcguguugguacuaaacacgcuauacuguuggucgcuguuucauuuguaacuuuaauaacagguaacaugaguuucaaagauuuagguagaguugucguuaugguuggggcaaccauggccgaugauauagggaugggaguaacuuaucuagcucugcuugcugcguucaaaguuagaccaacuuucgcagccggccuucuccuaaggaaauuaacauccaaagaauuaaugaugacuaccauaggaaucguccuuuugucacaaucuaccauaccagaaacuguucuugaauuaacugacgcucuggcacuagguaugauggucuuaaaaauuguuagaaacauggaaaaauaucaacucgcagucacaauaauggcuauacuaugcgucccuaaugcaguuauauuacagaaugcguggaaagugucaugcacuauucuagcgguagucucggucagcccuuuacuccuaacaucaagucaacagaaaacagacuggauacccuuagcacuuacgauaaaaggauugaauccaacagcuaucuuuuugacgacacucucucguaccaacaagaaacgaucauggccauuaaacgaagcuauaauggcaguaggaaugguaucuauacuugccuccagccuacucaaaaacgacauccccaugacgggaccauuaguugcaggaggauuacuuacaguuugcuacguuuuaacuggaaggagugcugaucuagaacuagagagagcgacggacguuaaaugggaagaucaagcugaaaucuccggaucuucacccauccuguccauaacgauaagcgaagauggaaguaugucuauuaaaaacgaggaagaagaacagacacuaacaauauuaaucagaacaggacuacuuguaaucucuggauuauuuccaauaagcauaccaauaacagcagcagcaugguaucuaugggaggucaagaaacagcgagccgggguacucugggacgugccgucgccgccgccuaugggcaaggcagaacuugaagauggcgcuuaccgaauaaagcaaaaggguauuuuaggauacucgcaaauuggggcgggaguauauaaagaagggacuuuucacacaauguggcacguaacacgaggugcagucuuaaugcauaagggcaaacgaaucgagccaagcugggcugauguaaagaaagaucugauaucguauggcggcggcuggaaacucgaaggugaauggaaggaaggcgaagaaguucaaguauuggccuuagaaccagguaaaaacccccgagcuguccaaacaaaaccuggauuauucaaaacaaacacuggaaccauuggagcaguaucccucgauuucaguccuggaaccaguggaucaccaauuaucgacaagaagggaaaaguuguaggucuauaugguaauggugucguaacaagaagcggggcuuacguaagugcuauugcucaaacggagaaauccauugaagauaacccagaaauagaagaugacauauuuagaaagaggagauuaacaauaauggacuuacauccaggugcagguaagacaaaacgguauuugcccgcuauuguaagagaagcgaucaagagaggucuuagaacgcuaauucuggcaccuacuagaguaguggcugccgaaauggaagaggcacuaagagggcuaccuauccgauaccaaacucccgcaaucagggcagaacacacaggcagggaaauuguggauuuaaugugucaugccacauuuacaaugcguuuacuaaguccaguaagagucccaaauuauaaucuuauaauaauggaugaagcacauuucacagauccagcauccauugcugcccggggauacauuucgacgcguguagagaugggugaagcugccggcaucuuuaugacugccacgccuccagguucaagagacccauucccacagucaaacgcgcccauaaucgacgaagaacgagaaauacccgaaagaaguuggaacagcggccaugaaugggugacggauuucaagggaaaaacaguaugguucguaccaaguaucaaagcgggaaaugacauagcugccugccuaagaaagaaugggaagaaaguuauccaauuaucaaggaagaccuuugauuccgaguacgugaagacuagaacaaacgauugggauuuuguaguaaccacagacaucagcgaaaugggagccaauuuuaaagcugagagaguaaucgauccccgaagaugcaugaaaccuguaaucuuaaccgauggagaagaaagaguaauccucgcaggaccaaugccaguuacgcauucgucggcugcacaacgcagggguagaaucgggcgcaaucccaaaaaugaaaacgaccaauauauauauaugggagaaccgcuagaaaaugaugaagacugugcacauuggaaagaggccaaaauguuacuugauaauaucaauacaccagaaggaauaaucccaaguauguuugaaccagaaagagagaaaguugaugcgauugauggcgaguaccgucugcgcggagaagcccgcaaaacuuucguugauuuaaugaggaggggcgaucuaccuguuugguuagcuuauaaaguagcggcggaaggcaucaauuacgcagaucgcagaugguguuuugaugggaucaaaaacaaucaaauauuagaggaaaauguggagguagaaauauggaccaaagaaggagaaagaaagaaguuaaaaccuagguggcuagacgcgaggaucuacagugauccauuagcacuuaaagaguucaaagaauuugcagcaggcagaaaaagccuaacauuaaaucuuaucacagagaugggcagacugccgacauucaugacacagaaaacacgugaugcguuagacaacuuagccguauuacacacagccgaagccgguggucgcgcuuacaaccacgcacuguccgaacuccccgaaaccuuggaaacucuacuauuauuaacacucuuagcgacaguaacaggaggaauauuuuuauuucuaaugucuggaagagguauuggaaaaaugacacuuggaaugugcugcaucauuacagccucaauacuguugugguacgcccaaauacaaccucacuggauagcugcuuccauaauauuagaguucuucuuaauaguacuacuuauaccggagccagagaaacaaaggacaccccaagacaaccaguugaccuacguugugauugcaaucuugacuguaguggcugcgacgauggcuaacgagaugggguuccuggagaaaacuaagaaagaccucggacugggcagcauagcaacacaacaaccugaauccaauauacuagauauagauuugagaccggccagugccuggaccuuauacgcgguugcaacaacauuugucacacccauguuaagacauaguauugaaaauucaucaguaaacgugucacuaacagcuaucgccaaccaagcaacuguucucauggggcuaggaaagggauggccauuauccaaaauggauauaggaguaccacuguuagcuauuggauguuauucccaaguaaaucccauaacccugacagccgcacuuuuacuacuuguagcgcacuaugcaauaaucggaccaggcuugcaagcuaaagccacacgugaggcucaaaaacgggcagcugcugguauaaugaaaaaccccacaguggacgggaucacaguaaucgaccuagauccaaucccauaugauccaaaauuugagaaacagcuaggccaaguaauguugcuaauuuuaugugugacgcaaguucucaugaugcgcacaacaugggcccuuugcgaggcucucacauuagcgacagguccuauaucaacauuaugggagggaaauccaggcagauucuggaacaccaccauagcaguaucaauggcaaauauuuuccggggaucauaccuagcaggagcuggguuacuauuuucaaucaugaagaauacuacuaacacucggcguggaacggguaacauaggggaaacucuaggcgaaaaguggaaaucgcgacuuaaugcacuaggaaaaagcgaguuucaaauauacaaaaagucaggcauucaagaaguagauagaacacuagccaaagaagggauaaaaaggggcgaaaccgaccaccaugcuguaucaagaggaucugcaaaauugcgcugguuuguggaaagaaauaugguuaccccugaaggcaaaguuguggaucucgguuguggacgaggggguugguccuauuauugcgguggacucaaaaacguaagggaaguuaaagggcugacuaaggguggcccuggucaugaggaacccauaccaaugaguacguauggauggaaucuaguucgucuacaaucagggguugacgucuucuuuauuccaccggagaaaugugacacgcuacuaugcgacauaggagagucuuccccaaacccgacaguagaagcagguaggacacuccguguccucaaccuuguugaaaauugguuaaacaauaacacucaauucuguaucaagguauugaauccauacaugccuuccgucauugagaagauggaagccuuacaacguaaguaugguggugcauugguacgaaauccuuuaucaagaaacucgacucaugaaauguauugggugucuaacgcuagcgguaacauagugagcagcguuaauaugauuucccguaugcucauuaaucgauucaccaugagacauaaaaaggcgacuuaugagcccgacguugaccuuggcucuggaacacggaauauaggcauugaaagugagauaccgaauuuagacauuauaggcaaaagaauagagaaaauuaaagaagaacaugagaccucuuggcacuacgaccaagaccacccuuauaaaacaugggcauaccauggaucguaugaaacuaaacaaacagguucagcuucgucaaugguuaaugguguagugagacuccuuacaaagccgugggacguuuuaccuaccguuacacagauggcgaugacugacaccacacccuucggacaacagagaguauuuaaagaaaagguugacacacgcacgcaagaacccaaagaagggacaaagaaauuaaugaaaauaacagcagaaugguuauggaaagaacuugguaaaaagaagacgccccgaaugugcacgagggaagaauuuacaagaaaaguacgauccaaugcugcccucggugcgauuuuuacggaugaaaauaaauggaagagugcaagagaagccguagaggauucacgauucugggagcuaguagacaaggaaagaaaucuacaccuugaaggcaaaugcgaaacaugcguguacaacaugauggggaaacgagaaaagaaauugggagaauuuggaaaggcaaaaggcagucgcgccauaugguauauguggcuaggagccagguuccuggaauuugaagcacuaggauuuuugaacgaagaucauugguucucgcgagagaacagcuuaucaggaguagagggagaaggucuacauaaacuagguuauaucuugagagaugucucaaagaaagaaggcggagcaauguaugcggacgauacagcggggugggauacacgcauaacccuagaagaucucaaaaaugaggagaugguaacaaaucacauggaaggugagcauaaaaaguuagcagaggcaauauucaaauuaacauaucaaaauaaaguuguccguguacaaaggccuaccccuaggggaacagucauggauauaauaucucgacgggaucagagagggucaggacagguaggaaccuauggacuuaauacguucacaaacauggaagcgcaacuaauuaggcaaauggaaggcgaaggaguuuucaaaaacauccaacaucuaaccguuaccgaagaagccgcaguucaaaauuggcuagcuaggguuggaagagaaagacugucaagaauggcaauuucuggcgaugauugugucguuaaaccauuagacgaccgcuucgcaaacgcacugacugcgcuaaacgacaugggaaaaauccgcaaggacauacaacagugggaaccgaguaaaggcuggaaugauuggacgcagguuccauuuuguucucaucacuuccacgaguugauuaugaaagacggccggguauugguugucccuuguagaaaccaagacgaauuaauugggcgcgcuagaauaagucagggugcaggcuggaguuuaagagaaacugcaugccuagggaaaucauaugcacaaauguggucacuaauguacuuucaucgaagagaccugaggcuggcugcgaaugcaauaugcucggcgguuccaagucacuggguuccuaccaguaggacaacaugguccauacaugcaaagcacgaauggaugaccacugaagacauguuaacuguauggaauagaguguggaucagagaaaauccguggauggaagauaaaacgccaguugagucaugggaggagaucccauaccucgguaaaagagaagaucaauggugcgguucucugauaggucuaacaucaagagcaaccugggcuaaaaauauacaagcugcgauuaaucaagugagaucgcuaauagguaacgaagaauacacagauuauaugcccucgaugaaaagguucagaagggaagaagaagaagcggguguguuaugguga

SEQ ID NO: 22318 - RNA, 9876 nt, Artificial Sequence
  derived and/or modified CDS sequence (opt6) from DENV-2__GU131924__SS-prME
ucagcugguaugauaaucauguugauaccaacaguaauggcauuucaccucacaacucgaaauggugagccgcacaugauaguaggcauacaagaaaagggaaaaagucuccuguuuaaaacggaggacgguguaaauaugugcacacuuauggcaauggacuuaggagaguuaugcgaagacacgauuacauacaaaugcccucuacuucgucaaaacgaaccugaggauauagacuguuggugcaacuccacaucaacuuggguaacuuauggaacuugcacuacuaccggagaacauagaagagaaaagaggucgguagccuugguuccccacguaggcauggggcuagaaacaagaacggagacuuggaugucaucggaaggcgcuuggaaacaugcgcaacggaucgaaaccuggauuuuaaggcauccagguuuuacaauuauggcagcuauccucgcauacacuauagggacaacacauuuucagcgagucuuaaucuuuauacugcuaaccgcuguagcaccaucaaugacgaugagguguauaggaauaagcaaucgggauuuuguagaagguguaucaggaggcuccuggguagauaucguuuuggagcacggaucaugcgucacaaccauggcaaagaacaaaccuacacuugauuuugaguuaaucaaaaccgaggcaaaacaaccggcuacacuaaggaaauacuguauagaagcgaaacuaacgaauacaacuacagagucaaggugcccgacacaaggagaaccuagucuaaaagaggaacaagauaaacgauucgugugcaaacacucgaugguugauagagggugggguaauggauguggccuguuuggaaaaggaggcauaguuacgugugcaauguucacauguaagaagaauauggaaggaaaaauuguacagcccgagaauuuagaauacacuauugucguuacgccacacucaggugaagaacacgcggucgggaaugacacaggaaaacaugguauggaaauaaaaguaaccccccaaagcucgauuacagaagcagaauuaacuggauaugguacggugacaauggaaugcucaccgaggacaggacuagacuucaaugaaaugguccuguuacaaauggaaaacaaagccugguuagugcaucgccagugguuucucgaucuaccgcugcccuggcugccuggugcugauaaacaagaaagcaacuggauucaaaaggagacacuaguaacauucaagaauccgcaugcaaaaaaacaagacguuguaguccucggaucacaagaaggcgccaugcauaccgcacugaccggugcaacggaaauacaaaugucaucagguaauuuauuauuuacgggccaccuaaaaugcagguuacgaauggauaagcuacaacucaaaggaaugucauacucuauguguacagguaaauuuaaaguuguuaaagaaauagccgagacucaacaugguacgaucgucauucgcguacaauaugaaggagaugguucuccauguaagauaccauucgagauaauggauuuagaaaaaagauauguacugggaagacuaauaacagugaacccuaucgugacggagaaggacucaccggugaacauagaagccgaaccuccauuuggugacagcuacauaaucauagggguagaaccaggacagcuaaagcuaaacugguucaagaagggcuccaguaucggccaaauguucgaaacuacaaugcgcggagcuaaaagaauggcuauauuaggggacaccgcgugggauuuuggcucuuuaggaggaguuuucacaagcauaggaaaagcacuccaucagguauucggagcuauauauggagcugcguuuagcgggguaucguggacuaugaagauacuuaucgguguaaucauuacguggauaggaaugaauagcaggucgacuagucugucuguaucgcucguacuaguaggaauaguaacuuuauaucuaggaguaaugguacaagccgacagcggauguguaguaucauggaaaaauaaagaacuaaaauguggauccggcauauuuauaacagacaacguucacacauggacagaacaauauaaguuucagccagaaucuccuaguaaacucgcuagcgcuauucagaaagcucaagaggaggguaucugugguauacguagugucacacgucuugaaaaccucauguggaaacaaauaacgccagaacuuaaucauauauuagccgaaaaugaagugaagcuaacaauuaugacaggagauaucaaaggcauuaugcaggcaggcaaacgaaguuuacguccucaaccuacagaauuaaaauauucauggaaaacuuggggcaaagcuaaaaugcugaguacagaaucauacaaucagacauuucuuaucgauggaccagagacugcagaauguccaaauacuaacagagccuggaauagccuagagguagaagauuauggguuuggaguauuuacuacaaauauuugguuaaaacucaaagaaaaacaagaugcuuucugcgauagcaaacuuaugucugccgcaauuaaggacaauagagcaguccaugcagauaugggauauuggauagagagcgcacuuaaugauacauggaaaauagagaaagcgaguuuuaucgaagucaaaaacugucacuggccaaagucacauacccuauggagcaauggcguacuagagucagaaaugauaauuccaaaaaaccucgcgggucccgugucucaacauaauuauaggccaggcuaucauacucaaauagcaggcccuuggcaccuugggaagcuagaaauggacuuugacuuuugcgaugggacuaccguaaucgucacggaagauuguggaaacagaggaccuagucucagaacuacaaccgccagcggaaaauuaauuacagaaugguguuguagguccugcacacuuccuccacucagauauagaggugaagacggaugcugguauggaauggaaauaaggccccugaaagaaaaggaagagaauuugguaaauucucuaguaacugcaggccaugggcagguugauaacuucucucuaggaguuuuagguauggcccuuuuccucgaagagaugcuaaggacuagaguaggcaccaaacaugcuauauuacugguugcgguaucuuuugucacucuuaucaccggaaacaugucauuuaaggauuugggcaggguuguuguaaugguaggugcuacaauggcggaugacauagguaugggcguaacauaccuagcccuauuagccgcauuuaaaguuagaccgacuuucgcugccggacuacuuuuaagaaaguugacuuccaaagagcuaaugaugacgacgaucggaauagucuuacuuagccaaucgacaauaccugaaacagucuuggaacuaacugaugcgcuugcucuggguaugauggugcuaaaaauuguacggaacauggaaaaauaucaauuagcaguuacaauaauggccauacuauguguacccaaugcugugauccuucaaaacgcuuggaaaguaucauguacaaucuuagcaguggucagcguaucaccccuacuucucaccucgucucagcaaaaaaccgauuggaucccuuuagcgcuaacuauaaagggauuaaacccaacagccauuuuuuuaacaacauuaagcagaacaaacaaaaagagaucuuggccguuaaaugaagcaauaauggcagugggaauggucagcauacucgcaucaagcuuacuuaaaaacgacauacccaugaccggcccacuaguagcgggcggacuguuaacuguaugcuacguauugacgggccgaucugcugauuuggaauuggaacgagcuacagauguaaagugggaagaucaagcugagaucagugggucgagccccauuuuaucuauuacgaucuccgaagaugggucaaugucuaucaaaaaugaagaggaagaacaaacgcuaacaauauuaaucagaacuggucuuuuaguaauuagcgguuuguucccaauuaguauaccgauaaccgcugcugcuugguaucuaugggaaguaaagaaacaaagagccggugugcuaugggacgucccaucucccccuccaaugggaaaagcagaacucgaagacggugcauaucggauaaaacaaaaaggcauacuaggauacucgcagauaggagcuggaguauauaaagagggaacuuuucauacaauguggcacguaacucgaggugcaguacucaugcauaaaggaaaaagaauagaaccuucaugggcugaugucaaaaaagaccuaauaucauacggugguggcuggaaacuagaaggagaauggaaggaaggugaagaaguacaagugcuagcccucgaaccgggcaaaaauccccgagcuguacagacuaagccaggacucuucaaaacaaacacggguacuaucggagcaguaucacuagacuucucucccggcacaaguggcagcccaauaauugauaagaaaggaaaaguaguaggauuguacggaaacggggucgucacccgcaguggagccuacguuucggcaauagcacaaaccgaaaaaucaauagaagacaauccagaaaucgaagacgauauauuuagaaaacgacggcuuacuauuauggacuuacacccgggugcugggaaaacuaagagguauuuaccugcuauaguuagagaagcaauaaaacgaggucuacgaacguuaauauuagcgccaacucgaguuguagcagccgaaauggaagaagcuuuacguggucuuccgauuagauaucaaacgccagcaauacgcgcagagcacaccggaagagaaauagucgauuuaaugugucacgccacauuuaccaugcgauuauuaaguccuguacgggucccaaauuauaacuuaauaauuauggaugaggcgcacuuuacugauccugcgucaauagccgcaagagguuauaucuccaccagaguugagaugggcgaagccgcagguauuuucaugacggcaacaccaccaggauccagggacccauuuccacagaguaaugcacccauaauugaugaagaacgagaaauaccggaacgaaguuggaauagcggccacgaaugggugacagauuucaaaggaaaaacaguaugguucguucccucaauaaaagcgggcaacgacauugccgcgugccuuaggaagaacggaaaaaaaguaauacaacuaaguagaaaaaccuuugauucagaguauguaaagacaagaacuaaugauugggauuuuguuguaacgacagacauaucugaaaugggagcaaauuuuaaagcagaaaggguaauagauccaagaagauguaugaagccugugaucuuaacagauggagaagaaagagugauccuagcagguccaaugccaguuacucauucuucagcggcucagaggcgaggaagaauaggaagaaauccgaaaaaugagaacgaucaauauauauauaugggagaaccucuagaaaaugaugaggauugugcucacuggaaagaggcuaagaugcuacuagauaacauaaauacuccagaagguaucauaccauccauguucgaaccagaaagagaaaaaguagaugcaaucgauggcgaauauagauugagaggugaagcucgcaaaacauucgucgauuugaugaggaggggagacuuaccgguguggcuugcauauaagguggcagcugaaggaauuaacuaugcagauagacggugguguuuugacgguauaaaaaauaaccagauuuuagaagagaacguggagguagaaauuuggaccaaagaaggcgaacguaaaaaacuaaagccgcguugguuggaugcaagaauauacucggacccgcuagcauugaaagaauucaaggaguuugcagcuggacgcaaauccuuaacccucaaccuuauuacugaaaugggccggcuaccaacguuuaugacacagaaaacucgagacgcuuuggauaauuuagcuguucugcauacugcagaagcaggugggagagcguauaaccacgcucuuagcgaauuaccugaaacacucgaaaccuuguuguuacuuacacuucuagcaacagucacuggcggaaucuuccuguuucuaaugaguggucgagguauagguaagaugaccuuaggaaugugcugcauaauuacggccagcauacuccugugguacgcucagauccaaccacauuggauugcugcaucaauuauacuagaguuuuucuuaaucguuuuauuaaucccugagccggaaaaacagagaacaccgcaagauaaccaguuaaccuacgucgugauugcgauauugacgguuguagcggcuacuauggccaacgaaaugggguuuuuagaaaaaacuaaaaaagacuuaggacuggguucuauagcuacucaacaaccugaguccaacauucuugacauugaucuaagaccugcaucugcuuggacucucuaugcgguagcaacaacuuuugucacaccaauguugcgacacucgauugagaauucuagugugaacgucagucuuaccgcuauagcaaaucaagcuacgguucucaugggacuaggcaaggguuggccauuaagcaaaauggauauaggaguuccgcucuuagccaucggcuguuauucacaaguuaauccuauaacccucacagcugccuuguuguuacuuguugcucauuaugcgaucauaggaccuggauugcaagcaaaagccacccgcgaagcacaaaaacgggcagcagccggcauaaugaaaaauccaacaguugacggaauuacggucauagacuuagacccaaucccauaugaucccaaauucgaaaaacaacuaggccaggucaugcuuuuaaucuugugugucacacaaguccuaaugaugagaacaacuugggcacuaugcgaagcacuaacucuagccacaggaccuaucucaacguuaugggaagggaacccagguagauucuggaacacgacaauagcagucaguauggcuaacauauuccgaggauccuaucuugcaggggcgggucugcuauuuucgauuaagaaaaacacaacaaacacucguagaggaacaggcaacaucggagaaacgcuaggagaaaaauggaaaucuagacugaacgcacucggcaaaagugaauuucagauuuacaaaaagagcgggauacaggagguugauagaacacuggcuaaggaagguauuaaaagaggagaaacugaucaucacgcuguuagucgaggcagugcaaaacuaagaugguuugucgaaaggaauauggugaccccagaagguaaagugguagaccuuggaugcgggcgaggcggcuggucauauuauuguggaggucuaaaaaaugugcgagagguaaagggauuaacuaaaggaggacccggacaugaagaaccgauaccgaugaguacauauggcuggaaccucguacggcuucagaguggaguagauguauucuucauaccgcccgaaaagugcgacacacugcuuugugacauaggagagaguagcccaaacccgacaguagaagcaggaagaacucuccgaguauuaaacuugguggaaaacugguuaaacaacaacacacaguuuuguaucaagguacuuaacccauauaugccaagcguaaucgaaaagauggaagccuuacagagaaaauaugguggagcacucgugagaaaccccuuguccagaaacaguacacacgaaauguauuggguguccaacgcgucuggcaauauuguaaguaguguuaacaugauuagcagaauguuaauaaauagguuuacaaugagacauaaaaaagccacuuaugagccugacguagaucuaggcagcggaacgcgaaacauaggcauugagagugaaaucccgaauuuagacauaaucgguaagagaauagagaaaauaaaagaggaacaugaaaccagcuggcauuacgaucaagaucaccccuacaaaacaugggcauaucacgguuccuaugaaacaaaacaaacugguagugccaguucaaugguuaacgggguaguucgcuuauuaacuaaaccaugggacguccuuccuacaguaacccagauggcuaugacugauacaaccccguucgggcaacagcgaguauucaaagagaagguagauacgagaacccaagaaccaaaagaaggaacaaaaaagcuaaugaagauaacugcagaauggcuauggaaagaacucgguaaaaaaaagacaccgagaauguguacacgcgaagaauuuacgagaaagguuagauccaaugcagcacucggagccauuuuuaccgacgaaaacaaauggaaaagugcgcgcgaagcuguugaagauagucgguuuugggaguuaguggauaaagaacguaaucuucaccuugaagggaagugugagaccugcguauacaacaugaugggcaagagagaaaaaaaauuaggcgaguuugggaaagcaaaagguucccgggcaauuugguauauguggcuaggugcgagauuucuagaguuugaagcccucgguuuucugaaugaagaucauugguuuucaagagaaaauucguuaucuggaguagaaggugaaggacuacauaaguuggguuauaucuuaagagaugucucaaaaaaagaaggaggugcuauguacgcagaugauacugcugguugggacacacggauaacguuagaggacuuaaaaaaugaggaaauuguaacaaaucacauggaaggagaacauaaaaaacuagcagaagccauuuuuaaauuaacauaucaaaauaaaguaguuagaguucaaagacccacaccucguggcacagugauggacaucauuucgcgcagagaucaaagaggaaguggacaaguaggaacauauggauugaacaccuucacaaauauggaagcucaguugauuagacaaauggaaggggaaggaguguucaaaaacauacaacaucucacuguaacagaagaggcagcuguucaaaauuggcuagcaagaguaggucgugaaaggcuuucacgaauggcaauaaguggggacgacuguguagugaagccauuggacgauagauucgccaaugcccuuacagcguuaaaugauauggggaaaauucgaaaagauauccagcaaugggaaccuucaaaaggauggaaugacuggacccaaguucccuucuguucgcaucacuuucaugagcugauaaugaaagaugggagagugcucgucguucccugucgaaaucaagaugaauuaauaggucgugcacgcauaucacaaggagcugguuggaguuuaagggaaacggcuugucuaggaaaaagcuaugcacaaauguggucuuugauguacuuucauagaagagauuugcgacuagcggcuaaugcuauauguagugcagucccaagccacugggugccaacgucucguacuacuuggucaauucaugccaaacacgaauggaugaccacugaagauauguuaacugucuggaauagaguguggauccgugaaaauccauggauggaagauaagacccccgucgaaaguugggaagaaauaccuuaucuaggcaagcgcgaggaucaaugguguggaucacucauaggccucacaagcagggcgaccugggcaaaaaacauucaggccgcuaucaaucaaguacgauccuugauaggaaaugaagaauacacugauuacaugccgagcaugaagagguucaggcgggaagaagaagaggcaggcguccugugguag

SEQ ID NO: 22319 - RNA, 9876 nt, Artificial Sequence
  derived and/or modified CDS sequence (opt6) from DENV-2__GQ868638__SS-prME
ucagcugguaugauaauuaugcuaauuccaacaguaauggcauuucauuuaacgacaagaaauggugaaccacacaugauaguagggauucaagaaaaaggaaaaucacuauuauuuaaaacugaagacggaguuaauauguguacccuuauggcaauggauuugggagaauuaugugaagauaccauaaccuauaaauguccauugcuacgucaaaacgaaccggaagacaucgacugcuggugcaauaguaccucaacauggguaaccuacggaaccuguaccaccacuggagaacacagacgcgagaaaagaagcguggcauugguaccacauguaggaauggggcuagaaacucguacagaaaccuggaugucauccgaaggagcauggaaacaugcucaaagaauagaaacuuggaucuugcgacauccaggauucacaaucauggcggccauacuggccuacacuauaggaacgacacauuuucaacgagcguuaauauucauucuuuuaaccgccguggcuccuucuaugacgaugcgaugcauagguauuuccaauagagacuuuguggagggaguguccggagggucauggguggacauuguauuagaacauggauccugugugacgaccauggcuaaaaauaaaccaacucuagauuuugaguugauaaaaacugaagcgaaacaaccugcuacucucagaaaauauuguauagaggcaaaauuaacgaauacaacgacugagucuagaugcccaacucaaggugaaccaucacuaaaagaggagcaagacaaaagauuuguaugcaaacauucaaugguugauagagguuggggaaauggaugcgggcuauuuggaaaaggcgguauaguaacaugcgcuauguucacauguaagaaaaauauggaggggaaaauaguacaacccgaaaaccuagaauacacaauaguagucacgccucauaguggagaggaacaugcaguaggcaacgauacagguaaacaugguaaagaaauaaaaguuacaccacaguccucaauuacagaagcagaacugacgggauauggaaccguaaccauggaaugcucgccgcgaacaggguuagacuuuaacgaaaugguccuguuacaaauggaaaacaaagcauggcuaguacaccgacaaugguuuuuagaccuuccauugcccugguugccuggugcagauaaacaaggaucaaauuggauccagaaagaaacuuuagugacauucaaaaauccucaugcaaagaaacaagacguaguaguuuuagggucucaggaaggggcuaugcauaccgcguuaacuggagccacagaaauucagaugucuucaggcaaucuuuuauuuacaggacaccugaaauguagguuacguauggauaagcuacaauugaaaggaaugaguuauucaaugugcacggguaaguucaagguuguaaaagaaauugcagaaacccaacauggaacaauaguaauaaggcuccaguaugaaggagauggcaguccauguaagaucccauucgaaauaauggaccuagagaaaagguacguuuuagggcgguugauaacgguaaacccgauugucacugaaaaagauucaccaguaaauauugaagccgaaccgcccuuuggagacuccuauauaaucauuggaguagagccaggucaauuaaaauuaaacugguuuaagaaaggaagcucaauuggucaaauguuugaaacgacaaugcgcggagcaaagagaauggcaauacuaggggacacagcuugggauuuuggaucuuuagguggaguuuuuacgagcguugggaaagcacuucaccaaaucuucggagcaauuuacggggcugcauucuccgggguaucguggacaaugaaaauacuaauaggaguaauaauaacauggauagguaugaacagucgaucaacaagccugagcguaucucuaguacugguaggaaucgucaccuuguaccuaggaguaaugguccaagcugauaguggauguguaguaucauggaaaaacaaagaauugaaaugcggaagugggaucuucauaacugacaauguacauaccuggacagagcaauacaaguuucagccagaaucaccuucgaaguuagcuucggcgauccaaaaggcccaggaagaaggcauauguggaauccgcucuguaacaagacuugaaaaccuaauguggaagcaaauuacaccggaauuaaaccauauacuagcagagaaugaaguaaaacuuacgaucaugacaggcgacauaaaaggcaucaugcaagcugggaaacgcucacuacguccacaaccuacagagcuuaaauacuccuggaaaacauggggcaaagcgaaaaugcuaaguacugaaucucauaaccagacauuucuaaucgacggaccagagacugcugaauguccgaauaccaauagagcauggaacucgcuagaaguagaagacuauggauuuggcguguucacaacgaauauaugguugaaacugaaagagaagcaagacgcuuuuugugacuccaagcuaaugucugcugcuauuaaggacaacagagcaguccaugcagacaugggauauuggauugaauccgcguuaaacgauaccuggaaaauugaaaaagccaguuuuauugaagucaaaaacugucauuggccgaaaagccacaccuuguggucaaauggaguccuggagagcgaaaugauuauucccaagaaucucgccggacccguuucccaacacaacuauagaccagguuaucauacucagaccgcgggcccuuggcauuuagguaaacuagaaauggacuucgauuuuugugauggaacuacgguaaucguaacagaagacugcgguaauagaggcccaaguuuacgaacaaccacggccucagggaaauuaauaacagaauggugcugcagauccuguacacuuccaccauuaagauacagaggugaagaugguuguugguacgguauggaaauuaggccccucaaggagaaagaggaaaauuuaguaaauaguuuagucacagcuggacauggccaagucgacaauuuuucccucggaguucuaggaauggcacuguuccucgaagaaaugcuucggacucgaguuggaacaaaacacgcaauccuauuaguagcggucucauuuguaacacuaaucacaggaaacaugucuuuuaaagaucuaggcagaguggucgucauggucggagcaacaaugaccgaugauauuggcaugggggucaccuacuuagcccuacuggcagccuuuaaggugagacccacauucgcagcgggauuacuacuaagaaaauugacaaguaaagaauuaaugaugacuacgauugguaucguacuccuaucccaaucgacaauacccgaaacaaucuuagaacugacugacgcauuggcccuugggaugaugguauugaaaaucgugagagauauggaaaaauaccaauuagcaguaacaauaauggccauauugugcguacccaacgcuguaauauuacaaaaugcauggaaaguguccuguacaauauuagcgguaguaaguguaucgccuuuauugcuuacgucaagucaacagaaaacugauuggauaccacuggcgcuuacuauaaaaggacugaauccuacugccauuuuccucacaacacuaucaagaaccaacaagaaacguucuuggccuuuaaaugaagcuaucauggcagucgguaugguuucaauauuagcaagcucacuacuuaaaaaugauauaccaaugacuggaccgcuaguagccgguggacuauuaacuguguguuacguuuuaacagggcgaagugcagauuuagaauuggaacgagccaccgacgucaagugggaagaccaagcugaaauaucuggaagcaguccuauauuauccauuacaauaucagaggacgggaguaugucaaucaagaacgaagaagaagaacagacucucacuauucucauaagaaccggccuauuaguuauuucaggucuguuuccugugaguauucccaucacugcugcagcuugguauuuaugggaaguuaagaaacaacgggcuggagugcucugggacguaccaucaccaccgccaaugggaaaagcagaguuagaagauggugccuaucgcaucaagcaaaagggaauacuaggguauagucagaucggagccgguguauauaaagagggaacuuuccauacaauguggcacguuacuagaggcgcaguauuaaugcauaaagguaagcgaauagaaccuucaugggccgacguaaagaaagaccuuauaagcuauggaggaggauggaaacuugaaggagaguggaaagaaggugaggaaguccaaguuuuagcacuagagcccgguaaaaaucccagagcaguacaaaccaaacccggauuauuuaaaacaaacacaggcacaaucggcgcggucagcuuagacuuuucuccuggaacaagcgguagcccuauaauugacaagaaaggaaagguugucgguuuauacgggaacggaguaguaacccgcaguggcgcguauguaagugcaauugcucagacagaaaaaucaauagaagauaauccagaaauugaagaugacauauuucgaaagaggaggcuuacuauaauggaccuucacccaggagcggguaaaacuaagcgauacuuacccgcaauuguacgagaagcuauuaaacgaggauuacgaacgcuaauucuugcuccaacaagaguaguagcugccgaaauggaggaagcauuaagaggauugccuauaagauaccaaacgccagcaauacgagcagaacacacaggacgugagauuguagauuuaaugugccacgcaacauuuacaaugaggcuguuaagcccggucagaguaccuaacuauaaccugauaaucauggacgaggcucauuucaccgauccagcuagcauagcagcaaggggauauauaaguacgcguguagaaaugggcgaagccgcaggaaucuuuaugacagccaccccgccgggaucgcgugauccauuuccgcaaucuaacgcucccaucauugacgaagaaagagaaauaccggaacgcucauggaacagugggcacgaauggguuacagauuucaaaggcaagacgguuugguuuguuccaaguaucaaagcaggaaacgauauagcugcauguuuaaggaaaaauggaaagaaaguaauacagcucaguagaaagacuuuugacucagaauaugucaaaacgagaacuaaugacugggacuuuguaguuacaaccgauauaagcgaaaugggcgcaaauuuuaaagcugacagggucauagacccucgacgguguaugaaaccgguuauacuaacagacggagaggaaagaguaauauuggcuggaccaaugccuguaacgcauucaucggcagcacagcguagaggacggauaggcagaaaucccaaaaacgagaacgaccaauacaucuauaugggugaaccucuagagaacgacgaagacugugcgcauuggaaggaagcuaaaaugcuuuuagacaauauaaacaccccugaagggauuauuccaaguauguucgagcccgaaagggaaaagguggacgcgauagacggagaauauagauuaaggggagaagcgagaaaaacauuuguugaucuaaugaggagaggggaccuuccagucugguuagcuuacaaaguggcagcggaagguaucaacuacgcggaccgacguuggugcuucgacggaauaaagaauaaccagauacuugaagagaauguggaagucgaaauuuggaccaaagagggcgagcggaagaaacucaaaccacguugguuagacgcgaggauauauagugauccauuagcauuaaaagaauuuaaagaguucgcagcgggaaggaaaucacuaacacuaaauuuaauaacugaaaugggaagguuaccgacauucaugacucagaaaacgcgagaugcauuagauaaccuagcuguacuccauacugcagaagcuggagggagggcuuauaaucaugcacuaagugaacuuccagaaacacuagaaacacucuuacuauuaacuuugcuugcaacgguuaccggugguaucuuucuuuuccuaaugaguggccgaggaauaggaaaaaugacgcuuggaauguguuguauaauaacagcaucaauucuuuugugguaugcucagauucaaccccauuggaucgcagcaaguaucauauuagaauuuuuccuaaucguccuauuaauaccggaaccggaaaaacaacgcacaccccaagauaaccaauuaacauaugucguuauagcaaucuuaacuguaguagcggcaacuauggcaaaugaaauggguuuucuugagaaaacuaaaaaggacuuagggcuaggaaguauugccacccagcagccagagaguaauauccuagacauugacuuacgaccugcuucagcuuggacguuauacgcaguagcgacuacauucguaacuccaauguugagacauagcaucgaaaauuccucagugaacguuagccuaacagcaauugcaaaucaagcgacggugcuuaugggguuagggaaagguuggccacuaucaaaaauggauauaggaguaccacuacucgcaaucggcugcuauucucaagugaauccuauaacauuaacagcugcuuugcuccuacucguggcgcacuaugcgauaauaggcccaggguuacaagcaaaagcuacucgugaagcacagaaaagagcggcagcugguauuaugaaaaauccaacggucgauggcauaacagucauugacuuagaccccauaccuuaugaccccaaauuugaaaaacaauuggggcaaguaaugcucuuaauacuuuguguuacgcaaguauugaugaugagaaccacaugggcucuuugcgaggcgcuaacccuagcuacaggaccuauuucuacuuuaugggaggguaauccugguagauucuggaauaccaccauagcggugagcauggcuaacauauuucgaggaagcuacuuagcaggagccggacuuuuauucuccauaaugaaaaacacaaccaacacuaggcgcgguacuggaaacaucggagaaacgcucggggaaaaguggaaaucacgcuuaaaugcacugggaaaaagcgaguuccaaacuuacaaaaagaguggaauccaggaaguggacagaaccuuagccaaggaagggauaaaacgaggugaaacggaucaccaugcuguuuccagagguucagcuaaguuacgcugguuuguagaacgcaauaugguaacacccgaaggaaaaguuguugaucuugggugugguagaggaggaugguccuauuacugcggcggucuuaagaacguucgggaggugaaagguuuaacgaaagggggaccuggccacgaagaaccaaucccgauguccacuuauggguggaaccucguacggcuucagaguggaguugacguguucuuuauuccgccugaaaagugcgauacccuacugugcgauauaggagaaaguucuccaaauccuacgguagaggcaggcaggacacuaagagucuuaaacuuaguggaaaauuggcuaaacaacaauacacaauuuugcauaaaaguauuaaauccauauaugccgagcguuauugagaaaauggaagcccuucaacgaaaguauggaggugcacucgugagaaauccguuaucacgaaauucgacgcacgagauguacuggguuucuaaugcaaguggaaacaucguuaguagcguaaacaugauuaguaggaugcuuaucaauagauucacaaugagacauaagaaagcuacauaugagccggacguagaucucggaucagggacaagaaauauaggaauagaaucagaaauacccaacuuagauauaauagggaagcgcauugaaaagaucaagcaagaacaugaaacgagcuggcacuacgaucaggaccaucccuauaaaacaugggcauaccacggaucauaugaaacgaaacaaacuggaucggccaguucgaugguaaacggaguaguuagguuacugacaaaaccaugggacguacucccgacagugacgcaaauggcuaugaccgacaccaccccauuugggcaacaacgaguuuuuaaggagaaaguagacacaagggcacaagagccaaaagaaggcacaaagaaacugaugaaaauuacugcggaaugguuauggaaagaacuugggaaaaagaaaacaccgaggaugugcaccagagaagaauuuacacguaaaguccgcaguaaugcagcauuaggagcaaucuuuacagacgaaaacaaguggaaaagcgcgagagaagcaguugaagacagccgguucugggaguuaguugauaaagagagaaaucuccaucucgaagggaagugcgaaacuugcguguauaacaugaugggaaaaagagagaaaaagcugggggaguuugggaaagcaaaaggaucucgggcuauuugguauaugugguuaggagcuagguuucuggaguucgaagcccuuggauuucugaacgaggaccacugguuuagucgagaaaauucacuaucagggguggaaggcgaagggcugcauaaauuaggguauaucuugcgcgauguaagcaagaaagaaggaggggcaauguacgcugaugauacagcaggaugggauacuagaauuacgcuagaagauuuaaagaaugaagaaaugguaacgaaccacauggaaggcgagcacaagaaauuggccgaagcgauauucaagcuaaccuaucaaaauaaaguaguuagagugcagcgaccaacuccaagagggaccguaauggauauuauuucaaggagagaccaacgaggaucuggacagguugguacauauggauuaaauacauuuacaaacauggaagcccaacucauucgacaaauggagggagaagguguauuucguaauauacagcauuuaaccgccacugaggaaguggcaguucagaauuggcuagcgcgcguagguagggaacgauuaucuagaauggcaauaucuggcgacgauugugucguaaagccccuugaugauagauuugcaaaugcacuaacagcgcuaaaugacaugggcaaaauuagaaaagacauacaacaaugggagcccaguaagggcuggaaugauuggacgcaaguuccuuuuuguagccaucacuuucaugagcucauaaugaaggacggucgcguccuaguaguucccugucggaaccaagaugaacucaucggcagagcaagaauaucucaaggagcggguuggucccugcgagaaacagcaugcuuagguaaaucauacgcucagauguggaguuuaauguacuuccaccgcagagaccuacgucucgcagcaaacgcaauaugcucugcgguaccaucucacugggugccuacaagucggacaacauggagcauucacgcaaaacacgaguggaugacaacggaggauauguugacaguauggaacaggguuuggauuagagagaaccccuggauggaggauaaaacuccaguagaaagcugggaagaaauaccuuaucuuggcaagcgagaagaccaauggugugggagcuugauuggccuaaccucacgcgcuacgugggcuaagaacauucaagcggcaauuaaucaaguucguuccuugauagguaaugaggaauacacagacuauaugccaaguaugaaacgauucaggagggaagaagaggaggcaggcguguuaugguaa

SEQ ID NO: 22320 - RNA, 9876 nt, Artificial Sequence
  derived and/or modified CDS sequence (opt6) from DENV-2__GU131927__SS-prME
ucagcugguaugauaauaauguugauaccgacuguaauggcauuucauuuaaccacuaggaauggcgaaccccacaugauaguuggaauucaggaaaaaggcaaaagucuauuauucaagacagaggauggugucaacauguguaccuuaauggcuauggacuuaggagaacuuugugaagauacuauuacguacaagugcccccuauuaagacaaaacgaacccgaggauauagauuguugguguaauucgacuagcacgugggucacauacggcacgugcaccacuacaggagaacauagaagagaaaaacgauccguugcgcuaguaccacauguggguaugggguuagaaacaagaacugaaaccuggaugagcagugagggagcauggaagcacgcucaacgaaucgagacuuggauacuacgacacccaggauuuacuauaauggcagcaauucucgcguauacaauaggaaccacucauuuucaacgagcauugauuuuuauuuuauugacagcaguagcucccuccaugacaaugagauguauaggaauaucgaaucgagauuucgucgaaggagugagcgguggaagcuggguugauauaguucuggagcaugguucauguguuacaacuauggcuaggaacaagccgaccuuagauuuugaacuuauuaagacggaagccaagcaaccugcaacacuaaggaaguacugcauugaggcuaaacuaacuaacacaacaacugagucuagaugcccuacucagggagagcccucuuuaaaggaagaacaagauaaacguuuuguguguaaacauaguaugguagaucgaggaugggggaacgguugcgguuuauucgggaaaggcggaauuguaacgugugcaauguuuacuuguaaaaaaaauauggaaggaaaaauaguucaaccagagaauuuagaguauacuauaguugucacuccucacuccggggaagagcacgcagucggcaaugauacggggaaacauggaaaggaaaucaaagucacaccgcagaguucuauuacagaagcugagcugacuggcuaugggacaguaacgauggaauguucaccuaggacuggacuagacuuuaaugagaugguauuauuacaaauggaaaacaaggccugguugguacaccgacaaugguuccucgaccugccauuaccguggcugcccggcgccgacaagcaagaaagcaauuggauccagaaagaaacccugguaacuuuuaaaaacccccacgcuaagaaacaagaugucgucguucuaggcagucaagagggcgccaugcauacugcauuaacaggcgcaacagaaauccaaauguccagcggaaaccuauuauuuacgggucauuuaaaaugucgacuaagaauggauaagcuacaacuuaagggcaugucuuacucaaugugcacugggaaguucaaaguggugaaggagaucgcagaaacucaacaugguaccauaguaauuagagugcaauacgagggagacggaucaccuugcaaaauaccauuugaaauaauggauuuggaaaaaagguauguauuggguagacuuauaacugugaauccuaucgucacugaaaaagacucaccuguuaacaucgaagccgaaccuccauuuggggacaguuacauuaucauagggguugaaccaggacaacuaaaauuaaacugguucaaaaaggggaguagcaucgggcaaauguuugagacaacuaugagaggggcuaaaagaauggcgauuuuaggagacacugcaugggacuuuggaagccuggggggugucuuuacgucaguuggcaaagcucugcaucaaguuuuuggcgcgauauacggugccgcauucaguggcguaagcuggacuaugaaaaucuugauaggcgucauuauuacguggauagguaugaauucacggagcacuaguuugucaguuucauuaguccuagucgguauugucacucuuuaccuaggagucaugguccaagcugacucuggaugcguaguuucguggaaaaacaaagaguugaagugugggagcggcauauucaucacagauaacguacacacuuggacagaacaauauaaauuucagccagaauccccuuccaagcuggcuucagcaauucaaaaagcacaggaagaaggaauuugcgguauucgauccguuacacgucuagagaauuuaauguggaagcaaauuacaccagaguuaaaucacauccucgccgaaaacgagguaaaacuaacaauaaugacgggggacauuaagggcaucaugcaagcgggacggagaucauugagaccccagccaacugaacucaaauacucauggaaaaccugggguaaggcaaagaugcuaucgaccgaaaguuauaaccaaacuuuuuuaaucgacgguccggaaacaacagaauguccgaaugcaaaccgcgcauggaacagucuggagguagaagacuacggguuuggaguguucacaacaaauauauggcuaaaacuaaaagaaaaacaagacgcguuuugugauaguaagcucaugagcgcugcuauaaaggauaauagagcaguacacgcagauaugggauacuggauagaauccgcauugaaugacacuuggaagaucgaaaaagcuaguuuuauagaaguaaagaacugucauuggccaaagucacauacucucuggucgaacggagugcuugaaagugaaaugauaauuccgaagagcuuagcgggcccgguuagucaacacaauuaucgaccagguuaucauacacagaucgcugggccauggcaucucgggaaauuagagauggacuucgauuucugcgacggaacuaccguaauaguaacugaggauugcgggaauagagggccaucacucagaaccaccacggcuaguggcaaacuaauaacagaauggugcugucguucuugcaccuuaccuccauuaagauaucgcggagaagaugguuguugguaugguauggagauaaggccgcuaaaagagaaggaggagaacuugguaaacucucugguuaccgccgggcauggacaaguggauaacuucagcuuaggcguuuuaggcauggcguuguuuuuggaagaaauguuaagaaccagaguaggaaccaagcaugcuauucucuuagucgcggucucuuuuguaacacuuauaacagggaauaugaguuuuaaggaucuaggacggguaguaguuauggucggagccaccauggcagaugacauaggaauggguguaacauacuuagcuuuacuagcugcuuuuaaagugaggccaacauuugcagcuggcuugcuacuacgaaaguuaacuaguaaagaacuuaugaugacuacaauaggaauaguucuauuaucgcaaaguaccaucccagaaacaauacuagaguuaacugacgcauuggcccuaggcaugaugguccucaagauaguaagaaacauggagaaguaucaacuugcuguaaccauaauggccauucuuugugugccaaacgcgguuauauuacaaaaugcguggaaagugucuugcacaauacucgcaguuguaagcguaucgccacuucuacuaaccucaucacaacaaaagacagauuggauuccauuggcuuuaaccaucaaaggccugaacccuacggcaauauucuuaacuacauuaucacgcacaaacaagaagcgauccuggccauuaaaugaagcaauuauggcaguaggaaugguaucaauucuugcauccucacuacuaaaaaaugacauacccaugacuggcccacuaguggcuggaggacugcuuacuguauguuacguauuaacaggucgcucagccgauuuagaacuagaacgugcuaccgauguuaagugggaggagcaagcagaaauaucuggcucaagcccaauauugaguauaacaauuagcgaagaugguaguaugucaauuaaaaacgaagaagaagaacaaacuuuaacuauccuuauaagaacaggacuucucgugaucucuggacuauuuccuauaaguauaccuauaacagcagcugcaugguacuugugggaaguaaaaaaacaaagggcuggugugcugugggacgugccauccccgccaccgaugggaaaggcugagcuugaagacggugcguaccgaauaaagcaaaaaggcauacuuggauacagccagaucggagccggcguauacaaggaaggaacauuucacacuauguggcacguuacacgcggugcaguguugaugcauaaaggaaaacguauugaacccagcugggcggaugugaaaaaagaucuuauaagcuacggagguggauggaaauuggaaggagaguggaaggaaggugaagaaguacaaguauuagcacuagaaccagguaagaacccaagggcagugcaaacuaagccuggucuauuuaaaacaaauacagggaccauaggugcagucagucuagauuuuucgccugggacaucagggagcccaauaaucgauaaaaaggguaaaguagucggguuauauggaaacggagucguaacacgaucaggagcuuaugugucagcaauugcacaaaccgaaaaaucuacagaggauaauccagaaauagaagaugauaucuuuagaaaaagaagauuaaccauuauggacuuacauccaggagccggaaaaacuaagagguaccugccugcuauaguuagagaagcaauaaaaagaggucuuagaaccuuaauccuagcaccaacaagaguuguagccgcagaaauggaggaagcguuaagaggacuaccaauaagauaucaaacuccagcaauacgcgcggagcacacgggacgagaaauaguggacuuaaugugccaugcuacuuucacaaugcggcuauuaaguccaguaagaguacccaauuacaaucuaauaauuauggaugaagcccauuuuacggauccugcaucuauagcagcucggggcuauauauccacuaggguugaaaugggagaagcugccgggaucuucaugacugcaacaccccccgguaguagagauccuuuuccucaaucaaaugcgccaauuauagaugaagaaagagagauuccagaacggucguggaacagcggucacgaauggguaaccgauuucaagggaaaaacagugugguucguaccaucaauaaaagcuggaaaugacauugcagccugucuucgaaagaaugggaagaaaguaauacagcuauccagaaaaaccuuugacagcgaauauguaaaaacacgaacaaaugacugggauuucguugugacuacagacauuagugagaugggugcuaacuucaaagcagaaagggucauugaccccagaagauguaugaagccaguaauucuaacagauggcgaagaacgaguaauacucgccggccccaugccaguaacacauuccagcgccgcacaacggagaggucggaucggcagaaaucccaaaaaugaaaacgaccaauauaucuauaugggggagccucuugaaaacgacgaagauugcgcucauuggaaggaagcuaaaauguugcuagacaauauuaauacaccggaaggcauuauaccaucgauguucgaaccugaacgugagaaagucgacgcaaucgacggagaauacagauuaaggggcgaagccagaaaaacuuuugucgaucucaugagaagaggugaccuaccaguuuggcucgccuacaaagucgcugcugaaggcauaaauuacgcugacagacguuggugcuucgacgguaucaaaaauaaucaaauuuuggaggagaauguagagguagaaauuuggacuaaggaaggggaacggaaaaagcuuaaaccacgcugguuagaugcucguauuuacucugacccccuagccuugaaagaauuuaaagaguucgccgcgggacgaaaaucgcuuacauuaaaucugauaaccgaaauggggcgacucccaacauuuaugacgcaaaagacaagagacgcucuagacaaucuagcaguguuacauaccgcagaagcaggagguagagccuacaaucacgcucuaagugaacuacccgaaacucuagaaacauuacuuuuacuaacguuauuggcaacuguaacagggggaauauucuuguuuuuaaugucagggagaggcauaggaaaaaugacauuggguaugugcuguauuauuaccgccuccauucuauugugguaugcccaaauacaaccacauuggauagcggcgucgauuauacuagaauucuuucuaauaguccuguuaauaccggagccugaaaaacaaagaacuccacaggauaaccaacuaaccuacgucgugauagcuauacuaaccguuguagcggcuaccauggcaaaugaaauggguuuucuagagaagaccaaaaaggacuuaggauuaggcucuauagccacucaacaacccgaauccaauauacuagacaucgacuuaagaccagcuucugccuggacacuguacgcgguagcaacaacauucauaacaccaauguuacgucauaguauagaaaauucaucgguaaauacaucuuuaaccgcaaucgcuaaccaggcaaccguucugaugggcuugggcaaaggauggccuuuaucaaaaauggacauaggaguuccucucuuggcuauuggguguuauucucagguaaauccaauuacuuuaacugcugcuuuauuacucuugguagcacauuaugcaauaauaggccccggacugcaggccaaagcaacucgugaagcgcaaaaacgcgcagcugccgggauaaugaaaaaucccacugucgaugggauaacagugauagacuuggauccuauaccauaugaccccaaauuugaaaaacagcuuggacaagucaugcuauugauucucugcguaacacaaguauuaaugaugcgaacaacaugggcgcugugcgaggcuuuaacguuagcaacuggaccaauaaguaccuugugggaaggcaacccuggacguuuuuggaacaccaccauagcgguaagcauggcgaauauauuucgugguuccuaccuagcaggagcgggacuacuauuuucuaucaugaaaaauacuacaaauacacgaagagguacagggaauaucggcgaaacuuuaggagaaaaguggaagagccgguuaaaugcacuagggaaaagcgaauuccaaaucuauaaaaaaucugguauucaagagguagaucgcacuuuagccaaagaaggaauaaaaagaggcgaaaccgaucaccacgccguaucaagaggauccgcuaaacuuagaugguucguagaaaggaauaugguaacuccggaaggaaagguggucgauuuaggguguggucgaggcggguggucuuauuauugugggggacuaaaaaauguaaaagaaguuaaggguuuaacgaaagguggcccgggucacgaagaacccauuccaaugaguacguauggguggaaccuaguucgcuugcaaucggguguugacguauuuuuuauuccuccggaaaaaugcgauacauuacuaugugauauuggagaauccagucccaauccaaccguagaagcaggucgaacguugagaguacucaaccuaguagaaaauuggcuaaauaacaauacacaauuuuguaucaaaguuuuaaauccguacaugccaucuguaaucgagaaaauggaagcauuacaaagaaaauauggcggagcacuuguacgaaauccccucucaaggaacaguacacacgagauguacugggugucaaaugcuucaggaaauauugucagcagcguuaauaugauuuccaggauguugauaaaccgguucaccaugagacauaaaaaagcaaccuaugaacccgauguagaucuaggaucagguacacgaaauauagggauagaaagcgaaguccccaacuuggacauuauuggaaaaagaauugaaaaaauuaagcaggaacaugaaacgucguggcauuacgaucaagaucauccguacaaaaccugggccuaccaugggucguaugaaacuacucagacugggagcgcaucaucuaugguaaaugggguuguuagacuguuaacuaaacccugggauguccucccaaccguuacacagauggcaaugacagacacuacaccauuuggucagcaaaggguuuuuaaagaaaaaguggacacacgcacacaagagccaaaagagggaacuaagaaauuaaugaagaucaccgccgaauggcuguggaaagaacuagguaaaaagaagacaccccguauguguacaagagaagaauuuacacguaaaguaagguccaaugccgcacuuggagcaauuuuuacggacgaaaacaaauggaaaucagcuagagaagcgguagaagauaguagauucugggagcuuguagacaaagagagaaauuugcaucuugaaggcaagugugagacuuguguauacaauaugauggguaaaagggagaaaaaacuaggggaauuugggaaggcaaagggcuccagagcgauuugguauaugugguugggcgcaagguuuuuggaauucgaagcguuaggauuucuuaaugaagaucauugguuuagcagggaaaauucacuaucaggagucgaaggcgaaggacuucauaaauuaggauauauacuacgugauguuagcaagaaagaaggaggggcgauguacgcagacgauacagcuggcugggacacgagaauaacucuggaagacuuaaaaaaugaagaaauggucacuaaccacaugaaaggggaacacaagaaauuagcagaagcuauauuuaaauuaacguaucaaaauaaaguaguuagaguacagcgcccaacaccgaggggaacggugauggauauaauaucaagacgagaccaacgcgggaguggacaaguugguacuuauggacugaacacuuucacuaacauggaagcucaauuaauuagacaaauggagggugagggaguauucaaaaauauacagcaccucacaguuacagaagaagucgcuguucagaacugguuagcaaggguugggcgugagagauuaucccggauggcaauuaguggugacgauuguguuguuaaaccuuuagaugaucgguuugcgaaugcuuugaccgcacuaaaugauaugggaaagauaaggaaagacauacaacaaugggaaccuucaaagggauggaaugacuggacacagguuccauuuuguagucaucacuuucaugagcuaauuaugaaggaugguagaguauuaguaguucccugcagaaaucaagacgaauuaauaggacgggcacguauaucccaaggggccggguggucuuuaagagaaacagcuugccuagggaaaaguuacgcgcagauguggaguuugauguauuuccauagacgggaccuacgguuagccgcaaacgcuauauguagugcagugccaucucacugggucccuacauccagaacgacuuggagcauucaugcuaagcaugaauggaugacaacagaggauaugcuuaccguauggaauaggguguggauacgugaaaauccuuggauggaagauaagacuccuguagaaucaugggaagaaaucccuuauuugggcaaaagagaggaccaaugguguggcagcuugaucggauuaaccaguagagcuacaugggcuaaaaauauucaagcggcgauuaaccaaguuaggucccuaaucgguaacgaagaauauacggauuacaugccauccaugaaaagauuuagaagggaagaagaagaggcuggugugcuaugguga

SEQ ID NO: 22321 - RNA, 9876 nt, Artificial Sequence
  derived and/or modified CDS sequence (opt6) from DENV-2__GU131928__SS-prME
agcgcggguaugauaauuauguuaaucccaacggugauggcuuuucauuuaacaacgagaaauggugaaccgcauaugauuguagguauacaagaaaaagguaaaucacuauuauuuaaaacagaagaugguguuaacauguguacauuaauggcgauggaucuaggagaacuuugugaagacacgauaaccuauaaauguccauuacuaagacaaaaugaaccagaagacauagacuguuggugcaauaguaccuccaccuggguaacauaugggacuugcacaacuacgggcgaacacagacgagagaaaaggucuguugcgcuagugccacauguggguaugggauuagaaacgcgaaccgaaacauggaugucgucagaaggugcauggaaacaugcacaaagaauugaaacauggauccuaagacauccaggcuucacuauaauggcggcuauccuggcauacacaaucgggacaacacacuuccagaggguucuaauauuuauacuucucaccgcuguagcgccuaguaugacuaugagguguauuggaauuucuaaccgugauuuuguagaagggguaucaggcggauccuggguugauauaguguuggaacauggaaguugugucacaacgauggccaaaaacaaacccacauuagauuuugaauuaauuaaaacggaagcuaaacaacccgccacuuuacguaaauauuguauagaagccaaauugacaaacacgacgacugaaagcagauguccaacacaaggugaacccucucuaaaagaagaacaagauaaaagguucguaugcaaacacucaaugguagauaggggauggggaaacggcuguggacuuuuugggaaaggagggauaguaacgugcgcaauguuuacaugcaagaaaaacauggaaggcaaaauagugcagccugaaaaucuagaauauacaauagucgugacgccacacaguggggaagaacaugcugucggaaaugacaccggaaaacacggaauggaaauuaaaguuacaccacaaaguucaauaacagaagcugaauuaacgggguacggaacgguaaccauggagugcaguccgcgaacagguuuagauuuuaaugagauggugcuuuuacaaauggaaaauaaagcguggcuaguucaucggcaaugguuucuagauuuaccuuuacccugguuaccuggcgccgauaagcaagaaucaaauuggauucagaaagaaacccuaguaacguuuaagaacccacaugcuaagaaacaagauguaguuguguugggaucccaagaaggcgcgaugcauacugcauugacaggcgcuacagaaauccaaaugagcucaggaaacuuauuauucacgggacaucuaaaaugucgcuugaggauggacaaacuccaauuaaaaggaaugagcuauaguauguguacugguaaguuuaaaguagugaaggaaaucgccgaaacacaacacggaaccauagucauaagaguacaguacgagggagaugguucuccguguaaaauaccuuucgaaauaauggaccuagagaaaagauacguauuaggaagauugauaaccgucaauccgauaguaacagaaaaagacaguccgguuaauauugaagcagaaccaccuuucggggacucuuauaucauaauuggaguggagccuggacaauuaaaacucaacugguuuaagaaagggucaucuauaggacagauguucgagacuacaaugagaggagccaaacggauggcuauauuaggggauacugcaugggacuuugguaguuuaggaggaguauuuacuucaauugguaaagcacuccaucaaguuuucggagcuauuuaugguguagcuuucaguggagugucguggaccaugaaaauccuaauaggcguaauuaucacauggauugguaugaacucgcgaucuacaaguuuaucugugucguugguacucguuggaauaguuacacuauauuuaggugucaugguucaggcugauagcgguuguguugucucauggaaaaauaaggaacuaaaaugcgguucaggcauauuuaucacggauaauguacacaccuggacagaacaauauaaauuccagccagaauccccauccaaacuagcgagugcgauucagaaggcacaagaagaaggaauuugcggaauuagauccgugacucgacuugaaaaccuaauguggaaacaaauaacucccgagcuuaaccacauucuagccgagaaugaaguaaaauuaacaauaaugaccggagauaucaaaggaauaaugcaggcuggcaagagaucuuuacguccacaacccacugaauuaaaguacaguuggaaaacaugggggaaagccaagaugcugucuacugaaagcuauaaucaaacauuucuaauagauggaccagagaccgcagagugcccuaacacuaaucgugcuuggaacuccuuagaaguagaagauuaugguuucggaguauuuacaacaaacaucuggcuuaaauugaaagagaaacaggaugcuuuuugugacucaaagcuaaugucagcggcaauaaaagauaauagagcaguacaugcagacaugggcuacuggaucgagucugcccuaaaugauacguggaaaauagaaaaagcaucauuuauagaaguaaagaauugucacuggccaaaaucacacacauuaugguccaauggaguucucgaaagugaaaugauuauccccaaaaaccuugcaggaccaguaucacagcacaauuaucgaccuggauaucacacgcagaucgccggaccauggcacuuaggaaaacuugaaauggauuuugauuuuugcgauggaacuacagucauaguaacggaagauugcgguaacaggggaccgagcuuaagaacaacaacugcuagcggaaaacuaauuacugagugguguugucguuccugcacauuacccccauuacguuauagaggggaggaugguugcugguauggcauggaaauccgaccccuuaaagaaaaagaagagaaucuaguaaauucgcucguaaccgcagggcacggacagguggauaacuucucacugggaguguuaggaauggcguuauuccucgaagaaaugcugcguacuagaguugguacaaaacaugcgauacucuuaguggcuguuucauuugucaccuuaauaacuggaaacaugaguuuuaaggaccuaggaagaguugucguaauggucggugcaacaauggcagacgauaucgguaugggaguaacauauuuggcguuacuggcagcguuuaaaguucgaccaacguucgcagcuggacuauuauuaagaaagcucacgucaaaagaauuaaugaugacuacaauugguauagugcucuuaucucaaucgacuauacccgaaaccguauuagagcuaacagaugcacuagcucuagggaugaugguucuuaaaaucgugcguaacauggaaaaguaucaauuagcagugacgauaauggccauacucugcgucccaaaugcugucauucuccaaaaugcauggaagguaucuugcacaauacuggcaguuguuagcguauccccauuacugcuaacaucgucacagcagaagacugauuggauaccacucgcgcucacaaucaaaggcuuaaauccgacagcaauauuuuuaacgacccuaucccggacaaauaaaaagcgaucuuggcccuuaaacgaagcaaucauggcagugggaaugguaucuaucuuagcauccucuuuacuaaagaacgacauacccaugacggguccuuuaguugcgggaggccuucuaacaguauguuacguuuuaacgggccgcagugcagaucuagaguuagaaagagcuacggauguaaaaugggaagaucaggccgaaauuucggggagcucgcccauuuuaagcauuacgauuagugaagacgggagcaugucaaucaaaaacgaggaggaagaacaaacguugacaauucuaauuagaacaggacuauuagugauaucaggccuauucccaauaucaaucccuauuacagcugccgcuugguaccucugggaaguuaagaaacagcgugcuggggugcuuugggacgucccaaguccgccuccaaugggaaaggcagaguuagaggauggagcauacaggaucaagcagaaaggaauacuuggauacucucaaauaggagcgggugucuauaaagaagguacguuucauacaauguggcauguaacacguggagcgguguugaugcauaaagguaaaaggauagaaccuaguugggcugacgucaagaaagaucucauuucuuauggcgguggauggaaacuggagggugaauggaaagaaggugaggaagugcaagugcuagcguuggaaccagguaagaauccccgugcaguacaaaccaaaccaggccuguucaaaacuaauacugguacuaucggagcugugucauuagauuucucgccaggaacaucaggaucuccaaucauugacaagaaaggcaaaguugucgguuuauacgggaauggaguagugacacguucgggugcauauguguccgcgaucgcacaaacagaaaaaucaauagaagauaauccugagaucgaagaugacaucuuuagaaaaagacgacuaacuauaauggacuuacauccuggggcuggaaaaacuaaaagguaucuuccugcuauaguaagggaggcgauuaaacgcggguugaggacacuaauccuggcuccaacucggguaguggccgcggaaauggaagaggcauuacguggcuugccaauuagauaucaaacgccagcaauuagggcggagcacacaggaagagaaauagucgauuugaugugccaugcgacuuucacuaugcgucuacucaguccugugcguguaccuaacuacaaucuaauuauuauggacgaggcgcauuuuacagaccccgcaucaauugcugcaagaggauauauuuccacucguguagaaaugggugaagcagcgggcauauuuaugacagcgacuccgccggggucaagagaucccuuuccucaaaguaaugccccuauaauugaugaggaacgugagauacccgaaaggaguuggaauagcggccaugaaugggugaccgauuucaaagggaaaacuguaugguucgugcccucaauaaaagcugguaaugauauagcagcauguuuaaggaaaaaugguaagaaagucauccaauuaucgcgaaaaacauuugauucagaguaugugaaaacuagaacuaaugauugggacuuuguaguaaccacagacauuuccgaaaugggagcuaacuuuaaggcagaaagaguaauagauccacgaagaugcaugaagccuguuauccuaacagauggagaagaaagaguaaucuuagcaggaccaaugccgguuacacauucaucggcggcacagagaaggggacgaauaggacgcaaccccaaaaaugaaaaugaucaauacauauacaugggagaaccccuagaaaaugacgaagauugugcgcacuggaaagaagcuaagaugcuuuuagauaacauuaauacgccggaagguaucauaccuucgauguuugaaccagaaagagaaaagguagaugccauagauggggaauauagacucaggggugaggcaagaaagaccuucguggaucuaaugcgccgaggagauuuaccaguauggcuugcuuacaaaguagcggccgagggcauaaauuacgcggaucguagaugguguuucgauggaauuaaaaauaaucagauacuagaagaaaauguugaagucgagauauggacaaaagaaggagaaagaaagaaacuaaaaccucgcuggcucgacgcaagaaucuauagugacccacuagccuuaaaggaguucaaagaauuugcugccgguagaaaaagucuuacuuugaaccucauaacagagaugggaagauugccaacguucaugacucagaaaacgagagaugcccuugacaaccuugcuguacuacauacagcagaagcagggggucgcgcauauaaucaugcgcuuagcgaauuaccagagacucucgagacacuacuacugcuaacccucuuggcaacuguuaccggaggaauauuccucuuuuuaaugagcgguagaggaauaggaaaaaugaccuuagguauguguuguauaauaacagccucaauucuccucugguacgcacaaauccagccgcauuggauagcagcaagcauaauuuuagaguuuuuccuaauagugcuauuaauuccagagccugaaaaacaaagaaccccgcaagauaaucaacuaaccuacguagugauagcaauuuuaacgguuguugcagcgaccauggcgaacgagaugggauucuuagagaaaaccaagaaagaucugggacugggaagcauagcaacgcaacagccugaaaguaauauauuagauauagaucucagaccggccagugcuuggacauuguaugcuguagcuacaaccuucgugacaccaaugcuuagacauagcauagaaaauucgagugucaauguuagcuugaccgcgaucgcaaaucaagcuacaguauuaaugggccucggaaaaggauggccuuuaaguaaaauggacauaggcguaccgcuucucgcaauaggauguuauagucaagugaauccaaucacauugacggcagccuuacuguuguugguugcucauuacgcaaucauuggcccaggucugcaagcuaaagcgacuagagaagcucagaaaagagcggcagcgggaauaaugaaaaauccaacuguugaugggauaacuguaauagaccuugauccaauacccuaugauccaaaauucgaaaagcaauuaggccaaguuauguugcuaauacuauguguaacacaaguucuuaugaugcguacaacaugggcucuaugcgaggcccucacgcuagcaacugggccaaucaguacuuuaugggaaggaaaucccgguagauucuggaauacaacaauugcagucucaauggcaaacauauuucgaggcaguuaucuagcaggagcaggauuacuauucucaauaaugaaaaacacuacgaacacucgaaggggaacaggaaacaucggggaaacauuaggcgaaaaauggaaaucacgacuaaaugcccuggguaaaucggaauuucaaauuuacaagaaaucaggaauccaagaaguagaucggacauuggccaaagaaggcauuaaacgaggugaaacagaucaucaugccgugucaaggggaagcgcaaaacuacggugguuuguagaacgcaacauggugacgccagagggaaaggucguugacuuaggauguggcagagguggauggucguacuauugcggaggauuaaagaacguacgugagguaaaaggauuaacaaaaggaggccccgggcaugaggaaccaaucccaaugagcacauacggauggaacuuaguucguuuacagucuggcgucgauguauucuuuauaccaccugaaaaaugugauacguugcucugugauauaggagaaucaucucccaaucccacggucgaggccggacggacauugagaguccuuaacuuagucgaaaauuggcucaauaacaauacacaauucuguauuaaaguccuuaauccauauaugcccucuguuauugagaaaauggaggcuuugcagaggaaauacggcggagcauuaguaagaaacccguuauccagaaauucgacacaugaaauguauugggugaguaaugcaucagggaacauuguaagcagcguaaauaugauaucacguauguugauaaaccgauuuacgaugaggcauaaaaaggcgacauacgaaccugaugucgaucucgguagcgguacucguaacaucggaauagaaagugaaacaccaaaccuagauauaauagguaaaaggauugagaaaauaaaggaagaacaugagacgucauggcauuaugaccaagaucauccauacaaaacuugggcauaucauggcaguuaugaaaccaaacaaaccgggagcgccagcucaaugguaaaugggguaguaagacuccugacuaagccuugggacguauuaccuacaguaacgcaaauggcaaugacagacacgacaccguucggucaacaacgaguauucaaagaaaaaguggauacucgaacccaagaaccaaaagagggaacaaagaaauugaugaaaauaacggcugaaugguuauggaaagaacuugguaaaaagaaaacuccucgaauguguacgagagaggaauuuaccaggaaaguacguaguaacgcggcacuaggagcuauuuucacugacgaaaauaaguggaaaucugcacgggaagcggucgaggacucacgcuuuugggaguuaguagauaaagagaggaaccuucauuuggaaggcaagugugagaccugcguuuauaacaugauggggaagcgugagaagaaauuaggcgaauuugggaaagcaaaaggaucaagagccauuugguacauguggcuaggagcaagauuccuggaauuugaagccuuaggcuuucuuaacgaagaccauugguucucuagagaaaacagcuuaucggguguagaaggugaagggcuacauaaacuagguuacauccuucgggauguguccaaaaaggaggguggagcaauguaugcugacgauacagccggaugggacaccagaaucaccuuagaagaccucaaaaacgaagagaugguaacaaaucacauggagggagaacacaaaaagcuagcggaagccauauucaaauugacauaucaaaauaaagucguaagagugcaacgaccuacaccaagagggacaguuauggacauuauaagccgaagagaucaacguggguccggccagguugguacuuaugguuugaauacauucacaaauauggaagcccaacuuauccgccaaauggaaggcgaaggcguuuuuaaaaacauucaacacuuaacaguaacugaagaagcagcaguccaaaacuggcuagcuaggguuggacgagaaagauuaagccggauggcaauaucgggggacgacuguguggucaaaccgcuagacgacagauuugcuaaugcacuuacagcauuaaaugauauggguaaaauaaggaaggacauucagcagugggaacccaguaaaggcuggaaugauuggacacaggucccuuucuguucacaccacuuucaugaauuaaucaugaaggacggcagagugcugguaguuccaugccgaaaucaagacgaauuaauuggacgugcgcgaauuagccaaggggcaggauggucacuaagagaaacagcguguuugggcaaaucuuacgcucaaauguggucauuaauguauuuucaucgacgugaucucaggcuagcggcuaaugcaauuuguucggcugugccaagucauuggguaccaaccagcagaacaacauggaguauacaugcaaaacaugaauggaugacuacagaagacaugcuuacuguauggaauagaguauggaucagagaaaauccuuggauggaggauaagaccccaguugaaaguugggaagaaauuccuuacuuaggaaagcgugaagaucaaugguguggaagccugauuggacugacaagccgugccacaugggcuaagaauauacaagcagccauaaaucagguccgaucucuuauaggaaacgaggaguauacugauuauaugccuagcaugaaacgauuucgacgagaagaggaagaagcuggaguccuaugguag

SEQ ID NO: 22322 - RNA, 9876 nt, Artificial Sequence
  derived and/or modified CDS sequence (opt6) from DENV-2__GU131929__SS-prME
ucugcaggaaugauuauaauguuaauuccaacuguaauggcauuucacuugaccacaagaaacggugaaccucacaugauuguggguauucaagagaaaggaaaaucccuauuauucaaaacggaagauggaguuaauaugugcacucuaauggcuauggaucuaggagaauugugugaagauacaauuacguauaaauguccacuacuacgacaaaaugaaccggaagacaucgacuguuggugcaauucgaccucuacuugggugacauaugggacuuguacuacaacaggagaacacaggcgugaaaaacgcuccguggcuuuagugccacacguggguaugggacuugaaacacguaccgaaaccuggaugagcagcgagggagcauggaaacaugcucaaaggauagaaacuuggauucugagacacccagguuucacaauaauggcagcuauucuggcguauacuauuggaacuacacacuuccaaagaguacuuauuuuuauucuacucacugcgguugcucccucaaugaccauucguugcaucggaauuucaaaccgagacuuuguggaaggaguuaguggaggaaguuggguagauaucguccuagaacaugguuccugcgugacaacuauggccaaaaauaaaccuacguuggauuuugaguuaauaaaaacagaagcaaaacaaccagccacccuaagaaaauacuguauagaagcgaaacugacgaauacaacaacggaaaguagauguccuacccaaggugaacccucgcuaaaagaagaacaagacaaacguuucguaugcaaacauucaaugguggaccgcggaugggggaacggguguggacuauucggaaaaggggguauagucacuugcgcaauguuuaccuguaagaaaaacauggaagggaaaauuguccagccugagaaucuugaauauacaauaguuguaaccccacauagcggagaagaacacgcagugggaaacgacacuggaaaacacgggauggaaauaaaaguaacaccacaaucaucaaucacugaagcagaauuaacgggauauggaacggucaccauggaaugcucaccuagaacugguuuagacuucaacgaaaugguauuacuucagauggagaacaaagcauggcugguccauagacagugguuucuagacuuaccauuaccguggcuaccaggugcagauaaacaagaaucuaauuggauccagaaagaaacuuuagucacguucaaaaauccucacgccaagaaacaggacguuguuguauuagggagccaggaaggcgcuaugcacacugccuuaaccggagcaacugaaauacaaauguccucaggaaaccuauuauuuacugggcauuuaaaaugucgcuuacgcauggacaaauugcaauuaaaagggaugucuuacucaauguguacuggaaaauucaaaguuguuaaagaaauagcagaaacccaacauggaaccauaguaauaagaguacaguaugaaggggauggcucaccuuguaaaauucccuuugaaauuauggaucucgagaaaagguauguccuggguagauuaaucacuguaaauccaauuguaacggaaaaagauagcccgguaaacauagaagcugaaccgcccuuuggugauucauacauaauaauugggguagaaccaggccaguuaaaauuaaacugguuuaagaaaggaucgucaauuggucagauguuugaaaccaccaugcgcggagcuaaaagaauggccauccuuggagacacugcaugggauuuuggaucauuaggcggagucuuuacauccauaggaaaagcucuacaccaggucuuuggugcuauauacggaguagcauuuuccggugugucauggaccaugaaaauauuaauaggggugauaauaacuuggauaggcaugaacucacgcagcacgucacuuuccgucagccuaguucuaguuggcauagugacacuauacuuaggaguaaugguacaagcugauucugguuguguaguauccuggaaaaauaaagaacuaaaaugugggucaggaauuuuuauaacugacaauguacacaccuggacagagcaguacaaguuccagccugagucaccuucgaaauuagcuucggcgauucagaaagcccaagaagaagggaucugugguauaagaagcguaaccagauuagaaaauuuaauguggaaacagauaacgcccgaguuaaaucauauucuugcagaaaacgaaguuaaauugacaauuaugacaggagauauaaaaggcauuaugcaagcagguaagagguccuuaagaccacaacccacagaacuuaaauauucuuggaaaacuugggggaaagcuaaaauguuauuuacagaauccuauaaucaaacauuuuuaauugauggcccagaaacagcggaauguccaaauacaaauagggcguggaacucacuagaaguugaggacuacgguuuugggguuuucacuacgaacaucugguuaaaacuuaaagaaaaacaagacgcuuuuugugauucgaaauuaaugucggcagcgauuaaagacaaccgcgcgguacaugcggauaugggcuauuggaucgagagugccuuaaacgauaccuggaagaucgagaaagcaucauucauugaagugaaaaacugucauuggccgaaaucccauacacuauggagcaaugguguccuugaaucagagaugauaauaccgaaaaaccuugcuggaccgguaucacaacacaauuauagaccaggcuaccacacgcagauagcaggaccuuggcaccuaggaaaacuggaaauggauuuugacuucugcgacggaacgacuguuaucgucacagaagacugugggaauagaggaccaagucuccgaacaaccacagcaucaggcaaacuaauaaccgaaugguguugcagaaguugcacacuuccgccauuacguuauagaggagaggacggguguugguaugggauggaaauucgaccauuaaaggaaaaagaggagaauuugguuaacucauuaguaacagcuggccacggacaaguugauaauuuuagccuaggaguacuuggaauggcauuauuucuugaggagauguuaaggacgcgcguugggaccaaacaugcuauauuauuaguagccgugaguuuuguaacucuaauuaccggaaacaugucuuuuaaagauuuagggcguguuguuguaauggugggcgcuacaauggcugacgauauagguaugggaguaacauauuuggcacuccuugcugcuuucaaaguucgucccacauuugcugcgggcuuacuucuacggaaacugaccagcaaagaauuaaugaugacgacuauagguauaguuuuacuuucccaaaguacgauaccagaaacagugcuggaauuaacagaugcacuugcacuuggaaugauggucuuaaaaauuguuagaaacauggaaaaauaccaacuugcugugacgaucauggcaauacuuuguguaccgaacgccgucauauuacaaaaugcauggaagguaucguguacaauacuagcaguggugucaguaagcccauuacuauuaacaucaucgcaacagaaaacugauuggaucccgcuggcauuaaccauaaagggccucaaucccacugccaucuuucugaccacacuaucaagaacaaacaagaaaagaucauggccucucaacgaagcaauuauggcagucgggaugguaaguauucucgcaucuagucuacucaaaaacgauauaccaaugacuggaccucuaguugcggguggacuucuuacgguguguuauguacuaacaggccgaucagcagaucuagagcuagagcgcgcgacggacguaaaaugggaagaucaagccgagauuaguggaaguucgccaauccucucuaucacuauaagugaggauggcaguauguccauuaaaaaugaagaagaagaacagacauuaacaauacuaauucgaaccggacuguuaguaauaucaggacuuuuuccaauaucuauuccaauaacagccgcagccugguaccucugggaagucaagaaacaacgcgccgggguauugugggacgugccuucaccgccaccaaugggaaaagccgagcuagaagauggagcauaucgcauuaagcagaaaggcauucuugguuacucacagauuggagcagggguauacaaagaaggcacauuccauacgauguggcacguaacaagaggagcaguguuaaugcauaaaggcaaacgaauagaaccaucgugggccgacgucaagaaagaucuuaucucguacggcggcggauggaaacucgaaggagaauggaaagaaggcgaagaagugcaaguucuugcgcuggaaccaggcaaaaauccuagagcgguucaaacuaaacccggcuuauuuaaaacuaauacuggcacaaucggagcuguuucacuugacuuuuccccaggaacaaguggcucaccuauuauagacaagaaaggaaagguuguggggcuauauggcaauggcguuguaacaagauccggagcauauguauccgcaauagcucaaacugagaaaaguauagaggauaauccagagaucgaagacgacaucuuccguaaacgacgacucacaauaauggauuuacauccgggugccggaaagacgaaaagguauuuaccggcgaucguaagggaagcaauaaaacgaggacuaagaacacugauuuuagcuccaacgagagucguugcagcagagauggaagaagcguuacgcggacuaccaauaagauaucaaacuccugcaauacgagcagaacauacagggcgcgaaauuguugaccucaugugucaugcgacauucaccaugagacuucugagcccuguucgagucccaaacuauaaccucauuauaauggaugaagcgcacuucacagauccggccaguauagcugcgagagguuauauaaguacccguguggagaugggagaagcagcgggcauauucaugacagcgacuccaccaggaucucgagacccuuuuccacaaagcaaugccccaauuauagaugaagaaagggagauuccggaacguagcuggaacaguggucacgagugggugacugauuucaaaggaaaaacaguaugguuuguaccauccauaaaagcaggcaacgauaucgcagcuugccucaggaaaaauggcaagaaaguaauacaacuuucuaggaagacauucgauagcgaauauguuaaaacgaggaccaacgauugggauuuuguagugacuacagacauaagugaaaugggugcuaacuuuaaagcagaacgugugauagacccaagacguuguaugaaacccguuauccuaacagacggcgaagaaagaguuauauuagcagggccgaugcccguaacccacucaucagcggcccaaaggcgagggaggauaggccguaaucccaaaaaugagaaugaucaauauauauauaugggagaaccgcuagaaaacgaugaagacugcgcgcacuggaaagaggccaaaauguuauuagacaauauaaacacacccgaaggaaucauacccucaauguuugaaccugaacgcgagaaaguggacgccauagauggagaauacaggcuaagaggcgaagcaagaaaaacauucguagaucucaugaggcgaggagauuuaccuguaugguuagcauacaaagucgcugccgaagguaucaacuaugcugaccgacgauggugcuuugauggcauuaaaaacaaccagauauuagaagaaaacguggaaguagaaauuuggacuaaagaaggagaaaggaaaaaguuaaaaccgaggugguuagaugcaaggaucuauuccgauccuuuggcccugaaagaguuuaaagaauuugcagcuggacggaagaguuuaacccuaaauuugauaacagaaauggguagacuuccgacauucaugacacaaaagacgcgagaugcauuagauaaucuggcaguauuacacacugcugaggccggugggagagcguacaaccaugcucugucagaauuaccggaaacccuugaaacacuccuacuuuugaccuuauuagccacaguaacuggagguauauuuuuauuccuaaugucaggaagaggcauuggaaaaaugacccuagguaugugcugcauaauaacugcuuccauuuuacuaugguacgcacagauacaaccacacuggaucgccgcaucaaucauacuagaguucuuucuaauuguucuacuuaucccagaaccagaaaaacagcgaacuccacaagauaaucaacuuacuuauguaguaauagcaaucuugacaguaguugcagcuaccauggcaaaugaaaugggcuuuuuggagaagaccaagaaagaucuagggcuagguaguauagcaacgcaacaaccugagagcaacauucucgacaucgaccuuagaccagccagugcauggacacucuaugcaguggcgaccacauucgucacuccgaugcuucgccacagcauugaaaauucgucuguaaaugucaguuuaacagcaauugcuaaccaggccacaguguugaugggacucgguaaaggcuggccacucaguaagauggauaucgguguucccuuguuagcaaucggaugcuacucacaaguuaaucccaucacucuaacagcggcacuacuauugcucguggcacauuacgcgauaauaggaccaggguuacaagcaaaagcuacaagagaagcacagaaaagagcagcagcggggauaaugaagaacccaaccguugauggaauaacaguuaucgacuuagauccuauacccuacgauccuaaauuugaaaaacaacugggacaaguuauguugcuaauccuuugcguaacucaaguauugaugaugaggacaacgugggcuuugugugaggcucuuacgcuagccacagggccaauuucuacauuaugggaaggcaacccaggucguuucuggaacacaacaauagcggucucuauggccaacauauuucgcgguagcuacuuagcaggagcaggccuauuguucuccauaaugaagaauaccacuaacacucgaagaggaaccgguaauauuggagaaacacugggagaaaaguggaaaaguagacuuaacgcucuuggcaaaucagaauuucagauuuauaagaaaucagguauacaggaaguagauaggacacuagcaaaagaaggaauuaaacggggagaaacagaccaucacgcaguuucgagaggaucagcgaaauuaaggugguuugucgaacgaaacauggugacuccggaaggaaaaguaguagacuuaggcugugguagaggagguuggucguacuacuguggaggucuuaaaaacguuagagagguaaaggggcugacuaaaggagguccgggacaugaagaaccgauucccaugagcacauaugguuggaaccucgucagauugcaauccggggucgacguguucuuuaucccaccagaaaaaugcgacacacuauugugcgauauaggagaaaguuccccaaacccaacaguagaagcgggccgaacucuaagaguucucaaucuggucgaaaauugguuaaauaauaauacacaauuuugcauuaagguucuaaacccuuauaugccaagugucaucgagaaaauggaagcguugcaaagaaaauacgguggugcguuaguuaggaacccauugaguagaaauucgacacacgaaauguacuggguaucaaaugccuccggcaauauaguuucaagugucaauaugaucucaagaauguugaucaaucgcuucacuaugagacauaagaaagcuaccuacgaacccgauguagauuuagguucagggacccgaaacaucggcaucgaaagcgaaacuccaaaccuggacauaauugguaaacgcaucgagaaaauaaaggaagaacaugaaacaaguuggcacuacgaucaggaccacccguauaaaacaugggcauaucacgggucauacgagacuaaacaaacgggaucugcaucgucuaugguaaauggcguagugcgauuguuaaccaaaccaugggacguguuaccaacugucacccaaauggcgaugacggacacaacaccguuuggacaacagagaguuuuuaaagaaaaaguagacacaagaacacaagaaccaaaagaagguacaaagaaacuuaugaaaauaacugcugaauggcuguggaaggaacucgguaagaagaaaaccccucgaaugugcacuagagaagaguuuaccagaaagguuagaucaaaugcagcucugggagcuauauuuacugaugaaaauaaauggaaauccgcgcgagaagccguugaagacucaagguuuugggaguugguagauaaggagcgaaaucuacacuuagagggcaaaugugaaacauguguauauaauaugaugggcaagagggagaagaaacuaggagaauuuggcaaagcuaaaggcucccgugcgauuugguacauguggcugggagcucgcuuuuuagaauuugaggcuuuaggauuuuuaaacgaagaucauugguuuagucgugagaauagccuaucuggcgucgaaggagaaggacugcauaaacugggcuauauacuacgcgacgugagcaagaaggaggguggcgcuauguaugcugaugacacggcaggaugggauaccagaaucacauuagaagauuuaaagaaugaagaaauggucacuaaucauauggaaggagagcacaagaaauuggcagaggcaauauucaaguugacauaucaaaauaaggucguacguguucaaagaccuacaccucgaggaacagugauggauauaaucagccgcagagaccagagaggaaguggacagguaggaacauacggguuaaauacguuuacgaacauggaggcccagcuaauuagacagauggagggggaaggcguauuuaagaauauacaacacuuaacgguuaccgaggaagcggccguucaaaacugguuggcuagagucggacgggaaagauuaagccggauggcuaucaguggcgaugacuguguugucaaaccgcuggaugauagauuugcgaacgcccuuacagcacucaaugauaugggaaaaauucgaaaggauauacaacaaugggaacccucaaaggguuggaacgauuggacucagguaccauucuguagccaucauuuucaugaacuuaucaugaaagacgggagaguuuugguggugccaugccgcaaucaagacgaacuuaucggucgagccaggaucucucaaggcgccggauggucguuaagagaaacagcguguuugggaaaaucauacgcacaaauguggagcuuaauguacuuccaccgaagagauuugcgauuagcagcaaaugcuauaugcagugcaguuccuucacauuggguccccacaucccguacaaccuggucuauccacgccaagcaugaauggaugacuacagaagauaugcuuacugucuggaaccgaguauggauuagagaaaaucccuggauggaagacaaaaccccuguggagucaugggaggaaauuccguaccuuggcaagcgcgaagaccaauggugcggcaguuuaauaggacuaaccuccagggcuacgugggcuaaaaauauacaggcugcaaucaaucaaguucggucacuuauaggaaaugaagaauauacagacuauaugccgucgaugaagagauuucgaagagaagaagaagaagcugguguccuuugguga

SEQ ID NO: 22323 - RNA, 9876 nt, Artificial Sequence
  derived and/or modified CDS sequence (opt6) from DENV-2__GU131930__SS-prME
ucggcagguaugauaauuauguugauaccaaccguaauggcauuucauuugaccacaagaaacggggaaccacacaugauaguugguauucaagaaaaaggaaaaucccuauuguucaaaacggaagacggagugaacaugugcacuuuaauggcuauggacuuaggugaacuaugcgaagacacaauuaccuacaaaugcccccuccuacgacaaaaugaaccagaagauauagauuguugguguaauuccacaagcacuuggguaacuuacgguacauguacaaccaccggggaacaccguagagagaaaaggucaguugcccuaguaccgcacguagguaugggucucgaaacaaggacagaaacauggaugucgucagaaggggcauggaaacaugcucaaagaauagaaacauggauacuucgacauccggguuucacaauaauggcagcaauacuggcauacacuauuggaacaacccauuuccaaagggcacucauauuuauacucuuaacagcuguagcaccaucgaugaccaugagauguaucgguaucucaaaucgagacuucguggaaggaguaucuggaggaaguuggguagauaucguccuugaacacggaucgugcgucaccacaauggccaaaaacaaacccacguuggacuucgaacugaucaaaacugaagcaaaacaaccagcuacauuacguaaauauuguauagaggcgaaauuaacaaauacaacaacagaaagccgaugccccacacaaggagaaccgagucuuaaagaagaacaagauaaaagauucguaugcaaacacaguauggucgauagaggaugggggaauggaugcggccuuuucgguaaaggaggaauaguaacuugcgcaauguuuaccuguaagaagaacauggaaggcaagaucgugcagccagaaaaccucgaguacacaauugugguuacuccucauucuggggaagaacacgcgguaggcaaugacacagguaaacauggaaaagaaauaaaaguaacaccgcaaagcagcauuacagaagcagaacuaaccggguacggaaccguaacaauggaguguagcccuagaacuggguuagauuuuaaugaaaugguucuccugcaaauggaauccaaagcauggcuaguacaucgccaaugguuccuugaucuuccucugccauggcuaccuggcgcagauaaacaagggaguaauuggauacaaaaagagacauuaguaacuuucaaaaauccccaugccaagaaacaagaugucguagucuugggaagucaagaaggggcuaugcacacagcuuugacaggggcgacugaaauacaaaugucgucagguaauuuauuguuuacuggacacuugaaauguagacugcguauggauaaauuacaauuaaaaggcauguccuacucaaugugcacaggaaaauucaaagucgugaaagaaauagcugaaacgcaacacgguacuaucgucauucgaguacaauaugaaggagauggaagcccauguaaaauaccauuugaaauaauggaucuggagaaaagguauguguuaggcagauuaaucacaguaaaccccauagugacagaaaaagacucaccuguuaacauugaagcagaaccaccauucggagacucauauauuauuauagggguugagccagggcaacucaaacuaaacugguucaagaaagguucgucaaucggucaaauguuugaaacaacgaugagaggggccaaacgaauggcgauauuaggagauaccgccugggauuucggcucauuaggugggguguucacaucgaucggaaaagcauuacaucaagucuucggggcaauuuauggagcugcauucagcggggucucauggacgaugaaaauucuaauuggagucauuauaacguggaucggcaugaauagcagaucuacuucauuaagcgugucucucguauuagucgguauagugacacuuuaucuugggguaauggugcaggcagauagcggguguguuguuucguggaaaaacaaagaauuaaaauguggaagugguauauuuauuacugacaauguccauacauggacugaacaauauaaauuccaaccagaguccccuuccaaauuagccuccgcuauucaaaaagcacaggaagaaggcauaugugguauaagaucagugacacgcuuggaaaaccuuauguggaaacaaaucacaccagaguuaaaccacauuuuagcagaaaacgagguaaaacuuacuauaaugacaggugauauaaaaggaauuaugcaagccgguaaaagaucccuaaggccgcagcccaccgaauuaaaauacagcuggaaaacauggggaaaagcaaaaaugcugaguacagaaagucauaaccagacauucuuaauagacggcccagaaacagcagaguguccuaacaccaaucgagccuggaauaguuuagaaguugaagauuauggauucgguguauuuacaacaaauauuuggcuaaaauuaaaagaaaaacaagacgcuuucugugacaguaaacuaaugucugcagcaauaaaagacaaccgugcagugcaugcugacaugggguacuggaucgagucagcacuaaaugauacauggaaaaucgagaaagcgagcuuuaucgaggucaaaaauugccauuggccaaaaagccacacucuauggaguaauggcguacucgagucagaaaugauaauaccgaaaaaucuagcaggaccgguuagucaacacaauuauagacccggcuaucauacccaaacggcaggcccguggcauuuagggaaacucgaaauggacuucgacuucugcgacgguacgacagucaucguuaccgaagauuguggaaaucgcggcccaagucuacgcacaacaacugcaucaggaaaacuuauaacugaaugguguugccgaucuuguacacuaccgccacugagauaucggggcgaagacggaugcugguaugggauggaaaucagaccucuuaaagaaaaggaagagaaccucgucaauagccuaguaacugcgggacacggacaaguggauaauuucucacuuggggucuuagggauggcccuauuucuagaagagaugcuacgcacgcguguaggaacuaaacacgcaauccucuuagucgcggucucuuuuguuacgcuaauuacuggaaauaugucauuuaaagaccuagguagagucguuguuauggucggcacaaccaugacagacgacauaggaaugggggucacauaucuggcuuuacuugcggcuuuuaaaguuagaccgacuuuugcagcgggccuauuacuuagaaaacuaacaucuaaagaauuaaugaugacaacuauugguaucguuuuacuaagccaauccacaauuccagaaacuauucuagaacucacugaugcacucgcucuaggcaugaugguacuuaaaauagucagggacauggaaaaauaucagcucgcagucacgaucauggcgauacuuugcguuccaaaugcaguaauacugcagaacgcuuggaaggugagcuguacaauauuagccgucguaagcguaagcccucuacuauuaacauccucacagcagaaaacugacuggauuccucuagccuuaacaauaaaagguuugaacccaacagcaauuuuucuaaccacauugagucguacgaauaaaaagcggucauggccccucaacgaagcuauaauggcugucgggauggugucgaucuuggccaguaguuuacuuaagaaugacauucccaugaccggcccguuagucgccggagguuugcuaaccgugugcuaugugcucacaggacgcagcgcagaccuagaacuugaaagggcgacugauguuaaaugggaagaccaagcagaaaucaguggaucuucuccuauauuaagcauaaccauuucggaagacgggagcaugucaauaaagaaugaagaagaagaacaaacacuuacgauacugauacguacaggauuacuuguaauauccgggcuauucccugugucuauuccgauuacugccgcagcaugguaccugugggaagucaaaaagcaaagagccgguguauuaugggauguaccgagcccaccaccaauggggaaagcggaacuagaagacggugcguaucgaauaaagcaaaaaggcauucuaggauauagccaaauuggggcaggaguuuauaaagaaggaaccuuccacacuauguggcauguuacucgaggcgcaguuuuaaugcauaagggaaagaggauugaaccgaguugggccgaugucaagaaagacuuaauuucguacggaggggguuggaaacuagagggagaguggaaagaaggugaggagguacaagugcuggcacuugaacccgguaaaaacccacgagcaguccaaacaaaaccuggguuguucaaaacuaacacgggaaccauuggagccgugagccuugauuuuucucccggcacaagugguuccccaauuauugacaaaaagggaaaaguagucggccuuuacgggaaugggguaguaacccguaguggggccuacgugucggcgaucgcgcagacagaaaagucuaucgaagauaauccugaaauagaagaugacauauuuagaaaaagacgacugacuauaauggaccuacauccaggugccggaaagacgaaaagguacuugccagccaucgucagagaggcaauaaaaagaggcuuacggaccuuaauacuugcuccaacaagggugguugcugcagagauggaagaagcacuaagaggccuaccgauccguuaccaaacaccagcaaucagagcugaacauacaggaagggaaauaguugacuugaugugucacgccacauuuacuaugcggcuccuaagcccugucagagucccaaauuacaacuugauuauuauggacgaagcgcauuuuacagauccugcaagcauagccgcgaggggcuacauauccacucgaguggaaaugggggaagccgcuggaauauuuaugaccgccacaccucccggaagcagagauccuuuuccacaaucuaaugcaccuauuauagaugaagaaagggaaauucccgagagauccuggaauacaggacacgaauggguuacugauuucaaaggaaaaacaguaugguucguuccaucaaucaaagcaggcaaugauauagcagcaugucucaggaagaaugguaagaaagucauccaauugucgaggaaaacguucgauuccgaauacgugaaaaccagaacaaaugauugggauuuuguuguaacuacagauauuucugaaaugggcgcaaauuucaaggcagaaaggguuauugauccuagaagaugcaugaaaccaguaauccugacugauggggaagaacgaguuauccuggcaggacccaugccugucacacacagcagugccgcacagagacgaggaagaauaggacgaaaucccaaaaacgaaaacgaucaguauauuuauaugggcgaaccauuagaaaacgaugaagauugugcccauuggaaagaggcaaaaauguuacuagacaacauaaacacaccugaaggaauaauaccaucuauguucgaaccagaaagagagaaaguggacgcgaucgauggggaauaccgauuaagaggggaggcuagaaaaacuuucguagaccuaaugcgaagaggagaccuaccgguaugguuagcuuacaaaguugcagccgaagguaucaauuacgcugaccgaagauggugcuuugauggcaucaaaaauaaccaaauacuugaagaaaacguagaaguagaaauauggacaaaagagggagaaagaaagaaacuaaaaccgagauggcuugaugcacgaauuuauucugacccacuagcgcuaaaggaauuuaaagaauuugcugcagggcggaaaaguuuaacacucaaucucauaacagaaauggguagauuaccaacauucaugacacagaaaacgagggacgcacuugauaaucuagccguccuccauacggcugaagcaggcggacgagcuuauaaucacgcacuuuccgaauuaccagagacgcucgagacuuugcuccuccugacucuacuagcaacggucacaggcggaauauuccuauuuuuaaugagcggccgaggaaucgguaaaaugacccucggcauguguugcaucauaacggcaucuauacuacuaugguacgcucaaauacagccacauuggauugcggcaucuauuaucuuggaauuuuuccuaauagucuugcugauccccgagcccgaaaagcagagaaccccucaagacaaucaauuaacguaugucgugauagcuauuuuaacuguaguagcagccacaauggcaaacgagaugggcuuucuagaaaagacuaagaaagaccucggacugggaucgaucgcuacucaacaaccagaauccaacauauuggacauugaccuuaggcccgccuccgccuggaccuuguaugccguagcuacaacuuucguaacuccaaugcucagacauagcauagaaaauagcucuguaaaugucucucuaacagcuaucgccaaccaggccacgguacuaaugggauugggaaaaggauggccacugagcaaaauggauauugguguaccuuuacuagccauuggauguuacucucaagugaaucccauuacauuaacagccgcuuuauuacuucuaguagcgcauuaugcaauaauaggcccagguuuacaagcgaaagcaacuagagaagcucaaaaacgagcagcagcaggaauuaugaaaaauccuacaguagacggaauaacuguaauagauuuggacccaauaccuuaugauccgaaauucgagaaacaacuuggacaagugauguuacuaauccugugugucacacaaguacuaaugaugcgcacaacaugggccuuaugugaagcacucacuuuagcaacuggcccaauaaguacauuaugggaaggaaauccaggaagauucuggaauacaacuauagcagugaguauggcaaacauauuuagaggauccuauuuagcuggugcuggacuucuauucaguaucaugaagaacacuacuaacacacgacgaggaaccggcaacauaggugaaacucuuggggaaaaauggaaaucgagacuaaaugcucuagguaaguccgaguuccaaacuuacaagaaaaguggcauacaagaaguagaccgcacauuggcuaaagaagguauuaagagaggcgaaacugaccaucacgcugugagucgaggaagcgcgaagcuaaggugguuuguugaaaggaauaugguaacaccggaaggaaaagucguagauuuaggcuguggccgagguggauggagcuauuacugcggugguuugaagaacguuagagaaguaaaaggacucacgaaaggagggccugggcacgaagaaccuauaccaaugucuaccuauggauggaacuuaguaagacuucaaucagguguugacguguucuuuauuccaccggaaaaaugcgauacuuuauuaugugauauuggagaauccagcccuaacccgacugucgaagcaggucguacccuaaggguauuaaacuuaguggagaauugguugaauaacaauacacaauuuugcauuaaaguccuuaauccguauaugccuaguguaauagagaaaauggaagcgcuacagcgaaaguacggcggagcccuaguaagaaauccacucagucgaaauucuacucaugaaauguacugggugagcaaugcuucagguaauauaguuucuaguguuaacaugauaagcagaauguuaauaaauagguuuacaaugcgacacaaaaaggcaacauaugagccugauguggacuuaggaucgggaacucgaaacaucgguauagagagugaaauaccuaaucuggauauaauaggaaagagaauagagaaaaucaaacaagaacaugaaacaucguggcacuaugaucaagaucacccauauaaaacaugggcuuaucacggaagcuacgaaacaaaacaaacaggaucugcgucaaguaugguuaacgggguaguucgucuucuaacaaaaccuugggacguccuaccaacagugacacagauggcgaugacagacaccacaccuuuuggacagcaacggguauuuaaagagaaaguggauaccagaacucaagaaccaaaggagggaacgaagaaauuaaugaaaauuaccgcugaauggcuauggaaggaguuagggaagaagaagacgccacguaugugcacaagagaagaauuuacacguaaaguaaggucaaaugccgcccuuggagcuaucuuuacagaugaaaauaaauggaaaucagccagagaggccguggaggacucacgauuuugggaauugguagauaaggaaagaaaccuucaccuagaaggcaagugcgaaacaugcguauacaacaugauggggaaaagggagaagaaauugggagaauuuggaaaagcgaagggaucgagagcaauaugguauaugugguugggggcacgauuucuagaauuugaagcacucggauuucuuaacgaagaccauugguuuagucgugaaaacucacuaucuggaguugaaggagaggggcugcacaaauuaggcuauauccuuagggaugucaguaaaaaggaagguggagcgauguaugcugacgauacagcgggaugggauacuagaauaacuuuagaagaucuuaaaaacgaggaaaugguuacuaaucauauggagggggaacauaagaaacucgcagaagccauuuucaaauugacauaucaaaauaaagucgugaggguccaaaggccuacuccaagggggacagucauggauauaauaucuaggcgcgaucaaagaggcucugggcaaguuggaaccuacggacuuaauacuuuuacaaacauggaagcacaacucauaagacagauggagggggaagggguauucaaaaauauacaacaucucacggcaacagaagagguagcugugaaaaacuggcuagcaagaguugggagagaaaggcugucgagaauggcgauuaguggggacgauuguguggucaaaccuuuagaugaccgguucgcaaacgcacucacagcuuuaaaugauauggguaaaauuagaaaagacauacagcagugggaaccgaguaaaggauggaacgauuggacgcaagugccauucugcagucaucauuuucacgagcugauaaugaaggauggacgaguccugguuguaccuugucguaaucaagaugaacucaucggucgagcgcggauaucgcaaggagcgggauggagucucagggagacugcauguuuaggaaagaguuaugcacagauguggagucuuauguauuuucacagaagggacuuaagacuugcggccaacgcgauaugcucugcuguacccagccacuggguaccgacaaguagaacaacuuggucaauucacgcaaaacaugaauggaugaccacagaggauaugcuaacgguauggaaucgaguguggaucagagagaauccguggauggaagauaaaacaccagucgaaucuugggaagaaauuccguaucuagggaaacgggaagaccaauggugcggcagcuuaauuggauuaacaagucgggcaaccugggccaaaaacauccaagccgcaauuaaucaggugaggagccucauaggcaacgaagaauacacagacuacaugccguccaugaaacgguuuaggcgcgaagaagaagaagcaggggugcuaugguaa

SEQ ID NO: 22324 - RNA, 9876 nt, Artificial Sequence
  derived and/or modified CDS sequence (opt6) from DENV-2__GU131931__SS-prME
ucagcagggaugauuauaauguuaauuccaacaguaauggcguuccaucuaacgacccgaaauggagaaccacauaugauuguaggcauccaagaaaaagggaaaucauugcuauucaaaacagaagacggaguaaauauguguacucuaauggcaauggaccucggagaacugugcgaagauacaaucacuuauaaauguccguuacucaggcaaaaugaaccagaagauauagacugcugguguaacucaaccaguacauggguaacauauggaacaugcacgacaacuggugaacauagacgcgagaaaagaucuguagcacuuguaccccacgucggcaugggccuagaaacacgaaccgaaacauggaugaguucagaaggugcuuggaaacaugcacaacgaauagaaacauggauacuacggcacccaggauuuacaaucauggcagccauucuggcacacaccauuggaaccacacacuuucaaagagucuugauauuuauacuauuaacagcggucgcaccaaguaugacaaugcgauguauaggcauaucaaacagagauuuugucgaagggguaucuggcgguuccugggucgacaucguauuagaacacggaucaugcguaacaacaauggcgaaaaacaaaccuacauuggacuuugaauuaaucaaaacugaagcaaaacaaccagcaacucucagaaaauauuguauagaagcaaaauuaacaaacaccacgacugaaucuagauguccgacucaaggugaacccagucuaaaagaggaacaagauaaaagauucguuuguaaacacagcaugguggaccgaggauggggaaaugguugugggcuauuuggaaaaggugguaucguaaccugcgcgauguuuacauguaaaaagaauauggaagguaaaauaguacaaccugaaaaccuugaauacacaauaguugugacuccacacaguggagaagaacaugcuguuggcaaugacaccggaaaacacggaauggaaauaaaagucacaccucaguccuccaucacagaagcagaauugacaggauauggcaccgucacaauggaauguucccccagaacaggcuuggacuuuaacgaaaugguauuauugcagauggaaaacaaagccuggcuaguccaccgacaaugguuuuuagauuugccacuaccguggcuaccgggagcagauaaacaggaauccaauuggauccaaaaagaaacccucgugacauuuaagaauccacacgccaagaaacaagaugucgucguauuagggagucaagaaggagccaugcauaccgcucuuacuggugcuacagaaauccaaaugucaucaggaaacuuguuauuuacaggucaucugaaaugucgguuacgaauggauaaauuacagcuuaaaggaaugucuuauagcaugugcacagggaaguucaagguuguuaaagaaauagcagaaacacaacacggaacaauaguuauucgaguacaguaugagggagacggaagcccaugcaaaauaccuuucgaaauaauggaucucgagaaacgauacgugcucggacguuuaauuacaguaaauccuauuguaacagaaaaagacagcccgguuaacauagaagcugaaccacccuucggggauaguuauaucaucauaggaguagagccugggcaauugaaauugaauugguuuaaaaaggguaguaguauaggucagauguuugaaaccacuaugagaggggcgaaaagaauggcuauacugggcgacacagcaugggacuucggaaguuuaggagggguauucaccuccaucgggaaagcccuucaccaaauauucggagccauuuacggugcagccuuuuccggcgugucuuggacaaugaagauccuuauaggcgucauaauaacauggauaggaaugaacucaagaucaacgucucugagcguaucgcuaguguuaguuggcaucguuacucuauauuuaggaguuauggugcaagccgacaguggauguguugugucauggaaaaacaaagaguuaaaauguggaaguggaauauucauuacagauaacguccauacauggacagaacaauacaaguuucaacccgaaaguccaucgaaauuagcuucagcaauacaaaaagcacaagaggaagguauauguggaauuagaucagucacaaggcuugagaacuuaauguggaaacaaauaacgccugaauugaaucauauucuugcugaaaacgaaguaaaacuaacuauaaugaccggugauauaaaagguaucaugcaagcugggaaacgaaguuuaaggccccaaccaacagaauuaaaauauucauggaaaacuugggguaaagcuaagaugcuuuccacugagucacacaaucagacauucuuaauagacgguccggaaacugcagaauguccaaacacaaauagagcauggaacucccuggaaguagaggauuacggcuucggaguauucacuacuaacauuuggcucaaacuuaaagaaaagcaagaugcuuuuugcgauucaaaacuuaugagugcagccauuaaagauaauagggccguacacgcagacauggguuauuggauugaaucagcauuaaacgacacauggaaaauugagaaagcgucguuuauagaaguaaagaacugucacuggccaaaaucacauacacucuggucgaacgguguacuagagagugaaaugauaauucccaaaaaucuugcaggccccgugagucagcauaauuaccgccccggauaucacacacaaauugcaggcccuuggcaccuugguaaacuggagauggacuuugacuucugugacgggacaacuguuauaguaacagaggacuguggaaaccgggggccaucacugcggacaacaacggcaucaggaaaacuuauaacagaaugguguuguagaucauguacgcucccgccccuaagguaccgaggugaagacgguugcugguacggcauggagaucaggccuuugaaagaaaaggaagaaaaccugguuaauagccuagugaccgcgggucauggacaagucgauaauuucuccuugggcgugcuaggcauggcauuguuucuugaagagauguugcgaacaagagucgguaccaaacaugcuauacugcugguagcagugucauuuguuacccuaaucaccggaaauaugucguuuaaggauuugggaagaguaguaguaaugguuggagcgaccauggcagaugauauagguauggguguaacauauuuagcuuuacuggcagcauucaaaguuagaccuaccuuugcggcgggucuccuguuaagaaaacuaaccaguaaggagcuaaugaugaccaccauuggaauuguucuauuaagccaaucuaccauaccagaaacaguuuuggaguuaaccgaugcacuagcucuaggcaugaugguucugaaaauaguacgaaacauggaaaaauaccaacuugcgguaacaauaauggcaauacuuuguguuccuaaugccgucauacugcaaaacgccuggaaaguuaguugcacaauacuggcaguaguaagcguaucaccauuacuauuaacaucuagucaacaaaagacagauuggauuccacuugccuuaaccauuaaaggucuuaaucccacggcgauauucuuaacaacacugucacguacaaauaagaaacgaucguggccacugaacgaggccauuauggcaguagguauggugucgauucuugcuucgucccuucuuaagaacgacauuccuaugaccgguccgcucguugcaggggguuuguuaaccgugugcuauguucugacugggcguagugccgacuuagagcuugaaagagcuacggaugucaagugggaagaucaggcagagauaaguggcucaaguccaauuuuaucuauuacuauaagcgaagacggaucaaugaguaucaagaacgaagaagaagaacaaacacuaacuauacugauuagaacaggguuacuggucauaucaggauuguucccaauuucgauaccaaucacggcugcagcaugguauuuaugggaggucaagaaacaacgcgccggugugcugugggacguaccgaguccaccaccaaugggaaaagcagaacuggaagacggagcauauagaaucaaacaaaaagguauauuaggauauucucaaauaggcgccgguguuuauaaagaagguacauuccacacaauguggcauguaacuagaggugcaguuuuaaugcauaaagguaagaggauagaacccucaugggcagacgugaagaaagaucugauuucuuacggugguggcuggaaacucgagggcgaauggaaagaaggugaagagguacaagucuuagcuuuggaaccaggaaagaauccacgagcuguccaaacuaaaccgggauuguucaaaacaaacacgggaacaauaggagccguaucauuagauuuuucaccuggaacaucagguaguccuauaauagauaagaaagggaagguaguaggucuauaugguaacggugucgucaccagaucgggggcuuacguuucagcuauugcucaaacagaaaaaucgauagaggauaauccagagauugaagaugacaucuucagaaagcgccggcuuacaauuauggaccuacaccccggagcuggcaaaacaaaaagguaucuuccagcaauaguucgggaagcgauaaaacgcggcuuaaggacuuuaauauuagcgccaacucgagucguagcggcggaaauggaagaggcccuaagaggacugccaauaagguaccaaaccccugcaauacgagcugaacauacugguagggaaauaguugaccuaaugugccaugcaaccuuuaccaugcgauuauugagcccuguaagaguaccaaacuacaauuuaaucauaauggaugaagcgcacuuuacugacccagcgucaauagccgcgcguggauauauaucaacacggguugaaaugggcgaagcggcgggaauauucaugacagcaaccccgccuggaucacgggacccuuucccccaaagcaaugcaccaauuauagaugaggaacgagaaauaccggagagaaguuggaacucaggccacgaaugggugaccgacuuuaagggaaagacaguaugguucgugccuuccaucaaggcaggaaaugacauagccgcaugcuuaaggaaaaauggcaagaaagucauccaauugucaagaaagacuuucgacucagaauacgugaaaacucguacgaaugacugggauuuuguuguaacuacggacauaucagaaaugggugcaaauuucaaagcagaaagaguuaucgaucccagacgauguaugaaaccggugauucuaacggacggagaggaacgcguaauacuagcaggcccaaugccugucacacauucaucagcagcccaaagaagaggaaggaucggucguaauccuaaaaacgaaaaugaucaauauaucuauaugggagaaccacuagaaaacgaugaagacugugcacacuggaaagaagcgaaaaugcuucuugauaacauaaauacgcccgaaggcauuauaccaucaauguucgaaccagaacgagaaaaaguugaugcaauagauggggaguaucgcuuacgaggugaagccagaaaaacuuucgucgaucugaugcgacggggcgacuugccaguauggcuagcauacaaaguagcagccgagggcauuaauuacgcagacagacggugguguuuugauggaaucaaaaauaaucaaaucuuggaagagaacguagaaguugaaauuuggacaaaagaaggagaacguaaaaagcuaaaaccaagguggcuggaugcccguauuuacucugauccuuuagcucugaaagaauuuaaagaauuugcagcuggaagaaaaucccuuacauuaaauuuaauaacugagaugggucgauuaccgacuuuuaugacacagaaaacaagagaugcucucgacaaccuggcaguacugcauaccgcagaggcaggcgggagagcauacaaucacgccuuaagugaauuaccugaaacauuagaaacacuccuacuccuaacacuauuagcuacaguaaccgggggcauauuucuauuuuuaauguccggcagaggaauaggaaagaugacacugggaauguguuguaucaucacagcauccauauuacucugguaugcgcagauucaaccgcacuggauugccgcaucaauaauuuuagaauuuuucuuaauaguuuuacucauuccggaaccagaaaagcaaagaacaccacaggacaaccaguuaacuuauguggugauugcuauacuaaccgugguagcagcaacgauggcuaaugaaaugggcuuucuagagaaaaccaagaaagaucuuggguuaggcucaauagcgacacaacaaccggaaagcaacauauuagacauugaucuaaggccugcaucugcauggacauuauaugcagucgcuacaacauuugugacacccauguugcgacauuccauugaaaacucgagcguuaacguuaguuuaacggcaaucgcaaaccaagcaaccguucuaauggggcuaggaaaaggauggcccuuaucuaaaauggauauaggcguacccuuauuagcaauaggauguuacucacagguaaacccaauaacacucacggccgcuuuacuuuuacucguggcgcauuacgcaauuauagguccaggucuacaggcaaaggcuacucgagaagcccaaaagagagccgcugcagguauaaugaaaaaccccacgguagacgguaucacagugauagaucucgauccuauaccauacgauccuaaauuugagaaacagcucggacaagugauguugcucauccuguguguuacucaaguccuuaugaugagaacaaccugggcacucugcgaagccuuaacacuagccacagguccgauuucuacauugugggagggaaauccaggacgauuuuggaauacgacaaucgcuguuucuauggcaaacauuuuucgaggaucguaucuagcaggagcaggacucuuauuuucgauaaugaaaaauacgacuaacacaagaagagggacaggaaauauaggggaaacucugggagaaaaguggaagaguagacuaaacgcacuugguaaaagugaauuucaaaucuauaagaaaucagggauacaagaaguagaccgcacacucgcuaaggaagggauaaaacguggggaaacggaucaucacgcaguuucuagagguucagcaaaauuaagaugguucguagaaagaaacaugguaacaccggagggaaaaguuguagaccuaggcuguggucgaggagguuggucguacuauugcggaggccugaaaaacguuagggaagucaaggguuuaaccaaaggagggcccggucacgaagaacccauaccuaugucuacguacggguggaauuuagucagacuacaaucuggcgucgacguuuucuuuauaccuccggaaaaaugcgauacacugcuaugugauauuggggagagcucaccuaauccaaccguagaagcaggucguacacugcguguccuuaauuuaguggaaaauugguuaaauaauaauacucaauuuuguauuaaaguacuaaaucccuacaugccuaguguuauugaaaagauggaggcacuccaacgaaaguauggaggugcauuaguccguaauccacuaucuagaaacucaacucacgagauguauuggguaaguaaugcuucuggaaacauagucucuagcguaaauaugauaucccggauguuaaucaacagguucacaaugagacacaagaaagcaacuuaugaaccagacguagaccucggauccgggacgaggaauauagggauugaaagugaaauaccuaacuuagauauuauagguaaaagaaucgagaaaaucaaagaagaacaugaaacuuccuggcacuaugaccaagaucauccauauaaaacuugggcauaccacggcagcuacgaaacaaaacaaacugguucagcuuccaguaugguuaaugguguagugagauuacucaccaaaccaugggacguucuaccaaccguaacacaaauggcaaugacugacacgacaccuuuuggucagcaaaggguuuucaaggaaaagguagauacaaggacacaagaacccaaagaaggaacgaagaaauugaugaaaaucaccgcagaauggcuuuggaaggaguuaggcaagaagaaaacaccacgaauguguacacgagaggaguuuacucgaaagguacgaucgaacgcagcucucggggcaauauucacagacgagaauaaauggaaguccgcucgagaggcaguugaagacucacgauuuugggagcuaguagauaaggagcggaacuuacaccuagaaggaaaaugugaaacaugcguguacaacaugaugggaaaacgggagaaaaaguuaggcgaguucggcaaagcaaaaggaagucgcgcuauaugguauaugugguuaggggcacgauuccucgaauuugaagcccuaggcuuccugaaugaagaucauugguucucacgagaaaauucacuuagcgggguagaaggugaagguuugcauaaacuuggauacauuuugcgcgacguaagcaagaaagaagggggcgcuauguaugcggaugauacugccgggugggacaccagaauuacacuagaggaccuuaagaacgaagaaaugguuacaaaccacauggaaggugaacauaagaaauuagcugaggcgauauuuaaacuaacguaucaaaauaaagucgugaggguucaacgaccaacaccuagaggaacaguaauggacauaauaagcagacgggaucaaagagguucuggucaaguaggaacuuauggccuuaacaccuucacaaacauggaagcccaacuaauccgucaaauggaaggugaaggagucuucaaaaacauacaacacuuaaccguuacagaggaggcggcagugcagaauuggcucgcacgaguuggaagggagagauuaaguagaauggcaauaucuggcgaugauuguguaguaaagccguuagacgauagauuugcaaacgcacuuaccgcacuaaaugacaugggcaaaauacgaaaggauauacaacagugggaaccaagcaaaggcuggaacgauuggacucaaguuccuuucugcagucaccauuuucacgaguugauaaugaaagacggaagaguucuaguuguaccguguagaaaucaagacgaacucauaggcagggcacgcaucagccaaggugcggguuggucacuacgagaaacagcgugccucggcaaaagcuacgcucaaauguggagucucauguauuuccauagacgugacuuaagauuagccgccaacgcgauauguucagcugucccgagucauugggucccaacaucuagaacuacauggucgauacacgccaaacaugaauggaugacaacugaagacaugcugacaguauggaaccgcguauggauucgcgaaaauccauggauggaagauaaaacgccaguagagucaugggaggaaauacccuaccuaggaaaacgggaagaucaguggugcggauccuugauaggauuaacauccagagcuaccugggcgaaaaauauacaggcagcuauaaaccagguuagaucacucauagguaacgaagaauacacugacuacaugcccaguaugaaacguuuucgacgagaagaagaggaagccggcguacuuugguaa

SEQ ID NO: 22325 - RNA, 9876 nt, Artificial Sequence
  derived and/or modified CDS sequence (opt6) from DENV-2__GU131932__SS-prME
uccgcagggaugauuaucaugcuaauucccacuguaauggcauuccauuugacaacaagaaauggagaaccgcacaugauuguagggauucaagaaaaagguaaaucccugcuuuucaaaacagaagaugggguaaauauguguacauuaauggcgauggauuugggagaacuuugcgaggacacaauuacuuacaaauguccauugcuucgccaaaaugaaccugaagauauugauugcuggugcaauagcacaucuacuugggugacauacggaacguguaccacuacuggagaacaccgacgagaaaaacgauccguggcccuuguuccucauguugggaugggacucgaaacacguacagaaacauggaugaguucggaaggagcuuggaaacaugcacaaagaaucgagaccuggaucuuaagacauccagguuucacuauaauggcagccauacuugcauacacgauagggacgacacauuuucaacgcguccuaauauuuaucuugcuaacagccguagcaccauccaugacuaugagaugcauaggaauuucuaaucgagacuuuguagaaggggugucaggagguaguuggguagauauugucuuagaacacggaagcugugugaccacuauggcgaaaaauaaaccuaccuuggauuuugaauuaauaaaaacggaagcgaaacaaccggcuacccuaagaaaauauugcaucgaagcgaaacugacaaacacaacgacugaaaguagauguccaacacaaggcgaacccucacucaaagaagaacaagacaaacgguuuguauguaaacacaguaugguugauagaggguggggaaaugggugcggccuguuuggaaaaggggguauuguuaccugcgcaauguucacauguaagaaaaauauggaggguaaaauaguacaaccggaaaaccuagaauauacuaucguaguaacaccucauagcggugaagaacaugcuguaggaaaugauaccggaaaacauggcauggaaauaaaaguaacaccacaaucuuccauaacggaagcugagcuuacaggauauggcacaguaaccauggaauguucgccucguacuggauuagacuuuaacgaaaugguucuacuucaaauggagaauaaggcauggcuuguacauagacagugguuuuuggaucugccauuaccauggcuaccaggugcagauaaacaagaaucaaauuggauacaaaaagagacguuaguaacuuucaaaaauccgcaugcuaagaagcaagaugugguugucuuggguucucaggagggggcaaugcauacugcacucacuggggcuacugaaauacaaaugucaagcggaaaucuucuauucaccggucacuugaaaugcagacuccggauggauaaacuucaacucaaaggaaugaguuauucuauguguacgggaaaauuuaaaguaguaaaagaaauagcggaaacacaacauggaacgauagugauucguguacaguaugagggagaugggaguccaugcaagauaccguucgaaauaauggauuuggaaaaacgguaugugcuugggagacugauuacagucaacccuauuguuacagagaaagacucaccuguaaauauagaagcugaaccgcccuuuggugauaguuacauaauaaucggaguagaaccuggacaacugaaacuuaauugguucaagaaagggaguucaauuggacaaauguucgagacgacaaugagaggugccaaacgaauggccaucuuaggagauacagccugggauuuuggaagccugggugguguuuuuacuucgauaggaaaggcccugcaucagguuuuuggggcaauauacggagcugcauuuucgggugucuccuggacaaugaaaaucuuaauaggagugauaauaacuuggauagguaugaacuccagaaguaccucguuaucaguuucucugguucuagugggaauagugacacuuuauuuagguguaaugguucaagcugauaguggcugugucguuucauggaaaaauaaagagcuaaagugugggucuggcauauuuauaacagauaacguucacacauggacugaacaauacaaauuucagccagaaucgccuucuaaauuagcaucagcaauucagaaagcucaagaagaaggcauaugcgguauacgguccguaacacggcucgaaaaucuaauguggaagcaaauaacaccagaauuaaaccauauuuuagcagaaaacgaggugaaacuaacgauaaugacaggagauauaaaagggauuaugcaagcagguaaaaggucuuuaagaccgcagccgacagaauuaaaauacaguuggaaaacauggggcaaagcaaaaaugcuuucaacagaaucuuacaaccaaacauuuuugaucgauggaccugaaacugcagaauguccaaacacaaacagggcguggaacucauuggaaguagaagauuacggguucggagucuuuaccaccaacauauggcucaaacuaaaagaaaaacaggaugcuuuuugcgauucaaaacuuaugucggcugcaauaaaagauaacagggcgguacaugcagauauggguuauuggauugaaagugccuuaaacgauacguggaagauugagaaagcaucauucauugaaguuaaaaauugccauuggcccaaaucacauaccuuguggucaaauggagugcuugagucugaaaugauuauucccaaaaaucucgcggggccagugagucagcacaauuauagaccaggauaucacacacaaauagcuggaccuuggcaucuaggaaagcuagaaauggauuucgauuuuugcgauggaacgacaguaauaguaaccgaagacugcggaaacagagguccuucccucagaaccacuacagccagcggcaaacuuauuacagaaugguguugucgcuccuguacgcucccaccuuugagauaucggggagaagacggaugcugguaugguauggaaauacgaccuuuaaaagaaaaagaagaaaauuuagugaacagucuagugacggccgggcauggucaaguggacaauuucucccuaggcguuuuagggauggcguuguuuuuagaagaaaugcuacguacaagaguuggaacaaagcacgccaucuuguuaguagcagucagcuuugugacgcuaauuaccgguaacaugaguuuuaaagacuuaggucgaguuguaguaauggugggcgcgacaauggcugaugacauuggaaugggggugaccuaccuugcguugcuagcggccuuuaagguacguccuacauuugcagcaggacuucuucuucgaaaacuuacaagcaaagaauuaaugaugacuaccauugguauuguauuacuaagucaaaguacaauuccugagaccguccucgaacucacagacgcauuagcucuuggaaugaugguuuuaaaaauuguaagaaauauggaaaaguaucaauuagcagucaccauaauggcuauuuuaugugucccaaacgcagucauccuacaaaaugcuuggaaaguuuccuguacuauauuagcgguugucucaguaagcccacuacuauuaaccaguucacaacagaaaacggauuggaucccucucgcacuuacaauaaaagguuugaacccaacagcaauuuuucuaacaacacuaucacguacgaauaagaaacggagcuggccauuaaacgaggccaucauggcuguagguaugguaucgauauuagccagcucacugcucaaaaaugacauuccaaugacagguccacugguugcgggaggauuacuaaccguaugcuauguccuaaccgggagaagugccgaucuagaacuugagcgagcaaccgauguuaaaugggaagaccaagccgagauaaguggaucuucuccaauuuuaucuauaacaauuucugaagacggcucuauguccaucaaaaacgaagaagaagaacaaacacuaacaauauugauucguacuggucuacugguaauaaguggauuauuuccgauaagcauaccaauaacggcagcagcgugguaucuuugggaaguaaagaaacaacgggccgguguuuuaugggaugugccgaguccaccgcccaugggcaaagccgaacuugaagauggugcuuaccguauaaaacaaaaaggaauacucggcuacucucaaauuggugccggcguguacaaagaaggaacguuccacacaauguggcauguuacaagaggcgcgguacugaugcauaaaggaaaacgaauagaaccuucaugggcagaugugaagaaagaucuaauuagcuacggaggcgguuggaaauuagaaggggaguggaaggaaggggaagaaguccaaguacucgcucuggaaccuggcaaaaauccuagggcaguucaaacuaaaccaggucuguucaaaacaaacacagggacaaucggggcaguuucauuggacuucucacccgguacaagcgguagcccaauaaucgacaagaaaggaaaaguaguugguuuauacgguaaugggguaguaacacguucgggggccuacgucucagcuauugcucaaacagaaaaaucaaucgaagauaauccagaaaucgaagaugacauauuuagaaaaagacguuuaacaauaauggacuuacauccaggagcagguaaaacuaaaagauaccucccggcuauagugcgggaggcgauaaagagggguuugcgaacauuaauccuggcacccacacgaguaguugcagcagaaauggaggaagcgcucagagguuugccuauacguuaucagacaccagcaaucagagcagaacacacaggucgagaaauuguagacuuaaugugucaugccacauucacaaugagauuauugagcccggucagaguaccaaauuacaauuuaaucaucauggaugaagcccauuuuacggauccugcaucgauugccgcuagaggguauauauccacgaggguugaaaugggugaggcugccggaauauucaugaccgcuacuccaccugguucgagagauccguuuccccagucaaaugcuccuauuauagacgaagaaagagaaauaccagaaagaagcuggaacucuggucacgaaugggugaccgacuucaaaggaaaaacaguuugguucguaccgaguauuaaagcuggaaaugauauagccgcuuguuuacguaaaaauggaaagaaaguaauacaacugucacggaaaacuuucgauucugaguauguaaaaacuaggacaaacgauugggacuuuguugugacgacugacauuagugaaaugggcgccaauuucaaagcagagcgagucaucgacccuagacgcuguaugaaacccgucauccuuacagauggugaagaaagaguaauucuagcaggcccuaugccaguuacacauucgucagcagcgcaaagaaggggacguauuggacgaaacccgaaaaacgagaacgaucaauacauuuauaugggagaaccacuugagaaugacgaagauugugcacauuggaaggaagcaaagauguugcuagauaauauaaauacaccagaagguauuauuccaaguauguuugaaccagagagagaaaaagucgaugccaucgauggcgaauaucgauuaaggggagaggcgcgcaaaacauuuguugacuuaaugaggcguggagaccugccagucugguuagccuacaaaguagcugcggaaggaauuaauuaugcugaucgccguugguguuuugauggaauuaagaauaaucaaauauuagaagaaaacguagaaguagaaauuuggacuaaagagggggagcgcaagaaacuuaaacccaggugguuagaugcccgaauauauagugauccauuggcccuuaaagaguucaaagaauuugcugcaggacgaaaaucauugacguugaacuuaauaacugaaauggggagacuaccaacauuuaugacgcagaaaaccagggacgcgcucgauaauuuagcgguucuacauaccgcagaggcaggagguagggccuauaaucacgccuuaagugaacuacccgagacuuuagagacacuucuacuauuaacuuuauuggcgacaguuacgggaggaauauuuuuauuucucaugucaggcagagggauagggaaaaugacgcugggaauguguugcaucauaacugcgagcauauuacucugguaugcacaaauacaaccgcauuggauugcggcuagcauaauauuagaauuuuucuugaucguucuguuaaucccagaacccgaaaaacaaaggacgccccaagauaaccaauugacuuauguuguaaucgcaauucuuacaguaguagcugcuaccauggcaaaugaaaugggauuccuggaaaagacaaagaaagaucugggucugggaaguauagcuacacaacagccagaauccaauauuuuagacauagacuuacgaccagcuagcgcauggacuuuauacgcaguugccaccacauuuguaacaccaaugcuacggcacaguauagaaaacaguagcguuaauguuaguuugacugcaauagcuaaccaagcaacuguauuaaugggacuggguaaaggguggccuuuauccaagauggacauaggaguaccguugcuagcaauuggauguuacagucaaguuaacccgauuacucuuacggcagcgcuacuauuguuggucgcccacuacgcgauaauaggaccuggcuuacaagccaaagcuacgcgagaagcgcagaaaagggcugcggcagguaucaugaaaaacccgacagucgaugggauaacagugauugaccuagacccgaucccuuaugacccuaaauucgagaagcagcuaggccagguaaugcuguugauauuguguguaacacaaguacuaaugaugaggaccacaugggcucuaugugaagcucuaacauuagcuaccggucccaucuccacacugugggaagguaacccagggagauucuggaauaccacuauagcuguaucgauggcaaauauuuuucgagguuccuaucuugcuggggcagggcuguuauucucgauuaugaagaauacaacaaauacgaggagaggaacggguaauauaggggaaacucuuggagaaaaauggaaaaauagacuuaaugcauuagguaaaucagaguuccaaaucuauaagaaauccgggauacaagaagucgaucgaacauuagcaaaagaagguauuaaaagaggagaaaccgaccaucaugcagucagccgcggaagugccaaguugcgaugguucguagaacgaaacauggugacgccagaagggaaagucguugaucucggcugcggaaggggaggauggucauacuauuguggaggacucaaaaauguacgagaaguaaaaggacuaacuaaggguggucccgggcacgaagaaccuaucccgaugaguacauauggguggaaccuuguaagauuacagucuggcguugaugucuucuuuaucccuccugaaaaaugugauacucugcugugugacaucggcgaaucuagucccaauccuaccguggaagcaggcagaacguugcgaguucucaaucugguagaaaacuggcuaaauaauaauacacaauucugcauuaaaguuuugaauccauauaugccuaguguaauagagaaaauggaagcauugcaacgaaaguaugguggagcucuagugagaaauccucuaucaagaaacagcacacacgaaauguauuggguaucaaaugcgucugguaauauaguaagcaguguaaauaugauuagucggaugcuaauuaaucgauuuaccaugagacacaagaaagcgacauacgagccugauguugauuuaggaucagggacacguaauauuggaauagaaucugagauuccaaaccuagauauuauuggaaagagaauugagaaaauaaaagaagaacacgaaacaagcuggcacuacgaccaagaccauccauauaaaacgugggcauaucauggaucauacgaaacaaaacagacuggaagugcaucuucaauggucaaugguguuguuagauuacugacgaaaccaugggauguccucccuacaguaacccaaauggcaaugacagacaccacaccuuuuggacaacaaagggucuucaaagaaaaaguugacacgagaacacaagagccuaaagaagguaccaagaaacugaugaagauaacugcugaaugguuauggaaagagcuuggcaagaagaaaacuccccgcaugugcacccgagaagaauuuacaagaaaaguacgaagcaaugcagcacugggagccauauuuaccgaugagaauaaauggaaaucggcccgagaagcggucgaagauucaagguuuugggagcuaguugauaaggaaagaaacuugcacuuagaagguaaaugugaaacaugugucuauaacaugaugggaaaacgagagaagaaacuaggagaauuuggaaaggcaaaaggcucgagagcuauaugguacauguggcuuggggcccgcuuucuagaauuugaagcauuaggguucuuaaaugaagaucauugguuuucgcgagaaaacagucuaagcggggucgaaggugagggcuuacauaaauuaggauacauauugagagaugucucuaagaaagaaggaggagcuauguacgcggaugauaccgccggcugggauacaaggauaacuuuagaagaucuuaaaaaugaggaaauggugacgaaucacauggaaggugagcauaagaaauuagcagaggcuaucuuuaaacucacguaucagaacaagguaguuagaguucagagaccaacgccucgaggaacggugauggacaucauaagucgaagagaccaacgaggaucaggccaagucggcacauauggauuaaauaccuuuacaaauauggaagcacaauuaauacggcagauggaaggcgaggggguuuuuaagaauauucaacaucugacuguaacggaagaagcagcgguucaaaauugguuggcaagaguaggccgugagagacuuaguagaauggcaaucucaggcgacgauugcguaguaaaaccuuuagacgauagguuugccaacgcauugacugcauugaaugacaugggaaaaauuagaaaagauauacaacaaugggaaccaucaaagggguggaacgacuggacacaaguaccguuuuguagccaccauuuucaugagcuaaucaugaaagaugguagaguucuaguuguuccgugucggaaucaagacgaguuaaucgggagggcaaggauuucucagggggcugguuggaguuuaagggaaaccgccuguuuaggaaagagcuaugcacagauguggucguuaauguauuuucaucgaagggauuuaagauuggcugcaaaugcaauauguucagccgugccuucacacugggucccaacaagcagaacgacauggucuauacacgccaaacaugaauggaugacaacagaagacaugcuuacuguauggaaucgaguauggauccgugaaaauccuuggauggaggacaagaccccaguugaaucaugggaagaaauuccauauuuagguaaaagagaggaccaguggugcggcagccuaauaggacuuacgucaagagcuacaugggcgaagaauauucaggcugcaauaaaucaaguuagaaguuugauagguaaugaggaauacacagauuacaugccuaguaugaagcgauuccgucgagaggaagaagaggcaggaguacuaugguaa

SEQ ID NO: 22326 - RNA, 9876 nt, Artificial Sequence
  derived and/or modified CDS sequence (opt6) from DENV-2__GQ199892__SS-prME
acagcugggguaauaguuaugcugauuccuaccgcaauggcauuucaucuaacgaccagaaauggcgaaccucauaugauaguuggaagacaagaaaaaggcaaaucgcuacuguuuaaaacagaagauggaguuaauauguguacgcuuauggcgauagaucuaggugaacuaugugaagauacaauaaccuauaaaugcccguuacuacgacagaaugaaccugaagauauagacugcugguguaacucaacaaguacuugggugacguaugguacaugcacaacuacaggagaacaccgcagagagaaaaggagcguggccuuaguaccucacgugggaaugggguuagaaaccagaacagaaaccuggaugaguucggagggagcauggaaacacguacaaagaauugaaacuuggauacuaagacauccaggauuuacgauuauggcugcgauacuugcauacaccaucggaacuacccauuuucagcgagcauugauauuuauuuuacuuacagcaguagcaccuaguaugacaaugcguuguauagguaucaguaacagggauuucguugaaggaguaucaggaggcucauggguagauauuguacucgaacauggaucguguguuaccacaauggcuaaaaauaagccaacccucgauuuugaacugauaaaaacggaggcaaagcaacccgcaacacuuagaaaauauuguauagaagcaaaacucacgaauacgacuacagagucucguuguccaacccagggggaaccuucucuuaaugaagaacaagacaaacgauuuauuuguaaacauaguaugguagaccgcggaugggguaauggauguggucuauucggaaagggcgggauaguaacaugugcuauguucacuugcaagaaaaauauggaagguaaaauaguacaaccagaaaauuuggaauacacgaucgugauuacuccacacucuggagaagaacaugcuguaggaaaugauacaggcaaacacggaaaagaaauaaaaauaacaccccaaucaucuacaacagaagcagaauuaacaggguacggaacaguuaccauggaaugcagcccuaggacaggucuugauuuuaacgaaauggugcuacuucaaauggaagacaaagcaugguugguucaccgucaaugguucuuggaucugcccuuaccuugguugccuggagcagacacucaagguaguaacuggauucagaaagagacucuaguaacauucaaaaauccgcaugccaagaagcaagauguaguugugcucggaagccaagaaggugcaaugcauacagcacuaacgggcgcaacagaaauucagaugucaucaggaaaucuacuuuucacugggcauuuaaagugcagguuaagaauggacaagcuacaacucaaggguaugaguuauaguauguguacaggaaaauuuaagauuguuaaagagauagcggagacacaacacggaacgauuguaauacguguccaauaugaaggagauggagcaccauguaagauaccguuugagauaacagacuuagagaaacgacauguuuuaggacgauuaauuacgguaaauccaaucgugacagaaaaagauuccccuguuaacauagaagccgaaccaccguucggagauagcuauaucaucguagggguagagccaggacaacuaaaacuuaauugguucaagaaaggaucgagcauuggucaaauguuugagacuacaaugagaggcgcaaagcgaauggcaauccuuggagacaccgcaugggauuucggaucucucggcgggguguucaccaguauaggcaaagcacuucaccaaguuuucggagcgaucuauggagcugcauuuucuggggugaguuggacaaugaaaauuuuaauuggugugauaauaacuuggauugggaugaauaguaggucaacuagcuugucagucucacugguucuuguggggguuguaacguuguaccuuggcgccaugguacaagccgauucagguugcauuguuaguuggaaaaauaaagaauugaaaugcggaucgggaauauucauuacugacaauguccacacuuggacggaacaauauaaauuccaaccagaauccccaucuaaacuagcuagugcgauacaaaaggcccacgaagaagggauauguggaauaaggucuguaacacgguuggaaaaucuuauguggaagcaaauaacuccagagcucaaucacauauuaucugagaacgaaguaaaacuaacgauuaugacaggagauauuaagggaaucaugcaggcaggaaaacgcaguuuaagaccgcaacccacggaacuaaaguacucguggaaaaccuggggcaaagcuaaaaugcuaucuacagaaucgcacaaccaaacguuucuuauagauggaccagagacugcggaauguccuaauacuaauagagcauggaacucgcuagaaguugaagacuaugguuuuggcguguucucaacgaacauuuggcuaaaauuacgagaaaaacaagacguauuuugugauucgaaguugaugucagccgcuauaaaagauaaucgagcuguacaugcugacaugggcuauuggauagaaucggcccuaaaugauacuuggaagauggaaaaagcaucguuuauugaaguaaaaucaugucauuggccgaaaucgcauacguuauggagcaacggagucuuagaaucggaaaugaucauacccaaaaauuuugcaggaccugucucacaacauaauuacagaccggguuaucauacacagaccgcuggucccuggcauuuaggaaaauuagaaauggacuucgauuuuugcgaagggacaaccguuguagucacugaagacugugguaauagaggcccaucacuaaggacuacaacagcaucggguaaguuaauuaccgagugguguuguagaucuugcacucuuccaccauuacgauaucguggcgaagacggauguugguauggaauggaaauaagaccacuuaaagaaaaggaggaaaaccugguaaauagcuuaguaaccgcgggacacgggcagauugauaacuuuucauuaggaauauuaggaauggcuuuguuuuuagaagagauguugagaacccgcguaggaacaaagcaugcaauacuguugguagcauugucauucgucacuuuaauaacagggaauaugucauuucgugacuuaggucgagugaugguuauggucggcgcaacuaugaccgacgauauaggaauggggguaacauaucuagcauuguuagcagcuuucaaaguccgcccaacuuuugcagcaggauuacuacuacgaaaacuaaccucaaaagaauuaaugauggccacuaucggaauagcgcuacugucccaaagcacucuccccgaaacuauauuggaguugaccgaugcccuagccuuaggaaugauggcauuaaaaauuguaagaaauauggaaaaauaccaacucgcaguuacaauaauggcgauaaguugcguaccuaaugcagucauuuuacaaaaugccuggaaaguuaguugcacgauucuugcagccguaagcguuucgccguuguuacugaccagcucgcaacagaaagcugacuggauuccgcuggcgcucacuauaaaaggcuuaaaucccacagcuauauuuuugaccacguuaucgcguacgagcaagaaaagaaguuggccccuuaacgaagcaauaauggcuguuggaaugguaucgauccuagcuucaucacuacucaaaaaugauauuccgaugacagguccccuaguggcuggaggacuacucacuguguguuauguucuaacgggucggagugcugaccuugagcucgaaagggcugcagacguaaaaugggaagaccaagccgaaaucaguggcuccuccccaauacuuagcauaacuauaagugaagacggcucgaugucaauuaagaaugaggaagaagaacaaacccuaacaauucucauaagaacgggguuauuaguuauaucaggaguuuuccccgugucaauaccaauaacggcugcagcaugguaccugugggagguuaagaaacagagggccgggguucuaugggauguaccuaguccaccuccuguaggcaaggcagaacuugaggauggggcguacagaauuaaacaaagagguauucuaggauauagucagaucggagccggaguauacaaagaagggacauuccacacaauguggcauguuacaagaggugcuguccuuaugcaucgugguaaacggaucgaaccgucaugggcugaugucaagaaagaccuaauuucguauggaggggguuggaagcuagaaggagaauggaaggagggggaagagguacaaguguuagcauuggaaccagggaaaaacccaagagcuguacaaacaaagccaggcauauuuaaaacgaauacagggaccauuggggcugucagcuuagauuuuagccccggcacaagugguuccccaauaguagauagaaaaggaaagguaguaggcuuguacggaaacgguguuguaacacguagcggagccuaugugagugccauagcccaaacugagaaaaguauagaagauaacccugaaauagaagaugauauauucagaaagaaaagauuaacaauaauggaucuccaucccggggcugguaaaacgaaaagauaucugccagcaauaguaagggaggcaauaaaacggggcuugcgaacgcuuauacuugcccccacaagggucguugcugcugaaauggaagaagccuuacgaggacuaccuauacgauaucagacgccagcgauuagagcagaacacacggguagggagauuguagacuugaugugccaugccacuuucaccaugagacugcugucaccgguaagaguacccaacuauaaccuaauaauaauggaugaagcacauuucaccgacccugcaucaauugcagcccgcggguauauuucaacacgcguugaaaugggagaagcugcuggcauuuuuaugacugcuacaccaccugguuccagagauccauuuccgcagucgaaugcaccgauuauggaugaagaacgagaaauaccugaaagaagcuggaacucuggccaugaguggguaacagacuuuaaagggaaaacaguaugguucgucccuucaauuaaagccggaaaugauauagcagcuugccugaggaaaaauggaaagaaaguaauucaacuuucaagaaaaacauuugauagcgaauauguaaaaacacgggcaaaugauugggacuuuguugugacuacugacauuagcgaaaugggagcuaacuuuaaagcagagagagugaucgauccaagacgguguaugaaaccaguaauacuuacugauggagaagaacggguaauuuuagcuggaccuaugccaguaacgcauaguuccgcugcacaacgccgugguagaauagguagaaaucccaaaaaugaaaaugaucaauacauauacaugggggaaccacuugaaaacgaugaagauugugcacauuggaaagaggccaaaaugcuccuagauaauauaaauacccccgaagggauaauaccuagcauguuugaaccagaaagggaaaaaguggaugcuauugauggagaauacagauuaaggggcgaagcccgaaagaccuuuguagaucucaugcggagaggcgaucugccuguaugguuagcuuauaaaguagcagccgaaggcauaaacuaugccgacaggaaaugguguuuugauggaaucaaaaauaaccaaauauuagaagagaauguggaaguugaaauauggacuaaggaaggugaaaggaagaaauuaaaaccacgcuggcuugaugcucggauauauagugauccacuggcccugaaggaauuuaaagaauuugcagccggaagaaaaagccuaacccuaaacuuaaucacggaaaugggacgucuuccaacauuuaugacgcaaaaggccagaaaugcguuggauaacuuagcuguacuucacacagcggaggugggcggcagggccuacacccacgccuuaagugaauuaccugaaacguuagagacacuuuuguuauugaccuuacuugcaacaguuacgggugguauauuuuuguucuuaaugagugguaaagguauaggaaagaugacacucgguauguguuguauaaucacggcuagcauacuauuaugguaugcucaaauucaaccacauuggaucgcagccucaauaauacuugaguucuuuuuaauugucuuacuaauuccggagccugagaaacagagaacgccacaggacaaucagcucaccuacguggucauugcaauauugacggucguagcugcuacgauggccaacgaaaugggcuuuuuggagaaaacgaagaaagaucuaggcuuuggaucaauaacaacacaagaaucagaaucuaacauacuagacauugaucuaagaccagcaagugccuggaccuuauaugccguugcaacuaccuucguaacacccaugcuuagacauucuauagaaaacucaaguguuaacguuucacucacugcaaucgcaaaucaagcgacagucuuaaugggacuugggaagggguggccacuuucgaaaauggauauaggagugccgcuacuggcuauaggauguuacucgcagguuaauccgauaacucuuaccgcggcacuucuauuauuaguugcacauuaugcgauuauagguccaggccuucaggcuaaggcaaccagagaggcccaaaagagagcagcugcugguaucaugaaaaacccgaccguagacggaauaacuguuauagauuuagaaccaauacccuacgauccaaaauuugaaaagcaauugggacagguaaugcuucugauacuaugcguuacgcagguauuaaugaugagaacuacgugggcauuaugugaagcucugacuuuagcaacugguccaaucaguacacuaugggaggggaauccuggacguuuuuggaacaccacaauagcaguuaguauggcaaauauuuuuaggggcucuuaucucgcgggugcuggacuacuauuuaguaucaugaaaaauacuacuaacacccggcgugggaccggaaauguuggagaaacucuuggagaaaaauggaagucucgacuaaaugcuuuagggaaaucugaauuucagauauacaagaaaagcgguauucaagaaguagaccggacacucgcaaaagagggaauuaagagaggcgaaacugaucaucacgcaguaaguagagguuccgcgaaauuaaggugguuuguagagcgcaauaugguuacuccggaagguaagguaguggaccucgguuguggacguggaggaugguccuacuauugcggggguuuaaagaacguccgagaagucaaaggcuugacaaaaggagggccuggccaugaagaacccaucccuaugucuacauacggauggaacuugguccgccugcaaaguggaguugauguauucuucacuccacccgagaaaugcgauacccuccuaugcgauauaggagaaucaucaccgaaucccacuaucgaagcaggacgaacguuaagaguacuaaaucuaguagaaaauugguuaaacaacaauacucaguuuugcaucaagguccuaaaccccuacaugcccaguguaauugagaagauggaaacauugcaacgcaaauacggaggagcacucguuagaaauccuuuaucgcgaaauucaacucaugagauguauuggguguccaaugcuacugguaauaucgugaguucaguuaacaugauauccagaauguuaauuaauagguucaccaugaagcacaaaaaggccacuuacgaaccagacguugacuugggaucuggaacacgaaauauaggaauagaaagugaaauaccaaaccuagacauuauagggaaacggauagagaaaauuaagcaagaacaugagacuucuuggcacuaugaccaagaucacccuuauaaaacuugggccuaucacggaucguaugagaccaagcaaacugguucugcgagcaguauggucaacggaguuguaagacuucuuacgaagccuugggacguagucccaauggugacucaaauggcaaugacagacacaacgccauuuggacaacaaagaguuuuuaaagaaaaaguggacacacguacacaggaaccaaaggaaggcaccaagaaacuaaugaaaauaacagcagaaugguuguggaaagaauuagguaaagagaaaacuccgcgaauguguaccagggaagaauuuacuaggaaaguuagaucaaacgcugcauuaggggcaaucuuuacugaugagaauaaauggaaaucagccagggaagcaguagaggauggaagauuuugggaacuugucgauagagaaaggaauuuacacuuagaaggaaaaugugaaacaugcguguauaacaugaugggcaaaagagaaaagaaacuaggagaauuuggaaaagccaaaggaucgagagcgaucugguacauguggcugggggcaagguuucuugaauuugaagcacuaggcuuucucaaugaagaccauugguuuagucgaggaaauucacuauccggaguagaaggugaaggauuacauaggcuagguuauauucuucgagaagugggcaagaaagaaggaggggcaauguacgcagacgacacugccgggugggacacaaggauaacuuuagaagaccugaagaacgaagagaugguuaccaaucauaugaagggagaacacaagaaacuugccgaagcaauauuuaaauuaacuuaccaaaacaaagucguucgaguacaaaggccuaccccgagggggacuguuauggauauaauaucgaggaaagaucaaagggguaguggacaaguagggacauauggccucaacacuuucacuaauauggaagcgcaacugauaaggcaaauggagggagaagggauauuuaagaguauucaacaccuaacugcuacagaagagaucgccguacaaaacugguuagcucgaguagggagagaaagauuaucacgaauggcuauuaguggggacgauuguguaguaaaaccaauagaugaccgcuuugcauccgcacuuacggccuuaaaugacaugggaaaaguaagaaaggauauacaacaaugggagccuucgagaggauggaacgacuggacccagguuccauucugcucucaccauuuucacgaauugguaaugaaagacgggagggucuuagucguacccuguagaaaucaagaugaacuaauagggcgagcaaggauaucucagggagcaggauggucucuaaaagaaacggcguguuuagguaaaaguuaugcccaaauguggacacuaauguacuuucaucggagagaucuucgacuagcagcaaacgcuauuuguagcgcuguuccgagucauugggucccaacuucacgaaccacauggucaauacaugccaagcaugaauggaugacuacagaagacauguuagcaguauggaaccgaguguggauucaagagaauccguggauggaagauaagacgccgguugaaagcugggaagaaguuccauauuuaggaaaacgagaagaucaguggugugggucacuaaucggucuuacaucucgugcuacuugggccaaaaacauacaaacagccauuaaucaaguacgaaguuuaaucggaaaugaggguuauacagacuauaugcccucgaugaaaagauuuagacgagaagaagaggaagcaggcguguuaugguag

SEQ ID NO: 22327 - RNA, 9876 nt, Artificial Sequence
  derived and/or modified CDS sequence (opt6) from DENV-2__JF730044__SS-prME
acagcuggagugauuauaauguugauuccaacugcuauggcguuccauuuaacuaccaggaauggggaaccacacaugauuguaggucggcaagaaaaaggaaaaucuuuacuauucaaaaccgaagauggaguuaauaugugcacuuuaauggcgauagaucuuggugaauuaugcgaagauacuaucacauacaaauguccacuccuacgacaaaaugaaccggaggacauagauuguuggugcaacagcacauccacuugggugacauacgguacuuguacaacuacaggggaacauaggcgagagaaaaggaguguggcucucgucccucacguugggaugggacuugaaacacgaacagaaacuuggaugucgucagaaggagcauggaaacauguacaaaggauagaaacauggauuuuaaggcauccuggguucacuauaauggcagcuauacuggcauacaccauaggaacgacacacuuccaacgggcuuuaauuuuuauacuucuaacugcugucgcuccaaguaugacaaugcgauguauagguauaaguaaucgcgauuucguagaagguguuucuggcggauccuggguagacaucguacuagagcauggguccugugucacaacuauggccaaaaauaaaccuacauuagacuuugaauuaauuaaaacggaagcuaaagaaccagcaacauuacggaaauauuguauagaagcuaaacuaacaaacacaacaacugagucacgaugucccacucaaggagaaccuagcuuaaacgaggaacaagauaaaagguucguuuguaaacacaguaugguugaccgaggauggggcaacggauguggacuauucggcaaaggaggaauagucacgugugcuauguuuacaugcaagaaaaauauggaaggaaaaauaguacagccagaaaaccuugaguauaccaucgucauuacaccucauucgggcgaagaacaugcuguggggaaugauacgggaaaacauggcaaagaaauaaagauaacaccucagucuucgucgacagaagcggaguugaccgguuaugguacaguaaccauggaaugcucacccaggacgggacucgacuuuaacgaaaugguacuguugcaaauggaagauaaagcaugguuaguacaucgucaaugguuuuuggauuuaccucucccaugguuaccuggggcggacacacagggaucaaauuggauacaaaaagaaaccuuagucacuuuuaaaaauccacaugcaaagaaacaggaugugguuguacuuggcucacaggagggugcaaugcauaccgcccuaaccggcgcaacagagauacaaaugucuucggguaauuuacuauuuacuggacaucugaaaugucgguuacgaauggacaagcugcaauuaaagggaaugucauauucaaugugcacaggaaaguuuaagauuguuaaagaaauagcugaaacucagcacgguacuauuguaauucgcguacaguaugagggagacgggagcccuugcaaaauacccuucgagauaauggacuuagagaaaaggcauguuuuagggcgccuuauaacaguaaacccaauagucaccgagaaagacagucccguaaauauugaagcagaaccaccauucggggacaguuauauuauaauuggagucgagccuggucaguuaaagcuaaacugguuuaagaaagguucaagcauuggacaaauguucgaaacuacaaugcguggagcgaaaagaauggcaauuuuaggugauacagccugggauuuuggaagccucggaggagucuucacuucuaugggaaaagcacuucaucaagucuuuggggcgauauauggcgcugcauuuucaggcguuagcuggacaaugaaaauucuaauagguguaauaauaacguggauaggcaugaauagucgaaguacaaguuugagcguuaguuugguccuagucggaguaauaacucuauaccuaggagccaugguacaagcagauucaggauguguagucucauggaaaaauaaagaacugaaauguggcucaggaauauuuauaacugauaacguucacacguggaccgagcaauacaaauuucagccagagucaccaucaaagcuagccucggccauucaaaaggcucacgaagaagguauuugugguauuaggucuguuacacggcuggaaaauuugauguggaaacagauuacgccugaacucaaucacauuuuaucagaaaaugaagucaaacucacgauuaugacaggagacauaaaagguauaaugcaggcugggaaacguagccuucgaccgcaaccaacagaauugaaauacucguggaaaaccuggggcaaagcuaaaaugcuaagcaccgagagccauaaucagacguuuuuaauagacggaccagagaccgccgaauguccuaauacuaacagggcuuggaacucucuugaaguugaagacuauggauucggaguuuuuaccacaaauaucuggcucaaacuaagagaaaagcaagacgucuuuugugauucgaaacuaaugucugcugcuaucaaagacaaucgcgcgguccacgccgacaugggguauuggauagaaucagcacuuaaugacacguggaaaauggaaaaggcuucuuuuauagaaguaaaaaguugccauuggccaaaaucgcauacauuauggagcaauggaguuuuagaaagcgaaaugauuauaccuaaaaguuuugcaggucccguaucccagcacaacuauagaccaggauacuacacacagacugcagguccguggcauuuaggaaaacucgaaauggacuuugauuucugugaggggaccacaguuguagucaccgaagacuguggaaauaggggaccuucgcuaaggacaacuacagcgagcgguaagcuaauaaccgaaugguguugcagaaguuguacacuaccaccacuacguuauaggggagaagacgguugcugguacggcauggaaauaagaccacugaaagaaaaagaagaaaauuuggucaacucucuaguaacugcaggacauggucagauagacaacuuuagucuaggaguuuuaggaauggcucuauuucuugaagaaaugcuaaggacucgagugggaacuaaacacgcuauacuacuuguagccgucuccuuugucacguugauaaccggaaacaugucuuuuagagaucuagguaggguuaugguaaugguaggagcaacuaugaccgaugacauaggcauggguguaacguaccuagcacugcuagccgcuuucaaagugagaccaacuuucgcagccggccuuuuacuaagaaaguugaccagcaaagaauuaaugauggcaacaauuggcauagcacuacuaagucaaaguacuauucccgagacgauucuugaacuaacggacgcgcucgcuuuagguaugaugguacuuaaaaucguaaggaacauggagaaauaucaacucgcaguaaccauaauggcuauaaguugcguuccaaacgcaguaauacuacaaaacgccuggaaaguaaguugcacaauauuagcagccgucagcguauccccacugcuacuaaccaguagucaacaaaaagcagacuggauuccauuagccuuaacaauuaaagguuugaauccuacggcgauuuucuuaacuacauuaucuagaaccucaaagaaaagaucauggccacuaaacgaagcaaucauggcuguuggcauggugucaauacucgcauccucuuuacuuaaaaacgauauacccaugacagggccuuuaguagcgggugggcuacuaacaguuuguuauguucugacuggucguagugcagaucuugaauuggaaagggcaacagauguaaagugggaggaucaggcagaaauuucagguagcuccccaauauuaucuauaacaauaucagaagacgguucuaugaguauuaagaacgaggaggaagaacaaaccuugacuauucugaucagaacuggacugcuugucaucaguggauuguuuccagucucgauaccaauuacugcagccgccugguaucuaugggaaguuaagaaacaaagggcuggaguacuaugggaugucccaucgccaccaccagugggcaaagcugaacuugaagauggugcauauagaauaaagcaaaaaggcauuuugggcuacucacaaauuggugccggaguauauaaagaagguacuuuucauacuauguggcacgucacucgaggagcaguauuaaugcaucggggcaagcgaaucgaaccuuccugggcagauguuaagaaagauuuaaucaguuacgggggaggauggaaacucgaaggagaauggaaagaaggugaagaaguacaagugcucgcucucgaacccggcaaaaauccgagagcaguucagacuaaacccggauuauucaaaaccaauacagggacuauaggagcaguaucccucgauuuuagcccagguaccaguggaaguccaaucgucgaucguaaaggcaaggucguaggcuuauacggaaacgguguaguuacccgaucaggggcauauguaucggcaauugcccagacggaaaagagcauagaagauaauccugaaauugaagacgauaucuuuagaaagaaacgacuuacgauaauggauuuacauccuggagcaggcaaaacaaaaagguaucucccugccaucguccgagaagccauuaaacgcggacuucgcacacuuauacuugccccaacacgaguaguugccgccgaaauggaagaagcucuccgcgguuugccuauacgauaccagacccccgcaauccgugcagaacacacaggaagagaaaucguagaucuaaugugucaugcaacauucacaaugagguugcuaucaccaguuagaguaccuaacuauaauuugaucaucauggaugaagcccauuuuaccgauccugcaaguauagcagcucgaggguauaucucaacaagggucgaaaugggcgaggcugccggaauuuucaugacagcaacacccccaggaucgagagacccauucccccaaucuaaugcuccuauuauggacgaagaaagagaaauucccgaacguuccuggaauagcggucaugagugggugacggacuucaaaggcaaaacaguaugguucgugccgagcauuaaagcugguaacgauauagccgcaugccucaggaaaaacgguaaaaagguaauucaguugucaagaaaaacguucgauucagaguacguuaagacaagaacaaacgauugggauuucguagucacaacggacauaucugagaugggagcaaacuucaaagccgaacgagucauagauccgagaagauguaugaagccgguaauccuaaccgacggagaagaacgaguaauuuuagcuggcccgaugcccgugacacauucuucagcagcacaacggcgcggucggauaggacguaaucccaaaaacgaaaaugaucaauacauauauaugggagaaccucuugagaacgaugaggacugcgcacauuggaaagaagcuaaaaugcuauuggauaauauuaauacacccgaaggcauaauuccaucaauguuugaaccggaaagggaaaaagucgaugccauagauggugaauaucgucugcguggcgaggcuagaaagacauuuguugaccuaaugaggagaggggacuuaccuguaugguuagccuaucgcguggcggcagaaggaauaaauuaugcagaccgaagaugguguuuugacggagucaaaaauaaucaaaucuuggaagagaacguugaaguagaaauauggacaaaagaaggugaacguaagaaacuaaaaccaagaugguuggaugcacggauauauucugauccccuggcacucaaagaauuuaaagaauuugcugcagguaggaaauccuuaacccuaaaccucauaacugaaauggguagacuuccaacuuuuaugacgcagaaagcccgugacgcuuuagauaaccuagcuguauuacauacagcugaagcuggugguagagccuauaaccaugcguuaucugagcuaccagaaacauuagaaacucucuugcuguuaacauuacuugccacugugacuggugguauauuucucuucuugauguccggcaaagggguaggaaaaaugacacuaggaauguguugcauuauaacugccucuauacugcucugguaugcacaaauucaaccgcacuggaucgcugcuucaauaauccuugaauuuuucuuaaucguuuuacuaauccccgaaccagaaaaacaacgcacuccucaggacaaccaauuaacuuauguaguuaucgcaaucuuaaccguagucgcugcgacaauggcgaaugaaauggguuuucuagagaaaaccaagaaagaucuaggucuaggaaguaucgcgacccaagagccugaaucaaauauucuggacaucgauuuaagaccagcaagugcuuggacacuuuaugcuguggcgacaacauucguuacacccaugcuaagacauucaauagagaacucaagcgugaacguuucauuaacagcgauugccaaucaggcuaccguacuuauggggcucgguaagggcuggccauuaucuaaaauggauaucggcguaccauuacuugcuauagguuguuauagucaaguaaacccgguuacauuaaccgcagcgcuuuuauuacugguagcgcacuaugccauaaucggaccuggacuacaagcgaaagccacacgggaagcucagaagagagcagcugcuggaauaaugaaaaaccccacgguagaugggauuaccguaauugaccuggauccaaucccauacgauccaaaauucgaaaaacaacugggccaagugaugcuccuaauacuuugcguaacucaaguguugaugaugaggaccacuugggcauuaugugaagcacuaacuuuagcgacaggaccaauaucuacauuaugggagggaaacccgggacgauucuggaauacgacaauagcugugucaauggcgaauauuuuccguggaaguuacuuagcgggagccggguuauuguuuuccaucaugaaaaauaccacaaauacaagaagaggaacuggaaacauaggagagacccuaggcgaaaaauggaaaaguagacuuaaugccuuaggaaaaagugaguuccagauauauaaaaagucaggaauccaagaaguggaccggacauuggccaaagaagguauuaaacgaggggaaacggaucaccacgcugucucaagagguucagcaaaacuaagaugguuuguugaacgcaacaugguaacaccagaaggcaaaguaguugaucuuggcuguggacgaggugggugguccuacuacugcggcgggcuuaaaaaugucaaagaaguaaagggucuuacuaaagguggcccaggucacgaggaaccaauaccaaugucuacuuacggcuggaaucuaguacgccuacaaucuggugucgacguauucuuuacuccuccagaaaaaugcgacacauuacugugcgauaucggugaaagcuccccaaauccgacgaucgaagccgggaggacacuacguguauugaguuuaguugaaaauuggcuaaauaaugauacccaauuuugcauaaaaguacuaaacccuuauaugcccucuguaaucgagaaaauggaaaccuuacagaggaaguaugggggagcguuaguucgaaaucccuuaucgcgaaacucaacacaugagauguauuggguaaguaacgcaaccggcaauauagucucuucgguaaauaugauaucaaggaugcucauaaacagguucacaaugaaacauaagaaagccacauacgaaccugaugucgauuugggcucggguacgcgaaauauaggaauagaaucagaaauuccuaauuuggacaucaucggcaaacgaauugaaaagauaaaacaagagcaugaaacaagcuggcauuaugaccaagaucacccauauaaaacaugggccuaucaugguaguuacgaaacaaaacaaacgggauccgcauccuccauggucaacggaguggucagauuauuaacaaaaccaugggacgucguaccgaugguaacacagauggcgaugaccgacacuacaccuuucggacaacaacgugucuuuaaagaaaaaguggauacacguacacaggagccuaaagaaggcacaaagaaacucaugaagauuacagccgaauggcucuggaaagaacuagguaagaagaaaaccccgagaauguguacacgcgaggaauuuacaaggaaaguucgaucaaaugcagcccuuggagcgaucuucacagacgaaaacaaauggaagucagcacgggaagcaguagaagauagcagauuuugggaacuuguggauaaagaacguaauuugcacuuagaagguaaaugcgagacaugcguauacaacaugauggggaaacgagagaaaaagcugggggaauuugggaaagcuaaaggaaguagagcaaucugguacauguggcugggcgccagauuuuuagaauuugaggcucuaggauuucuuaaugaagaucacugguuuucgagagaaaauucguuaaguggaguagaaggugaggguuuacauaaacuaggguauauacugagagaugucggcaagaaagaggguggcgcaauguacgccgaugauacagcugguugggacacuagaauaacacuggaagauuugaaaaacgaagaaaugguuacaaaccauauggagggcgaacacaagaaacuagccgaagcuauauucaaacuaacuuaucaaaauaagguaguccguguacaaagaccaacaccccguggaaccguaauggacauaauaucucgacgagaucaaagaggaucgggacaggucggcacauacgggcugaacacauuuacgaauauggaggcacaacuaauccgacagauggaaggugaagguauauuuaaaagcauccagcaucuaacagccacugaggaaauagccguucaaaacuggcuagcacggguuggaagagaacguuuaucaaggauggcgauuaguggagacgauugcgugguaaaaccuuuagaugauagguucgcaagcgcucuaacugccuuaaaugauaugggcaaaguacgcaaggacauccaacaaugggaaccgucuagaggguggaaugacuggacacaaguuccuuuuugcagccaccauuuccaugaauuaauaaugaaagauggaaggguauuaguaguaccuugcaggaaucaggacgaauuaauagggagagcgagaauaucucaaggcgcaggcuggucauugaaagaaacggcaugccucgguaaaagcuacgcacaaauguggucacuuauguacuuccauagaagagacuuacgacuugcagcgaaugcuauauguagcgccguaccuucacacuggguaccuacaagucgaacaacauggucuauccaugccaaacaugaauggaugacaacugaagauaugcuaacugucuggaauagggucuggauacaggaaaauccguggauggaagacaaaaccccaguggaaagcugggaggaaguucccuacuugggaaagcgagaagaucaaugguguggaucacuaaucggacucacuagccgugcuacgugggcaaagaauauacaaacggcaaucaaucaaguacggucauuaaucgguaaugaagaauacacugauuauaugccaucaaugaaacgauuucgaagagaagaggaagaagcgggcguacucugguaa

SEQ ID NO: 22328 - RNA, 9876 nt, Artificial Sequence
  derived and/or modified CDS sequence (opt6) from DENV-2__FJ639697__SS-prME
acagcaggaguaauaauaauguuaauucccacagcuauggcauuucaucugaccacacgcaauggagaaccucauaugauaguaggucgacaagaaaaaggaaaaagccuauuauucaaaacugaagauggaguuaauauguguacuuugauggcaauagaccugggagaacucugugaagauacaauaacauacaaauguccgcuuuuaagacaaaacgaaccagaagauaucgauuguugguguaauucuacuucaacgugggugacauacgggacuugcacuacaacuggugaacaucgaagagagaaaagaagcguagcuuuagugccccacguggguaugggacuagaaacacgaacugaaacauggauguccucagaaggagcuuggaaacaugugcaacguaucgaaacauggauacuacgucauccgggguucacgauaauggcagcgauucuggcuuauacgauagguaccacacauuuucaaagagcauuaauauucauauuauuaaccgcuguagcacccaguaugacuaugagauguaucggaaucaguaaucgagacuucguagaaggugucaguggugguucauggguagauauaguucuagaacacgguaguugcguaacaacgauggcuaaaaauaaaccaacgcucgauuuugaauuaauuaaaacagaagcaaaagaaccagcaacucuaaggaaauauuguauagaagcaaaacuaaccaauacgaccacagaaucaagaugcccaacacaaggagaaccgucauuaaaugaagaacaagauaaacgauuuguauguaaacauucaaugguagacagaggauggggaaacgguuguggucuguucggaaaaggaggaauaguaacgugcgcuauguuuacuugcaagaaaaacauggaagguaagauagugcaaccagaaaaucuagaauauacaaucguaauuacaccacauaguggggaagaacaugcgguaggaaacgauacagguaaacacggcaaagaaauaaaaauuacaccgcaaagcaguucaaccgaagcagaauuaacaggauacggaacaguuacuauggaaugcuccccuaggacaggauuagauuucaaugaaaugguucuacuccaaauggaagauaaagccugguugguacaccgucagugguuuuuagauuuaccauuacccugguuaccuggagcagauacccaaggaagcaauuggauacagaaagaaaccuuaguaacuuucaagaauccacaugccaagaaacaggauguaguaguuuuaggaagucaggaaggagcaaugcacacggcucugacgggagcaacagaaauacaaaugucgagcggaaaucuguuguucacaggucaucuaaaaugccgucuccgaauggauaaauuacaauuaaaaggcaugagcuacaguaugugcacagguaaguuuaaaauugucaaggaaauagcagaaacucaacaugguacgauugucauuaggguucaauacgaaggagacggcaguccgugcaaaaucccuuuugaaauaauggaccuggagaaaagacacguccuuggaagguugaucacuguaaauccuauagugacugaaaaagacucuccggugaauauagaggcagaacccccuuuuggggauucuuacauuauaauaggagucgaaccaggucaauugaaguuaaauugguucaagaaaggauccagcauaggccaaauguucgagacuacaaugagaggugcaaaacguauggcaauacuaggggacacagcuugggauuucgggucucugggcgggguuuuuacaucuaugggaaaggcccuacaucaaguauuuggugcaauauauggggcggcauuuagcggaguuucauggacaaugaaaauucucauaggggugaucaucacauggaucggaaugaacucuagaaguacuucccucaguguuagcuuggucuuagucgguguaauaacacuauauuuaggagcaaugguacaagcugauucuggguguguaguaucguggaaaaauaaggaguuaaagugugguucuggaauuuucauaaccgacaauguacacacauggacggaacaauacaaauuucaaccagagagcccgaguaaacuugccagcgcaauucaaaaggcgcaugaggaagguaucuguggaauacggagugugacgaggcuugaaaauuugauguggaaacaaauuacaccggaguuaaaucauauauuaucagaaaaugagguaaaacucacaauuaugacuggagacauaaaaggaauuaugcaagccggaaaaagaucacugagaccccaacccacugaauuaaaauauuccuggaaaacauggggaaaagcaaagaugcucaguacagaaucccauaaccagaccuuccugauugacggaccagaaaccgcggaaugcccgaauaccaaccgagcguggaacucccuagaaguugaagacuacggguuuggaguguuuacaacaaacauauggcucaaguugagggaaaagcaggauguauuuugcgauucuaaacucaugucggccgcaaucaaggauaaccgagccguccaugcagauaugggguauuggauagaguccgcauuaaaugacacguggaagauggaaaaagcuaguuucaucgagguaaaaaguugucauuggccaaaaucacauacucuaugguccaauggcgugcucgaaagcgaaaugaucauaccuaaaucauucgcagggccuguaucgcaacauaauuacagacccgguuacuacacacagacggcaggcccauggcaucuaggaaaguuggagauggauuuugauuucugugagggcaccacagugguaguuacugaagauugcggcaacagggguccaucccuucgaacaacaacugcaucaggaaaauugauaacagaauggugcuguagaagcugcacgcuuccgccacugagauacagaggagaagauggaugcugguauggcauggaaauaaggccauuaaaggaaaaagaggaaaauuuggugaacagccuaguuaccgccggacacggacagauagacaauuuuucucuuggaguccuaggaauggcccuauuuuuagaagaaaugcuaaggacuagagugggaacuaaacaugcuauauugcuagucgcuguuagcuuuguaacacucauaaccgguaauaugagcuuucgugacuuaggacgcguaaugguaaugguaggagcuacaaugacggaugacauugggaugggggucacuuacuuggcguuauuggccgcuuuuaaggugagacccacauuugcagcugguuuacugcuaagaaaauuaacuagcaaagagcucaugauggcuacaaucggaauagcguugcuaucgcaaaguaccauaccagaaacaauuuuagaguuaaccgacgcauuagcccuaggaaugauggugcugaaaauaguacggaacauggagaaguaccaauuggcaguaacgauaauggccaucaguuguguuccaaacgcaguaauacuacaaaaugcuuggaaaguaaguuguacuauacuggcggcaguaagugucucaccucuucuuuuaacaucgucgcaacagaaagcggacuggauuccacuagcauuaacuauaaaaggguuaaauccuacugcaaucuuccugacaacacucucgagaacuagcaaaaagagaucauggccgcucaaugaagccauaauggcuguuggaaugguaucaauauuggcgaguagccuccuaaagaacgauaucccuaugacaggcccacuuguugccggagggcuucucacaguguguuauguuuugacugggcguucagcagaucucgaacuagaacgagcaacggauguaaaaugggaagaucaagcggaaauuaguggaagcaguccuaucuuaaguauuacgauauccgaagauggguccaugucaaucaaaaaugaagaagaagaacaaacacugacaauauugauacguaccggucuauuaguuauuucgggucucuuuccgguuucgauuccgauaacggcugcugcgugguaccuaugggaagucaagaaacagcgagccggaguucuuugggaugucccgucaccgccuccggucggaaaagcugaguuagaggauggcgccuaucggauuaaacaaaaagguauuuuggguuauucacaaauuggagcggguguauauaaagaggguacuuuucacaccauguggcaugugacccguggggcgguauugaugcauagggggaaacguauagaaccuucgugggccgaugucaagaaagaccuuauuucuuauggagggggauggaaguuggaaggggaauggaaggagggagaggaagugcaaguucuagcucucgaaccugggaaaaauccacgcgcaguucaaaccaaaccgggacuuuucaaaacaaauacaggaacaaucggcgccguuagccuagauuuuucaccuggaaccucaggaucaccaauuguagaucgaaaaggaaaagucguaggucuauauggaaacggugucgucaccaggucaggagcauauguaucugcaaucgcgcaaacagagaaguccauagaagacaacccagaaauugaggaugauauuuuucgcaagaaaaggcuaacaauuauggaucugcaccccggggcagguaaaacgaaaagauauuuacccgcgauaguuagggaagccauuaagcggggacuacgaacacucauucuagcuccaacaagaguuguugcagcagaaauggaagaggccuugcgaggguuaccaauacgauaucagacuccagcaaucagagcagagcacacggggcgagaaaucgucgaccugaugugucacgcgacauuuacuaugcgauuauugucuccugucagagugccgaacuauaaccuaauaauaauggacgaggcacauuuuacggaccccgccagcauagcagcucgaggguacauaucaaccagaguagaaaugggcgaagccgcgggcaucuucaugaccgcuacaccaccaggcuccagggaucccuucccgcagucuaaugcaccaauaauggaugaagaaagagaaauaccggagcgaucauggaacaguggucacgaauggguaacugauuuuaaggguaaaacuguaugguucguaccaucaaucaaagcagggaacgacauugcugcauguuugcgcaaaaauggcaagaaaguuauacaguuaagccguaaaaccuucgacucagaauauguaaaaacacguacuaaugauugggauuuuguagugacgacugauaucagugagaugggagcaaacuuuaaagcagagagggucauagauccucgucgcugcaugaagccagucauucugacagacggagaagaacgugucauacuagcaggccccaugccaguaacucauaguucagcagcacagcguagagggcgaauugguaggaaccccaagaaugaaaaugaucaguauaucuauaugggagaaccguuggaaaaugaugaagacugcgcucacuggaaggaggcaaaaaugcuacucgacaauauaaacacacccgaaggaauaauuccauccauguuugaaccggaacgugaaaaaguugaugcuaucgacggcgaguauagacuuaggggugaagcacgaaaaacuuucguugaccuaaugaggaggggcgauuugccuguaugguuagccuaccgugucgcggcagaaggaauaaauuacgcggaccgacguuggugcuuugauggggucaaaaacaaucaaauuuuagaggagaacguggagguggaaauauggacuaaagaaggggagagaaagaaauuaaaaccacgaugguuagaugcuagaaucuacagcgacccauuagcuuuaaaagaauuuaaggaauuugcugcuggccguaaauccuuaacccuaaaucugauaacggaaaugggaagacuacccacauucaugacacaaaaggcccgggacgcuuuagauaaucuagcuguauuacacacagcagaggcaggagggagggcguauaaccaugcauugucagagcuaccagaaacguuagaaacacuucuucuauuaacacuacucgccacugucacgggagggaucuuccuauuucucaugucuggaaaagguguagguaagaugacuuugggaaugugcuguauaaucacagcaucaauauuacucugguaugcucaaauacagccucauuggauagcagcuucuauaauacuagaguucuuucuuauaguacugcuaauaccagaaccggagaaacagaggacaccacaagauaaccagcugaccuauguugugauugcaauuuuaacgguuguagcugcuaccauggcuaaugaaaugggguuccuggagaaaaccaagaaagacuuaggauuggguagcaucgccacucaagaaccugaaagcaauauucuugacauagaucuacgaccagccucugcguggacacuauaugcuguagcaacaacuuucgugacaccuaugcucagacauucaauagaaaauucaucaguaaacgugucucucacagccauagccaaucaagccacaguauuaaugggacuugggaaaggauggcccuuaucaaaaauggacauuggggucccauugcuagccaucggaugcuacagucaaguuaauccaguuacccuaacagcugcucuccuacuauugguugcccauuacgccaucauagguccaggacuccaggcaaaggcgacgcgagaagcucaaaagagggcugcggcaggcauaaugaagaaccccacuguugaugggauuacaguaauugaucuagacccaauuccauacgacccaaaauucgaaaaacaauugggccaagucauguuacuuauccuaugugugacgcaggucuugaugaugaggacgacaugggcacuuugugaagcauugacauuagccaccggcccuauaaguacuuuaugggaaggaaauccaggacguuuuuggaauaccacaauagcaguaucaauggccaacaucuuucgaggaucguauuuggcgggagcaggauuauuguucucaauaaugaagaauacaacaaacacaagaagaggcacgggcaacaucggcgagacuuuaggugaaaaauggaaaaguagauugaaugccuuagggaagucggaauuucaaauauacaagaaaucaggcauacaagagguagacagaacguuagcuaaggaagggauuaaaagaggugagaccgaucaucacgcaguuucuagagguucagccaaauuaagaugguuugucgaaagaaauauggucaccccggagggaaaagugguugacuuaggaugcggaagaggagguuggucauauuauugugggggccugaaaaacguuaaggaagucaagggguugacgaagggcgggccaggacaugaggaaccaauuccuaugucaacguauggguggaacuuagugaggcuccaaagcggaguagauguauucuuuaccccgccagaaaaaugugacacacuccucugcgacauaggggaaucaucaccaaaccccaccauugaagcugggagaacauuacgugugcucagccuugucgagaacuggcuaaacaaugauacccaauucugcauaaaagugcuuaauccguauaugccuucagucauagagaaaauggaaacacugcaaagaaaauacggaggcgcucugguaaggaaucccuuauccagaaauaguacacaugaaauguauuggguauccaacgcaacgggaaauauaguaaguucaguuaacaugauuucuagaaugcugauuaauagguucacaaugaaacacaagaaagcaacguacgaacuagacguagauuuagggucaggaacaagaaacaucggcauagaaagugaaauuccaaaucuggauauaauagguaagcgaauugagaaaauaaaacaagaacaugagaccucauggcauuaugaucaggaucauccuuacaaaacuugggcauaccacgguagcuaugagacaaagcaaacuggaagugcuaguucgaugguaaacggggucguaagacugcucaccaagccuugggauguuguuccuaugguaacucagauggcaaugacugauacuaccccauuuggacagcaaaggguauuuaaagagaagguagacacacguacgcaagaaccaaaagaaggaacuaagaaacugaugaagauaacagcagagugguuauggaaagaguuagguaagaagaaaacccccagaauguguacaagggaagaauuuacaagaaaagugcgaagcaaugcugcacucggagcgauauuuacagaugagaauaaguggaagagugcucgcgaggccguugaagauucacgauucugggaauuaguugauaaagaaagaaauuuacacuuagaaggaaaaugugaaacaugcguuuauaacaugaugggcaagagagagaagaaacuuggagaauuuggaaaagcgaaaggaaguagagccauaugguauauguggcuuggcgcaagauuucuagaguucgaagcacuuggcuuucugaacgaagaucauugguucagccgugagaauagccuaucggguguagaaggugaaggauuacauaaacuuggauauauucuucgcgaugugggcaagaaagaagggggagcaauguacgccgacgacaccgcuggaugggacacacggauaacacuagaagaccucaaaaaugaggaaauggucacaaaccauauggaaggagagcauaaaaaguuagcggaagcuaucuuuaaguuaacuuaucaaaauaaagugguucguguucaaagaccaacuccuagagguacugugauggauauaauaaguagaagagaucaaagaggcucgggacaaguaggaacguacggauuaaacacuuuuacuaacauggaggcccaacuaauccgacaaauggaaggcgagggaauauuuaaaagcauccaacaccuaacugugacagaagaaauugccguacaaaacugguuagcuagaguaggacgagagagauuaaguagaauggcaauaagcggagacgauuguguagugaaaccccuggaugaucgguuugcgagugcacugacggcauuaaaugauaugggaaaggugcgaaaggauauucaacaaugggagcccagcagaggauggaaugauuggacacaaguuccuuuuuguagucaucauuuucaugagcuuauaaugaaagaugggcgcguccuaguaguuccgugccgaaaccaagaugaguuaauagggagagcuagaaucucacaaggugccggguggucccuuaaggagacggcuugccuaggaaaaucguaugcccaaauguggagucucauguacuuucaccgucgagaucuacgcuuggccgcaaacgcaauauguucugcagucccuucacacuggguaccgacaagucguacuacauggagcauacaugcaaaacaugaguggaugacaaccgaagauaugcuaacagucuggaaucgaguuuggauacaagaaaaucccuggauggaagauaaaacgccagucgaauccugggaggaagugccuuacuuaggaaaacgugaagaucaauggugugguaguuugauaggccuaaccucaagaacuaccugggccaaaaauauucagaccgcaauuaaucaagugcgcucauuaauaggaaacgaggaguacacugacuauaugccaucaaugaaaagauuucgccgcgaagaggaagaagccgguguuuuaugguaa

SEQ ID NO: 22329 - RNA, 9876 nt, Artificial Sequence
  derived and/or modified CDS sequence (opt6) from DENV-2__FJ639698__SS-prME
acagcagggguuauaaucaugcucauccccacggcuauggcguuccaucugacuacccgcaauggugaaccccacaugauuguaggacggcaagaaaaaggaaaaagucuccuauucaaaacugaagaugguguaaauaugugcacuuugauggcaauagacuuaggagaacuuugugaagacaccauaaccuauaaaugucccuuacuucgucagaacgaacccgaagacaucgauuguugguguaauucuacaaguacguggguuaccuauggaacaugcacuacaacuggagaacacagaagagaaaaacguuccguagcccuaguaccacauguugguaugggucuugaaacacgcacagaaacuuggaugucaucggaaggggcauggaaacacgcacaaagaauagaaacuuggauacugagacauccuggauucacaauuauggcagcaauacuugcuuacacaauuggaacuacgcauuuucaaagagcauugauauucauucugcucacagcaguagcaccaucaaugacaaugcgaugcauaggaauuuccaaccgagauuuuguagaaggcguuucaggaggcucuuggguggacauaguauuagaacauggcucuugcguaacgacuauggccaaaaauaaaccaacauuagacuuugaacucauaaaaacagaagcuaaagaaccggcaacucuacgaaaauacugcauagaagccaaacuaacgaauacuaccacugaaagcagaugcccuacucaaggcgaaccgucauuaaaugaagaacaggauaaaagguucguuuguaaacauucaaugguugaucgcggcuggggaaauggcugugguuuauuuggcaaaggaggcauuguaacgugcgcgauguucagcugcaagaaaaacauggaaggaaaaaucgugcagcccgagaaucucgaauauacaauaguuauaacaccgcauagcggugaagaacaugcaguugggaaugacacuggaaaacauggaaaagaaaucaagaucacaccgcagucaucuauaacagaagcagagcuaacaggcuacggaacuguaacaauggaauguucaccuaggacaggccuagauuuuaacgaaaugguauuacuccagauggaggauaaagcaugguuaguacauaggcagugguuccuggacuuaccacuuccauggcuaccaggugcugacacccaaggaaguaauuggauacaaaaagagacauuggucacguucaagaauccucaugccaagaagcaagauguuguaguuuuggguucacaagaaggagcaaugcacacugcacuuacgggggcgacagaaauacaaaugucuucgggaaacuugcuuuucacaggccaccugaaauguagacuacggauggauaaacugcaacuuaaaggaaugucauauucaaugugcacuggcaaauucaagauagugaaagaaaucgcagaaacucagcauggcacaauaguuaucagggugcaguaugaaggagacgggagccccugcaaaauaccguuugaaaucauggacuuggagaaacgucacguauuggguagguuaaucacaguuaaucccauuauaacagaaaaagacagucccguaaauauagaggcugagccucccuuuggugauucuuauauuaucauaggagucgaaccaggucaacuuaaacucaacugguuuaagaaaggaaguucuauuggacaaauguucgagacaacaaugcguggugcaaaaagaauggcaauacuuggugauacagcuugggauuuuggaucauugggaggaguguucaccaguauuggcaaggcgcuacaucaaguuuucggagcgauuuauggagcugccuucuccggaguuucuuggacaaugaaaauccugauuggaguaauaaucacauggauuggaaugaacucccggaguacaaguuuaucaguuaguuugguguuaguuggaguuauuacgcuauauuugggggcuaugguacaagcggauuccgguuguguagucagcuggaaaaauaaggaacuaaaaugcgguucugguauuuuuauaacggacaauguccauacuuggacugaacaguauaaguuucaaccugaauccccaucuaaauuagcgagcgcgauucagaaagcucacgaagaggguaucugugguauucggaguguaacacggcuagaaaaucuaauguggaaacaaauaaccccugagcuuaaucauauucuuagcgaaaaugaagucaaguuaacuauaaugacuggcgacauaaaaggaauaaugcaggcaggaaaacgcuccuuacgaccacaaccuacagaauuaaaauacucuuggaagacauggggcaaagcaaaaauguuaucaacugaaucacacaaucaaacauuuuuaaucgauggacccgaaaccgccgaguguccaaauacaaauagagcuuggaacucuuuagaaguagaagacuacggauuuggcguauuuacaacaaauauauggcugaaacuuaaagagaaacaagacguuuucugcgauccuaaguugaugagcgcagcuauaaaagauaaucgagcaguucacgcggauauggguuacuggauagagucugcccuaaaugauacauggaaaauggaaaaggcaucuuucauugaaguuaagagcugccauuggccgaaaagucauacauuauggaguaauggaguccuagaaucagaaaugauaauaccaaaggguuuugcggguccgguuagucaacauaacuaucgcccgggcuacuacacgcaaacagcagggccauggcauuugggaaaacuugagauggauuuugauuuuugugaaggcacuacgguuguugucacggaagauuguggaaacagaggaccuagucuuagaacaacgaccgcauccgguaaguuaauaacggaguggugcuguagaaguugcacucuaccaccgcuucgauaccgaggugaggauggauguugguaugguauggaaauaagaccccuaaaggaaaaagaagaaaaucucguaaauucucucguuaccgcaggccauggucaaauagacaauuucucacugggaguacuaggaauggccuuauuccuagaagaaauguuaagaacucgaguggggacaaagcacgcgauacuucuuguggcaguaaguuuuguaacuuuaauaaccgggaacaugagcuucagagauuuaggcagaguuaugguuauggucggagcuacgaugacggaugauaucggaaugggaguaacuuaucuugcacuuuuagccgcauucaaaguacgaccgacguucagugcaggacuacuucucaggaaguuaacaucaaaagaacuuaugauggcuacuauaggaaucgcucuauugucacaaaguacaaucccggagaccauauuagaacuaacagaugcacucgcacugggaaugauggucuuaaaaaucguaagaaacauggagaaauaucaacuagcaguuacuauaauggccauaagcugcguucccaacgcaguuauacuucagaacgcuuggaaagugaguugcacgaucuuagcagccgucuccguuucgccauuauuguuaacaagcucccagcaaaaggcagacuggauaccgcucgccuugacaauuaaaggcuuaaacccgacagccauauuuuuaacgacucuuuccagaaccucuaagaaaaggucauggccauugaaugaagcuauaauggcaguggggauggugucuauucuagcauccucuuuauugaagaaugacauaccaaugacgggucccuuggucgccggugggcucuuaacaguauguuauguacuaaccgggcgaucggcagauuuggaauuagaaagagcaacugacguaaaaugggaagaccaagccgaaauaucagguuccucgccuauuuuaucgauuacaauuagcgaagauggaagcaugaguaucaaaaaugaagaggaagaacaaacgcucacaauuuuaauccgaacgggacuguuggucauaucaggauuauuuccgguaucuauacccauuacagcugccgcuugguaucuuugggagguuaaaaagcagagggcaggaguauuaugggauguuccgucgcccccuccagucggaaaagccgagcuagaggauggugcauaucgaauuaaacaaaaaggaauacuugguuauagucagauaggugccggcgucuacaaagagggaacuuuccauacgauguggcacguaacaagaggugcaguucuuaugcauagaggaaaacgaauugaacccaguugggccgauguuaagaaagaucugaucucuuauggagggggauggaaacuggaaggagaauggaaagagggagaagaaguccaaguucuugcauuagaaccggguaaaaauccgcgcgcaguacagacuaaacccggcuuauucaaaacuaacacaggaacaauuggugcagugagucuggacuuuuccccaggaacaucuggaucuccgauaguugauagaaaaggaaaaguugugggauuauacggaaauggaguaguuacuaggucuggcgccuaugucucagcaauagcacaaacggaaaaaucaauugaagauaauccugaaauagaagacgacauauuuagaaagaaaagacuaacuauaauggaccuacacccuggagcaggaaaaacaaaacgauauuugccggcaauugugagagaggcaauaaaaagaggacuccggacgcuuauccucgcaccuacgagagugguugccgcagaaauggaagaggcuuuaagggggcuuccaauacgauaucaaacccccgcaaucagagcagaacauacagggcgggaaauaguagauuuaaugugccacgcgacauucacuaugcgccucuuaucuccaguaagaguccccaacuauaauuugauaaucauggaugaagcccauuuuacugauccggcaaguauagcagcaagaggguauauaucuacacgaguagaaaugggggaagcagcggguauauucaugacagcuacaccacccgguagccgugauccuuuuccacaaucuaaugcuccaauuauggaugaagaaagagaaaucccagaaagaaguuggaauaguggacaugaguggguaacugauuucaaggggaagacagugugguucgugcccucgauaaaagcuggaaaugauauagcagccugucugaggaaaaauggaaagaaagugauucaguuauccagaaaaacguucgauagugaauacguuaagacucgaacuaaugauugggacuuugugguaacaaccgacauuucggaaaugggugcuaauuucaaagccgaaaggguaauagaucccagacggugcaugaagccuguaauccucacugauggagaagaacgcgugauucuagcaggaccgaugccuguuacccauucguccgcagcacaaagaagaggcagaauugggaggaacccaaagaacgaaaacgaucaauauauuuacaugggagaaccgcuggaaaaugacgaagauugugcacacuggaaagaagcaaaaauguuacuggacaacauuaauacacccgagggaauuauacccaguauguuugaaccagaacgcgaaaaagucgaugcaauagauggagaguaccgguuaagaggugaggcaagaaaaaccuucguagaucuaaugcgcagaggagacuuaccagucuggcuagcauacagaguugccgcagaaggaauuaacuaugcugauagaagauggugcuucgauggcguuaaaaacaaccaaauucucgaagagaauguagaaguagaaaucuggacaaaggaaggcgaacgaaagaaacuaaaacccagaugguuggaugcacgcauauacagcgauccucuagcucugaaagaauuuaaagaauuugcagcaggccgaaaaucucucacacuaaauuuaaucacugaaaugggucguuugcccacauuuaugacccaaaaagcgcgggaugcacuugauaaucuugcuguacuucauacagccgaaguuggugguagagcuuacaaucacgcuuuauccgaauuacccgaaacguuggagacauuauuauugcucacauuguuggcaacgguaaccggaggaaucuuuuuauuuuugaugucgggaaaagggguuggaaagaugaccuuggguauguguuguauuauaacugcaaguauacuguuaugguaugcucaaauacaaccgcacuggauagcagcuucuauaauacuagaguucuuuuuaauuguucuacucaucccggagccagaaaaacagagaacgccacaggacaaccagcuaaccuauguuguaaucgcaaucuugacgguuguugcugccacuauggcaaacgaaaugggguuccuagagaaaacuaagaaagaucucggauugggaagcaucgcaacucaagagcccgaaagcaacauauuagauauagaucuacgcccagcaagcgccuggacauuguacgcaguagcgacaacauucgucaccccaaugcugcgacauucaauagaaaacuccagcguaaacguaucacuaacagcgauugcuaaucaagcgacaguacucaugggccuaggaaaaggauggccguuauccaaaauggacaucgguguccccuuacuugcuauuggaugcuauucccaaguaaacccuaucaccuugacagcugcacucuuguugcuaguagcccauuacgcaauuauaggaccaggacuucaagcaaaagccacgcgagaagcucagaaaagagcagcggcuggcauuaugaaaaauccaaccgucgacgguauaacaguuaucgacuuagauccuauuccguacgauccaaaauuugaaaaacagcuagggcaaguaaugcuucugauucuauguguaacucaagugcuaaugaugagaacuacaugggcauugugugaggcucucacacucgccacggguccaauauccaccuuaugggaaggaaacccuggcagauucuggaauacuacaauagcaguuucaauggcuaauauauucaggggaaguuaucuugcaggcgcaggucuauuguucucaauaaugaagaauacaacaaauacucgcagaggcacggguaacauuggugagacacuuggagagaaauggaaaucuaggcuuaacgcucuggguaagaaugaguuccaaauuuauaagaaaucgggaauacaagaagucgauaggacacucgcaaaagaaggaauaaaacgcggagaaacggaccaccaugccguaucgcgugggagcgcaaaacuacgaugguuuguugagaggaacaugguuacacccgaaggaaaagucgucgauuuaggaugugguagaggugguuggaguuauuauugcggagguuugaaaaauguacgagaaguaaaagguuuaacaaagggugguccuggacaugaagaaccuauaccgaugaguacauacgguuggaaucuaguaaggcuacaaaguggggucgacguauucuuuaccccacccgagaaaugcgauacucuacuaugugauauaggagaaucuagcccuaacccuacuauagaagcaggcaggacuuugcgcguucucagccucguagaaaauuggcuaaacaaugacacucaauuuuguauaaaaguuuuaaacccguauaugccuuccguaauugagaaaauggaaacacuccaacgcaaauauggcggugcccuaguacgaaauccccuauccagaaauuccacgcacgaaauguacuggguguccaacgcaacgggaaauauuguuucaagcguaaauaugauuagccgaaugcugauuaauagauuuacgaugaaacacaagaaagcgacauaugaaccggacguggauuuagguaguggcacaagaaacauuggaaucgagagcgaaaucccgaaucuugauauaauugguaaaaggauagagaaaauuaaacaggaacaugaaacaaguuggcauuaugaccaagaccaucccuauaaaacaugggccuaucauggaagcuaugaaacgaagcaaaccggaagugcuuccucuaugguaaacgguguaguccgauuacucacgaaaccaugggauguuguacccaugguuacacagauggccaugacagauacuaccccauucggacagcaaagagucuucaaggagaagguugauacaagaacacaggagccaaaggaaggaacgaagaaauuaaugaagauaacugcaaaaugguuauggaaagaauugggcaagaagaaaacuccaagaauauguacgagagaagaguucaccaagaaaguuaggaguaaugcugcauuaggugcaauuuucacugaugaaaauaaauggaagucggcgcgagaggcuguagaagacagccguuucugggaauuaguagauaaagaaaggaauuuacauuuagaagggaaaugugaaacuugcguauacaacaugaugggcaaaagagagaagaaauugggagaguucggaaaagcgaagggauccagggccauuugguauauguggcucggugccagauuccuagaauuugaggcccucggauuucucaaugaagaucauugguuuucgcgugaaaacagcuuauccggcguagaaggagaagggcuucauaaacuugguuauauacuuagggauguauccaaaaaggaaggaggggcgauguaugcagacgauacagcggggugggacacaagaauaacacuagaagaucugaagaaugaagaaaugguaacaaaccauauggaaggggagcauaaaaaguuagcagaagcaauauucaaauuaacguaccaaaacaaaguggugagggugcaaagaccaacaccaagagguacggucauggauauuauuucaaggagggaucaacgcgguaguggccaaguagggacauacgggcuaaauacuuuuacaaauauggaggcacaauuaaucagacaaauggagggagaaggaauauucaaaucgauacaacauuugacggucaccgaagaggucgcagugcagaacuggcuagcaaggguugguagagagaggcuaucucguauggccauaucaggagaugauuguguggucaagccccuagaugacagauucgcuucugcgcuuacugcguugaacgauaugggcaagguaagaaaagacauacaacaaugggagccaucgcggggauggaaugauuggacgcaagucccuuucuguucgcaucacuuucacgaacuuauaaugaaagauggacguguauugguaguccccuguagaaaccaggacgaguugaucggacgagcaaggauaucacaaggagcaggauggagucucaaagaaaccgcgugcuuaggaaaaaguuaugcgcaaauguggucuuugauguauuuucauagaagagaccuucgacuugccgcuaacgcaauauguucagcaguuccgagucauugggugccaacaagcagaacaaccuggucgauucacgcaaaacaugaauggaugacaacagaagauaugcuuacuguuuggaacagaguauggauacaagaaaaccccuggauggaagauaagacaccaguggaaagcugggaggaaguucccuaucuggggaagcgagaagaucaaugguguggcagucuuauagggcucacuucuagggcuacgugggccaaaaacauacaaaccgcgauaaaccaaguucguaguuugauuggcaaugaggaauauacugacuauaugccuucuaugaagcguuuuagacgggaagaagaagaggcgggcguauuaugguaa

SEQ ID NO: 22330 - RNA, 9876 nt, Artificial Sequence
  derived and/or modified CDS sequence (opt6) from DENV-2__FJ639699__SS-prME
acugcagggguaauaauuaugcuuauaccuacagcgauggcauuccauuugacaacgcgaaauggcgaaccacacaugauaguuggacgacaagaaaaagguaaaagucuuuuguuuaaaacagaagacggagugaauaugugcacauuaauggccaucgaccuaggggaacugugugaagauacuauuacauauaaauguccauugcugaggcaaaacgagccggaggauauagacugcuggugcaacucaacuucaacauggguaacuuacggaacaugcaccacaacaggagagcaucgcagagagaagcguucaguagcucuaguuccccauguaggaauggguuuggaaacgcgcacugaaacauggaugagcagcgaaggcgccuggaaacaugcgcaaaggauugaaacguggauacuuagacauccagguuuuacaauuauggcggccaucuuagcauacacaauaggaacaacccacuuccagagagcacuaauauucauuuuguuaacagcaguugcucccagcaugacaaugcgauguauuggaauaucuaaccgcgacuucguugaggguguaucgggaggcucauggguagauauuguguuagaacauggaaguugcguuacaaccauggccaagaauaaaccuacguuagauuucgaacuuauuaagacggaagcuaaggagccagcaacauugcgaaaauacugcauugaagcaaaguugacaaauacaacaacugaaagucgauguccaacgcagggagaacccucacugaaugaggaacaagauaaaagguucguauguaaacauucuaugguggauagaggauggggaaauggcugcggccuuuucgguaaaggcgggauaguaacuugcgccauguuuuccuguaaaaagaauauggaagggaaaauuguucaaccugaaaauuuagaauauacuauugugauuaccccccacaguggugaggaacacgcuguagggaacgacacuggaaaacaugguaaggaaaucaaaauaacuccccaaagcaguauaacagaggcggaauuaacagguuaugguacggucacgauggaaugcucaccccguacaggauuagauuuuaaugagaugguacuauuacaaauggaggacaaagccuggcuaguacauagacaaugguucuuagaccuuccucucccuugguuaccaggagccgauacccaggggaguaauuggauccagaaggaaacccuugucacguuuaagaauccgcacgcgaagaaacaagaugucguaguuuugggaucacaagaaggugcgaugcacacggcgcuaacaggugcaacagaaauccaaaugucaagcggaaaucuucuauuuacgggccaucucaagugccgccuaagaauggauaaguuacaacucaaaggaaugagcuauuccauguguacaggaaaauuuaagaucgugaaagagauagccgagacccagcacgggacgauagugauaagaguacaguacgagggugauggaucgccaugcaaaauaccguuugagaucauggauuuagaaaagcgccacguacuaggccgguuaauaacugucaaucccauaaucaccgaaaaggauucucccguuaacauugaagccgagccuccauucggagauucuuauauaauuaucgguguggagccaggacaauuaaagcuaaacugguucaaaaaagggagcagcauaggccaaauguuugagacaacaaugagaggagcaaagcguauggcaauacuaggagauaccgcuugggacuuugggucauugggaggugucuucaccagcauagggaaggcauuacaucagguuuuuggagcgauauauggagcagcauucaguggagucagcuggacaaugaagauucuaauaggaguuauaauaaccuggauagggaugaacagccgaaguacgagucuauccgucaguuuaguccuaguaggaguuauuacauuauauuuaggcgcaaugguacaagcugacagugggugcguagugucuuggaagaacaaagaguuaaaaugcggauccggaauuuuuauaacagacaauguucacacguggacggagcaauacaaauuccaaccagaaucgccgagcaaacuggcgagugccauccaaaaagcccaugaagaaggaauaugugggaucaggaguguuacacgucuugaaaaucuaauguggaaacaaaucacaccagaacuuaaccauaucuuaagcgaaaaugagguuaagcugacuauuaugaccggugauauaaaagggauuaugcaggcgggcaaaaggucacuuaggccacaaccuacagaauugaaguacucauggaagacuuggggaaaggcaaaaauguugagcacagaaagccacaaccaaacguuccucauagacggaccagaaaccgcagaauguccaaauacuaaccgagcauggaacucgcuggaggucgaagauuauggauucggaguauuuaccacaaauauauggcucaaauuaaaagagaagcaagaugucuuuugugauucuaagcuuaugagugcggcaauaaaagauaaccgggcaguccacgcagauaugggauauuggauagagucagcacugaaugacacauggaagauggaaaaagccucauuuauagaagucaaaagcugucauuggcccaaaucucauacacuauggucaaacgggguucucgaaucagaaaugaucauacccaaggguuuugccgguccaguuucacaacauaauuaucgaccggguuauuacacucaaacagcuggaccuuggcacuuaggcaaacuagaaauggauuucgacuucugcgaaggcacuacuguuguagucacagaggauugcgguaaucguggaccuagccugagaaccacgacugcaagugggaaacucauuacagaaugguguuguaggaguugcacuuuacccccuuuaagauaucguggugaagacggaugcugguaugggauggaaauucgcccauuaaaagaaaaagaggaaaaucuagugaauucguuaguaacugcaggacauggacagauagacaauuucucacugggcguucuuggaauggcauuguucuuagaggaaauguuacgaacaagaguuggaacaaaacacgcaauacuauuaguagcaguaaguuuugugacuuuaaucacaggaaacaugucauuucgagauuuaggacgugucaugguaaugguaggagcuacaaugaccgaugauauuggcaugggaguaacguaucuugcguugcucgcagcguuuaaagugagaccaacuuuugcagccggacuucuauuacgaaaacuaaccaguaaagaacuuaugauggccacaauagguauagcauugcuuucacaaucaacaauaccugaaacuauauuagaacuaacagacgcgcuugcacuagggaugaugaucuuaaaaauuguaagaaauauggaaaaauaccaguuagcggucacuauuauggccauaucuuguguuccgaacgccguaauacuacaaaaugccuggaagguaaguugcaccauauuagcagcuguaagugugagcccauuacuacuuacgaguagucaacaaaaagcugacuggaucccauuagcacuuaccauuaaagguuuaaacccuacagcaaucuuuuuaacgacacuuagcagaacuucuaagaaaagaucguggccauuaaaugaggcuauuauggcagucggaaugguaucaauacuagcgucaucacucuugaaaaaugacauuccaaugacaggaccacugguugcggggggguuacugacaguuugcuauguguugaccggacgaucggcugaucuagaacuggaacgagcaacggaugucaaaugggaagaucaagcagaaauaucaggcagcucacccauccuuagcauuacaauuagugaagaugggucaaugucaauaaaaaacgaagaagaagaacaaacuuuaacaauuuuaauaaggacaggucuacuuguaaucucaggucuauuucccguuucgauuccuaucaccgcagcugcuugguacuuaugggaaguuaaaaaacagcgggcaggaguucugugggacguaccaagccccccuccgguuggaaaagcggaauuagaagauggugcauaccguauaaaacaaaaagguauucuuggguauucccaaauaggugcuggaguuuauaaagaagguacauuucauacaauguggcauguuacuagaggagcgguacuaaugcaucgcggaaaacggaucgaacccaguugggcagauguaaaaaaagaucuaauuaguuacggaggaggauggaaacuagagggagaauggaaagaaggcgaggaagugcaaguauuagcccuagagccagguaaaaacccgagggcugugcagaccaaaccugguuuguuuaaaaccaacacggguacaauuggagcuguauccuuagacuuuuccccggguacgucaggaucaccgaucguagauaggaaagguaaaguugucggucuauacggcaaugguguaguaacaagaaguggagcauacguaagcgcgauugcacagacggaaaaauccaucgaagacaacccagagauagaggaugacauauuucguaaaaaaagacucacgaucauggaucuacacccuggcgccgguaaaacgaaaagauauuuaccagcaauagugagagaggcgauuaaaaggggguuacgcacauuaaucuuggcaccaacaaggguuguggcugcagagauggaggaagcucuaaggggauuaccaauacgguaccagacaccagccauuagggccgaacacacaggaagagaaauuguugaucucaugugccaugcaaccuucaccaugagacuacucaguccggugcgcguuccuaauuacaauuuaauuauuauggaugaagcgcauuucaccgauccagcaucaaucgcugcaagaggcuauauaucuacaagagucgaaaugggcgaagccgcagguaucuuuaugaccgccacacccccaggcagccgugaucccuuuccgcagucgaacgcccccaucauggaugaggaaagagaaauacccgaacgaucauggaacaguggacacgaauggguaacugauuuuaaagguaagacagugugguucguaccaucaaucaaagcuggaaaugauauagcugcuugcuuacgaaaaaacgggaaaaaaguuauccaauugucgcgaaaaacauucgauagugaauaugucaaaaccagaacaaacgauugggauuuugucgugacaacugacauaagcgaaaugggcgcuaacuuuaaagcugaaagaguaaucgacccaaggcgguguaugaagccugugauacuaacugauggugaggaaagagugauacuugcuggaccaaugccuguaacucacucguccgcugcgcaaaggagaggucgcauuggaagaaauccgaaaaaugaaaaugaucaauauauuuauaugggcgaaccucuagagaacgaugaggacugugcacauuggaaagaagcaaaaaugcuccuugauaacauaaacacccccgaaggaauuauuccaaguauguucgaaccagaacgagaaaagguggaugcgauagauggggaauauagacugagaggugaagcgagaaaaacuuuuguagaccucaugaggcgcggcgaucuaccaguguggcuagcauaccgagucgccgcugaagguauaaauuaugcagacagacgcuggugcuuugauggaguaaaaaacaaucagauccucgaagaaaauguagagguugaaauauggacaaaggaaggugagagaaaaaaauuaaagccacguuggcuagacgcucgaauauacucagacccucucgccuuaaaagaauucaaagaguucgccgcaggucguaagucauuaacacuaaaucuaauaacugaaaugggacgacucccgaccuuuaugacacaaaaagcgcgagaugcuuuagauaaucuagcaguacuccauacagcagagguuggagggagagcauauaaucacgcgcucucagagcuaccagaaacgcuugaaacguuacuacucuugacgcuguuggcaacagucacaggagggauuuuccuguuucuaaugagcggaaaaggugucgguaagaugacucuaggaauguguuguauaauuaccgcgaguauacugcuaugguaugcucaaauucaaccucacuggauugcagcuagcaucauccuggaauuuuucuugauaguguuauuaaucccugaaccagaaaaacaacguacgccgcaagauaaucagcucacauauguagucauugccauacuaacggucguggcugccacaauggcaaaugaaaugggcuuuuuagaaaaaacgaaaaaagaucugggacuggggagcaucgcgacucaagaacccgaaucaaacauuuuagauauagacuuaagaccagcaagugccuggacuuuauacgcgguugccacgacauucguaacuccaaugcuucgccacuccauagagaauucgaguguaaaugucaguuugacagcuauugccaaucaagcuacuguguuaauggguuuaggaaaaggcuggccuuuaucaaaaauggauauaggaguaccacuacuagcuauuggauguuauucgcagguaaauccgauuacacuaaccgcggccuuauuauugcuaguugcucacuaugcaauuauugggccaggccuacaagcuaaagcaacccgugaagcucaaaaaagagcggccgcuggaauuaugaaaaauccaacuguagacggaauuacagugauugacuuagauccaauaccuuacgauccaaaguuugaaaaacaacuagggcaggucaugcuuuuaauauuaugcguaacgcaaguguuaaugaugcggacaacuugggcacucugcgaagcauuaacacuagcaacuggaccgauuucgacuuuaugggaaggaaaucccgggcgauucuggaauacaacaaucgcaguuucuauggcaaauauuuucagagggucauaucuugcuggagcaggacuauuauuuucaauuaugaaaaauacgacaaacacaagaagaggaacagggaacauuggagaaacacuuggggagaaguggaaaagucguuugaacgcauuagggaagaacgaauuucaaauauauaaaaagagcggcauacaagaaguugaucggaccuuggcaaaagaaggaaucaaaaggggagagaccgaccaccaugcaguaaguagaggcagcgcaaaacuacgaugguuuguggaaaggaauaugguaacaccugaaggcaaaguaguagaucuuggcuguggaagagggggauggucuuauuacugugguggacucaaaaacguacgagaaguaaaaggacugacaaaagguggaccgggccaugaagaaccuauuccaaugaguacauauggcuggaacuuaguucgacuucagaguggaguggacguauucuucaccccuccagaaaaaugcgacacgcuguuaugugauauaggagaaucaaguccuaacccaaccauugaggcaggaagaacacuccgcguauuaucacuaguagaaaauuggcuuaauaacgauacucaguucugcauuaaaguauuaaauccauauaugccaucaguuauugaaaaaauggaaaccuuacaaagaaaguaugguggagcgcuaguaagaaauccccuaucgcgcaacucgacacacgaaauguauugggucucuaaugccacagggaacauagucagcuccgucaacaugaucuccaggauguugauaaauagauuuacaaugaaacauaaaaaagcaacuuacgaaccagauguagauuugggaucuggaaccaggaacauagguaucgaaagcgaaauaccaaaucucgauaucauagggaaacgaauugaaaaaauuaaacaggagcacgagacuaguuggcauuacgaccaagaccaucccuauaaaacaugggcguaccauggaagcuacgaaacuaaacaaacuggaucagcuagcaguauggucaauggcguuguacgucuuuuaacgaaaccaugggacguagugccaaugguaacacaaauggccaugacugauacuacucccuuuggacaacaacggguuuuuaaggaaaaagucgacacaagaacccaagagccaaaagaaggaacaaaaaaacugaugaagaucaccgcaaaauggcuauggaaagaacugggaaagaagaaaacaccaaggauauguacacgugaagaauucacgaagaagguacggaguaacgcagcccuuggcgcgauauuuacagacgaaaauaaauggaagucugcaagagaagccguugaggauagucgauuuugggaauugguggacaaagaaagaaaucuacaccuagaagggaaaugcgagacuuguguguacaacaugauggguaaacgagaaaaaaagcuaggugaauucgggaaagcgaaaggaagcagggcaauuugguauaugugguuaggggcaagguuccucgaauucgaggcucuugguuuucuuaaugaagaccauugguuuucccgggaaaauucucuaucagggguagaaggcgaaggacugcauaaauuaggguauauccuuagggauguaaguaaaaaagaggggggggcaauguaugcagacgauacugcugggugggauacgaggauuacauuagaagacuuaaaaaacgaggaaaugguuaccaaccacauggaaggugagcauaaaaaacuugccgaagcaauauuuaaguuaacauaccaaaauaaaguaguaagagugcagcguccuacuccccgcggaacagucauggacauuauuaguaggagggaccaacgugggucuggucagguaggaacuuacggcuugaauacauucaccaauauggaagcccaacugauuaggcaaauggaaggggaggguauuuucaagucuauucaauaccucacugucacagaggaaguagcagugcaaaauuggcuggccaggguaggaagagagcguuuaagccgaauggcaauaagcggggaugauuguguaguaaagccucuagacgaucgcuuugcgagcgcauuaacagcuuugaaugacaugggcaaaguuagaaaagauauucaacaaugggagccuucuagaggauggaaugacuggacgcaagucccguucuguucccaucacuuccaugaacugauuaugaaagaugguagaguccucguuguaccauguagaaaucaagacgaacuaaucgguagagcacguauaucacaaggggcaggguggucccuuaaggaaacagcaugucuuggcaaaucuuacgcacaaauguggagucuuauguacuuucaucgccgggacuuacggcucgcagcaaacgccauuuguagcgccguaccaucgcauuggguuccaacuucccgaacaaccuggucaauacacgcuaaacaugaauggaugacuacagaggauauguuaaccguauggaauaggguuuggauucaagagaacccauggauggaagauaaaaccccuguggaaucaugggaagaagucccauauuuaggaaagcgugaagaccaauggugugggaguuugauuggcuugacuucccgagccacaugggcuaaaaacauccaaacggcaaucaaccaaguacgcucauuaauugguaaugaagaauacaccgauuacaugcccucaaugaagcguuucagaagggaagaagaagaggccggaguauugugguaa

SEQ ID NO: 22331 - RNA, 9876 nt, Artificial Sequence
  derived and/or modified CDS sequence (opt6) from DENV-2__FJ639700__SS-prME
acggcggguguaauaauaauguugauccccacugcaauggcauuucaccuaacgacgagaaauggagaaccccacaugauugugggaagacaagaaaaagggaaaagccugcuguuuaaaacugaagacggaguuaauauguguacccuaauggcaauugaucuaggagaacuaugugaagauacaauuacauauaaauguccauuauugaggcaaaaugaacccgaagauauagauuguuggugcaacucgacaaguaccugggugaccuacgguacgugcaccacgacgggagaacauagaagagaaaaacguaguguagcacucguaccucaugugggaaugggccuggaaacuagaacugaaacauggaugucaagugaaggagcuuggaaacaugcccaacgcaucgaaacguggaucuuaagacauccuggauuuacuauaauggcagcaauuuuggcauacacaauagguacgacacauuuucaaagagcccuaauauuuauauuacuaacugcugucgcaccaucaaugaccaugagauguauaggaauuucaaauagggauuuuguggaaggagugagcgggggcucauggguagacauuguccuggaacacggaaguugcguaacgacaauggcuaaaaacaaacccaccuuagacuuugaacuuauaaaaacugaagcaaaagagccugcaacuuuaagaaaauauuguauugaggcaaaacucacaaauacaacuacugagucgagauguccuacacaaggggagccaucacuaaaugaagaacaagauaaacgcuucguaugcaaacauaguaugguugaucgcggaugggguaauggaugcggcuuguuuggaaaagggggcauagucacgugcgcaauguuuucguguaagaaaaauauggaaggaaaaauuguacagccagaaaaucuugaauauacaauaguaauuacuccucauucaggcgaagaacaugccgucggcaacgacacgggcaaacacggaaaagagauuaaaauuacaccacaaucuuccauaacagaagcagaauuaacuggauaugguaccguaacaauggaguguagcccuagaacuggcuuagacuucaacgaaaugguauuacuacaaauggaagauaaagcauggcucguacacaggcaaugguuucucgaccuaccacuuccauggcuuccaggggcagacacucaaggaucgaacuggauccagaaagaaacccuaguaacauucaaaaacccucaugccaagaaacaagauguaguagucuugggaucucaagaaggugcgaugcacacugcauuaaccggagcaacagaaauacaaaugagcucaggcaaucuacuauucacgggacauuuaaaguguagacugcgaauggacaaauuacaacuaaagggaaugaguuacagcauguguaccggcaaauucaaaauagucaaagaaauagcagaaacccagcacggaacuaucguaauuaggguacaauaugaaggugacggaagcccuuguaaaauaccauuugaaauaauggauuuagagaaaaggcacguguuagguagauuaauuacagucaacccgauaauuacugaaaaggacucccccguaaauauagaggccgaaccuccauuuggagauucauauauaauuaucgggguagaacccgggcaacuuaaauuaaauugguucaagaaaggcagcuccauaggacagauguuugaaacaacaaugcgaggugcuaaacgcauggccauacuaggggacacugcaugggacuuuggaucauuaggaggggucuuuacuucaaucggaaaggccuuacaucaagucuucggagccauuuauggagcugcguuuucgggggucucauggacaaugaaaauauuaauuggaguuauuauuacuuggauagguaugaacucuagaaguacaucacugucuguaucauuaguccucguaggaguuauaacguuguaucucggggccaugguacaggcagacucggguugugugguaucuuggaaaaauaaagaguuaaaauguggcucgggcauauuuauuacagauaauguacauacuuggacagagcaauauaaguuucaacccgaaagcccaucaaagcuagcuagugcaauccaaaaagcacaugaagagggaauauguggaauaaggucggucacuaggcuagagaaccuaauguggaaacaaaucacaccagaacucaaucacauacuaagcgagaaugaggcuaaacucacgaucaugacuggagauauuaaaggcauaaugcaagccggcaaacgcagucuuagaccgcaaccaacagagcuaaaauacaguuggaaaacuuggggaaaggccaaaaugcuuaguacagaaucgcauaaucaaacguuucuaauagacggaccagaaacugccgaguguccaaauacaaaucgugcauggaacucacuugaaguugaagacuacggauuuggaguauuuacaaccaauaucuggcucaaguuaaaagaaaaacaagacguauuuugugauaguaaacuaauguccgcugcuauuaaagauaaccgugcgguacaugcagacaugggcuauuggauugaaucagcccuaaaugauaccuggaagauggaaaaggcaaguuuuauugaagugaaaucaugucauuggccuaaaucacacacacuuuggucuaaugguguauuagaaucagaaaugauaauuccaaaagguuucgcaggaccggugagccaacauaacuaccggccagguuaccacacacaaacggcuggaccauggcaccuuggaaaacuggaaauggauuuugacuuuugugaagggaccacggucguuguaacggaagauugugguaaccgagggccaaguuugcguaccacgacugcgucagggaaacucauaacggaauggugcuguagauccuguacacuaccaccuuuaagguaucguggagaggacggauguugguaugguauggagauaagaccauuaaaggaaaaagaagaaaacuuaguaaauucccuaguaacugcuggacacggucaaauagauaauuuuucccuaggcguacuggguauggcguuauuuuuggaagaaaugcuuaggaccagaguuggaacaaaacaugcaauccucuuaguggccgucaguuuuguuacauuaauaaccggaaauaugucauucagagauuuaggaagggugauggugauggucggggcuaccaugacagacgacauaggaaugggaguaacauaucuagcacuucuagcagcuuucaaagucaggcccacauucgcagcgggucucuugcuacgaaaauuaacuuccaaagagcuaaugauggcuacaauaggcauagcccuacuuucucagucuacgauacccgaaaccauacuagaacugaccgaugcccuggcgcuagguaugaugauacuaaaaauaguaagaaacauggaaaaauaccagcuugcuguuacuauaauggccaucaguuguguuccaaacgcaguuauuuugcaaaaugcauggaaggugaguuguacgauucuugcugcuguaucggucaguccucuuuuguuaacgaguucucaacagaaggcagacuggaucccauuagcauuaaccauaaaagggcucaauccaaccgcaaucuuccugacaacucuuucaagaacaagcaagaaacggaguuggcccuugaaugaggcaauaauggcaguugggaugguaaguauucuagcuaguucuuuacuaaagaacgauaucccaaugacaggcccauuaguagcaggaggacuuuuaacaguuuguuauguacuaacaggaagaagcgccgaccucgaacuagaacgcgcaacagauguuaaaugggaagaucaagcagagaucucaggaaguuccccaauucucucaauuacgauauccgaagacgguaguaugagcaucaaaaaugaagaagaagaacaaacuuugacaauacucauucggacgggauugcuaguaauaucggguuuguuuccgguuucuauaccaauuaccgcggccgcgugguauuuaugggaagucaagaaacaacgagcaggaguauuaugggaugucccgucgccaccacccguagguaaagccgaguuagaagauggagcauauaggaucaaacaaaaagguauacuaggcuauucgcaaauaggugcaggcguauauaaagaagguacauuccacacaauguggcacguaacaaggggagcaguauugaugcauagagguaaaagaauugagccaaguugggcagaugucaagaaagacuuaauaucuuacggggguggcuggaaacuggagggggaauggaaagaaggggaagaaguacaaguccuugcgcuugaaccugguaaaaacccaagagccguacagacgaaaccaggacucuuuaagaccaauacagguacaauuggcgcaguaucacucgauuuuucuccugguacgucugguucaccuaucgucgacagaaaaggaaagguagugggacuguauggaaauggcgugguaacgagaagcggcgcuuacguaucagccaucgcgcaaacagagaaaagcauagaagacaauccagagaucgaagacgacauauucagaaagaaaagacuaacgauaauggauuugcaucccggagcugguaaaacgaaaagauaucugccagcaauuguacgugaagcuauuaaaagaggcuuacggacacuaauuuuagcccccacacgcgugguggcugcagagauggaagaagcucuacguggacucccuauuagauaucaaacacccgcaauaagagcggaacauacaggucgagagauagucgaccugaugugccaugcuacuuucacuaugagguuacuaucaccuguucguguaccaaacuauaacuuaauaauaauggaugaagcacacuucacagacccagcgucaaucgcugcaagaggauacaucucuacccgcguugaaaugggugaggcagcggguauauucaugacggccacaccuccuggaucaagagauccauucccgcaaucaaacgcaccaauaauggaugaagaacgggaaauacccgaacgcagcuggaacucuggacaugaauggguuacagacuuuaagggaaagacaguuugguuugugccgucgauaaaagcugguaacgacauugcagcguguuugcguaaaaacggcaagaaagugauccaguuaucaaggaagacauucgauucggaauaugugaaaacacgcacgaaugacugggauuuuguagugacuaccgacauuagcgaaaugggagccaacuucaaggcugaacgcgugauagauccccgacgauguaugaaaccagucauuuugacugauggugaggagagagucauauuggcaggcccgaugccgguaacccauuccucggcagcucaaaggagaggcaggauaggucgcaaucccaaaaaugaaaacgaccaauauauauauaugggagagccuuuagaaaaugaugaagacugugcacauuggaaggaggcaaaaaugcuguuagacaacauuaacacaccagaaggaauaauacccucaauguuugaaccugaaagagaaaaaguugaugcaauagauggcgaauacagacuaagaggagaagcaagaaaaacauuuguugaccuuaugcggcgaggagaccuaccuguaugguuagcuuacagaguagcggcagaaggaauuaauuacgcggacagacgauggugcuuugauggagugaaaaacaaccagauauuggaagagaauguagaaguagagauuuggacuaaagagggcgaacguaagaaacuaaaaccaagauggcucgaugccaggauauauucagacccuuuagcauugaaggaauuuaaagaguucgcagcgggucgaaagucauuaacacuaaaucucaucacugaaaugggucguuuaccgacuuucaugacucagaaggcccgugacgcucucgauaauuuagcaguacuacauaccgcugaaguuggagggagagcuuauaaucacgcucuaucagaauugccugagacucuugagacgcuacuucuacuaacauugcuagcaacaguaacuggcggcauauuuuuauuuuuaaugucagggaaaggugucggaaaaaugacucucggaaugugcuguauaauuacggcuaguauacuauugugguaugcacaaauacagccacauuggauagcagcauccauuauuuuagaauuuuuccuaauugucuuguuaauuccugaaccagaaaagcaacgcacuccacaagauaaccaacucacguacgugguuauugcuauauuaacaguuguugcagcaaccauggcaaacgaaauggguuucuuagagaaaacuaagaaagaucucggauugggaucgauagcuacucaagaaccagaaucgaauauccucgacauagaccuucggccggcuucggcguggacacuauacgcgguugcgacaaccuuuguaacgccuaugcuuagacacagcauugaaaauucuucuguaaacguuucccucacggcaauugcaaaccaagccaccguucucaugggccuaggaaaagguuggccccuaucgaaaauggacauugggguaccgcucuuggcaauaggaugcuauagucaagugaacccuauaacauuaacugcugcacugcuauuauuaguagcacacuacgcgaucaucggccccggacuucaggcuaaagcgacaagagaagcgcagaaaagggcagcagcaggaauuaugaaaaacccaacaguagacggaauaacagucaucgauuuagauccaaucccauacgacccgaaauuugaaaaacaacuaggccaggucauguuguuaauauuaugcguuacucaaguucucaugaugcguacgacaugggcguuaugcgaggcgcuuacacuagcgacugguccgauaucuacauugugggaagguaauccaggaagguuuuggaacacaacaaucgcaguaagcauggcaaauauuuuuagggggucuuauuuagcgggcgcgggucucuuauucuccauaaugaaaaauacuacaaauacuaggagaggcacggguaacauuggugagacucuaggcgaaaaauggaaaaguagacuuaaugcucucgguaaaaaugaauuucaaauauauaaaaagucaggcauucaggaaguagacagaacuuuggccaaagaaggaauaaagaggggcgaaacggaucaccacgcuguaagucggggaucugcaaagcugcggugguucguagaacgcaauaugguaacucccgaaggcaaaguaguagaccuaggaugugguagaggagguuggucguacuacugugguggauugaaaaaugucagagaagugaaaggauugacaaaaggagguccuggacaugaagaacccauaccgaugucgacuuaugguuggaaucuaguucgacuucagaguggaguugacguguuuuucaccccgccagaaaagugugacacacucuuaugugauaucggugaaagcuccccaaauccgacaaucgaggccggacgaacauuacguguucuaagccuagucgagaauuggcuuaacaaugauacacaguucugcauuaaaguguugaaccccuacaugccuucgguuaucgagaaaauggaaacucuucaaagaaaauacggaggugcgcuaguaagaaauccauugucuaggaauaguacacaugaaauguauuggguuucaaaugcgacgggaaauauuguuucguccguuaauaugaucucucgaauguuaauuaacagguuuacuaugaaacauaagaaagcgacguaugaaccugauguugaucugggcucaggaacgaggaauauagggauugaaucggaaauuccuaauuuagauaucauuggcaagcguauagaaaagauaaaacaggagcaugagacuucauggcauuacgaccaagaccaccccuacaagacaugggcauaucacggaagcuaugagacuaaacaaacagguagugcuagcagcaugguaaacggcguugucagacuauugaccaagccaugggacguggugccgaugguaacucaaauggcuaugacagacacuacaccguucggccaacagagaguauucaaggaaaaaguagauacaagaacgcaagaaccaaaagaaggaacuaaaaaguuaaugaaaauaacggcaaaauggcuuuggaaagaacuaggcaagaagaaaacgccgcgaauaugcacgagagaagaguucacuaagaaagugcgauccaacgcagcacugggugcaauauuuacagacgaaaauaaauggaaaucagcgagagaagccguagaagauagucgauuuugggaguuagucgacaaggagagaaaucuacacuuagaagggaagugugaaacgugcguguauaacaugaugggaaaaagggagaagaaauuaggugaguucgguaaagcaaaaggcucucgagcaauaugguacaugugguuaggagcgagauucuuagaguucgaagcacuugguuuccuaaaugaagaccauugguuuaguagagaaaacucucugucagggguagaaggugaagguuuacacaaacuaggguauauucuacgggauguuucaaagaaagaagggggagccauguaugcggacgacacggcggguugggauacgcgaauaacccuggaagaccucaaaaaugaagaaaugguaacgaaucauauggagggcgaacauaagaaauuggcagaagcaauauuuaagcuaaccuaccaaaacaaaguugugcgaguacaacgcccuacaccuagaggcacgguuauggauauaaucucccguaaagaucaaagaggaucaggacaaguaggaacauaugggcucaauacuuucacuaauauggaggcacaacuaauuagacaaauggaaggugaagguauuuucaaaucuauccaauaccuaacagugacggaagagguugcagugcagaacuggcucgccaggguaggacgcgaaagacuuaguaggauggccauaagcggagaugauuguguaguaaaaccacuagaugauagguuugcuuccgcgcuaacggcccuaaaugacauggguaaaguucgaaaggauauucaacaaugggaaccaucaagagguuggaaugauuggacucaaguaccuuuuuguucgcaucauuuucaugaacuaauaaugaaagauggacgagugcuuguuguaccaugucgcaaucaagacgagcucauaggcagggcgagaauuagucaaggagcaggcuggagcuuaaaagaaaccgccugccuaggcaaaucguaugcccaaauguggucacuaauguacuuucauaggagagaucuacggcucgcugcaaacgcgauaugcucagcgguaccuagucacuggguaccaacaagucgaacuaccuggucgauccacgcuaaacaugaauggaugacaaccgaagauaugcuuacuguauggaacagaguuuggauucaagaaaacccauggauggaagauaaaacacccguagaaucaugggaagaggucccguaccuuggaaagagagaagaucaaugguguggaucuuuaauuggucuaacaucaagagcaacaugggccaaaaacauucaaacugcaauaaaccaaguuaggagcuuaaucggaaacgaagaguacaccgacuacaugccuucaaugaaaagguuucgccgagaggaagaagaagcaggaguguuaugguag

SEQ ID NO: 22332 - RNA, 9876 nt, Artificial Sequence
  derived and/or modified CDS sequence (opt6) from DENV-2__GQ868620__SS-prME
agcgcagggaugauaauuauguuaauaccaacagugauggcuuuucauuuaacgacaagaaacggugaaccccauaugauaguagguauacaagaaaaaggaaaaucucuauuauucaaaacugaagaugggguuaauauguguacucuaauggcgauggaucugggagaacuuugcgaagauacaauaacauauaaaugcccauuauugcggcaaaacgaaccagaagacauugauuguuggugcaauucgaccaguacuugggugaccuauggcacguguacaacaacaggcgaacauaggcgagagaaaagaucaguugcgcuuguaccacauguaggaaugggucuagaaacacgaacagaaaccuggaugucaagugaaggggcuuggaaacacgcucaaaggaucgaaacuuggauccucagacauccaggauucacuauuauggcugcgauuuuagcuuacaccauagggaccacucacuuccaaagagcguugaucuuuauacuauuaacggcuguagcucccaguaugacaaugagauguauaggcauuucaaauagagauuuuguugaaggaguaucggguggaagcuggguggauauaguauuagaacaugguuccugcguaacuacaauggcuaaaaauaaaccaacuuuagauuuugaacugauaaaaaccgaagcaaaacaaccagcuacacuuagaaaauacuguauugaagcaaaauugacaaacacuacgacagaaaguagaugccccacacaaggagaaccuucuuuaaaagaagaacaagacaaaagguuuguaugcaaacacucuaugguggauagagguuggggaaacggguguggcuuguucgguaaaggagggauaguaaccugugcaauguuuacaugcaagaaaaauauggagggcaaaaucguucaacccgaaaaucuagaauauacaauaguagucacuccacauucaggcgaagaacacgcaguaggaaacgauaccgggaaacacggaaaagaaauaaaaguaacgccucaaaguuccauaacagaggcagaguugacaggauacgggacuguaacaauggaaugcuccccaaggacgggcuuggacuuuaacgaaaugguauuauugcagauggaaaacaaagcauggcuagugcacagacagugguuccuagaucuaccacuaccauggcucccaggagcagauaaacaaggcuccaauuggauacagaaagaaaccuuaguuacauucaagaauccccacgccaagaaacaagaugucguaguauuaggaagccaggaaggagcuaugcacacagcauuaaccggcgccacggaaauacaaaugucaucuggcaaucuccucuuuacuggccaucuaaaguguaggcuaagaauggacaaauugcagcuaaagggaaugucauauaguauguguacagggaaauucaaaguggucaaggaaauugccgagacucaacacggaaccauuguuauacgagugcaauacgaaggggauggaagcccaugcaaaauaccauuugaaauuauggaucuagaaaaacgguauguccuuggcagacuaauuacugugaacccgauaguaacagaaaaagauucaccagucaacauugaagcggagcccccauuuggugauaguuauauaauuauagggguugaaccgggccaauuaaaacuuaacugguucaagaaagguucgucaauuggacagauguucgagaccacuaugagaggcgcgaaaagaauggcuauucuuggagauacugcaugggauuuuggaucccuaggugggguuuuuacgucaauagggaaggcacuacaucaaguuuucggggcgauuuauggagcugcauuuuccggagucucauggacaaugaaaauauuaaucgggguaauuauaacauggaucgggaugaacucucguucaacuucccucucuguuucuuuagucuuaguaggaauagucacacucuaucuaggagugaugguacaagccgauaguggcugcguggucucuuggaagaauaaggaacucaaauguggcucuggaauauuuauaacugauaauguccauacauggaccgaacaauacaaguuucaaccggaaagcccaucaaaacuagcgucugcaauucaaaaggcacaggaagaagggauaugugggauucguagcguuacccgacuggagaaccugauguggaaacaaauuaccccagaguugaaccauauacuggcugaaaacgaaguuaagcuaaccauaaugacuggcgauauaaaaggcaucaugcaagcaggaaagagaucccuacguccacaaccaacagaauuaaaguacucuuggaaaaccugggguaaagccaaaaugcuaucgacagaaagucacaaucaaaccuuuuuaauagauggucccgagacugccgaaugucccaauacaaauagggcguggaacucacuggaaguggaagauuauggcuucgggguguucacuacaaauauaugguugaaacuuaaagaaaaacaagaugcauucugugauucaaaauuaaugucagcagcaauaaaagauaacagggcaguccaugcggauaugggcuauuggauagaaucagcauuaaaugacaccuggaagauagaaaaagcaucguucaucgaggucaaaaauugccauuggccgaaaucacauacauuguggaguaauggaguacuagaaucagaaaugaucauucccaaaaaucuggcgggucccgucucccaacauaauuaccgaccuggauaucauacgcagauugcaggaccguggcacuuaggcaaauuagaaauggauuuugacuucugugauggaacaacaguuauuguuacagaggauugcgguaauagagguccaucacuaaggaccaccacagcgagcgggaagcuaaucacagaauggugcugucgaucuugcacacuaccaccacuucgauaucgcggagaagacggaugcugguauggcauggagauccggccacuaaaagaaaaggaagaaaacuuagugaacaguuuaguaaccgcuggccauggacaaguugauaauuuuucguuaggagugcuugguauggcacucuuucucgaagagauguugcguacucgaguagguacuaaacacgcaauccuauuaguggccguaucuuucguaacuuuaauaacagggaacaugucuuucaaagaccugggaagagucgucguaauggugggugcuacaaugaccgaugacauagggaugggaguaacauaucuagcuuuauuagcagcuuuuaaaguacggccuacauucgcugcagggcucuuauuacgcaaacuuaccaguaaggaacuaaugaugacuacaauagguauagugcugcuaucucaaagcacgauaccagaaacaauccuugaguuaaccgacgcacuagcuuugggcaugaugguccugaaaauaguaagaaauauggagaaauaucaauuggcaguuacaauuauggcgauucucugcguuccgaacgcgguaaucuugcaaaaugcuuggaaaguaaguuguacaauacuggcaguugugucaguaucucccuuacuauuaaccaguagucaacagaaaacagauuggaucccacuagcuuugacgauuaaaggauuaaacccaacugcuauauuucucacaacacugucuagaaccaauaaaaagagaucauggccauuaaacgaagcgaucauggccguuggaaugguaucaauccucgcgaguucucuauuaaagaaugauauaccaaugacagguccacucguugcagggggcuuacuaaccgucuguuacguacuaacaggacgaucagccgaccuagaauuagagagagcuaccgauguaaaaugggaagaccaagcagaaauuuccggaucuaguccaauauuaucuauaacaauuagugaagacgguucaaugaguaucaaaaaugaagaagaagaacaaacucuuacaauacugauucgaacaggucuauuagucauaaguggccuguuccccguaucuaucccgauuacagcagcugccugguaccuaugggaggucaagaaacagcgcgcagggguacugugggauguuccuagcccuccaccuaugggaaaagccgaacuagaagacggagcauauagaauaaaacaaaaagguauucucggcuacucacaaauaggagcuggaguauacaaggagggcacauuucacacgauguggcacguaacuaggggagcgguucuuaugcacaaagggaaaagaauugaaccuagcugggcagaugugaaaaaggaucucauaagcuauggaggggguuggaaacuugaaggugaauggaaagaaggggaagaagugcaaguauuagcauuagaaccagggaaaaauccuagaguuguucaaacaaagccgggguuauuuaaaacaaauacugguacaauaggggcuguuucucucgauuuuucaccagggaccucagguucaccgauuaucgacaagaaaggcaaaguaguaggacucuaugguaacggcgucgucacgagaucgggagcguauguaucagccauagcacaaacagaaaaaucaauagaggacaauccugaaauagaagacgauauuuuuaggaaacggcggcugaccaucauggaucuccacccaggugccggaaagacgaagcguuauuugcccgcaauuguucgggaggcaauaaaaagaggguugagaacuuugauacuugcaccaacuagaguaguagcagcagaaauggaagaagcgcuacgagggcuacccauacgguaucagacaccagcuauaagagcggagcauacugguagagagauaguugaucuuaugugucaugcuacauucacaaugagacuauuaagcccaguaagaguuccaaauuacaacuuaauuauaauggacgaagcccacuuuacagacccggcauccaucgcggccagaggauauauaaguacgcgugucgaaaugggagaagcugcagguauauuuaugacggcaacgccaccgggaaguagagacccuuuuccucaaucaaaugcaccaauaaucgacgaagaaagagaaauuccugaacguaguuggaauaguggacaugaaugggugacugacuuuaaaggaaaaacgguuugguucgugccaaguauaaaggcaggcaaugacaucgcagccugcuuaaggaaaaauggaaagaaaguaauacaacuauccagaaagaccuucgacagcgaguauguuaaaacgcggacgaaugauugggacuuuguaguaacaacagacaucagcgagaugggagcuaacuuuaaagcugaacgcgucauagacccaaggagaugcaugaaaccuguuauauuaacggauggggaggagcggguaauccuggcaggcccuaugccuguaacacauagcucagccgcccaacgcaggggacgcauuggccgaaacccuaaaaacgaaaaugaucaauauauauacaugggggaaccacucgagaaugacgaagacugcgcacacuggaaggaagcgaaaauguuacuagacaauauuaauacaccugaagguauaauaccgucaauguucgaaccugaaagagaaaaagucgaugcuauugauggagaauauaggcuucgaggagaagccaggaagacuuuuguagacuuaaugagacgaggagaucuaccagucuggcucgcuuauaaagucgcagcugagggcaucaauuaugcugaucgacggugguguuucgauggcaucaaaaauaaccaaauacuugaagagaauguugaaguggaaauauggacuaaggaaggagagagaaagaaguuaaagcccagauggcuagacgcacggauauacucggacccgcuggcccuaaaagaguucaaagaauuugcugccggccgcaaaagucuaacgcuaaacuuaauaaccgaaaugggaagacuuccgacuuuuaugacgcaaaagacucgggacgcauuggacaaccucgcaguccuacauacagcagaagcugguggcagagcguauaaucacgcuuuauccgaacuuccagaaacguuagaaacacuucuauugcuuacauuacuagcgacuguaacgggaggcauuuuucuauucuuaaugagcgggagagggauagguaagaugacguuggguaugugcuguauaauuacggcuuccauacucuuaugguacgcacaaauucaaccacacuggauugcagcaucuauuauacuagaguucuuucuaauagucuuacuaauaccagaaccagaaaagcagagaacaccacaggacaaccaacuaacguauguagucauugcgauauuaacaguuguugcggcaacgauggccaacgaaauggguuuucuggaaaagaccaagaaagaccuugggcuggguaguaucgcaacgcagcagccugaaucaaauaucuuagacauagacuugcgcccagccagcgccuggacacuuuacgcaguagcaacuacauuugugaccccaaugcuccgucauucaauugaaaauaguagugucaacguaucccucaccgcaauagccaaccaggcuaccgucuugaugggacuaggaaaaggauggccgcuaucgaaaauggauaucggggucccacuauuagcuauaggcugcuacucacagguuaauccuauaacuuuaacugcagcccuacuacugcuuauagcccauuaugcaauaauugguccgggucuccaagcuaaggcaacaagagaagcacagaaaagagcugcugcuggaaucaugaaaaauccaacagucgauggaaucacuguuaucgaucuggauccgauccccuacgauccgaaguucgaaaagcaacuuggccaaguuauguuacugauuuugugcguaacacaaguacuuaugaugagaacgacuugggcauugugugaagccuuaacacuggccacugguccuauuucuacucucugggaagguaacccuggucgguuuuggaacacuacuaucgcuguuaguauggccaacauauuuagagggucguaccucgcuggagcuggauuacuuuucucaauaaugaaaaacgcaaacaauacccgcaggggaacugguaacauuggcgaaacccuuggcgaaaaauggaagucgcgacucaacgcauuaggaaaaagcgaguuucaaaucuauaagaaaucaggcauacaagaaguagacaggacauuggcgaaagagggcauaaaaaggggagaaacggaccaucacgcuguuuccagggguucugcgaaacuaagaugguucgucgagcgaaauaugguaacuccagaaggcaaagucguugaccuaggaugugggcguggugguuggagcuauuacugcggaggcuugaaaaaugugcgagagguuaagggacuaacaaaagggggacccgggcaugaagaacccauacccaugucuacuuauggcuggaaucuagugcgccuacaaucagguguggauguauucuuuauuccucccgaaaagugugauaccuugcucugcgacauaggugaaucaaguccaaauccuacaguugaagcaggacgcacuuuaagaguucugaacuuaguagaaaauuggcuaaacaaugauacucaauucugcauaaaggucuuaaauccauauaugccuucggugaucgaaaagauggaggcacuucaacgaaaguaugguggagcguugguccggaacccacuaucaaggaacucgacacacgaaauguacuggguaucaaaugcauccggaaacauagugagcagcgugaauaugauaagucguaugcuaaucaaucguuuuacaaugagacacaaaaaggccacguaugagccagauguagaucuaggaucaggaacacgcaacauuggaauugaaucagaaaucccgaaccuagacaucauaggaaagagaauagagaaaauaaagcaagagcaugaaacaagcugguacuaugaccaagaucacccuuauaaaaccugggccuaucacggaaguuacgaaacgaagcaaacaggaagcgcuucgucaaugguaaauggcguuguaagauugcucaccaaaccaugggacguucuuccaacagucacucaaauggcgaugacggauaccacaccuuuuggucaacagcgggucuucaaagagaaaguugauacuagaacacaagaaccaaaagaaggaacuaagaaacucaugaaaauaacggcagaauggcuauggaaagagcuggguaagaagaaaacuccaaggaugugcacaagggaagaauuuauaagaaaaguaagaucaaaugcagcguuaggagccauauucacggaugaaaauaaauggaaaucagcacgagaagcaguagaagacagucgauucugggaguuaguugacaaagagcguaauuuacauuuagaagguaaaugcgaaacuugcguauacaauaugauggguaaacgagagaagaaacuaggugaauuugggaaagcaaaaggcagccgagccauaugguacauguggcuaggcgcgagauucuuggaauuugaagcgcuaggguuccugaacgaagaccacugguucaguagggagaacucguuaagcggaguagaaggggaagggcuccacaagcuaggcuacauauuaagagauguuaguaagaaagagggaggcgccauguacgcagaugauacagcgggcugggauacaagaauuacauuagaagacuuaaagaaugaggaaaugguaacaaaucauauggagggagaacauaagaaguuagcugaagcuaucuuuaagcucacauaucaaaacaaagucguuaggguccaacgaccaaccccgagaggaacaguaauggauauaauaagcagaagagaccagagagguaguggacagguaggaaccuauggguuaaacacauucacgaauauggaggcacaacugauacggcaaauggaaggugaaggcguauuugaaaacauccagcaccuaacggugacugaagaagucgcuguacagaauugguuagcgagaguaggaagggaaagguuaaguagaauggcaaucagcggugacgauuguguaguaaagcccuuagacgacagauucgcuaacgcacuuacagcauuaaacgacauggguaagauucgaaaagacauccaacaaugggaaccguccaagggauggaaugauuggacucaagucccauuuuguagccaucauuuucacgaacucaucaugaaggacggaagaguccuagugguaccuugccgaaaccaagaugagcugauuggccgagcaagaaucagucaaggugccgguuggucauugagagaaacagcaugucuuggaaaaucauaugcccaaauguggucgcuaauguauuuccauagaagagaccuaagacucgccgcuaacgcaauaugcucggcaguaccuagucauuggguucccacgucuagaacaacauggucuauccacgccaagcacgaauggaugacuacagaggacaugcuaacagucuggaauagaguuuggauuagagaaaauccauggauggaagauaaaacacccguagagucuugggaagaaauuccauacuuaggcaaacgugaagaucaauggugcgguucauuaauugggcucacgagccgagcgacuugggcgaaaaauauacaagcugcgauuaaucaaguaaggucgcucauuggaaaugaagaguauacagauuacaugccgucuaugaaaagauuuagaagagaagaagaggaagcuggaguacucugguga

SEQ ID NO: 22333 - RNA, 9876 nt, Artificial Sequence
  derived and/or modified CDS sequence (opt6) from DENV-2__FJ639702__SS-prME
acugcagggguaauaauaauguuaauuccaacugcaauggcuuuccaccuuaccacccgaaacggagaaccucauaugauaguagguagacaagaaaaagggaaaucccuccuuuucaaaacugaagacgguguuaauaugugcacauuaauggcaauagauuugggcgaauuaugcgaagauacaauuaccuauaaauguccuuuauuaaggcaaaaugaaccagaggauauagauuguugguguaauucgacaucaacgugggucacauaugggacuugcacgaccacaggugaacacaggcgcgagaaaagaagcguugccuuaguuccccauguagggaugggacuagaaacaagaaccgaaacauggauguccagugagggagcauggaaacaugugcaacguauugagacauggauccuucggcacccagguuucacaauuauggcagcuauucuagcauacacgauaggaacaacgcacuuccaaagggcauuaauauucauucuacuuacugcuguagcuccuucuaugaccaugagaugcauagguauauccaaccgagacuucguagaaggcgucucgggaggaucauggguugacauuguucuggaacacgguucauguguaacaacuauggccaaaaauaaaccaacacuggauuucgaauugauaaaaacagaagcaaaagagccagcuacuuuaagaaaauacugcauagaagcuaaacugacaaauacaacgaccgaaucucgauguccgacucaaggagaacccuccuugaacgaagaacaagauaaaagguuuguuuguaaacacucaaugguugacagagguuggggaaauggaugugguuuauucggaaaaggggguauaguuacaugcgcaauguuuacauguaagaaaaauauggaagguaaaaucguacaaccugaaaacuuagaguacacaauaguaauuacuccacacucgggagaagaacaugcgguaggaaacgauacagguaaacauggcaaagaaauaaaaauaacgccucagucuaguucaaccgaagcagaacuaacuggcuauggaacuguaacuauggaaugcuccccuagaacaggacuagauuuuaaugaaauggugcuacuacaaauggaggauaaagcaugguuagugcacaggcaaugguuucuugauuuaccacuuccguggcuacccggugcagauacacaaggaucaaauuggauacaaaaagagacguuaguaaccuucaaaaacccucacgcgaagaaacaagauguugucguacuaggcucucaggagggcgccaugcauaccgcguuaacgggcgccacugagauacaaaugucaaguggaaauuugcuuuuuacuggacauuuaaaauguagguuaagaauggauaaacugcaacuuaaggggaugucauauucaaugugcacugguaaauuuaaaauaguuaaggaaaucgcugaaacacaacacgguacuauuguaauaagaguccaauacgaaggcgauggaucacccuguaaaauuccauucgaaauaauggaccuugagaaaaggcauguuuuggguagauuaauuacuguuaacccaauagucacagaaaaagauucaccagugaauauugaggccgaaccucccuuuggugauuccuauauaauuauaggaguagaacccggacaacuuaaauuaaacugguuuaagaaagggagcagcauagggcaaauguuugaaacaacaaugcgaggcgcaaaacgaauggcaauauugggcgacacagcgugggauuuuggcagucucggcggaguauucacaucuaugggaaaagcacuccaucagguauucggugcaauauauggugcggcuuuuuccgggguuucuuggaccaugaaaauacugauagguguaauuauuacauggauaggcaugaacuccagaucaacaucacuuaguguuagcuugguuuuaguaggugugauaacauuauauuuaggugcgaugguacaggcggacucugguugugucguuaguuggaaaaauaaagaacuaaaguguggaucagguaucuuuauaacagauaauguccauacauggacagaacaauacaaauuucagccagaaagcccgucaaaguuggcgucugcaauacaaaaagcccaugaagagggcaucugugggauucggagcguaacaagacuugagaacuuaauguggaaacagauaacaccugagcuaaaucauauucugagugagaacgaagugaaauugacgauaaugaccggcgauaucaaaggcauuaugcaagccggaaaaaggucauugaggccacagccaacagaacucaaauacaguuggaaaacuugggguaaggccaagaugcuguccacagaaucacacaaucaaaccuuucucauagauggaccagaaacagcggaauguccuaauaccaaccgugcuuggaacagccuugaaguugaggauuacggcuuugguguauucaccacaaacauaugguuaaagcuacgugaaaaacaagacguuuucugcgacucaaaacuaaugucugcugcgauaaaagacaaccgagccguacaugcagacaugggauauuggauagaauccgcacuaaacgacacauggaaaauggagaaagcaaguuuuauagaaguaaagucaugucauuggccaaaaagucauacuuuauggucuaacggaguucuugagucggaaaugaucauacccaaaaguuucgcaggcccgguaucucaacauaauuauagaccuggcuacuauacucaaacugcagguccauggcaucuagggaaacucgaaauggauuucgauuucugugaaggaacaacuguagugguuacggaggacuguggaaaucggggcccuucgcuucguacgacuacagcgagcggaaaauuaaucacagaauggugcuguagaagcugcacgcugcccccauuacgguauagaggagaggaugguuguugguaugguauggagauaagaccguuaaaagaaaaggaagaaaauuuagucaacucacuuguuacagccggccacggacagauugacaauuuuagcuuggggguuuugggaauggcguuauuccucgaagaaaugcuuagaacuagagugggaacuaaacacgcgauacucuuaguagcugugagucugguaacucuuauuacaggcaauaugucauuccgugaccuuggacgcgucaugguuauggugggcgccaccaugacagaugacauaggcaugggaguaaccuaucuagcauuacuugcugcauucaaagugagaccaacauuugcagcagggcuuuuguuaaggaaauugacaucgaaagagcuuaugauggcaacgauaggaauagcccuuuuaucgcagaguacaauucccgaaacuauacuggaauuaacagacgcauuagccuuagguaugaugguacuuaagauaguaagaaauauggagaaauaccagcuugcgguaaccauaauggccaucaguuguguuccuaaugcaguaauacuacaaaaugcguggaaagucucaugcacaauacuagcagccguauccguuaguccucuguugcuuacgaguucacaacaaaaagccgauuggauuccacuagcguuaacuaucaagggacuaaacccaaccgcuaucuuucugacuacacuuagucgaaccucuaagaaacguaguuggccccuuaacgaagcaauuauggcagucgguaugguuaguauccuggcuagcagucuucuuaaaaacgacauaccaaugacaggaccgcuaguagcagggggucuuuuaacaguuugcuauguacuaacaggcagauccgcagaucucgagcuggaacgggcgacggaugugaaaugggaagaccaagcagagauaucgggaagcucucccauccugucuaucaccauaagugaggauggaucgaugaguaucaaaaaugaggaagaagaacagacacugacgauauuaaucagaacaggcuugcuaguaauaucagguuuauuuccgguuucaaucccuauuaccgcagcagcaugguauuugugggaaguuaagaaacaaagggccgguguauugugggauguuccgucaccaccuccugucggaaaagcggaauuagaggauggugcuuauagaauaaagcagaagggaauacucgguuauucgcaaauuggggccggaguguauaaggaagggacauuucauacuauguggcacguuacuagaggggcaguauugaugcauagagguaaacgaauagaaccaaguugggcugaugucaagaaagaccucauuucauaugggggcggcuggaaacuagaaggugaauggaaagaaggagaagaaguccaaguauuagcguuggaacccgguaaaaacccaagagcaguccaaacuaaacccggucucuuuaagacgaacacaggcacgaucggugcagucucauuagauuuuucuccaggcacuucuggaucgccgauuguugaccguaaaggaaaggugguugguuuauacggaaauggcguaguaacacgaucaggagcguacguaagcgcgaucgcacaaacugaaaaaucuauugaagauaauccagagauugaggacgacauuuuucggaagaaaagacuaacaauuauggauuuacauccaggagcuggcaaaacgaagagauaccuaccagcgauagucagagaggcgauaaaacgagggcuccgcacacuaauacuagcucccacuagaguaguagcagcagagauggaagaagcgcugaggggacugcccauacgauaucaaacuccugcuauccgagcagaacacacaggaagagaaaucguagacuugaugugucaugcuacauucacuaugcgcuuauugaguccaguacgcgugccuaauuauaaucuuaucauaauggaugaagcacacuucacggauccagcuucaauugcugcucgaggauauauaucaacacgaguagaaaugggagaagccgcaggcaucuucaugacggcgacgccgcccgggaguaaggauccauuuccgcaaaguaaugcaccaauaauggaugaagagagagaaauaccagagagauccuggaacucgggucaugagugggucacagacuucaaaggaaagacagucugguuugugccgucgauaaaagcagguaaugauauugccgcuuguuuacguaaaaaugggaagaaagugauacaguuaaguagaaaaacauuugauucagaauaugucaaaacgcgaacuaaugacugggacuuugucguuacuacggauauaucagaaaugggagcaaauuuuaaagcagaacgcgugauugaucccagacguugcaugaaaccaguuauccuaacagacggcgaagaaagagucauauuggcagguccaaugccagucacacauuccagcgcagcccaacggagagguagaauaggaagaaaucccaaaaacgaaaacgaccaguacauauauaugggugaaccauuagaaaacgacgaggauugcgcgcauuggaaagaggccaaaaugcuauuagauaauauuaauacgcccgaggguauaauaccuaguauguucgaaccugaacgggaaaaaguugacgcaaucgauggagaauauagacuacgcggagaagcacguaagacguuuguagaccuuaugcggagaggggauuuaccugugugguuggcauacagagucgcagcagaagggauaaacuacgcggauaggagaugguguuucgacggggugaaaaauaaucaaauucuugaagagaacguagaaguagagauauggacaaaggagggggagaggaagaaauuaaaaccccgcuggcuagaugcaagaauauauagugacccauuagcauugaaagaguucaaggaauuugccgcuggucgaaaaucucuaaccuuaaauuuaauaacggagaugggaagguuaccaacauucaugacacaaaaagcuagggaugcauuagauaaucuagccguucuacacaccgccgaagcaggaggucgggcauauaaucaugcauugagcgaacucccagaaacccuugaaaccuuauuauugcucaccuuauuagcaacaguuacaggcggaguguuucuauucuuaaugaguggaaagggagucggaaaaaugacauugggaauguguuguauaaucacugcgagcauauuacuaugguaugcucagauucagccgcacuggauugcggcaaguauuaucuuagaauuuuuccuuauaguucucuuaauuccggagccagaaaaacaaaggaccccucaagacaaccaauugacauauguugugaucgccauccuaacugugguagcagccacgauggcuaaugaaaugggauuccuagagaaaacaaagaaagaucuaggguuaggauccauagcuacacaggaaccagaaaguaauauacuggacauagauuuacgcccagcaucagcuuggacccuauaugcagucgcuacuaccuucguaaccccuauguuacgacacucaauagaaaacaguaguguuaacguaagccucacggcgauugcuaaucaggcaacagucuugaugggacuaggaaaaggcuggccuuugucaaaaauggacauaggcguaccauuauuagcaauaggaugcuacucacaagucaauccugucacucugaccgcugcccuacuauugcuuguagcccauuacgccaucauaggaccagguuugcaggcaaaagcaaccagagaggcccagaaaagggcugcggccggaauaaugaagaauccaaccgucgacggcauaaccguaauagaccuagaccccaucccauaugaccccaaguucgaaaaacaauuaggccaaguaaugcuccuaauacuaugcguaacucagguuuuaaugaugcguacgaccugggcacugugcgaagcccugacacuagcuaccgguccaauaagcacccuuugggaagguaauccaggacgauucuggaacacuacgauugcuguuuccauggcaaauauuuuuaggggcucguaccuagccggagcaggguuacucuucagcauuaugaaaaacacuacgaacacacgaagaggaacgggaaauaucggagaaacuuuaggggaaaaauggaaaucuagguuaaacgcacuaggaaaaucagaauuucaaauauauaagaaaucaggaauacaagaaguagauagaacguuggcuaaagagggaauuaagcguggggaaacagaucaucacgcaguaagucgugguagugcaaaacuaaggugguuuguagaaagaaauauggucacacccgagggaaaaguaguagaucuaggauguggucguggaggcuggucauauuacuguggaggucuuaaaaacguuaaagaaguaaaaggccuaacaaagggcggaccaggccaugaagaaccaaucccaauguccacuuacggauggaaccuaguuagguuacaaaguggaguggauguguucuuuacaccgccugaaaaaugcgauacgcuauuaugugacauaggagagaguucaccgaauccgacaaucgaagcgggcagaaccuuaagaguccugaguuuagucgaaaauugguuaaacaaugacacucaauuuugcauaaaaguuuuaaaccccuacaugcccaguguaauagagaaaauggaaaccuuacaaaggaaguacggaggcgcauuagugaggaacccacuuaguaggaacucaacgcacgaaauguacugggucagcaacgcaacagguaauauugucucaagcguaaacaugauaucuaggauguuaaucaauagguuuacuaugaaacauaaaaaggccacauacgaaccggacguugaccuggguucugggacaagaaauauuggcauugaaagugaaauacccaacuuagauauaauagguaaaagaaucgagaaaauaaaacaggaacaugaaacaaguuggcacuacgaccaagaccauccauauaaaaccugggcauaccauggcucuuaugaaaccaaacaaacuggcucggcaagcucaaugguaaauggggucguucgauugcuuacaaaaccgugggauguuguaccuaugguaacacaaauggcaaugacugacaccacacccuuuggucaacaaaggguuuuuaaggagaaagucgacacccguacacaggaaccuaaggaaggaacgaagaaacucaugaaaauaacagccgaauggcucuggaaagagcuagggaagaagaaaacaccuaggauguguacucgcgaagaauuuacaaggaagguacggucaaacgcggcacuaggugcaauauucacggaugaaaauaaauggaaaucugcccgagaagcaguggaggauucgcgauuuugggaauuaguagacaaggaaagaaaucuacaccuagaaggaaagugcgaaacuugcguauacaacaugauggguaaaagagaaaagaaacuuggggaauuugguaaagcaaaaggaucuagagcaauaugguauaugugguugggugcaagauuuuuagaguuugaagcucuaggauuuuugaaugaagaccauugguuuucccgugaaaacucguuaagcggcguagaaggagagggauuacacaaacuaggguauauacugagagacguugguaagaaagaaggaggagcaauguaugccgaugauacugcuggaugggacacgcguauuacuuuagaagacuugaaaaacgaagagauggucacgaaccauauggagggagaacauaagaaauuagcagaagcuauauuuaaauuaacauaccaaaauaaagucguccgcguacaaagaccaacaccaaggggaacggugauggacauuauuucaaggagggaccagagagggaguggacaaguaggaacuuauggauuaaauaccuuuacgaauauggaagcccaauuaauacgacaaauggaaggagaagguaucuuuaagagcauucaacauuuaacugcgacagaagaaaucgccgugcaaaacugguuagcuagagugggaagagagcgacugucacgaauggcaaucaguggcgacgauugcguaguuaaaccucuugacgaccgauucgcuucagcucuaacugcacuaaaugacauggggaagguccggaaagacauccagcaaugggagccgucuagaggauggaaugauuggacacagguaccauuuuguucacaucacuuucacgagcucauaaugaaagauggacggguucuuguagucccaugccgcaaccaagacgaauugaucggccgagcacgaauaucacaaggagccggguggucacuaaaggaaacugcaugccucgguaaaucuuaugcucagauguggucacuaauguauuuucauagaagggaucuacgccuggcugcgaacgcaauuuguucugcaguuccaagccauuggguaccaacuagcaggacaacauggucgauacaugcaaaacaugaauggaugacuacugaggauauguugaccguauggaaccgaguauggauacaggaaaaucccuggauggaagauaaaacuccaguagagucgugggaagaagugccuuaucuagggaagcgagaagaccagugguguggcucucuuauagguuuaacaucaagagcaacuugggcuaaaaacauucagacagcaauuaaucaagucaggucccuaaucggcaaugaagaauacaccgauuacaugccgagcaugaaacgauuucgcagagaagaagaagaagcgggaguacuaugguaa

SEQ ID NO: 22334 - RNA, 9876 nt, Artificial Sequence
  derived and/or modified CDS sequence (opt6) from DENV-2__GQ868621__SS-prME
agcgcaggcaugauuauuauguuaaucccaacagucauggccuuucaccuuaccacccgaaacggugagccacauaugauaguaggaauacaagaaaaaggaaaaucucugcuuuuuaaaacagaagaugguguaaauaugugcacgcucauggcgauggaccucggagaauuaugcgaagauacuaucaccuacaagugcccacuguugcgccaaaaugaacccgaagacaucgauuguugguguaauucuaccaguaccugggugacuuaugguacauguacaacaacaggagagcaucggagagagaaaagguccguggcacuggugccacauguaggaauggguuuggaaaccagaacggaaacauggaugagcucagaaggggcauggaaacaugcacaaagaauagaaacauggaucuuaagacaucccggcuuuacuauaauggcagcaauuuuggccuacacaaucggaacuacucacuuucaaagaguguuaauuuuuauucuccugacagccguggcuccaagcaugacuaugagauguauagguauaucuaaccgggauuucgucgaaggcguuucaggugguuccuggguagacauuguuuuagaacaugguucuugcguaacaacaauggcgaaaaauaaaccuacucuagauuuugaauugauuaaaacugaagccaaacagccagccacacuacgcaaguauugcaucgaggccaaacucacaaacacaacaaccgaauccagauguccuacucaaggugaacccucacucaaagaagaacaagauaaaagauuugucugcaaacauucaaugguagaccgagguugggguaaugguuguggauuauucgguaaagguggcauuguaacuugcgcgauguuuacuugcaagaaaaacauggagggaaaaauaguucagccagagaacuuagaauauacaauaguagugacaccucauagcggugaagaacaugcuguggguaaugauaccgggaagcacggaaaagaaaucaaagucacaccacaaagcaguauuacugaagcugaauuaaccgguuaugggaccgucaccauggaauguucaccucguacuggccuagauuuuaaugaaaugguacuauuacaaauggaaaauaaggccuggcuaguacauaggcagugguuuuuagauuuaccucuaccguggcucccaggugccgauaaacaagagucuaauuggauucaaaaagaaacucuaguaacauuuaaaaauccacaugcaaaaaaacaagacguaguagugcuugggagccaagagggugcaaugcauacagcauugacgggcgcgacggaaauucagauguccucuggaaacuuacuuuuuacagggcacuugaaaugccgccuacgcauggacaaacuacaauuaaagggaaugaguuauaguaugugcaccggcaaauuuaaaguagugaaggaaauagcagaaacacagcaugguacaauaguuaucagaguacaauacgagggagaugggaguccauguaagauaccguucgagaucauggaccuugaaaagagauacauuuuaggaagauugauaaccguuaauccaaucguuacagagaaggauaguccagucaacauagaagcugaaccgccauuuggggacaguuacauaauaauaggaguagaacccggacaacuuaaauugaauugguucaagaaagguaguaguaucggucaaauguuugaaacaaccaugagaggggcuaaaagaauggcaauauugggugacacagcaugggauuucggaucucucggaggaguauuuaccucgauagguaaagcguuacaucagguuuucggugcaauuuauggcgcggcauucaguggaguuucguggaccaugaaaauuuuaauaggaguaaucauaaccuggauuggcaugaauucacguuccacuagucuuucugucucacucguguuaguagguauaguuacacuguaccuuggagugaugguacaggcugacucgggauguguagucucuuggaaaaauaaagaacuaaaaugugguucagggauauuuauaacugauaauguucacacauggacugaacaauauaaauuucaaccagaaucaccaucaaagcuugcaucugcuauacagaaggcacaagaggaggguauaugugggauacgaucugugacgcgauuggaaaauuugauguggaagcaaauaacuccagaauugaaccacaucuuagcagaaaaugagguaaaauuaacuauaaugacaggagauauuaaaggaauaaugcaggccgguaaaagaucuuugcgaccacaaccuaccgagcuaaaauauagcuggaaaacaugggggaaagcgaaaaugcucucaacugaaaguuauaaccaaacauuucuuaucgauggaccggaaacagcagaauguccaaacaccaauagagcguggaauucucuugaaguagaggacuacgguuucggaguauucacuaccaacauuugguugaaauugaaagaaaaacaagacgccuucugcgauucuaaacuaaugagcgcugcaauaaaagauaaccgugcaguacaugcggauauggguuauuggaucgagagugccuuaaacgacacauggaaaauugagaaggcaucauuuauugaaguaaagaauugccauuggccaaaaagucacacucuuuggagcaaugguguuuuggaaucugagaugaucauacccaaaaaucuagcuggccccguaucacaacauaacuaucgcccgggguaucacacacagaucgccgggccuuggcaccuugggaagcucgaaauggacuuugacuucugugauggaacaacuguuauagucacagaagauuguggaaaccgcggacccagcuuaaggacaacaacagccagcgguaaacucauaaccgagugguguugcaggucuuguaccuugccaccauugcgauacagaggagaagauggauguugguacggaauggaaauaaggccccuuaaggaaaaggaagaaaacuuaguuaauucuuuaguaaccgcaggucauggucagguugauaacuuuucucuaggaguauuaggaauggcauuguuuuuagaagagaugcugagaacacgggucggcaccaaacaugcaauauuauuaguagcgguaaguuucaugacuuugaucacaggaaacaugaguuucaaagauuuagguagaguagugguaaugguaggagcaaccauggcagacgauauaggaaugggcguaacuuaucuagccuuacuagcagcuuuuaaaguaagaccaacauuugcagcagggcuauuacugcguaaauuaacgucaaaagaacuaaugaugacaacaaucggaauaguacuauugagucagaguacuauacccgaaacaguauuagaauuaacagaugccuuggcacuaggaaugaugguccucaaaaucguucgcaauauggaaaaauaucaacucgcugucacaaucauggccauucugugcgugcccaacgcuguaaucuuacagaaugcauggaaaguaucauguaccauacuagcaguaguaagcgugaguccuuuauuguugacuagcagucaacagaaaacugacuggaucccacucgcacugacaaucaaaggucuaaauccaaccgcgauuuuucucacuacacucucgcggacgaauaaaaagagaagcuggccccuuaacgaagcaauaauggcuguaggaauggugucaauauuggccucuagucuucuaaaaaacgauaucccuaugaccgguccuuuagucgcaggugguuuauuaaccguuuguuauguccugacgggucgaucggccgacuuagaacuggaacgggcaacggaugucaaaugggaagaccaagcagagauaaguggaucaagcccaauucuaucaauaacaauuagugaagauggaucaaugaguauaaaaaaugaagaggaggaacacacacugaccauacuuauucgcacuggucuucucguuaucagcggucuauucccaaucucaauacccaucacugcggccgcaugguauuugugggaaguuaaaaagcaaagagcagggguauuaugggaugugccauccccaccgccuaugggaaaggccgaacuugaagauggagcauauagaaucaagcaaaaaggaauacuaggcuauagucaaauaggagcggguguauauaaagagggaacuuuucauaccauguggcauguuacacggggggcaguacugaugcauaaggguaaaaggauugagccaucaugggcagauguaaaaaaagacuuaauaucauauggaggcgguuggaaacuagaaggagaauggaaggagggagaagagguacagguucuggcuuuggaacccggaaaaaacccaagggccgugcaaacaaaaccaggacuauuuaaaacgaauacaggaacgauaggagcaguuaguuuggauuuuaguccgggcacaaguggaucuccuauuauagauaaaaaaggcaaaguuguaggacuuuauggcaacggaguggugacgagaaguggcgcauaugugucugcgauugcccagaccgaaaaauccaucgaagauaaucccgaaaucgaagacgacauauuuaggaaaagaaggcucacaauuauggauuugcauccgggagccgguaaaacgaaacguuacuuaccagcuaucgugcgugaggcuauaaaaagaggucuacgaacccuaauuuuagcaccuacuaggguaguagcagccgaaauggaagaagcguugcgaggacucccuauuagguaccaaacuccugcaauaagggcugaacauacaggaagggaaauaguggaccugaugugucacgcuacauucaccaugagacuucucagcccaguacggguuccaaacuacaaucugauuauaauggaugaggcccacuucaccgacccugccucuauagcagcuagagguuauauaagcacaagaguugaaaugggugaagccgcagggauauuuaugaccgcaacaccaccuggaagcagagauccguucccgcaaucuaaugcacccauaauagaugaagaaagagaaaucccugaacggucuuggaacagcgggcaugaaugggucacugauuuuaaggggaagacaguaugguuuguucccucaauaaaagcuggaaacgauauagcagcuugccuucgcaaaaauggcaaaaaagugauacaauugucaaggaagacuuuugauucagaauaugugaagaccagaacuaacgacugggauuuuguuguuacaacggauauaagcgaaaugggcgcaaauuuuaaggcugaaagaguuauugacccaagacgaugcaugaaaccaguuauccuuacugauggugaagaacgcgugauacucgcuggccccaugccugucacucacagcucagcugcucaaagacgugggagaauaggacgcaacccgaaaaacgaaaacgaccaauacaucuacaugggugaaccacucgagaaugacgaagacugugcacacuggaaagaagcaaaaaugcuuuuggacaauauaaacacaccagagggaaucauaccuucaauguucgaaccagaaagggaaaaggucgaugcaauagacggagaauacagacuacgaggcgaagcgagaaagaccuucguugaucuuaugcgacgcggagacuuaccgguuuggcuagccuacaaaguagcagccgaagguaucaauuacgcugacagacgauggugcuuugauggcauuaagaacaaccaaauauuggaagagaacguggaaguugagauauggaccaaagaaggagaacggaagaaacucaaaccucgauggcuagacgcgagaauuuacucagacccacuugcacuuaaagaauucaaagaauuugcugcugggaggaagucccucacuuuaaaccuaaucacagaaauggguagacugccuacauucaugacccagaaaacgagagaugcacuagacaaccuugcgguccuacauacagcagaggcugggggacgugcuuacaaucacgccuuaucugaacuuccagaaacuuuagaaacucuauuauuauuaacgcuacuagcaacugugacugggggcaucuuccuguuuuuaaugucagggagggggaucggaaaaaugacucuagggaugugcuguauaauuacagcuaguauauuacuaugguaugcccaaauccaaccccacuggauagcagcuucuauuaucuuagaauucuuucugauuguguuacuuaucccagagccggagaagcaaaggacaccacaagauaaucaacuuacuuauguaguaauagcuauauuaaccgucguagcggcaaccauggcaaaugaaaugggauuuuuggaaaaaacgaagaaagaucucggauuagguucaauagcaacacaacaaccagaguccaauaucuuagauauagaucugcguccugccucagcauggacacuuuaugcuguagcgacaacuuuuguuaccccaauguuaaggcacucaaucgaaaacuccagcgugaauguaaguuuaacagcgauugcuaaucaagcaacgguguuaaugggacucgguaaagguuggccacuaucaaaaauggauauaggaguaccccuuuuagccauaggcuguuauucucaagucaacccgaucaccuuaacugcggcacuacugcuauuaguugcacauuaugccauuauaggcccuggacuccaagccaaagcaacacgagaggcucagaagagagccgcagcggggauaaugaaaaacccaaccgucgacggcauaacaguaauagaucuagacccaauaccguacgauccgaaguuugaaaaacaauugggucaaguaauguuacugauacucuguguaacacaaguacuuaugaugaggacaacaugggcgcuaugugaagcguugacauuagcgacaggaccaaucucgacguuaugggaaggaaacccgggacguuuuuggaauacuacuauagccguaagcauggcuaacauauucagagguagcuaccuggcgggcgcagguuuguuauucuccaucaugaagaacacaacuaacacacguagagggacagggaacauuggagagacauuaggggagaaauggaaaagccggcuuaacgcacuggguaagagugaguuccaaauauauaaaaaaucagggauacaggaaguagaccgaacuuuagcuaaagaagggauuaaacgcggggaaacagaccaccacgcgguuucccguggaucagcaaaacuucgaugguuugucgagagaaauauggucacuccagaaggaaaagugguugaccuuggauguggaaggggugguuggucuuauuacuguggaggacuaaaaaauguacgugaggugaagggacuuacuaaaggaggaccaggucaugaagaacccauuccuauguccacauaugguuggaaucuuguaagacuccaaaguggaguugauguuuucuucauaccaccggaaaaaugcgauacacuacucugcgauauaggggaaaguuccccaaauccaaccguugaagcagguaggacuuuaagaguacuuaauuuaguggagaauuggcuuaauaacaauacgcaauuuugcaucaaagucuuaaauccauauaugccaucuguaauagaaaaaauggaagcacuacaacgcaaauaugggggggcguuaguaagaaauccacuaucaagaaauucuacacacgagauguauuggguuagcaaugcaucagguaauauuguaaguucagucaauaugauaucaagaauguuaauaaaucgauucacaaugagacauaaaaaagcuaccuacgagccagauguugauuugggaagcggaacaaggaacauaggaaucgaguccgaaguuccuaaucuugauauaauaggaaaaaggauugagaaaauaaaacaggaacaugaaacaaguuggcauuaugaccaagaucauccauacaaaacgugggccuaucauggaaguuaugaaacuaaacagacaggcucagcaucuagcauggugaauggaguaguucgguuacuuaccaagccuugggauguccuaccaacagucacccagauggcuaugacagauaccacaccauuuggacagcaaagaguauuuaaagaaaaaguagauacaagaacacaggaacccaaggaaggaaccaaaaaauuaaugaaaauaacugcagaguggcuguggaaagaauuagguaagaaaaaaaccccuagaauguguacucgagaagaauuuaccagaaaagugcgaaguaacgcggcacucggagcuauauucaccgaugaaaauaaauggaagucagcgagagaagcaguagaagauaguagguucugggaacuaguagacaaagaaagaaaccuucaccuggaagguaaaugugagacaugcgucuauaacaugauggggaaaagagaaaagaaauuaggugaauuuggaaaggcaaaaggaucacgugcaaucugguauauguggcuaggagcaagauucuuagaauucgaagcuuuaggcuuccuaaaugaagaccacugguuuucucgcgagaauuccuugucaggcguagagggagaggguuuacacaaauuggguuauauucugagagaugugagcaagaaagaaggcggagccauguaugccgaugauaccgcaggcugggauacaagaauuacauuagaagaccuaaaaaaugaagagaugguuacgaaucacauggaaggagaacacaaaaaauuggcagaggccauauucaaauugaccuaucagaauaaaguagugagaguucagcggccaacuccacguggaacaguuauggauauaauaucaagaagggaccagcgggguagugggcaagugggaacguauggucucaauacauuuacaaacauggaagcucaacuuauccgucaaauggaaggagagggaguuuuuaaaaacauccaacacuugacugucaccgaggagguggcuguucaaaauuggcuugcccgcguagggcgugaacguuuaucgagaauggcuauaaguggcgacgauugcguggucaaaccacuagacgauagguucgcaaaugcacuuacagcguugaaugauauggggaaaaucagaaaagacauucaacaaugggagccauccaaggguuggaaugauuggacucaagucccuuuuuguagucaucacuuccaugaauugauaaugaaagaugggcgcgugcuaguugugccuugucgaaaucaggacgagcuaauagggagagcacgaauuucgcaaggugcugguuggucauugcgugaaacggccuguuugggaaaaaguuaugcacagauguggagcuuaauguauuuccaccgcagagacuugaggcuugcagcgaaugcaauuugcucagcuguaccuucgcacuggguucccaccaguaggacgacauggucgauacacgcaaaacaugaauggaugacgaccgaggauauguugacuguguggaaucggguauggauacgagaaaauccauggauggaagauaaaacaccgguagaaucuugggaagaaauaccauaucuuggcaaaagagaagaccaauggugcgguagccuuauaggguuaacaagccgugcgacaugggccaaaaauauacaggcugcuauaaaucaaguaagaucuuugauaggaaacgaagaauacacugacuauaugccaucgaugaaacguuuccgaagggaggaagaagaggcaggaguacuaugguaa

SEQ ID NO: 22335 - RNA, 9876 nt, Artificial Sequence
  derived and/or modified CDS sequence (opt6) from DENV-2__FJ639704__SS-prME
agugcuggaaugauaauaauguuaauuccuaccguuguagcauuucauuugacuacccguaauggagaaccacauaugauuguugguauacaagaaaaaggcaaaucguuacucuuuaaaacugaagacggaguaaacauguguacacuuauggcaauggaucucggagaacuuugcgaagauacaauaacauacaaaugcccuuuauugcgacaaaacgaaccagaagacauagauuguugguguaauucgacgucaaccuggguaacauaugguacuugcacgacuacaggcgaacaucgacgagagaaaagaaguguagcccuagucccucauguagggaugggucuagaaacaaggaccgaaacauggaugucuucagaaggagcauggaaacaugcacaacgaauagaaacauggauacuacgacacccagguuuuacuauaauggcagcaauauuggcauauacuauugggacuacgcacuuucaacgugcuuugauauucauacuacuaacagcaguagccccaucaaugaccaugagauguauugggaucaguaaccgugacuucguggaaggcgucucuggugggucauggguagacauaguauuagaacacggaucguguguaacaaccauggcgaaaaauaaaccaacccucgauuucgaacuaauaaaaacagaggccaaacaaccggccacacucagaaaauauugcauugaagcuaaacuaacuaacaccacuaccgaaucgcgaugcccgacucaaggcgaaccgucauugaaagaggaacaggauaaaagguucguaugcaaacacucaaugguugaccggggauggggaaauggcugcggacuuuucgguaaagggggcauaguuacuugcgcaauguucacgugcaagaaaaacauggaggguaaaauaguacagccggaaaacuuagaauacacuauuguagugacaccucauagcggagaggagcacgcaguuggaaaugacacaggaaaacauggaaaagaaauaaaaguaacuccacaaucuaguaucacagaagccgaacuuaccggguacgguaccguaacgauggaaugcagcccaagaacugggcucgacuuuaaugagauggucuuacuacaaauggaaaauaaggcuuggcuuguacaucgacaaugguucuuagaucuaccuuuaccuugguuaccgggugcugacaaacaagaaagcaauuggauucaaaaagaaacucuaguaacauuuaagaacccgcacgccaagaaacaggacguuguggucuuagggucccaggaaggagcuaugcacaccgcccuuacaggagcaaccgaaauccagaugaguagcggaaaucuauuguuuacuggccaccuaaaguguaggcuccguauggacaaacuccaguuaaagggaauguccuacagcauguguacuggcaaauuuaaaguuguaaaggaaauugccgaaacacaacacgguacuauagugauaaggguacaauaugagggagauggguccccuugcaagaucccuuucgaaaucauggauuuagagaaaagauauguucuagguagauuaaucacugucaacccaauagucacagaaaaagauagucccguuaauaucgaggcggagccgccuuuuggugauagcuauaucauaaucggcgucgagcccgggcaacucaaacuuaauugguuuaagaaagggagcaguaucgggcaaauguuugagacaacuaugcguggggcgaaacgaauggcuauucuuggagauacagcaugggauuuuggcucccuagguggaguauuuacaaguauagguaaagcacuucaccaaguuuucggcgcaauauauggugcagcauucucugguguaagcuggacgaugaagauacugauagggguaauaauuacauggauagguaugaauagcagaucaacaucuuugaguguaagccuagugcuuguagggauaguuacccuauauuuaggcguaaugguucaagcagauucaggaugcguuguuucauggaagaacaaagaacugaaaugcgguucuggcauuuuuauuacagacaauguacacaccuggacagagcaauauaaauuucaaccagagucaccauccaaauuagcaagugcaauacaaaaagcccaggaagaaggaauaugugggauacgaucagucacgagacuagaaaaucucauguggaaacaaauaacgccugaauuaaaucauauauuagccgagaaugaaguaaaacugaccauaaugacgggagauauaaaagggauaaugcaagcagguaaacgaagucucagaccgcaaccuacagaguuaaaguacucauggaaaaccuggggcaaaaccaaaauguuaaguacagaaucguacaaccaaacuuucuuaauugacggucccgaaaccacggaguguccaaauacuaauagggcauggaacucucuggaagucgaggauuauggauuugguguauuuacuacuaauauuuggcucaaauugaaggaaaaacaagaugcauucugugauucaaaacuaaugucugcagccauaaaggacaaucgggcgguacacgcugauaugggauacuggauugaaucugcacucaacgauacuuggaaaauagagaaagcaaguuuuauagaagugaaaaacugccacuggccaaaaucucauacgcuuuggucaaauggagugcucgagucggaaaugauuauacccaaaaaucuugcuggaccugugucacaacacaacuauagaccgggguaucauacucagaucgccgguccauggcauuugggaaaacuagagauggauuucgacuuuugcgauggaacaacuguaaucgugacugaggacuguggcaaucgaggaccaucguuaagaacaaccaccgcgucaggcaaacuaaucacagaaugguguugcagaucgugcacauuaccgccauuaagguaccguggugaagaugguuguugguauggcauggaaauacggccgcuuaaagaaaaagaggaaaacuuaguaaauuccuugguuaccgcuggucacgggcaggucgauaauuuuucccuugguguucuuggaauggcauuguuccucgaagagauguuacgcaccagaguagguacgaaacacgcgauauuauugguugcuguaucauuugugacgcuaauaacaggaaacaugucauuuaaagaucuuggaagaguagucgugaugguuggagccaccauggcagaugauauugggaugggcgugacuuaucuagcucuauuagcagcauuuaagguaagaccaaccuuugcugcgggauugcugcuaagaaaacuuacuucaaaagaacucaugaugacuacaauagggaucgucuugcucucccaaucaaccauaccugagacaauauuagaacugacagacgcuuuagcgcucggaaugaugguccuuaagauaguacgaaauauggaaaaguaucaacucgcugucaccaucauggcaauuuuaugcguacccaaugcaguaauauuacaaaaugcauggaaaguuucaugcacgauuuuagcagugguaucggugaguccacuccuuuugacuucaucacaacaaaaggcggacuggauuccccuugcauuaaccauaaaaggguuaaaucccacugcaauauuuuuaacaacccuaucuagaaccaauaagaaacguaguuggccacugaaugaggcuauuauggcaguaggaaugguaucaauauuagccucgucucuauugaagaaugacauacccaugacaggaccacucguggcugggggacucuuaacagucugcuauguuuuaacaggacgaucagccgacuuagaacuggaaagagcaacagaugucaagugggaagaacaagcggagauuucuggauccucaccgauauuguccaucacaaucucugaagaugguaguaugagcaucaaaaaugaggaagaagaacagacacuaacaauauuaauacguacaggucuauuaguuauaucaggacucuuuccaauaaguaucccuauaaccgcagcagcuugguaccucugggaagucaagaaacaaagagcgggaguauuaugggauguuccaaguccaccacccauggguaaagccgaacuugaagauggugcauaucguauuaaacagaagggaauuuuaggguacagucaaauuggcgcaggcgucuacaaggagggaacuuuucacacaauguggcauguaacucggggagcaguacuuaugcacaaagguaaaaggaucgagccuucaugggcagacgugaagaaagaucuaauuagcuauggcgguggauggaaguuagaaggagaauggaaagaaggugaagaaguccaagucuuggcacucgaacccggcaaaaauccacgagcuguucaaacaaagcccggacuauucaaaaccaacacgggcacaauuggugcaguaucccuagauuucucuccaggcacgucagguucgcccauuauugauaagaaaggaaaaguuguaggauuguacggaaacggaguaguaaccaggucaggagcauaugucucagcaauugcgcaaacggaaaagaguauagaagacaacccagaaauugaagacgauaucuuucgcaaacgaaggcucacaaucauggaccuucacccaggggcaggaaaaacuaaaagguaccugccggcgaucgugagagaggcaauaaaacguggucuaagaacacuaauauuggcaccaacaagaguagucgcggcagagauggaagaggcuuugcgcggacuacccauuagauaucaaacaccagccauucgcgcagaacauaccgguagggagauaguagaccuaaugugucacgccacauuuacaaugcgucuacuaaguccgguccgugugccgaauuauaauuugauuaucauggacgaagcacacuucacagacccggcaucaauugcggcacguggauauauuucgacuaggguggaaaugggagaggcagcaggaauuuuuaugaccgcaacaccuccuggaaguagagacccguucccacaaucuaaugcucccauaauugacgaagaacgugaaaucccugagcguaguuggaauagcggacaugaauggguaacggacuucaaaggaaagacuguaugguuuguaccaaguauaaaagcaggaaaugauauugcggccugcuuaaggaaaaaugggaagaaaguuauacaacucuccagaaaaacuuuugacuccgaguauguaaaaacgagaaccaaugauugggauuuuguuguuacuacagauauuucagaaaugggcgcaaacuuuaaagcagaaagagugaucgaccccagaagauguaugaagccagucauauuaacugacggugaggaacguguaaucuuagcaggaccgaugccaguaacucauucuucagccgcucaaagaagaggccgaauuggucgaaacccaaagaaugaaaaugaucaguacauauacaugggugaaccguuagaaaacgaugaagacugugcgcauuggaaagaagcaaagauguuguuggacaacauaaacacuccagaaggaauuauaccaucaauguucgagcccgaaagagagaagguugaugcaauugauggugaauaccgacuccgaggagaagcucgcaaaacauucguagaucuuaugagaagaggcgauuuaccaguuuggcuugcauauaaagucgcagcagagggaaucaacuaugcagaucguagaugguguuuugacggaaucaaaaauaaucaaauuuuagaagaaaauguagaaguugagauuuggacgaaagaaggagaacguaagaaauuaaaaccccgaugguuagaugcuagaauuuauagcgacccauuggcgcugaaagaauuuaaagaguucgcugccggacgaaaaucgcucacacugaacuuaauaacagagaugggcaggcuuccaacuuucaugacgcaaaagacuagagacgcucuugauaacuuagccgugcuacacacugcugaagcagggggccgcgccuacaaccacgcuuuaucugaguuaccugaaacccuagaaacacuacuacucuuaacacuuuuagcaacuguaacaggagguauuuucuuguuucucaugagugguaggggaauuggaaaaaugacgcuaggcaugugcugcauuauuacagcuucgauccuacugugguacgcacagauucaaccucauuggaucgcugcuagcauaauuuuagaauuuuuccuuauaguucucuuaauucccgaaccagaaaagcaaagaacaccacaggacaaccaguugacauaugucguaauagcaauacuuacgguaguggcggcaacaauggccaaugaaaugggcuuccuugagaaaacuaagaaagaccuuggucuugguuccauugcaacacaacaaccagagaguaauauccuggacauugaucuucgaccagcaagugcauggacgcuguaugcaguagcaacgaccuuuauaacuccaaugcugagacauucgauagaaaauuccucagugaacauaagccuaacagcaauagcgaaucaggcgacagugcuuauggggcuuggaaaaggauggccauuaucaaagauggauauuggugucccucuacuugcgauagguugcuauucccaaguaaaucccauuacuuuaacugccgcuuuacuucuauuaguagcacauuacgcuauaauugguccgggacugcaagcaaaggcuacaagagaggcacagaaaagggcagcagcagguauuaugaaaaacccaacugucgauggaaucacuguaauagauuuggacccgauuccauacgauccuaaguuugagaagcaacugggucaagugaugcugcuaauacuuugugugacacaaguucuaaugaugcggacaacgugggcuuugugcgaggcacuaacgcuagcaacagggcccaucaguacuuuaugggagggaaacccaggucgauuuuggaacacaaccauagcagucucgauggcaaauauauuuagaggauccuaucuagcuggagcaggccuucucuuuucuauaaugaaaaacaccaccaauacuaggagggguacggggaauaucggcgaaacuuugggcgagaaguggaaaucacgucuaaaugccuuagguaagagugaauuucaaauauacaagaagucagguauccaagaaguggaucgaacacuugcaaaagaaggaauuaaaaggggagaaacagaucaccaugcggucuccagaggaucugcgaaacugaggugguucgucgagcgcaacaugguuacaccagaaggaaaaguaguagaccuaggguguggacguggaggguggucauauuauuguggaggucuuaagaacgugaaagaagugaaaggacugacuaaaggagggccuggacaugaagaaccaauccccaugucaacguauggguggaaucuaguacgauuacagucuggagucgauguguucuuuauaccacccgaaaagugcgacacauuacuuugugauauaggcgagagcaguccaaauccuacuguagaagcagggaggacucucagggucuuaaacuuagucgagaauuggcugaacaauaauacacaguuuuguauaaaggucuugaauccguauaugccuucagugauugagaagauggaagcauuacagagaaaguacggaggagcucuuguuagaaauccucuaagucgcaauucgacucacgaaauguauuggguaucaaaugcgucagggaauauaguaagcagugucaacaugauuagccguaugcucauaaauagguuuacuaugagacacaaaaaggcaacauaugaaccugauguggauuuagggagcgguacaaggaacauugggauagaaagugaaguaccuaaccuugauauaaucgggaaaagaauugaaaagauuaaacaagaacacgaaacaaguuggcauuacgaucaagaucacccauauaaaacaugggcauaucaugguucauaugaaacaaaacaaacuggauccgcgaguaguaugguuaauggaguaguacgacuccuaaccaaaccaugggauguacuaccaacaguaacacaaauggcuaugacugacacaaccccauuugggcaacaaagaguuuucaaagagaagguagauacucgaacacaagaacccaaggaaggaaccaagaaauuaaugaaaaucacagccgaaugguuauggaaggaacuagguaagaagaaaacuccacguaugugcacccgugaagaguuuacacgaaaaguucgaagcaaugcugcacuuggugcaauauucacggaugagaauaaauggaaaucagcaagggaggccguagaggacucaagauuuugggaacuuguggacaaagagcgaaauuuacauuuggagggcaaaugugagacuuguguuuauaacaugaugggcaaaagagagaagaaacuaggagaguucggaaaagccaaagggucccgagcaauaugguacaugugguuaggggccagguucuuagaguucgaggcgcuuggauuuuugaacgaggaccauugguucucgagagaaaauucacuaaguggcguagaaggcgaggguuugcauaaacuaggauacauuuuacgggacguaagcaagaaagaggguggagccauguaugcugaugacacagcagggugggacacacggaucacguuagaagaucugaagaacgaagagaugguuacaaaccacauggaaggagagcacaagaaacuagcggaggcuauuuucaaauuaaccuaccaaaacaaaguagugagagugcagcgaccuaccccuagaggcacagugauggacaucauuagccgcagagaccagagagggaguggccaaguuggaacauauggacuaaacacauuuacaaacauggaagcccagcuaauacggcaaauggaaggugaaggaguuuuuaaaaauauucaacauuuaacagugacugaggaaguugccguacaaaauuggcuugcccgugucgguagagaaagguuaucgagaauggcaauaaguggcgaugauugcguaguuaaaccauuagaugauagauuugcaaaugcauugacagcacuaaaugauauggggaaaauacgaaaagacauacaacaaugggagcccagcaaagguuggaaugauuggacacaaguaccauucuguucucaucauuuccaugaacugaucaugaaagacggaagaguauuagucgucccuugccgcaaccaagacgagcugaucgguagagcuaggauaucucaaggagccggauggucucugagagagacggcaugucuaggaaaaaguuaugcccaaauguggaguuuaauguacuuccacaggcgggaucuuagauuagcagcaaacgccauauguucggcaguaccuucucauuggguuccuacgaguagaaccacguggucaauacaugcgaaacacgaauggaugacaacagaagauaugcuaacaguuuggaaccguguuuggauaagagaaaauccauggauggaagauaagacgccaguagaaucaugggaagaaaucccauaucuagggaaacgagaagaccaaugguguggaucguuaauaggauuaacuucacgcgcaacaugggcuaaaaauauacaggcagcgauaaaccaaguaagaagccuaaucggaaacgaggaauauacggauuauaugccauccaugaagagguuuagaagggaagaggaggaggccggcguucuuugguaa

SEQ ID NO: 22336 - RNA, 9876 nt, Artificial Sequence
  derived and/or modified CDS sequence (opt6) from DENV-2__GQ868622__SS-prME
agugcgggaaugauuauaaugcuuauaccuacaguaauggcuuuccauuuaacaacacgaaauggggaaccacacaugauaguuggcauacaagaaaaagggaaaucacuccuauuuaaaacggaagaugggguaaauaugugcacccuuauggcgauggaccuuggcgaacuuugugaagacacaauaacuuacaaauguccacuuuuacgucaaaaugaaccagaagacauugauuguuggugcaauucaacaaguacaugggucacguacgggaccuguacaacuacuggugaacacagaagagaaaaacguuccguggcucuaguuccacaugucggaaugggucuugaaacuagaacagaaacguggaugucuucagaaggggcuuggaaacacgcccaacguauagaaaccuggauccugaggcacccugguuucaccauaauggccgcuauucuagcuuacacaauuggcacaacccacuuucaaagagcacuuaucuuuauacuauuaacagcaguugcuccaucaaugacaaugagauguauagggauaucuaaucgagauuuuguugaaggcguaucuggaggcaguuggguagacaucguccuugaacaugggucuugugucacaaccauggccaaaaauaaaccaacuuuagauuucgaauugauaaaaacugaagcccgccaaccugcaacuuuaagaaaauacuguauugaagcaaaacugaccaauacgaccacagaaaguaggugcccuacccaaggcgagccaucauuaaaagaagaacaagauaaacguuucguuugcaaacacaguauggucgaucgaggcugggggaaugggugcggcuuauuugggaaaggcggaauaguuacaugugccauguuuacguguaagaaaaauauggaaggaaaaaucguucaaccagaaaaucucgaauauacuaucgucguuacaccucauagcggugaagaacacgcgguuggcaacgauaccgggaaacacgguaaagagauuaaaguaacgccgcagaguucaauuacagaagcggaacuaacaggcuauggaacaguuacuauggagugcaguccucgaacgggccuagauuucaacgaaaugguuuugcuucaaauggaaaacaaagcauggcuaguacaccgucaaugguuucucgaucuaccauuaccauggcuuccaggcgcagauaaacaagggaguaacuggauccaaaaagaaacguuaguaacuuucaaaaauccgcaugccaagaaacaagacgugguaguauugggaucucaagagggagcuaugcauacagcgcucacgggagccaccgaaauccaaaugucuucuggcaauuuauuauuuaccggccacuugaaauguagauuaagaauggacaaauuacaacucaaagguaugucauauucuaugugcaccgguaaauuuaaaguaguaaaagaaauagcagaaacucaacauggaacaauagucauucgcguucaauaugaaggggacggaagcccaugcaaaauaccguucgagauuauggaucucgagaaaagguauguacuaggcaggcuuauaaccguaaaccccauaguuacugaaaaagauucuccugugaauauugaagcggaaccaccauuuggagacaguuacaucauaauaggcguugaaccuggucaauugaaacucaacugguucaagaaaggaaguuccauuggccaaauguuugagacuacaaugcgcggugccaaaaggauggcgaucuuaggagauacugcgugggauuucggaaguuuaggcggcguuuuuacgagcauaggaaaagcauuacaccaagucuuuggagcaaucuauggagcagcuuuuaguggaguuucauggacaaugaaaauauuaaucggggucauaauaacauggauaggcaugaacucgcgaaguacaucuuuaagugugucauuaguauuaguagguauugugacgcuauaucugggggugaugguccaagccgauucuggcugcguuguaaguuggaaaaacaaagagcuuaaauguggcuccgggauauuuauaacugacaauguacauacguggaccgagcaauauaaauuccagccugaaucaccuaguaaauuagccagcgcuauacaaaaagcucaagaagagggaaucuguggaauccguucagucacuagguuagaaaaucugauguggaaacaaaucacgccagaauugaaccauauauuagcagagaacgaaguuaaauugaccauuaugacaggcgauaucaaaggaauaaugcaggcaggcaaaagaucacuucggccacaaccgacagaacuuaaguauucauggaaaacaugggguaaagcuaaaauguuaucaaccgaaagccauaaucaaacauuccuaauugacgguccagaaaccgcugaaugcccaaacacuaauagagcauggaacucacuggaaguggaagauuauggauuugguguuuucaccaccaauaucuggcuaaaacuaaaagagaaacaagaugcguuuugcgauuccaaacugaugagugccgcuaucaaagacaaccgggccguacaugcagauaugggguacuggauugagagcgccuuaaacgauacauggaaaauagaaaaagccaguuucauugaagucaaaaauugccauuggccuaaaagccacacuuuauggucaaacggagucuuggaaagcgaaaugauuauacccaagaaucuugcugguccugugucacagcauaauuacagacccgguuaccauacccaaauagcagggccuuggcaccuuggaaaauuagaaauggauuuugacuuuugcgauggaacaacagugauaguaacagaagauugcgguaaccgcggaccgucauuaagaaccacaacggcuagcgguaagcuaauaacagaauggugcugcagaucgugcacuuuaccaccguuacgcuaucggggagaagauggauguugguauggaauggaaauaagaccuuuaaaagaaaaggaagagaaucucgugaacagcuuaguaacagcaggacacggacaagucgacaauuuuaguuuagguguucuuggaauggcucucuuucuggaagaaaugcuaaggacacguguaggaaccaaacacgccauucuauuaguggcgguguccuucgucacucuaaucacaggaaauaugaguuuuaaagaccuagggcguguuguaguaaugguaggagcaacaaugaccgaugauauaggaaugggagugacauaucuggcacuauuggcugcuuuuaaaguuaggccaacauuugcagccggauuauuacucaggaagcuaacaucaaaagaauuaaugaugacaacgauaggaauuguacucuuaucacaaagcaccaucccggagacaauacuggaguuaacugacgcgcuggcgcuaggaaugaugguuuuaaaaauaguacgagauauggaaaaauaucaacucgcaguuaccaucauggcgauucuuugugugccaaaugcgguaauacuacaaaacgcauggaaaguuucgugcacgauauuagccgucguaucuguuucaccuuuacuauugaccucaucucaacagaaaacagacuggaucccccuagcucugacuauuaaaggguuaaaucccacagcaauuuuccuaacaacauuaagccgaacaaauaagaaaaggucuuggccacucaaugaagccauaauggcagugggaauggugucuauacuugcuaguucauuauuaaagaaugauauuccaaugacgggaccacucguggccggggguuuauuaacaguauguuauguuuuaacaggacgaucagccgaccucgaacuugagcgggcuacugacguaaaaugggaagaccaagccgaaaucucggggucguccccaaucuuaagcauaacaauaucagaagacgguucaauguccaucaaaaaugaagaagaagaacaaacucucacuauuuugauaagaacuggucucuuagucauaucgggacuauuuccaguaucgauaccgauaacagcagcugcuugguaccuaugggaaguuaagaaacaaagagcaggcguacugugggaugugccaucuccgccacccaugggaaaagcugaacuugaagauggagcauauagaauaaaacaaaaagguauuuuagguuacagucagaucggcgcgggaguuuauaaggaaggaacuuuucauacaauguggcaugucacgcggggagcaguccuaaugcauaaagguaaacguaucgaacccuccugggcugauguuaagaaagaccuaaucuccuacggcgguggcuggaaauuagaaggggaguggaaagaaggagaggaaguccaggucuuggcauuagagcccgggaagaacccaagggccgugcaaacuaaacccggacuauuuaagacaaauaccggcacuauuggagcuguuucucuggauuuuagccccggcaccuccggaucuccaauuaucgauaaaaagggaaaaguaguaggacucuaugguaauggagucgucacucgcucaggagcauacguaagugcaauagcucagacagaaaagucuauugaggacaauccugaaaucgaagaugauaucuuucgaaaaagacgauuaacuauaauggaucugcauccuggagcgggaaaaacaaaacgcuaccuccccgcuauagugagagaagccauaaaaaggggacucagaacguuaauacuggcuccuacaagaguuguugcugcggaaauggaagaagccuugagaggacuuccaaucagguaucagacgccugcaauucgugcagaacacaccggucgggagauagucgacuuaaugugucaugcuacuuucacuaugagacucuuaucaccaguccgggugccaaauuauaauuuaauaauuauggacgaagcucauuucaccgauccggcuucaauagcagcaagaggcuauauaaguacgcgagucgaaaugggugaagcagcgggaaucuuuaugacugccacucccccuggaagucgcgauccauuuccacaaucaaaugcacccauaauagacgaagaaagagaaaucccagaaaggagcuggaacucaggacaugaauggguaacagauuuuaaagguaaaacaguaugguucguacccagcauaaaagccggcaaugauauagcagcgugcuugcgcaagaauggcaaaaagguuauacagcuaucucgaaagacuuuugacucagaauauguaaagacaagaacuaaugacugggauuucguuguaaccacagauauuuccgagaugggugcuaauuuuaaagccgaacgagugauugauccccgucgaugcaugaagccaguaauuuuaacugauggggaagaacggguaauacuggcgggacccaugccaguuacacacucuucugcugcacaaaggagaggaagaaucggcagaaaucccaaaaaugagaaugaucaauauauauauaugggagaaccucuagaaaacgacgaagauugcgcacauuggaaagaagccaaaauguugcuagauaauauuaacacuccagaaggaauuauaccgaguauguuugaacccgagcgcgaaaaagucgaugcuauagacggagaauaucgucuucgaggagaagcacgaaaaaccuucguugaccuaaugcgaagaggggaucuaccuguaugguuagccuauaagguagcagcagaaggcauuaauuaugccgacagaagauggugcuucgaugggaucaaaaauaaccaaauuuuagaggaaaacguugagguagaaauuuggacaaaagaaggugaaagaaagaaacuuaagcccagguggcuagaugcgagaaucuacucagacccgcucgcauuaaaggaguucaaagaguucgccgcagggaggaaaucccucacucucaauuuaauuacggaaauggguagguuaccaacuuucaugacccaaaagacaagggaugcacuugacaacuuggccguacugcauacagcagaagcaggcggucgagcuuacaaccacgcauuaagugaacuuccugaaacguuagaaacacuauugcugcuaacauuauuagcaacuguaacaggagggauuuuccuauuucuaauguccggucgaggcauaggaaagaugacacuugguauguguuguaucauuacugccaguauauuguuaugguaugcacaaauccagccucauuggaucgcagccucuauuauuuuggaguucuuuuuaauaguucuacuaauucccgaaccagagaaacaaagaacgccacaagacaaucaacuuacauacguaguaauagcaauccuuacaguuguggcggcgacuauggcaaacgaaaugggauuccucgagaaaacgaagaaagaucuuggucuaggaaguauagccacccaacaaccagaaucuaacaucuuggacauagaucucaggcccgcuucagcuuggacauuguaugcuguagcaacaacauucgucacaccaauguuacgucauucaaucgaaaauagcuccguaaauguuucauuaacagcuauagcuaaccaggcaacaguauugaugggcuuggggaagggauggccacuuucgaaaauggacauugguguaccucuacucgcaauaggcugcuauucucaaguaaauccuauaacacucacggcggcccuacuauugcuuguagcccauuacgcgauuauaggaccaggucuucaagcaaaagcgacacgagaagcccagaaaagagcagcagcaggcauuaugaaaaauccaacaguugaugggauaacgguaaucgauuuagauccuauucccuacgacccgaaguucgaaaaacaauuaggccaggugaugcuauuaauccucugcguaacacaggucuuaaugaugcguacaacaugggcccucugcgaagcacugacucuugcaaccggaccaauaucuacacugugggagggaaacccaggaagguuuuggaauacgacuauagcugugaguauggcgaauauauuuagagguucauacuuggcuggcgcaggauuguuauuuucaaucaugaagaacacgacaaauacaaggcgugguaccgguaauaucggugaaacucuaggagaaaaauggaaaaguagauuaaaugcuuuaggaaagucagaauuucaaacauacaagaaaagugguauucaggaaguagacagaacacuggcuaaagagggaauaaagagaggagaaacagaucaccaugcuguuagcagaggaucagcaaaacuuagaugguuugucgaaagaaauaugguaacuccagaaggcaagguugucgaucuggggugcggaagaggaggguggagcuacuacugcgguggucugaaaaauguaagagaggucaaaggacugacgaaaggaggcccuggacaugaggaaccuauuccuaugaguacuuauggauggaauuuggugagacuacaaagcgguguagauguauucuucauacccccugaaaaaugugacacgcuccuuugugauauaggugaaucuaguccuaauccaacaguagaggcaggucgcacguuaaggguuuuaaaucuagucgagaacuggcuuaacaacaauacacaauuuuguauuaagguacugaauccuuauaugccuucgguaauugagaaaauggaagcccugcaacggaaauauggaggagccuuaguccgaaauccauuaagucgaaauagcacacaugagauguauuggguuagcaacgcaaguggaaauauagugucaagcgucaauaugauaucacgaaugcuaauaaacagauuuacuaugcgucauaaaaaggccacauacgaacccgauguagauuuagguaguggcacgcgaaacauaggcauagaaagugaaauaccuaaucucgauauuauugguaaaagaauugagaaaauaaagcaggaacaugaaacaagcuggcauuaugaccaggaucauccguauaagaccugggcauaucaugguucauaugaaacaaaacaaacagguucugcaaguucgaugguuaauggaguagugcgguugcuuacuaagccgugggauguacuuccaacaguaacacaaauggcuaugaccgacaccacaccauucgggcagcaaagagucuuuaaagagaagguugacacacguacccaggaaccaaaagaagggaccaagaaacuaaugaaaauuacagcagaaugguuauggaaggaguuaggcaagaagaaaacaccucgcauguguacuagggaggaauuuacaagaaaaguacguucaaacgcagcacucggcgcuaucuuuacggaugaaaacaaauggaaaucagcuagggaagcaguggaggauaggcguuucugggagcuaguugacaaagaacgaaaccugcacuuagaagguaaaugcgaaacaugcguauacaacaugaugggaaaaagagagaagaaacuaggugaauuuggcaaagcuaaaggauccagagcgauaugguacaugugguugggagcacguuuucuagaguucgaagcucuaggauuccucaaugaggaucauugguuuucucgagaaaauaguuuaagugguguagagggagaaggauugcacaaacugggguacauccuccgcgauguuucuaagaaagaaggaggggcaauguaugcugaugacaccgccgguugggauacacguauaacguuagaagacuuaaagaaugaagaaauggugacgaaucacauggaaggggaacauaagaaacucgcugaggcaauuuucaaguugacauaucaaaauaaagucguaagaguacaacgaccuacuccuagaggcacaguuauggauauaauaaguaggcgggaucaaagaggaucgggccaagucgguacauacggcuuaaacacguuuacaaacauggaggcacaacuaauaagacaaauggaaggagaagguguuuucaaaaauauacagcauuuaacggcaacugaagaaguagcaguucaaaacuggcuagccagaguagggcgagagcgacucucuagaauggcaauaucaggugacgauuguguuguaaagccacuggacgacagauucgcaaaugcacugaccgcuuuaaaugauaugggaaaaauacggaaagacauccaacaaugggagccauccaaagguuggaacgacuggacacaaguaccauucuguucucaucacuuccacgaacuuauaaugaaagacgggagagugcugguaguaccuuguaggaaucaagacgaauugaucgggcgagcccgcauaagccaaggugcuggguggucauugcgagaaacugcgugucuagggaaauccuacgcucaaauguggaguuugauguauuuucaccgacgugacuuacgccuagcagcgaacgcaauauguagugcaguaccgucacauuggguaccuacaucaaggacaacguggucgauacaugcaaaacaugaauggaugacaacugaagauaugcucacgguuuggaaucgaguauggauacgggaaaauccauggauggaagacaaaacuccaguugaaaguugggaggaaauccccuaucugggaaaaagagaagaucaauggugugguucgcuaauaggccuuacaucucgagcgacuugggccaaaaauauucaagcugcgaucaaccagguucguagccuuaucggcaacgaagaauauacugacuauaugccaucaaugaaacgguucaggagggaagaggaggaagcaggcguacugugguga

SEQ ID NO: 22337 - RNA, 9876 nt, Artificial Sequence
  derived and/or modified CDS sequence (opt6) from DENV-2__FJ639705__SS-prME
ucugcaggaaugauaauuauguugauaccuacagucauggcuuuccaccuaacuaccagaaacggagaaccacauaugauagucggaauacaagaaaaaggcaaaagucuucucuucaaaaccgaagauggaguaaacauguguacacuaauggcuauggaucuuggagaauugugcgaagauacaauaacauacaaaugccccuuacuaagacagaaugaaccagaagacauagauugcuggugcaauuccacaagcacauggguaacauacgguacauguacgacuacgggagaacaccgaagagaaaaacguucuguagcauuaguuccucauguagguaugggucuagaaacgagaacagaaacauggaugucuuccgaaggugcauggaaacaugcacaaagaauugaaacuuggauucuaaggcauccaggguucacgauuauggccgcuauccuugcauauacuauaggaacgacccauuuccaacgagcauugauauuuauauuacuaacagcaguagccccuucuaugacuaugcgaugcauuggcauaaguaacagagauuuuguugaaggaguaucaggagggagcuggguugacauagucuuagaacaugguucaugcguuacgacaauggccaaaaacaaaccaacauuagauuucgaacuaauaaaaacagaagcaagacaaccugcaacacugaggaaauauuguauugaagcaaaauugaccaacacuacaacugaaaguaggugccccacacaaggcgaaccuuccuuaaaagaagaacaagacaaacguuucguuuguaaacacuccauggucgacagagguugggguaacggaugcggucuuuucgguaaagguggcaucgugacaugugccauguuuacauguaagaaaaacauggaaggaaaaauaguacagccagaaaaucuagaauacacgauaguaguuacuccucacucuggagaagaacaugcaguaggcaacgauaccggaaaacacggaaaagagauuaaagugacaccccaaucauccauaacggaagcggagcuaacaggauauggaacaguaaccauggaaugcaguccucgcacagguuuagacuucaaugaaaugguccuacuucaaauggagaacaaggcuugguuaguccaccggcaaugguuuuuagauuuaccucuaccuuggcuaccuggcgcggauaaacaaggcagcaauuggauacaaaaagaaaccuuaguaacauucaaaaacccgcaugcgaagaaacaagacguaguuguacuaggaucgcaagaaggagccaugcauacagcucuaacuggggccaccgaaauacaaaugucgucuggcaauuugcuauuuaccggucaccugaaaugcagacuacguauggauaaauugcaacuaaaaggaaugucuuauagcauguguacugguaaauucaaaguagucaaagaaaucgcggagacacaacauggaacuauuguuauacgaguucaauaugaaggagacggcuccccgugcaaaauuccauucgaaaucauggaccuagagaaaagauauguuuuaggucgacucauaacgguuaauccuauaguaacugagaaagacucgccaguaaauauugaggccgagccgccguuuggugauagcuauaucauuaucggaguggaaccgggucagcuaaaacuuaacugguuuaaaaaggguucgagcauagggcaaauguuugaaacuacgaugagaggugcaaagagaauggccauuuuaggugacacagcaugggacuucggcucgcuagguggaguuuuuacaagcauagguaaagcauuacaucaaguauuuggggcgauuuacggagccgccuuuucagguguuucguggaccaugaaaaucuuaauaggcguaauaauaacauggauuggaaugaacucucgaaguacuucacuaucaguauccuuaguuuuaguaggcauagucacucucuaucugggaguaaugguccaagcagacagcggguguguagugucuuggaaaaacaaagaacugaaauguggcagcggaauuuucauaaccgauaaugugcauacuuggaccgaacaauacaaguuucaaccagaaucaccaaguaaguuggcaucggccauccaaaaggcccaagaagaaggaauaugcgguauaagaagugugacaagauuagagaacuuaauguggaaacagauaacaccugaacuaaaccauaucuuagccgagaaugaagucaaacuuacaauuaugacgggagauauuaaaggcauaaugcaagcuggaaaacggaguuugcgaccgcaaccaacugaacuuaaauauuccuggaaaacaugggguaaggcaaaaaugcugucaacggaaucucauaaucaaacauuccuaaucgauggaccggaaacagcugaauguccaaauacaaauagagcuuggaacucguuagagguagaagauuacggauucgggguuuuuaccaccaauauauggcugaaacucaaagagaaacaggaugcuuuuugugauagcaaacucaugucggcggcaaucaaagauaauagggcaguucaugcugauaugggauauuggauagaaucagcuuuaaacgauacauggaaaauagaaaaagccucuuuuauagagguuaagaauugucauuggccaaaaucacacacucuauggucgaacggaguacucgaaagugaaaugauuaucccaaagaacuuagcugguccgguuucacaacacaacuaucgaccuggauaucacacccagauagcuggcccguggcaucuaggaaaacuugagauggacuuugacuucugugacgguacuacugucauagucacagaggacugcgggaacagaggucccagcuugagaacgacgacggccucugguaaauuaauaacggaauggugcugccggucauguacacuuccacccuuaagauaccguggagaagaugggugcugguacggcauggaaauaaggccgcuaaaagaaaaagaggaaaaccuuguaaauucacuggugacagccggucacgggcaaguggauaacuucucacuagggguguuaggaauggcguuauucuuggaagaaaugcuaagaacucgcgucgguacaaagcacgcuauccuacugguagcgguaucuuuugucacucucauuacaggaaacauguccuuuaaagaccugggaagaguugucguuauggucggggccacuaugacugacgauauagggaugggaguaacguauuuagcacugcucgcagcuuucaaaguacggccgacauuugcggcaggccuacuauuaagaaaacuaacuagcaaagaacugaugaugaccacgauagggauaguccuucucucgcagaguacuauucccgaaacaauuuuagaacucacagaugcuuuggcucuagggaugaugguucucaaaaucguccgcgauauggagaaguaccaacuagccguaaccauaauggcgauacuauguguaccgaaugcgguuauucuucaaaaugcuuggaaaguaucgugcacaauacuagccguaguaaguguaaguccauuacuauuaacauccucacagcagaaaaccgauuggauaccacuagcccuaacgaucaaagggcuaaaucccacugcuauauuuuugaccaccuugagcaggacgaacaaaaagagaucguggccuuugaacgaggcaauaauggcagucgggaugguaucgauccuagcgaguagucuucugaaaaaugacauccccaugacgggaccccuaguagccgggggucuacuaacagucuguuauguucuaacaggucguucggcagacuuagaauuagaaagggcaacugacgugaaaugggaagaucaagcagagaucucaggaagcucgccaauacuuucaauaacgauaucggaagacgggucuaugucuauaaagaaugaagaagaagaacagacacuuacaauacugauaaggaccggauuauuagucauaucaggccuuuucccagugaguauaccaauuaccgcggcugcaugguauuuaugggaaguuaagaagcaaagggcgggcguguuaugggauguuccgucaccuccaccaaugggaaaagcagagcuugaagacggugccuauaggauaaaacaaaaaggaauacuaggcuauucucaaauaggcgcgggcguuuauaaagaagguaccuuucauacuauguggcacguaacgaggggugcgguuuuaaugcacaaaggcaaacguauugaaccgagcugggcagauguuaagaaagaucuaaucaguuacggaggaggauggaaauuggaaggagaauggaaagaaggugaagagguccaagugcuugcgcucgaaccagggaagaaucccagagcagugcaaaccaaaccaggccucuuuaaaacaaacacagguacuauaggugcggugagcuuggauuuuucucccgguacaagcggaucgcccauaauagacaagaaaggaaaaguugucggucucuauggaaaugguguggugacaagaagcggggcguacguaucagcaauagcgcaaacugaaaaauccauagaagauaacccggaaauagaagacgauauauuucgaaaaagaagacugacuaucauggaccuucacccaggcgcgggaaagacaaagagauaccuacccgcaauagugcgagaagccauuaaaagaggacuaagaacccuuauacucgcuccaacgagagucguugcagcagaaauggaagaagcucuaagaggauuacccauacgauaucagacuccugcuauuagagcagaacacaccggacgugaaauuguugacuuaaugugucaugcaacauuuacaaugcgacugcuaagcccgguccgagugcccaauuacaauuugaucaucauggaugaggcacacuucacugacccagccagcauagcagcaagaggguauauaaguacucgaguagaaaugggugaagcggccgguauauucaugacagcaacaccuccgggaucacgggacccauuuccacagucaaaugcacccaucauagacgaagaaagggagauuccagagaggucauggaauaguggccaugaguggguaacagauuucaaagguaagaccgugugguucguuccaaguaucaaggcaggaaaugauauugcagcauguuuacguaaaaacggcaagaaaguaauacaauugagccgaaaaacguucgauagugaauauguaaagacaagaaccaaugauugggacuuuguaguaacaacugacauaagugagaugggggccaauuuuaaggcagagagaguuauugauccccgacgcuguaugaagccugucauacuaacagauggcgaagaaagagucauacuugcagggcccaugccaguaacccauaguagugccgcgcaaagaagaggccguauaggucgcaauccaaagaacgaaaacgaccaauacauauauaugggcgaaccauuggaaaaugacgaagacugugcacacuggaaagaagcaaaaauguugcucgacaacaucaauacgccagaaggaauaauaccuuccauguucgaacccgaaagagagaaaguugacgcaauugauggggaauauagacucagaggggaggccagaaaaacguucguugaucucaugaggagaggagacuuaccaguuuggcucgcuuauaaaguugcagcugaggguaucaacuaugcagauaggcgaugguguuucgauggcaucaaaaacaaucaaauauuagaagagaacguggaggucgaaaucuggacgaaagaaggugagaggaagaaacuaaaaccgagaugguuagacgcuaggauuuacucagauccguuggcgcucaaagaguucaaagaguucgcagcuggucgaaaaagucugacucuuaauuuaauaacugaaaugggaaggcugcccaccuucaugacacaaaagacaagagaugccuuagauaaucuagcggugcuccauacagcggaagccggcgguagagcuuacaaccaugccuugagcgaauugcccgaaacacucgaaacacugcuuuuauugacauuauuagcaacaguaacugguggaauauuucuauuucuaaugaguggacgagguaucgguaagaugacauuagguauguguugcaucauuacugccuccauucuauuaugguacgcccaaauacaaccacacuggauagcagcuagcauuauacuagaguucuuccugaucguacuacugauaccagaaccagaaaaacagagaacuccucaagauaaucaguuaacguacguagucaucgcaauccuaacaguuguugcagcaacaauggcaaacgaaaugggcuuccuggaaaagaccaagaaagacuuagguuuagguaguauagcgacacaacaacccgaaaguaacauuuuggacaucgaccucaggccggcaucggcguggacauuauaugcuguagcaacgacuuucgugacacccaugcucagacauucaauagagaacaguucuguaaauguaagccuaacugcgauagcuaaucaggcaacagugcuaaugggacuaggaaaagguuggccguuaucaaaaauggauauagguguaccuuuguuagcaauugguuguuacucacaaguaaacccuauuacacuaacagcugcauuacuaagucuuguugcacacuaugcgauaauaggaccaggucuucaagcaaaagcgacacgagaggcccaaaaacgagccgcggcgggaaucaugaaaaacccaacaguagauggcauuacugugauagacuuagacccgaucccauaugauccaaaauuugaaaagcaauuaggucaaguaauguugcugauauuauguguuacacaaguacuaaugaugaggacgaccugggcccuuugugaagcauugacgcuagccacagguccaauuucuacauugugggaaggaaauccgggaagguuuuggaauacuacaauagcugugucaauggccaauauauuucggggaaguuaucucgcgggagcuggacuauuguuuucuauuaugaagaacacaacaaacacucgacgaggaacagguaacauaggagaaacacugggugaaaaauggaaaucgaggcuaaaugcgcuagggaaaucggaguuccagacuuacaagaaaucaggcauucaagagguagacagaaccuuggcaaaagaagguauaaagagaggagagacagaccaucaugcaguaagcagaggaucugcaaaauuacguugguuuguagaaagaaauaugguuacuccggaggguaagguaguagaucuggguugcggaagggguggauggagcuauuacuguggaggucuuaagaacguucgggaagugaagggacuuaccaaaggaggccccggucaugaagaaccgauaccaaugucuacauauggguggaaucuuguaagauuacagucuggaguagauguauucuuuauuccuccagaaaagugcgacacuuuauuaugugauauuggggaaagcucuccaaacccuacaguugaagccggucgaacacuacgugucuuaaaccuaguagaaaacuggcuuaauaauaauacucaauuuuguauuaaaguacucaauccauacaugccaucaguaauugaaaagauggaagcgcuacaacgaaaauauggaggagcucuaguacguaauccuuuaagcaggaacucaacacaugagauguacugggucaguaacgcaucaggaaauauagugaguagcgucaacaugauaagccgaauguuaaucaauagguuuacaaugcggcacaaaaaggcgaccuaugaaccugauguugacuugggcucaggaacucgcaauauuggaauagaaucagaaauacccaauuuagauauuauagggaaacguauugagaaaauaaaacaagaacacgaaacaaguuggcacuacgaucaggaucauccauauaaaacaugggcuuaucaugguucauaugaaacaaaacagacaggcucugccucgagcaugguaaauggaguggucaggcuucuaaccaaaccaugggacguucuuccaacuguuacacaaauggcgaugacugauacuacuccauucggucaacaacgcgucuucaaagaaaaaguugauacuagaacacaagaaccaaaagaagggacaaagaaacucaugaaaauaacagcugaauggcuuuggaaagagcuugguaaaaagaaaacuccucgcauguguacacgugaggaauuuacuagaaaagugcgaucaaaugccgcuuuaggagcaauauucaccgaugagaauaaauggaaaagugcccgcgaggcaguagaagacucacguuucugggaguuaguugauaaagagaggaaccuacaucuugaagguaaaugugagacuuguguauauaacaugaugggaaaaagagagaagaaacucggugaguuuggaaaagcgaaaggcagccgagcaauaugguauauguggcuaggcgcaagguuccuagaauuugaggcacugggcuucuuaaacgaggaccauugguuuucacgagaaaacucauugucagguguagagggugaaggacugcacaaauuaggauauauacuaagggauguaagcaagaaagaagggggagcaauguaugcugaugacaccgcgggcugggacacucggauuacauuggaggaucuaaagaaugaagagauggucacuaaucauauggaaggagaacauaagaaauuagcagaggcuaucuucaaacucacguaucaaaauaaagugguacggguacaacgcccaacacccagagguacuguaauggacauuaucucaaggagagaucaacgaggaucuggccaaguugguaccuacggauuaaauaccuucacaaacauggaggcacaauuaauacgccaaauggagggagaaggugucuuuaaaaauauacaacauuuaacagcgacugaagaaguagcuguucaaaauugguuggcaagaguaggaagagaacggcuaaguagaauggccauaucuggcgaugauugcguuguaaaaccucuugaugaucgauuugcaaacgcucucaccgcucugaaugacauggggaaaauaagaaaagauauacaacaaugggaaccaagcaaaggguggaacgauuggacccaagugccauuuugcucucaccacuuucaugagcugauaaugaaagaugggagaguccugguagugccaugccguaaccaagaugaacugauaggcagggcuagaauuagccaaggagcagguuggucuuugcgagaaacagcgugccuaggaaaauccuacgcccaaauguggaguuugauguauuuucacagaagagaccucagauuagcagcaaacgcaauuugcagugccguaccuucacacuggguacccacaaguaggacgacauggaguauacacgccaagcaugaauggaugacaacugaggacauguuaacaguguggaacagaguguggauucgggaaaauccauggauggaggauaaaacaccaguugaaucaugggaagagaucccguauuuaggaaagagagaggaucagugguguggaucauuaaucggcuuaacaaguagagcaacaugggccaaaaauauccaggcagcaauaaaccaaguucguucauuaauaggcaacgaagaguauacagauuacaugccuucaaugaaacgauuuagacgagaagaggaagaagccggcguacuuugguaa

SEQ ID NO: 22338 - RNA, 9876 nt, Artificial Sequence
  derived and/or modified CDS sequence (opt6) from DENV-2__FJ639706__SS-prME
agugcagguaugauaauuaugcuuauuccaacaguaauggcauuucaccuaacuacgcgaaauggagaaccacauaugauuguaggaauacaagaaaaagguaaaucuuuacuauuuaaaacggaagacgggguuaauaugugcacgcuaauggcaauggaucucggagaauuaugugaagacacuauaacguacaaauguccauuacuucgacaaaacgaaccggaagacauagauuguuggugcaauucgacaaguacguggguaacauacgggacaugcacaacaacaggcgaacaucgaagagaaaaacgaucaguggcucuagucccccacguaggaaugggauuagagacuaggacggagacuuggauguccagugagggagcauggaaacacgcacaacgcaucgagaccuggauauuaaggcauccaggauuuaccauaauggcugcaauucuagcguauacaauaggcacuacucauuuccaaagagcacuaauauucauuuuauugacggcaguugcuccaucuaugacuaugcguuguauuggaauaucuaaucgggauuucgucgaggggguaucagguggcaguugggucgauaucguccuggaacacgguuccugcguuaccacaauggccaaaaacaaaccuacguuagauuuugaguuaauuaaaaccgaagcaaaacaaccagcgacuuuacgaaaauauugcauugaagcuaaacuaacaaauaccacgacugaauccagaugcccaacacagggcgaacccucacuaaaggaagaacaagauaaacgcuucguaugcaaacauucaauggucgacagaggauggggcaauggaugcggacuuuucggcaaaggugggauuguaaccugugccauguuuaccuguaaaaagaauauggaagguaaaauuguucaaccagaaaaucucgaauauacaauaguaguaacuccucauucuggcgaagaacacgcgguagggaaugacacaggaaaacauggcaaggaaauaaaagucacuccgcaaucguccauaacagaagcugaauuaacaggauacgggacaguaacuauggaauguuccccacgaacggguuuagacuucaaugaaauggugcuuuugcagauggaaaacaaagcguggcuaguucauagacaaugguuccuagauuuaccacuaccaugguugccuggagcagauaagcaagguaguaauuggauacaaaaagaaacucuagugacauuuaaaaauccacacgcaaagaagcaagauguuguaguauuggggucccaggaaggugcuaugcauacagcauuaacgggagcaaccgaaauacaaaugucaagcggcaauuuacuauucaccggucauuuaaaauguagacuucguauggauaaacuacaauuaaaagguaugucguauucaauguguacuggaaaauucaagguagugaaggaaauagcggaaacucaacacggaacgaucguaauaagaguucaauacgagggcgaugguucaccauguaaaauuccauuugaaauuauggaucuagagaaacguuauguacuagggagacuuauaacagucaacccuauaguuacagaaaaggacagcccuguaaacauagaagcagaaccaccguucggggauaguuacauaauaaucgggguugaaccaggccaauuaaaacugaacugguucaagaaaggaaguaguauuggucaaauguuugaaacaacgaugcgaggugccaaacgaauggcaaucuuaggugauacagccugggauuuugguucucuaggcggaguauuuacuucgaucgggaaggccuuacaccaaguauucggggcaauauauggggcugcauuuagcgguguaucguggacuaugaaaauacugauugguguuaucauaacauggauagggaugaacucgagaaguacaucccuaucaguaucacugguacuuguaggaaucguuacgcuauacuuaggaguaaugguacaggcugauaguggauguguagucagcuggaaaaauaaggaauuaaaaugugguuccggcaucuuuaucacagauaauguacauaccuggacagagcaauauaaauuccagccugaguccccguccaaacuugcuuccgcaauucaaaaagcacaagaggaaggaauuuguggcaucaggagcguaaccaggcuagaaaaccucauguggaaacaaauaacaccagaacuaaaccauauacuagcggaaaacgaaguaaaguuaacaauaaugacgggagauauaaaaggaaucaugcaggcaggaaagcgaucccucagaccgcaaccuaccgaauugaaauacucauggaagacuuggggaaaagcuaaaaugcuaucgacggaaucgcauaaucaaacuuucuuaauugacggucccgaaacagcggaguguccuaacacaaaucgcgcuuggaauagccuugaagucgaggacuacggcuuugguguguucaccaccaauaucuggcuaaaauuaaaagagaagcaggaugcauucugugauaguaagcucauguccgcagccaucaaagacaaucgagcaguccaugccgacaugggauauuggauugaaucugcguugaacgacacuuggaagauagaaaaagcaucauucauugaagucaaaaacugucauuggccaaaaucacacaccuuauggagcaacggcguacucgagucagaaaugauaauuccuaaaaacuuagcagggccaguaagccaacauaauuaucgcccagguuaucacacgcaaaucgcaggaccauggcauuuaggcaaacuugaaauggauuuugacuucugugaugggacaaccguaaucguuacagaagacugcgggaauagaggaccuucacuucggacuacgacagcuucaggcaaguugaucacagaaugguguugucgaaguugcacgcuaccaccacugagguauagaggugaggauggauguugguacgguauggaaauacguccauuaaaagaaaaagaggagaaucugguaaauucauuagucaccgcaggacauggacaaguggauaauuucaguuugggugucuuagguauggcacuuuuucucgaagagaugcuuagaacuagaguuggaacaaaacacgcuauucugcuuguggcagucaguuuugugaccuuaauaacuggaaauauguccuuuaaggaucuagguaggguuguaguaauggugggcgcuacgaugacagacgauauagggauggguguuacauacuuggcuuuauuagccgcuuuuaaagugagaccaacauucgcagcgggcuuauuguuacgaaaacuaaccagcaaagagcuuaugaugaccacgauugggauagcacuccucagccaaucaacuauaccagagacaauauuagaauugacugaugcgcucgcauuaggcaugaugguucuaaaaauaguccgcgacauggaaaaguaccaguuagccguuacaauaauggcuauccuauguguaccaaacgcaguaaucuuacaaaacgcauggaaaguuaguuguacgauccuagcuguaguuucgguuucuccacuucuuuuaacaucaagccaacaaaagacagauuggauaccacucgcacuaacuauaaaaggauuaaaucccaccgccauauuuuugacgacgcuaagucguacaaauaagaaaagaucuuggccucuaaaugaagcuauaauggcaguaggaaugguaaguauauuagcgucaucucuauuaaagaaugauaucccaaugaccgguccguuagucgcuggagggcuacuuacggucugcuacgucuugacagguagaagugccgauuuggaauuagaaagggcgaccgauguuaaaugggaagaccaagcugagauuucaggaaguucuccaauacuaaguauaacuauuucugaagacggcaguauguccaucaagaaugaagaggaggaacagacccucacaauacucauuagaaccggucuacuuguaauuucaggcuuauucccaguaucuaucccaauaacggccgcugcuugguaucucugggaagugaagaaacaacgagcggggguauugugggacguaccaaguccucccccuaugggaaaagcagaguuggaggacggugcguaucgcauaaaacaaaaaggcauccuaggauauagucagaucggagcaggaguauauaaggaaggaacguuucacacaauguggcacguuacaagaggggcugugcuaaugcacaaagggaaaagaauagagccaaguugggcggaugucaagaaagaccuuauaucauacggaggggguuggaaacuugaaggagaauggaaggagggagaggaggugcagguauuagcacuagaaccaggcaaaaauccaagagcaguacaaacaaagccaggguuauuuaagacuaacaccgguaccauuggcgcuguuuccuuagacuucucuccugguacaucugggucacccauaauugauaagaaaggaaaagucguggggcuauauggaaacggaguaguaaccagauccggugcauaugucuccgccaucgcccaaacggaaaaaucgauagaagauaauccggaaaucgaggaugauauauuccgcaaacgaagguuaacaaucauggaucuacauccaggagcaggcaagacuaagcguuaucuaccagccauaguaagagaagcgauaaaacguggauugaggacguuaaucuuagcuccaacaagaguuguagcugcagaaauggaagaggcuuuacgaggacuacccauaagauaccagacaccagccauuagggcugaacauacaggaagggaaauugucgauuuaaugugucaugcuacguuuaccaugagauuauuaaguccaguaaggguuccuaacuauaaucugaucauuauggaugaagcgcacuucacagacccagcgucuauagccgcaagagguuacauaaguacucgaguagagaugggagaggccgcgggaauuuucaugacggccacucccccgggaucccgagaccccuuuccacagaguaacgcaccgaucauugacgaagaacgcgagauuccagaaagaucauggaacucuggccacgaguggguaacagauuuuaaggguaagacagucugguucguccccucaaucaaagccggaaaugacauugcugcauguuugcgcaagaacgggaagaaagucauacaauuaucacggaaaacuuuugauucggaauacgugaaaacacgaaccaacgauugggacuuuguaguaacaacagacauuagugaaaugggugcuaacuuuaaggccgaaagaguuaucgauccuagaagauguaugaaaccuguuauauuaacagacggugaggaacgaguuauacuugccgguccgaugccgguaacacacagcucggcagcacaacgacgggguagaaucggaagaaacccgaaaaaugaaaaugaccaauacaucuauaugggagagcccuuagaaaaugaugaagacugcgcgcacuggaaggaggcgaagaugcuuuuggacaacauuaacacgccagaagguauuaucccaucaauguucgaaccagagcgcgagaaaguggacgccauagauggagaguaccgguuaaggggagaagcacguaaaacauucguggauuuaaugagaaggggagaucuaccaguauggcuagccuacaaaguggcagcggaaggaauaaauuaugcagauaggagauggugcuuugacggaauuaaaaauaaucaaauucuugaagaaaauguggaaguugaaauuuggacaaaagaaggggaaagaaagaaacugaagccaagauggcucgacgcgagaauuuauuccgauccuuuagcccugaaagaguuuaaggaguuugcugccgggaggaaaucauugacuuugaauuugauaacggagaugggacgguugcccacauuuaugacacagaaaacgagagaugcacuagacaaucuggcuguauuacauacagcagaagcuggaggucgagcuuacaaucaugcucuuucagaguuaccagaaacacuagagacacuucuauuauuaaccuuacuagcuacuguaacaggaggcauuuuucuauuccuuaugucaggcagggggauaggaaaaaugacacuaggaaugugcugcauuauaacggcuaguaucuuauuaugguaugcacaaauccagccccauuggauagccgccagcauaauucuagaguucuuucuuauugucuugcuaauaccugaacccgaaaaacagagaacaccgcaggauaaccagcuaacguacguaguaauagcaauucuuacuguaguggcagcaacgauggcaaacgagaugggauuucuugaaaagacaaagaaagauuuagggcugggcuccauagcaacgcaacagccagaaucaaacauacuagauaucgaccuuagaccggcaagcgcauggacuuuguaugcgguagcaacgacuuucguuacuccaaugcuuagacacagcauugagaacagcucggucaacgugagccuuacagccauagcaaaccaagcaacaguucucaugggacuagguaaaggcuggccucuaucaaaaauggacaucgguguaccccuacuagccauaggaugcuauucacaagugaauccgauaacauugacagcagcauuacuacuccuaguagcucauuaugcgaucauugggccaggucuacaagcuaaagcaaccagagaagcucaaaagcgugcagcugcaggaauuaugaagaacccuaccguggacgguauaacggugaucgaucuagauccaauuccauaugauccaaaguucgaaaaacagcuagggcaaguuauguugcuaauccuuugcguaacgcaaguacuaaugaugaggacaacgugggccuuaugcgaggcuuuaacauuagcgacggguccaauaagcacccucugggaagguaauccaggcagauucuggaacacaaccauagcuguuucaauggccaauaucuuuagaggcaguuauuuggcaggagccggccuuuuauucucuauaaugaagaauacuacaaauacuagaagggggacaggcaauauaggagagacgcuaggggaaaaguggaaaucaagguugaaugcgcucgggaaaucggaauuucagacauauaagaagucugggauucaagaaguagauagaacauuggcuaaggaagguauaaaacgaggcgaaacagaccaccacgcagucuccagggguucggccaaacuuagaugguucguugagcgcaacaugguuacgccagaaggcaaagugguagauuuagggugugggaggggugguuggucuuacuacuguggaggguuaaagaauguuagagaagugaagggauugaccaaaggagguccgggacacgaggagccaauuccuaugucaacauauggcuggaauuugguuagacuacaaucaggaguugacgucuucuuuauuccaccggaaaagugcgacacauuacuuugcgacauaggggaaucaucuccaaauccgacaguagaagcagguagaacacuccguguacuuaaccugguagaaaacugguugaauaacaauacucaguucuguauuaaaguuuuaaaccccuauaugcccagugugauagagaaaauggaagcacuucagcguaaauauggaggagcacucguuagaaauccauuaucuagaaauuccacacaugaaauguacugggucagcaaugcaucagggaauaucgucucaucaguaaacaugaucucucggauguuaauuaauagauuuaccaugcgacauaaaaaggcaacauacgagcccgauguagaucucggguccgggacgcguaacauaggaauugaguccgaaauuccaaaccuugacauuaucggcaaaagaauagagaaaauuaaacaagaacaugaaacaucuuggcauuaugaucaagaucaucccuauaaaacaugggcauaucacggcagcuaugaaacuaaacagacaggaucagcuagcuccaugguaaauggcgugguucgauuacuaacgaaaccuugggauguguuaccuacgguaacacaaauggcaaugacagauacgacuccauucggacagcaaagaguauuuaaagaaaaaguggauacucgaacccaagaaccgaaagaggggaccaagaaauuaaugaagauaacagcagaguggcuauggaaagagcuagggaagaagaaaacaccucguauguguacgcgagaagaguuuacacguaaagugcguaguaaugccgcacuaggagccauuuuuacagaugaaaauaaauggaaaucugcacgggaggcgguagaagauucaagauuuugggaauuaguugauaaagaaagaaauuugcaccucgaaggcaaaugugagacaugcgucuauaacaugauggguaaacgggaaaagaaacuaggagaguucgggaaagcaaaaggaucuagagcaaucugguauauguggcuuggggcccguuucuuagaauuugaagcauuagguuuucuaaaugaagaucauugguucucaagggaaaauaguuuguccggaguggaaggagaaggauugcauaaacuaggauacauacuacgagauguaucaaagaaggaagguggagccauguacgcagacgauacggcaggaugggauacgcgaauaacacuagaagaccucaaaaaugaagaaauggucacuaaucauauggaaggugaacacaaaaagcuggccgaagcaaucuucaaacuuacauaucaaaacaaaguaguuagaguucaacgacccacaccaagaggaaccguuauggauauaauaucaaggaaagaucaacgagguucaggacaaguagggacguauggcuugaauacguucacuaacauggaagcucaauugauucgacaaauggaaggagagggaguguuuaaaaauauccaacaccuaaccgcaacugaagaaguugcaguucaaaacugguuagcgcguguaggcagggagagacucuccagaauggcgauaagcggagacgauugcguuguaaaaccuuuagacgaucgauuugcuaacgcucucacagcauugaaugacaugggaaaaauaagaaaggauauucaacaaugggaaccuucgaaaggauggaacgacuggacgcaaguaccauuuuguucgcaucauuuccacgaacuuaucaugaaggauggacguguauuaguagugcccuguagaaaccaggaugaauuaauagggcgagcacgaauaucgcaaggugcuggauggucuuugcgggaaacagcaugccuaggaaagaguuaugcccagauguggagccugauguacuuccauagaagggaccuuagacuugcugcuaaugcaauuuguagugcaguucccagucauuggguaccuacguccagaacgacauggucuauccaugcgaaacacgaauggaugacgacagaggacauguugacaguuuggaauaggguauggauacgggaaaauccuuggauggaagauaaaacaccaguugaaagcugggaagaaauuccauaccuagggaagcgagaggaucaaugguguggauccuuaauuggucugacuucacgggcgacaugggccaaaaauauucaagcagcuauuaaucaaguaagauccuuaaucgguaaugaggaauacacagauuauaugccaaguaugaaacgauucagaagggaagaggaagaagccgguguauuaugguag

SEQ ID NO: 22339 - RNA, 9876 nt, Artificial Sequence
  derived and/or modified CDS sequence (opt6) from DENV-2__FJ639707__SS-prME
uccgcagguaugauuauaaugcugauuccuacuguaauggcuuuucaucuaacaacgaggaauggugaaccucacaugauuguaggaauacaagaaaaagguaaaucccuacuauucaaaacugaagacgguguuaauauguguacuuuaauggcuauggaccuaggcgaauugugugaagauacuauaacuuauaaaugcccacuacugcggcaaaaugaaccagaagacauagacugcugguguaacucaaccucaacaugggugacguaugguacuuguacgacaacaggugaacauagaagggagaaaagaucgguagccuuaguaccacauguuggcauggggcucgaaacacgaacagaaacauggaugaguucagaaggagcauggaaacacgcccaacggauagaaacauggaucuuaagacacccaggguucacuaucauggcggcaauccuugcguauacuauaggaacgacgcacuuucaacgggugcucauuuuuauauuauuaacagcuguagcaccuucuaugacaaugaggugcaucggaauaaguaaccgagacuuuguagaaggcgugucaggcggcucuuggguugauauuguauuagaacacggguccugcguaacaaccauggccaaaaauaaaccaacccuugauuuugaacuuaucaaaacagaagcaaaacaaccagcaacacuacgcaaauacugcauagaagcaaaacuaaccaauaccacuaccgaaucaagaugucccacgcaaggugaaccuuccuuaaaagaagaacaagacaagagauucguauguaagcacucgaugguagaucgcgguuggggcaaugguugcggguuauuuggcaaagguggaauugugacgugcgcuauguuuaccuguaagaaaaacauggaagggaagauaguacaaccagaaaaucuugaauauacuauuguaguaacaccacacucuggagaagaacaugcaguuggcaaugacacuggaaaacauggaaaagaaauaaaaguaacgccacagucaucuauuacagaagcagaguugacaggguacgggacaguaaccauggaauguuccccgagaacgggacuggauuucaacgaaaugguuuuacuucaaauggaaaacaaagcauggcucguucauagacaaugguuuuuagaccuaccacugccaugguuaccaggugcagauaaacaggagagcaauuggauacagaaagaaacccuagugacuuuuaaaaacccacacgcuaagaaacaagaugucgucguucuaggcucacaagaaggugccaugcauacagcgcucacuggcgccaccgaaauccaaaugucaucuggaaauuugcuuuucacgggucaucugaaauguagguuaagaauggacaaacuacagcuaaaagguaugucauauucaaugugcaccggaaaauuuaaaguggucaaggaaauagcugaaacucaacaugguacaauagugauuaggguacaauaugagggagacggaucaccuugcaagauaccauuugagauaauggauuuagagaaaagauacauccuaggcaggcuuauaacgguaaauccuauuguaacggagaaagauucaccaguaaacauagaagcagaaccaccguucggagacucauauauaauuauaggcguugaacccggacaauuaaaauuaaauugguucaagaaaggaaguucuauuggucaaauguuugaaacaacuaugagaggcgcuaaaagaauggcaauacugggugauaccgccugggauuuuggaucauuagguggagucuucacauccaucgguaaagcacuucaucagguauucggagcgaucuacggugcugcguucucaggcguuagcuggacuaugaaaaucuuaauaggaguuauuaucacauggauugguaugaauagucggagcacaaguuuaagcgugucguuaguucuggucgguaucguuacacucuaucuuggaguaaugguacaagcagacucaggguguguugucucguggaaaaauaaggaacuuaaaugcggaagugguauauucauaaccgauaacguacauacauggacugaacaguauaaauuucaaccagaaagcccguccaaacuagcuagcgcaauccaaaaggcucaagaagaaggaaucugugguauccgaaguguuacuagacuggaaaaccuaauguggaaacaaaucaccccugaauuaaaucauauucuugcugaaaaugagguaaaauuaacuauuaugacuggagauauaaaaggcauaaugcaagccgguaaaaggagucugagaccgcaacccacagaacugaaauauaguuggaaaacuuggggcaaggcuaaaaugcuaucaaccgaaucauauaaccagacuuuucuaauagaugggccggaaacaacugaaugucccaacacgaauagggcauggaacucucuugaagucgaagauuauggcuuugguguauucacuacaaauauauggcuuaagcucaaagaaaaacaagacgcuuuuugcgauucaaaguugauguccgccgccauaaaagacaauagggccguccaugcugacaugggcuauuggauugaguccgccuugaaugauacguggaaaauagagaaagcgucauuuaucgaggucaaaaacugucacuggcccaagucgcauacucuuugguccaauggaguacuagaaagcgaaaugauuauaccgaaaaaccucgcggguccggucagucaacauaacuacagacccgguuaccauacccaaauagcaggaccauggcacuuaggaaaguuggagauggauuuugacuuuugugaugggaccacagucauuguaacggaagacuguggaaaucgaggaccgucuuuacggacuacuacagcaagugggaaauuaauaacagaguggugcuguagaaguuguacucuacccccuuuaagauaccgcggagaagacggguguugguauggaauggagauacggccuuugaaagaaaaagaagagaaccugguaaacuccuuaguaacggcugggcacggucaaguagacaacuucucgcuaggcguuuuagguauggcauuauucuuagaagaaauguugcgaacaagaguuggcacgaaacaugcuauuuugcuuguagcgguaucuuucaugacauuaauaacaggcaauaugucauuuaaagaccuuggaagaguaguagucaugguaggugcuacuauggcagacgacaucggaauggguguaacauacuuagcacucuuagcugccuuuaaaguaagaccuacuuucgcugcuggacuauuacuacgaaaacuuaccuccaaagaacucaugaugacgacaauuggcauagugcuacuaucacaaaguacgauaccugagacuguauuagaacuaaccgaugcgcuagcauuagguaugaugguacuaaagauaguucgaaacauggaaaaauaucaacuggcgguaacgauuauggcaauccucugcguaccuaacgcaguaauauuacagaacgcauggaagguauccugcacaauucuagcagugguuaguguaagcccucugcuucuaacuucaucacaacagaaaacagauuggauaccauuagccuuaacaauaaaagggcuuaaccccacugcaauauuccucaccacauuaagucggacuaacaagaagagaucuuggccgcuuaaugaagcuauaauggcaguuggaaugguuaguauacuggccagcucauuacugaaaaacgacauaccaaugacgggaccacuagccgcuggagggcuguuaacuguauguuauguccuaacagggcggucagcagaucuggaauuagagagagccacagauguaaaaugggaagaccaagcggagauaaguggaucgucacccauacucagcauaacaauaucagaagacgggucaaugaguaucaaaaacgaagaagaagaacaaacuuuaacaauucuaauaagaaccggucugcuuguaauaucgggcuuauucccuauauccaucccaaucacugcugcagcuugguauuuaugggagguaaagaaacaacgagccgggguucucugggaugucccuucuccgcccccaaugggaaaagcugaacucgaagauggggcauaccggauaaaacagaaaggaauauuggguuauucacaaauuggggcugguguauauaaagaaggaacauuucacacgauguggcauguaacgagaggagcaguguugaugcauaaagggaaacgaauugaacccucaugggcagacgucaagaaagaucucaucucauauggaggaggauggaaacucgaaggagaguggaaagaaggagaggagguacaaguauuagcucuagaacccgguaaaaacccuagagcaguucaaacuaaaccagguuuauucaaaacaaauacuggaacgaucggagccgugucacuugauuuuucgcccggcacuagcggaagucccauaauagacaaaaagggaaaagucgugggccuguaugguaacggaguaguaacuagaagcggggcuuauguuucagccauugcgcagaccgagaagaguauagaggauaacccggagauugaagaugauauauuuagaaagaggagacucacgaucauggauuugcacccaggcgcugguaaaacaaaacgcuaucugccugcaauuguaagagaggcuauuaaaagaggauugaggacacuaauuuuagcaccgacgcgaguggucgcagcagagauggaggaggcauuacgaggacucccaauccgauaccaaacgccggccauacgcgcagaacauacagguagggaaauuguggaucuaaugugucaugcuacauuuacgaugagacuucugucaccuguucgagugccgaauuauaauuugauaauuauggacgaagcccacuuuaccgauccugcuaguauagcugccagagguuauaucucuacaaggguugagaugggagaagcugcggguauauucaugaccgcuacuccaccagguucaagagacccauucccacagucaaacgcgccuauaauagaugaagaaagagagauaccagagaggagcuggaacagcggucaugaguggguaacagauuuuaaagggaaaacaguaugguucguaccauccaucaaggccgguaacgauauagcugcaugucuucguaaaaacggcaagaaaguaauccagcuuaguagaaaaacuuucgauucugaauaugcuaaaacccgaacaaaugauugggauuucguugugacuacugacauaucugaaaugggagccaauuuuaaagcagaaagagucauagauccuaggcgauguaugaaaccgguaauccuaacagauggagaggaaaggguuauucucgcuggaccuaugccagucacacauaguagcgcagcgcaaaggcggggacguauaggccguaaccccaagaaugaaaaugaucaauauaucuacaugggagaaccacuagagaaugacgaagacugcgcacauuggaaggaagcuaaaauguugcuagauaacauaaauacgccagaaggaauaaucccauccauguuugaacccgaacgggaaaaggucgaugccaucgauggcgaauauagacuccggggagaagcacgaaagacauuuguagaucucaugaggaggggcgauuuaccaguaugguuggcauauaaaguggcugcggagggaaucaacuacgcagacaggagaugguguuucgaugggaucaaaaacaaucaaauucuagaggaaaauguagaaguagaaauuuggacaaaggagggagaaaggaagaaacugaagccgagguggcuugauaguagaauuuacagcgacccucuagcccugaaagaguucaaagaguucgccgcggggcggaagaguuuaacuuuaaacuuaauuacagagaugggucgucuccccaccuucaugacccaaaagacaagagaugcgcuagauaaucuggcaguacuucauacagcugaagccggugggagagcauauaaucaugcacucucagaacuccccgaaacauuagagacucuucuucuacugacguugcuagcgacugugacaggagguauauuucuauuucuaaugaguggaagaggaauuggaaaaaugacacuaggaauguguuguaucauuacagcgucuauacuuuuaugguaugcacaaauacagccacacuggauugcagcaucgauaauucuugaauuuuucuuaauaguuuuacuaauaccagagccugaaaaacaaaggacaccucaggauaaucaacuaacuuacguuguuauugcaauucuaacugugguagcagccacuauggcaaacgaaaugggauuuuuggaaaagacgaagaaagaucuagggcuuggcucuauugccacacaacagccugaauccaauauacuagacauagaucuccgaccagcgagugccuggacacuauaugccguugcaacaaccuucgugaccccaauguuacggcauaguaucgaaaauagcucagugaacgucagucuaaccgccauugcuaaucaagcuaccguacuugucggacuuggaaaagguuggccauuaucaaaaauggauauagguguuccguuacuagcgaucgguuguuacucucaaguaaauccaauaacacugacagcagcucuuuuguuauuaguggcacacuaugccauaauugguccaggauuacaagcuaaagcgacacgggaagcgcaaaaacgagcagcagcaggaauaaugaaaaauccaacgguugaugguaucacaguaauagauuuagacccaaucccauaugacccaaaauuugaaaaacaauugggacagguaaugcuacuaauacuuugcguuacacaagucuuaaugaugcgaacaacuugggcauugugcgaggcuuuaacccuugccaccgguccuauuaguacuuugugggaagguaacccaggaagauucuggaacacuacgauugccguuucaauggcaaauauauuuaggggguccuaucuagcaggagcgggcuuauuauucaguauaaugaaaaacacuacuaauacaagacgcgggaccggaaauauaggagaaacucugggagagaaauggaaaucucguuuaaaugcucuaggaaaauccgaguuccaaauuuacaagaaauccggcauucaagaaguugacaggacacuggcgaaagaaggaaucaaaagaggagagacugaccaucaugcugucaguagggggagugcuaaauuaaggugguucguagagcggaauaugguuacaccggaaggcaaggucguggauuuaggaugcggucgcggggguuggucguauuacuguggagggcucaaaaacguaagagaagucaaaggacuuacaaaaggaggaccuggccacgaagaacccauaccaaugagcacuuacgguuggaauuuaguacgauuacaauccggaguugauguguucuuuauucccccggaaaaaugugauacucuuuuaugugauauaggcgaaagcucaccaaacccgacaguagaagcuggccguacucuccgagucuuaaauuuggucgagaacuggcuuaauaauaauacccaauuuuguauuaagguauugaaucccuacaugccuagugugauugagaaaauggaagcacuacaacgaaaauaugggggugccuuaguacguaauccacugagcagaaauaguacacacgaaauguauuggguaucuaacgcaagugguaacauagucagcucaguaaacaugaucucaagaauguuaauuaauagguuuacaaugcggcauaagaaggccacuuacgaaccagaugucgauuuaggcucugguacacguaacaucggaauugagagugaaguaccuaaucucgacauaaucggaaaaagaauagagaaaauuaaacaagagcaugaaacaaguuggcacuacgaucaagaccauccauacaaaacuugggcguaucaugggagcuacgaaacaaaacaaaccggauccgcauccucuaugguaaauggaguaguuagguuacuaaccaaaccuugggacguucuuccuaccguaacccaaauggcaaugaccgauaccacaccauucggacaacaaagaguuuuuaaagaaaagguagauacucgcacacaggagccgaaagagggaacgaaaaaguuaaugaaaauuaccgcggaauggcuauggaaagaauuagggaaaaagaaaaccccaagaaugugcacgagagaggaguucacacgcaaaguuagaucaaaugcugcucuaggggcuaucuucacagaugagaacaaauggaaaagugccagagaagcuguagaagacagucguuucugggaacucguugacaaagaaagaaaucuccauuuagaagggaagugcgagacaugugucuauaacaugauggguaaacgugagaagaaacuaggugaguuuggaaaagcuaaggguuccagagcaauuugguauauguggcucggggcuagauucuuagaguucgaagcacugggauuccuaaacgaagaccauugguuuaguagagaaaacucauuaagcgguguugaaggagagggacugcauaagcuggguuauauccucagggacguaagcaagaaagaagguggagcuauguaugcagaugauacagccgggugggauacacguauuacacuggaagaucucaaaaacgaggagauggucacuaaucauauggaaggugaacacaagaaauuagcugaagcuauuuucaagcuaacauaccagaauaaaguagugaggguacagcgcccaacgccucgaggaacagucauggauauuauuucaagaagagaccaaagaggaucuggucaagucgggacuuacggucuaaacacguucacuaacauggaagcacagcugauacgacagauggaaggggaagggguuuuuaagaauauucaacauuuaaccguaacggaagaggucgcuguacagaauugguuagcucguguugguagggagagguugucucggauggccaucagcggugacgauugugucguuaaaccucuagaugaccgauucgcaaacgcauuaacugcauugaacgauauggguaaaaucagaaaagacauacaacagugggagccgagcaaagguuggaaugauuggacccaagugccuuuuuguucacaccacuuucacgaacuaaucaugaaagacggcaggguacuugugguaccauguaggaaccaagaugaauuaauagguagagcaagaaucucacaaggggcaggauggucucuucgagaaacggccugucucgguaaaucauaugcgcagaugugguccuugauguacuuucauagaagagaccugaggcuagcggcgaaugccauuugcucggcaguaccuucacauugggucccaacuucccgaaccacuuggucaauacaugcgaaacaugaguggaugaccacagaagacauguuaacuguuuggaaucgcguauggauaagagaaaacccauggauggaggauaaaacuccgguugaaagcugggaagaaauccccuacuugggaaaaagagaggaccaguggugcggcucuuugauaggacucacgucgcgagcaacgugggcgaaaaacauucaagcugcuauaaaucagguuagaucauuaauagguaaugaggaguacacagauuauaugccaucaaugaagcgauucagacgugaagaggaggaagcugggguccugugguaa

SEQ ID NO: 22340 - RNA, 9876 nt, Artificial Sequence
  derived and/or modified CDS sequence (opt6) from DENV-2__FJ639708__SS-prME
ucugcgggaaugauaauaaugcuuauuccgacgguaauggcauuccaucuaacuacgagaaauggugaaccacauaugauuguagggauccaagaaaaagguaaaaguuuauuauuuaaaaccgaagacggaguaaauaugugcacgcucauggcaauggacuuaggugaacuaugugaagacaccauuacauauaaauguccauuacuaagacaaaaugaacccgaagauaucgauuguugguguaauucaacgaguacauggguuacauaugguacauguacgaccacaggagaacauagacgugaaaaacguucaguagccuuagucccucauguuggaaugggucuggagacuagaacagaaaccuggauguccuccgagggagcauggaaacaugcgcaacgaauugaaacauggauacuaagacacccaggauuuacuauuauggcagccaucuuagcguacacaaucggaacaacacauuuccaacgaguccuuauauuuauauuacuaacagcaguugcaccaucuaugacuaugagauguaucgguauaucaaauagagauuucguagaaggggugagcgggggaucuuggguagauauuguccuugagcacggaucaugugucacuaccauggcuaaaaacaaaccuacauuggauuucgaguuaaucaaaaccgaagccaaacaaccagccacucugagaaaauauugcauagaagccaaacuaacaaauacaacuacagaaagccgaugucccacgcaaggagaaccgaguuuaaaagaagaacaagacaaaagauucguauguaaacauuccaugguugauagaggauggggaaacggaugcggucucuuuggaaaaggggguauaguaacgugugcgauguucacauguaagaaaaauauggaagguaaaauaguacaaccagaaaaccuagaguauacuauaguaguaacaccacacucgggagaagaacacgcagucggaaaugacaccggaaaacacggaaaagaaauuaaagucacgccccaaucgucuauaacagaagccgaauuaacagguuaugguacugugacaauggaauguuccccaaggacuggucuagacuucaacgaaaugguauuacuacaaauggaaaauaaagcauggcugguucauaggcaaugguuuuuagauuugccacuuccguggcuucccggagcugacaaacaagaaaguaacuggauccaaaaagagacccuaguaacauuuaaaaacccacacgcuaagaaacaagauguuguuguauuagguucucaagagggggcgaugcacacagcgcuaacgggagccacugagauccaaaugucauccggaaaucuucucuuuacagggcaucuaaaaugucgauugcgcauggacaaauugcaacuuaagggcauguccuauagcauguguacaggcaaauuuaaaguuguaaaggaaauagcugagacgcaacaugggacaauaguaauacgggugcaauacgaaggugacggaaguccauguaaaauuccauucgagauaauggaucucgagaaaagauauauacugggaagauugauaacagucaacccaauaguaacagagaaagauucaccagucaacauagaagcugaaccgccguuuggugauucauauauuauaauugggguagagccaggucaacuuaaauugaauugguuuaagaaagguucaaguauaggacaaauguuugagacgaccaugagaggcgcuaaacgcauggcgauuuuaggagauacggcgugggauuuugguucacucggagguguauuuacauccauagguaaggcuuuacaccaaguauuuggugcuauauauggagcagcuuuuaguggcgucucauggacgaugaagauuuugauugggguaauaauuacguggauagggaugaauaguagaucgacuagcuugaguguuaguuugguccuaguugggauaguuaccuuauaccugggaguaaugguucaagcugauucagggugugucgucucauggaaaaacaaagaauuaaaauguggaucaggaauuuuuauuacagacaacguccacacauggacggaacaguauaaauuccagccggagaguccgagcaaauuagcaagcgccauacagaaagcucaagaagaaggaauauguggaauaagaucaguaacuagauuagaaaauuuaauguggaaacaaauaacuccagagcuaaaccauauccuagcggaaaaugaagucaaguuaacuaucaugacuggagacaucaaaggaauaaugcaggccggaaagagaucacuucggccacaacccacagaacucaaguauuccuggaaaaccuggggaaaagcgaaaauguugaguacagaaucuuacaaccaaacauuuuuaauagaugggccggaaaccgcggaaugcccaaacacuaacagagcauggaacuccuuagaagucgaagauuauggauucggaguauuuacaacuaacauuugguugaaacuaaaagaaaaacaagacgcauuuugugacucaaaacuaaugagcgcggccauuaaggauaaccgggcuguucaugcugauauggguuauuggauagaaagcgcauugaaugauacguggaaaauagaaaaagcaucuuucauugaaguuaagaauugccauuggccaaaaucucauacacuuuggaguaaugguguacuugaaucagagaugaucauccccaagaaucuagcuggcccggugucucaacauaauuauaggccuggauaucacacucaaauagcaggaccguggcauuuggguaaacuugagauggauuuugauuucugcgacggaacgacuguuauaguaacugaggauugcgguaauaggggaccuucguugaggacgacaacugcuuccgguaaacuuauuaccgaaugguguugcaggagcugcacccuaccaccguuacgcuaccguggcgaagauggauguugguacggcauggaaauaagaccgcuaaaagagaaggaagaaaauuuaguaaacagucuugucacugcaggucaugggcaaguagacaacuuuucacuagggguuuuagguauggcuuuauuucuagaggaaaugcucagaacucggguaggaaccaagcaugcuauacuacugguugcaguauccuuuaugacgcuaauaacgggcaacaugucauucaaagauuuaggacgugugguaguaaugguaggugccaccauggccgaugauaucggcaugggaguaacuuacuuagcacuucuggcugccuucaaaguaagaccuacauuugcugccggguuauuacuuaggaagcuaacaucaaaagaguuaaugaugacaacaaucgggaucguauugcuuucacaaucaacaauaccagaaacuguauuagagcuaacagaugcacucgcauuaggaaugaugguuuuaaagauaguaaggaacauggaaaaguaucagcucgccguuacaaucauggcuauuuugugugucccaaacgcagucauucuucaaaacgcuuggaaaguaucauguacuauuuuagcaguuguuuccgucagcccacuccuacuaacauccagccaacagaaaaccgacuggauaccgcuagcuuugacgauaaaaggauugaauccaacugcaauauuccuuaccacauuaaguagaacgaauaagaaaagaucuuggccauuaaacgaagcaaucauggcaguaggaauggugucuauauuagcaagcuccuuacuuaaaaaugacauaccaaugacaggcccccuaguagccggagguuuacucacagucugcuauguauuaacgggucgaucagcagauuuagagcuugaacgagcaacugauguuaaaugggaggaccaagcugagaucucaggaucuaguccgauucuuucaauaacuauuucggaagacggcuccaugucaauuaaaaaugaagaagaagaacagacacuuaccauacuaaucaggaccggauuauuaguaauuucagggcuuuucccaauaucuauuccaauaaccgcggcggccugguaucuaugggaagucaaaaagcaacgugcuggaguacuaugggacgucccaucgccgccgccuaugggcaaagcagaauuagaggauggagcauacagaauuaaacaaaaaggaauacuaggauauucucaaauuggagcaggaguauacaaagaggggaccuuucauacaauguggcauguuacacguggagcgguccugaugcacaaaggaaagcgcauagaaccaaguugggcggacguuaaaaaggacuuaauaucauacgguggaggauggaaacuagaaggagaauggaaagaaggcgaagaaguccagguacuugcauuagagcccggcaaaaauccuagagccgugcaaacuaaaccuggacuauuuaagacuaacacaggaacaaucggggccgugaguuuagauuuuagcccagggacgucuggaucaccgaucauagauaagaaagguaaaguugucggacuauauggaaauggcgucguaacucggucuggggcuuaugugucagcaaucgcucaaacagaaaaaucaauagaagacaauccugaaauugaagaugauauauuucgaaagcgcagauuaacaauuauggaucugcacccaggcgcuggaaaaacgaaaagguaccuaccagcaaucguacgagaagcaauaaagcgaggccuuagaacguuaauacuagcacccacuagggugguagcggcugagauggaggaagcguuacguggccuuccuauaagauaucagacuccagcuauacgagcugaacacacaggucgagagauuguagaucuaaugugucacgcgacauucacuaugagauuauuaucaccagucagaguacccaauuacaacuuaauaauaauggaugaggcucauuuuacugacccugcgucaauugcugcccgaggauauauaucaacaagaguggaaaugggagaagccgcuggaauuuucaugacagcuaccccuccagggaguagagauccauucccucaaucaaacgcacccauaauagacgaagaaagagaaauaccagagagaucauggaacucaggucaugaauggguuacagacuuuaagggaaaaaccguaugguuugugccaucgaucaaagcuggaaaugauauugcggcaugucuaaggaaaaauggaaagaaaguaauacagcuuucaagaaagacguucgauagcgaauacgucaaaacuagaaccaaugacugggauuuuguugugacaacagacauuagugagaugggagcgaauuucaaagccgagagaguaauagauccuaggcgcuguaugaaaccuguaauuuuaaccgauggcgaagagagggucauuuuagcaggacccaugccuguuacucauuccuccgcagcacaaagaagaggcagaauaggaaggaacccgaaaaacgaaaaugaccaauauauauauaugggggaaccacuagaaaacgaugaagacugugcucacuggaaagaagcaaaaauguuauuagauaauauuaauacucccgaggggauaauacccucuauguuugaaccugaacgcgaaaaaguugacgcgaucgauggagaguaucgcuuaagaggugaggcccgaaaaacauuuguagaucucaugagacgaggcgauuugccagucuggcuugcauacaaagucgcagcugaggggauuaauuaugcagacaggcggugguguuucgaugguaucaaaaauaaucagauuuuagaagaaaacgucgaaguugagaucuggaccaaagaaggagaaagaaagaaacugaagccaagauggcuagacgccaggauauauagugauccauuggcgcucaaagaguucaaagaguucgcugcagggagaaagagcuuaacacuuaacuugauaacagaaauggguagauugcccacguucaugacacagaaaacaagagacgcgcuagauaacuuagcaguauugcacacugcugaagccggugggcgagcguauaaucacgcacuaagcgaauuaccugaaaccuuagaaacgcuucuacuauuaacguuacuugcaacuguaacgggcggcauuuuccuauuccucaugaguggacgagguauaggaaaaaugacgcuagguauguguuguaucauaaccgcuucaauauuguuaugguacgcacaaauucaaccccauuggauagcggcuucaaucauacucgaauuuuucuuaaucguacucuuaauaccugaaccugaaaagcaaaggaccccacaagacaaucagcugacguacguugugaucgccauacuaacagucgucgccgccaccauggcgaaugaaaugggguuccuugagaaaacgaagaaagaucuaggauuaggaucuaucgcuacccaacaaccagaaucgaacauacucgacauagaccuccguccagcuucagcauggacacuauacgcgguggccacaacuuuuguaacaccaaugcuucgacauucaauugaaaacagcaguguuaacguaagccuaacggcaauugcgaaccaagcuacuguuuuaaugggccuugggaagggauggccacuuucaaaaauggacauaggcguaccauuacuggcuauagggugcuacucacagguaaacccuaucacauugacagcggcguuauuacuuuuaguggcucacuaugccauaauuggaccuggccuacaagccaaagcaacccgagaggcacagaaaagggcagcagcaggaauaaugaaaaauccaacaguugauggaauuacugugauagaccuggaucccauaccguacgauccuaaguuugaaaaacaacuaggacaaguuaugcuccuuauuuuaugugugacccaaguacuuaugaugcggacgacuugggcacucugugaagcauugacauuagcuacugguccaauuagcacacugugggaaggcaacccaggacguuucuggaauacaacgauagccgucucuauggccaauauauuccgugguagcuaucuagcuggugcaggcuuauuauuuucaauaaugaaaaacacuacaaacacucgcagaggaacagguaacauaggugaaacgcucggcgaaaaauggaaaucuagacuaaaugccuuggguaaauccgaauuucaaauauauaagaaaagugggauucaagaagucgacagaacucuagcgaaagagggaauaaaacggggcgaaacagaucaccaugcaguaucaagagguucugcgaaacuccgaugguucguagagagaaacaugguaacaccggaaggaaaggugguagaucuaggcuguggcagagguggcuggagcuacuacugcggcggacucaagaauguccgcgaaguuaaaggauuaacaaaggguggcccagggcaugaggaacccaucccaaugaguacuuauggcuggaauuuaguuagacuacaaaguggaguagacguguucuucauacccccugaaaaaugugacacauuguugugugauaucggagagucaucgccuaacccgacgguggaagccggacgcacccuucgugucuuaaacuuaguggaaaacugguuaaauaacaauacucaauuuugcauaaaggucuuaaacccauacaugccaucaguaaucgagaaaauggaggcauuacaacggaaauauggaggagcucuagugagaaacccuuuaucacguaauuccacccacgagauguacuggguaucaaacgcuaguggaaauaucguaaguucaguuaacaugaucaguaggauguugaucaauagauuuacuaugaggcacaagaaagcaacauacgaacccgauguagauuugggaucggggacgcgaaauauaggaauagagucagaaguuccaaaucuggauauaauaggaaaaagaauagagaagauuaaacaggaacacgagaccucauggcauuacgaccaagaucaucccuauaaaacuugggcuuaucacgguuccuaugagacaaaacaaacagguuccgcaaguuccauggugaauggaguaguaaggcuguuaacuaaacccugggauguuuuacccacggugacucaaauggcuaugacggacacaacuccauucggucaacaaagaguuuuuaaagaaaaaguggauacaagaacucaagaacccaaggaaggaaccaagaaacuuaugaaaauuacagcugagugguuguggaaggaguugggcaagaaaaagacaccgcgcauguguacuagagaagaguucacccgcaaaguacguucgaaugcugcucuaggggccauauuuaccgaugaaaacaaauggaaauccgcccgugaagcaguugaggauaguagauucugggaauuagucgacaaagaacgaaacuuacaucuagaagggaaaugugaaacuugcguuuauaauaugaugggcaaacgugagaagaaauuaggagaauuuggaaaagcuaagggcaguagggcgaucugguacauguggcuaggagcaagauuucuugaauuugaagcucuaggauuucuuaaugaggaucacugguuuagucgagaaaauucgcuaucgggaguagaaggugaaggcuugcacaagcuggguuauauacuaagagacgucuccaagaaagaaggcggggcuauguacgccgacgacaccgcaggaugggauacacggauuacucuugaagaucucaaaaaugaagaaauggucacgaaucacauggaaggggagcacaagaaauuggcggaggcaauuuuuaagcuaaccuaucaaaauaaaguggucaggguccaaagacccaccccacguggaacggugauggauauaauuucuagaagagaccagagaggaucgggacaagugggaacauauggguuaaauacuuucacuaauauggaagcccagcucauuagacaaauggagggugaagguguuuucaaaaauauacagcaucuaacagugacugaagaaguggcgguacagaauuggcuagcacgcgucggccgggaacgacuaagcagaauggcaauaucgggagaugauuguguagucaaacccuuagaugaucgcuucgcuaaugcguuaacugcauuaaaugauaugggcaagauacggaaagauauucagcaaugggaaccgaguaaagguuggaaugacuggacacaaguuccuuuuugcagucaccauuuccaugagcuaauaaugaaggaugggagagugcuaguaguuccauguaggaaucaagaugaacugauugggagggcaagaauaucccaaggagcgggcuggagucuaagggaaacggcgugccuaggaaaauccuaugcccaaauguggucguugauguauuuucauagaagagaucuacggcuugcugcgaaugcgauauguagugcuguaccaucccacuggguacccacaucacguacaacauggaguauacacgcuaagcaugaauggaugacaacugaagauauguugacgguauggaacagggucuggauaagagaaaacccuuggauggaagauaaaacgccgguggaaucaugggaggaaaucccuuaucuuggaaaaagagaggaccaauggugugguucucucauagguuuaacaucucgugccaccugggccaaaaauauacaggcggccaucaaucaagugaggucacuaauaggcaaugaagaauacacagacuacaugccaaguaugaaaagguuuagaagggaagaggaagaagcuggagucuuaugguga

SEQ ID NO: 22341 - RNA, 9876 nt, Artificial Sequence
  derived and/or modified CDS sequence (opt6) from DENV-2__FJ639709__SS-prME
ucugcaggcaugauaauaaugcuaauaccaacgguuauggcauuucaucuaacgacacggaauggggaaccucauaugaucguugguauccaagaaaaaggaaaaucucuuuuauucaaaaccgaagacggaguaaacauguguaccuuaauggcuauggaucuaggugaacuuugcgaagauacgauuacauacaaauguccucuucucaggcagaaugaacccgaagacauagacuguuggugcaacucaacuucaaccuggguaacauauggaacauguacaacaacaggagaacacagacgagaaaaacgcucaguugccuuagugccacacguagggaugggacucgaaacaaggacagaaacuuggaugaguucugaaggcgcauggaaacaugcacaaaggaucgaaaccuggauacuuaggcauccaggauuuaccauaauggcggcuauuuuagcauauaccauagguacuacucauuuucaaagagcacucauuuucauacuacuaacagcgguugcaccuagcaugacaaugagaugcauaggcauaaguaauagagacuucguagaaggugugucaggagguaguuggguagacauugugcucgaacacggaaguugcgugacgacuauggcuaaaaacaaaccgacauuggauuucgaacuaauuaaaacagaagcaaaacaacccgcaaccuuacgaaaauacugcauagaagcaaaauuaacaaauacgacgacugagucaagauguccuacacagggugaaccuucuuugaaagaagaacaagauaaaagguuuguuugcaaacauucuaugguagauagagguuggggaaauggcugcggacuauuuggcaaaggcggcauagugacuugcgcaauguucacauguaagaaaaauauggaaggaaaaauaguucaaccggaaaacuuggaauauacuauuguugucacuccgcacagcggcgaggagcacgcaguaggcaaugacacaggcaaacauggcaaagagauuaaaguuacgccacaaucaagcauaacagaggcagaacucacggguuaugggacagugacuauggaauguagccccaggacgggacucgacuuuaacgagauggucuuauuacagauggaaaauaaagcauggcugguacacagacaaugguuucuagacuuaccacugccauggcuaccgggagccgauaagcaggggucgaacuggauacaaaaagaaacucucguaacuuuuaaaaauccucaugccaagaaacaggacguggucguacuaggaucccaagagggcgcuaugcacacagcuuuaaccggugcgaccgaaauacaaaugucuagcgguaauuuacuauucacaggacaccucaagugccgacuucgcauggauaagcuccaauuaaagggaaugagcuauucuaugugcacggggaaauucaagguugucaaagagaucgcugagacacaacauggaacuauuguaauucgaguacaauaugaaggagacgggagucccuguaaaauacccuuugagauaauggauuuggaaaagagguacguuuuaggaagauuaauaaccgucaauccaauaguaacggaaaaagacaguccggugaacauagaagccgaaccgccauucggagacucauacauuauuauuggggucgaacccgggcaacucaagcugaauugguuuaaaaaggggucauccauuggacagauguuugagacuacaaugagaggggcgaaacgaauggcuauuuuaggggauacagcaugggacuuugguucguugggugguguuuuuacaaguauaggaaaagcacuucaucaaguauucggagcgauauauggugcugcguuuucaggaguaaguuggaccaugaaaauccuuaucggagugauaauuacauggaucgggaugaacucccguucaacgucucuuagcguaucauugguccuagugggaauagugacgcuauauuuaggaguuaugguacaagcagauagcggauguguuguaagcuggaaaaacaaggagcuuaaauguggaucagguauauuuauaaccgacaauguacacacguggacggaacaauauaaauuucaaccagaaagcccgucaaaacuugcaucagccauacaaaaagcucaagaagaagguauaugugggauacggucugugaccagacucgagaacuuaauguggaagcaaaucacaccggaauuaaaucauauacuugcagaaaaugagguaaaauuaacaauaaugacuggggauauuaaaggcauaaugcaagccgggaaaagaucuuuacgaccgcaacccacagaacucaaauauaguuggaaaacaugggguaaagcaaagauguuaucaacugagucucauaaucagacuuuucucauagauggaccugaaacugccgaaugucccaauacuaaccgagcauggaauagcuuagaaguagaagauuauggauucgggguauucacuaccaacauuugguuaaagcuaaaagagaaacaagacgccuuuugugauaguaagcuaaugucugcugcgauaaaagacaauagagcgguacacgcggauaugggcuauuggaucgaaucagcacuuaaugauacauggaaaaucgagaaagcuaguuuuauagaaguuaagaauugccauuggccaaaaucucacacucuauggucuaacggaguauuggaaucggaaaugaucauaccaaagaaucucgcuggaccuguuagucagcacaauuacaggccuggauaucacacacaaaucgcagggcccuggcaccugggaaaauuggagauggauuucgacuuuugcgacgggacuacagucaucgugaccgaagauugcggcaacagaggccccagcuuacggacaacaaccgccucuggaaaacuaaucacagaauggugcuguagguccugcacucucccuccuuuaagguacagaggugaggacggcuguugguacggaauggaaauacguccucuaaaagaaaaggaagaaaaccugguuaacuccuuaguaacugcggggcacggccaaguagauaauuuuagucucggcguauuaggaauggcacuauuccuggaagaaauguuacgaacacgugugggcacuaaacaugcuauacuauuaguagcgguaaguuucguuacccuaauaacugguaacaugagcuuuaaagaccuaggacgcgugguaguaaugguaggcgcaacaaugaccgacgauauuggaaugggaguuacauaucuagcauuauuggcagcuuuuaaaguaagaccuacguuugcagcgggacuuuuacuacgaaaauuaacaucgaaagaauuaaugaugaccacgauaggcaucguauugcugucacaaaccaccaucccugaaacuauacuggaauuaacugacgcucuggcucuggguaugaugguccuuaagauaguacgcgauauggaaaaauaccagcuagcagucaccaucauggcaauacuuugcgucccgaaugcugugauauuacaaaacgccuggaaagucaguugcacgauccuugcagucguuagugucucaccucuccuucugaccucaucacaacaaaagacugauuggaucccacuagcucuaacaaucaaaggauuaaacccaacugccauauuuuuaacuacuuuaagucgaacuaauaagaaacgaucuuggccguuaaacgaagccaucauggccguuggaaugguuagcauuuuggcuaguagcuugcuuaaaaacgacauacccaugacaggaccuuuagucgccggugggcuccugacagucuguuacguguuaacaggccgaagcgcagaucuagaacuugagcgagcuacggacguaaaaugggaagaucaagcugaaauuaguggaucuuccccaauacugucaauaacuauaucggaagaugguucgaugucuauuaaaaacgaagaagaagaacaaacucuaacgauuuuaaucagaacugguuuguuaguuauuucuggcuuauuuccaguuucaauaccuauaacggcagcugcaugguauuuaugggagguaaagaaacagagggcgggaguacuaugggauguaccaucuccgccuccgaugggcaaggcugaauuggaagauggugcguaucguaucaaacaaaaagggauucuaggguacucucaaauuggugcuggcguguauaaagaagggacguuccauacaauguggcaugucacacgaggugccguauugaugcauaaagguaagcgaauagagcccagcugggcagacguuaagaaagaucuaauaucauacggagggggcuggaaacuugagggagaauggaaggaaggcgaggaaguacaaguucucgcauuagagccggguaaaaauccgcgagcaguccagacaaagccaggacuauucaaaacgaacacggguacuaucggagcaguuagcuuagauuuuucacccgguacaucagggagucccauuaucgacaagaaaggaaaagugguaggccuuuacggaaacggaguaguaaccaggaguggagcauacguaagugcaauugcucagacggaaaagagcauugaagacaauccggaaauugaagacgacauauuucgaaagcgucguuuaacuaucauggauuuacauccuggcgccgggaaaacaaagagauauuuaccggcaaucguuagggaggcaauuaaaagaggccuucguacacuuauuuuagccccuacaagaguuguagcggcugaaauggaagaagcgcuccgaggauuaccaauucgcuaucaaaccccggcuauccgugcugaacacacaggaagagaaauaguagauuuaaugugucacgcaacguucacgaugcgauuacuuagcccggucagagucccgaacuauaaucuaauuauaauggaugaggcucauuuuaccgauccagcaagcaucgccgcgagaggauauauuuccacaagagucgaaaugggagaagcagcaggaauuuuuaugacugcuaccccuccaggcagccgagacccuuuuccgcaaaguaaugcuccaauaauugaugaggaaagggaaauacccgaacgcuccuggaacaguggucaugaaugggucacagauuuuaaaggcaaaacaguuugguuuguaccaucuauuaaggcaggcaacgauauugccgcguguuugagaaagaauggaaagaaaguuauacaacuaagucggaaaacuuucgauuccgaauacguuaaaacgaggacuaaugauugggauuucgucguaacaacggacauuucugagaugggggccaauuuuaaagcggaaagaguaauagauccuagacgauguaugaaaccaguaauuuuaacagauggugaagagagggucauucuagcuggaccgaugccggucacgcauucgucugcagcucaaagaagggggcgaauuggcagaaacccuaaaaaugagaaugaucaauacauuuacaugggagaaccccuugagaacgaugaagacugugcacauuggaaagaagcaaaaaugcuauuagauaacauuaauacaccggagggaauuauaccaucgauguuugaaccggaaagagaaaaaguugacgcaauugacggcgaauaucgguuacgaggugaagcacggaaaacauucguggauuuaaugcguaggggagaucuaccagugugguuggcauacaaaguugcagcggaagguauuaacuaugcugaccguagaugguguuucgaugguauuaaaaauaaucagauauuagaagaaaauguagaagucgagauuuggaccaaggaaggcgaacguaagaaguuaaaaccucgaugguuagacgcccgaauauacagcgauccucuugcucuaaaggaauuuaaagaguucgcugcaggaaggaaaaguuuaacacuaaacuugauaacggaaauggggcgauuacccacguucaugacgcagaaaacgagagaugcucucgacaauuuagcaguacuccacacagcugaggcaggaggacgagcauacaaccaugcauuaagugaacuaccugagacacuagaaacacuuuuauugcuaaccuugcuugccaccgucacuggagggauuuucuuauucuugaugucaggaagagggaucggaaaaaugacguuaggaaugugcugcauaauaacagcaucaauacuauuauggaacgcucaaauccaaccacauuggauugccgccaguauaauacuagaauuuuuccuaauuguccuacuuauuccugagccggaaaaacaaagaaccccacaagacaaccaacuuacguacgugguaauagccauucugacgguaguagcugcaacuauggcaaaugagauggguuuucuagagaaaacaaagaaagaucuuggauuagguaguauugcuacgcaacagccugaaaguaacauacuagauauugacuuaagaccagcuucagcuuggaccuuguaugcaguagcaacaacauuuguuacgcccaugcuaagacauucuauagaaaauucuaguguuaacgucucauuaaccgcuauagcaaaccaagcaacuguacuaaugggccuaggcaaaggcuggccuuuaucuaagauggauaucggggucccacucuuagcgauugguuguuauucacagguuaacccaauuacuuuaacugcggcacuucuauuacuuguagcccauuacgcaauaaucggaccgggacuacaggccaaagcuacgagagaagcucagaaaagggcugcagcggggauaaugaaaaaucccacuguagauggaauaaccgugauugaucuugacccuaucccauaugauccgaaguuugaaaaacagcugggacagguaaugcugcuuauauuauguguuacucaaguacugaugaugagaaccacaugggcucuuugugaagcacugacucuggcaaccgguccuauuucuaccuuaugggagggcaauccuggucgauucuggaauacuacaauugcaguuucaauggccaacauuuuuagaggaaguuaccuggccggugcggguuuacucuucaguauaaugaagaacacaacaaacacaagaaggggcaccggaaauauaggggagacacuaggugagaaauggaaaucuagguugaacgcacuaggaaaaucugaguuccaaaccuacaagaaaagugguauucaggaaguugaucguacucuagcaaaagaaggaauuaaaagaggagagacagaucaucaugcaguauccagaggaagcgcuaaauuacggugguuugucgaacgaaauauggucacuccagaggguaagguaguggaccucggguguggaagaggcggcuggagcuauuauuguggaggacuaaagaaugugagagaagucaaaggauugacaaaaggagggccuggccaugaggaaccuauaccaaugucaaccuacgguuggaaucuuguuagauuacaaucaggaguagacguauuuuucauaccuccagagaaaugugauacauuauuaugugacauaggcgaaucaucaccaaauccaaccguugaagccggcagaacauuacgaguucuuaaucugguggaaaacugguuaaauaacaauacucaauuuugcaucaagguauuaaauccguacaugccauccguuauugaaaagauggaggcacugcaaaggaaauaugguggggcacuuguacguaauccauuaucaagaaacucgacucaugaaauguacugggucucaaaugcuucagggaauauaguauccuccguuaauaugauuucaagaaugcuuauaaacagguucacaaugagacauaagaaagcaacauaugaaccagacguggaucuaggaucaggaacaaggaacauaggaauagagucagaaauucccaacuuagauauuauaggaaagagaaucgagaaaauaaaacaggaacaugaaacaucuuggcauuaugaccaggaccauccauauaaaacuugggccuaucacggcaguuacgaaacuaaacaaacagggagugccucuagcaugguaaauggagucguacgauuacuaacgaaaccaugggacguacuuccuacaguaacacaaauggcaaugaccgacacuacuccuuuuggacaacagaggguuuucaaagaaaaaguagacacacgaacucaagagccuaaggaagggacaaagaaacugaugaagauaacugcugaauggcucuggaaagaacuugguaagaagaaaacaccucgcauguguacacgugaggaauuuacaagaaaaguuagaagcaacgcagcucuaggugcgauuuuuacagaugagaacaaguggaaaucagcaagagaagcaguagaagacaguagauucugggaauuagucgacaaagaaaggaaccuccaucucgaaggaaaaugcgaaacaugcguuuacaauaugaugggcaaacgggagaagaaacuaggcgaguuuggcaaagccaaagguucucgagcaaucugguacauguggcuuggugcacgcuuucuugaguucgaagccuuaggauuccuuaacgaagaucauugguuuucacgggagaauagucucucaggugucgaaggagagggauuacauaaguuggguuacauacuucgagacguaaguaaaaaggaaggaggagcuauguaugcagaugacacggcaggcugggacacuaggauaacuuuagaagaccucaagaacgaagaaaugguaacuaaucauauggagggcgagcacaagaaacuagcagaggcaauauucaaacuuacuuaucagaacaaggucguucgaguacaacgaccaaccccaagggguacgguaauggauauaauuucaagaagagaccaaagaggaucaggucagguaggaacuuauggcuuaaacacauuuacuaauauggaggcacaacuaauucgacagauggaaggagaaggaguuuuuaaaaacauacaacaucuaacagcaacagaagaaguagcaguacaaaauuggcuagcaaggguaggacgggaaagauuaucgcguauggccauaucaggagacgauugcgucgugaaaccccuugaugaucgcuuugccaaugcauuaacagcgcuaaacgauaugggaaagauacgaaaagacauucaacaaugggaaccaucuaaggguuggaaugauuggacacaaguuccuuucuguucucaucauuuccacgaacuaauaaugaaagauggucguguauuaguagugcccugcagaaaucaagacgaauuaauuggucgggcgcgaaucagucagggagcuggauggucguuacgugagaccgccugcuuaggcaaaucguacgcucaaauguggucccucauguacuuccaucgucgggaccucaggcuugccgcgaacgcuauaugcuccgcugucccaucucauuggguuccgaccaguaggaccacuuggucgauacacgcgaagcacgaauggaugacgacugaagauauguuaacuguauggaauagagucuggauuagggaaaauccauggauggaagauaaaacuccuguagaguccugggaagaaauuccauauuuagggaaacgagaagaccaguggugcggcucccuaauuggguuaacuagccgagcuacaugggccaaaaauauucaagcagcaauuaaucagguaagaagucuaauaggcaaugaagaauauaccgauuacaugccauccaugaaaagauuuaggcgagaagaagaagaggcuggaguguuaugguag

SEQ ID NO: 22342 - RNA, 9876 nt, Artificial Sequence
  derived and/or modified CDS sequence (opt6) from DENV-2__FJ639710__SS-prME
agcgcuggcaugaucauuaugcuaauuccaacuguaauggcauuucacuugacuacaaggaauggcgaaccgcacaugaucguugguauucaagaaaaagguaaaucgcuguuauuuaaaacagaagaugguguaaauauguguacacugauggcuauggacuuaggugaauuaugcgaagauaccauuacuuacaaaugcccacuacuaaggcaaaacgaaccagaagauauagauugcuggugcaacagcacaaguacuuggguaaccuacggcacuugcacaacuacaggggaacauagaagagagaaaaggaguguggcacuugugccacauguagggauggguuuggaaacacgcacugaaacauggaugaguucggaaggagcauggaaacaugcacaacguaucgaaaccuggauauuaagacacccgggauuuacuauaauggcugcaaucuuagcauauaccaucgggacgacacacuuucaacgagcguugauuuuuauauuacuaacagcggucgcaccaucaaugacuaugcggugcauuggaauauccaaucgugacuuuguagaaggaguuagcggcggaaguugggucgacauaguacuagaacacggaucgugcguaacgaccauggcuaaaaacaaaccgaccuuagacuucgaacuaauaaaaacugaagcaaaacagccagcaacauuaagaaaauacuguaucgaagcaaaacuaacuaacacgacuacggaaucacguuguccaacucagggagaaccgagccuaaaagaagaacaagauaaaagguucguauguaaacacuccaugguugauagagguuggggcaacggcuguggacuuuucgggaaaggcgcuauaguaaccugugcuauguuuaccugcaagaagaacauggaagguaagauaguccaaccggagaaucuugaauacaccauagugguaacaccucacucuggagaagaacacgcggucggaaaugacacagguaaacacgguaaagaaauuaaagugacuccacaaaguucgauuacggaagcugaacuaacaggcuacggaacgguuacgauggaaugcucaccuagaacuggauuggauuuuaaugagaugguacuacugcaaauggagaauaaagcauggcuaguucacaggcaaugguuccuggauuuaccguuaccaugguuaccaggcgcugauaaacaggaaucaaauuggauucagaaagaaacuuuagucacauuuaaaaauccccacgccaagaaacaagacguaguaguacuaggaucgcaggaaggugcaaugcauacagcauuaacaggcgcaacagaaauucagaugucaagcggaaaccugcuauuuacaggucauuuaaaaugucgauuaagaauggauaaacuccaacuuaaagguaugucauauaguaugugcacaggaaaauucaaaguggugaaagaaaucgcggagacgcaacaugguacgauagucauacguguucaauaugaaggagaugggaguccauguaaaauaccuuucgaaaucauggauuuggagaaacgauauguacucgguagguugauaacuguaaauccaauuguaacagagaaagauucaccaguaaacauagaggcggaaccaccuuuuggagauagcuacauaauuaucggaguugaaccggggcaacuaaaacugaauugguuuaagaaaggaucuagcauaggccaaauguucgaaacuacaaugagaggagcaaaaagaauggccauuuuaggggacacagccugggauuucgggucucuugguggagucuuuacuucuauagguaaagcccuacaucaaguauuuggagcaauuuauggcgcagcguucucaggagucagcuggacaaugaaaauucuuaucggcguuaucauaacguggauuggaaugaauagcagaucaacaagucuuaguguauccuuaauucuggugggaaucguaacacuauauuuaggcguaaugguacaggcagacaguggauguguaguaucauggaaaaauaaagaguuaaaauguggaucuggaauauuuauaaccgacaauguucacacuuggacagagcaauauaaauuccaaccagagagcccaucaaaacuggcaagugcuauucaaaaagcacaggaggaggguauuugugggauacgaucgguaacacgcuuagaaaauuugauguggaaacaaauuacacccgaauugaaccauaucuuagcagaaaaugaaguaaaauugacgauuaugacaggagauauaaaagguauuaugcaagcggggagacgaucgcuaaggccacaacccaccgaauuaaaauauucauggaaaacgugggggaaagcuaagaugcuuucaacggaaaguuauaaucaaaccuuccucauugaugggccugaaacaacagaauguccuaauacuaauagagccuggaacucacuagaaguggaagauuauggguucggcguauuuacaacaaacauauggcugaagcuaaaggaaaaacaagaugcuuucugugacucaaaauuaauguccgcggccaucaaagauaauagagcuguucacgccgauaugggauacuggauagagucagcacuuaacgauacuuggaaaaucgaaaaagcaucauuuauugaagucaagaauugccauuggccuaaaucgcacacgcuuuggucuaacggaguuuuagaaagcgaaaugauuauuccuaagaauuuggcugguccaguuucccaacacaacuaccgaccgggauaccauacacaaauugcugggccuuggcacuuaggcaaauuagaaauggacuuugauuuuugugacggaacgacagucauugucacagaagauugcgguaaucgugguccuucauugaggacuacuacagcaucagguaaguuaauaaccgaaugguguugccgcagcugcacucugccaccacuaagguaucgaggugaagacgggugcugguacgggauggaaauuagaccucuaaaagaaaaagaagaaaaucuugucaacucccuaguaaccgcuggacacgggcaaguugauaauuuuucauuggguguccuaggcauggccuuauuucucgaagaaauguuacgaacacgcguuggaaccaagcacgcaauauuacugguagccguaaguuucguaacacuuauuacgggaaacaugaguuucaaagaccuggggcggguugugguaaugguaggagcaacuauggcagacgacauagguaugggaguuacauauuuagcccuauuagccgcauuuaaagugagacccacuuucgcagcggguuugcuauugaggaaacucaccuccaaagaacuaaugaugacaaccauuggaauuguacuccuuagccaauccacgauuccagagacaauacuagagcugacggacgcauuagcucucggaaugaugguacuaaaaauaguuagaaauauggaaaaauaucaacuagcuguuacaauuauggcaauacugugcguuccuaaugcuguuauacuacaaaacgcauggaaaguuagcugcacuauauuagcaguaguaagcgucucgccauuguuauuaacaaguucucaacagaaaaccgauuggauuccauuagcacuuacuaucaaagggcucaaucccaccgcuaucuuccuaacuacauuaaguaggacuaacaagaaacgaagcuggccuuugaaugaggcgaucauggcaguagguaugguaaguauccuugcgaguagccuuuugaaaaacgacauaccgaugaccggaccucucgucgcgggaggacuacuuacgguguguuauguuuugaccggaagaagugcugaucuugagcuagagagggcaacagauguaaaaugggaggaacaagccgagauaucuggcaguagcccaauucuuaguauaacgauaagugaagaugggucaaugucaaucaaaaaugaagaggaggaacaaacccugaccauacugaucagaacaggguugcuuguuaucucugguuuguuccccaucaguauaccaauaacggcugcagcaugguacuugugggaagucaagaaacaaagggcugggguacugugggauguaccgucaccuccaccaauggguaaggcagaacuugaagauggggcauacaggauuaagcagaagggcauauuaggauauucucaaauuggggcuggaguguauaaggaaggaacauuucacacuauguggcacgucacacguggugcaguuuugaugcacaaaggaaaacggauugagccaucaugggcagaugucaagaaagauuugauuuccuaugggggcggauggaaacuagagggagaguggaaagagggagaagaaguucaaguucuagccuuagaaccggguaaaaauccgagggcaguccagacaaagcccggccuuuucaaaacgaauacuggaacaauaggcgcugugucauuggauuuuagcccaggcacaucgggaaguccuauaauagacaagaaagguaaaguuguaggguuauaugguaauggagucgugacgcgcagcggcgcauaugucagcgcaaucgcacaaacagaaaagagcaucgaggauaauccagaaauagaagacgauaucuuucguaaacgacgacucacuaucauggauuuacauccaggagcaggaaaaacaaaaagguauuugccagcaauagugcgugaagcuauuaaaagaggacuucgcacucuaauacuggcgccgacgagagucguagcagcagaaauggaggaagcccuccgcggcuuacccauuagauaucaaacuccggccauaagagcggagcacaccggucgugagauaguagauuuaaugugccaugccaccuucacgaugaggcuucuuucaccugugagaguuccuaauuauaauuuaaucauaauggacgaagcucauuuuaccgacccugccucaauagcggcucgaggauauaucucaacacgaguugaaaugggggaagcggccgguauauucaugaccgcuaccccaccaggauccagggauccguucccacagaguaaugcaccaaucauagaugaagaaagagaaauuccagaacguucauggaauagcggacacgaguggauaacggauuuuaaaggaaaaacaguaugguuuguaccuucuauaaaagcuggaaaugacauagccgcgugucuccguaaaaaugggaagaaagugauacaacugucaagaaaaacauuugacucagaauauguaaaaacaagaacuaacgauugggauuuuguagucacuaccgauauaagugaaaugggugccaauuucaaagccgaacgcguaauagacccacgacgaugcaugaagccagugauucugacagauggagaagaaagagucaucuuagcaggaccaaugccaguaacgcacucgucagcagcucaacgcagaggacguauaggacgcaaucccaaaaaugaaaaugaccaauauauauauaugggagaaccuuuagagaaugacgaagauugugcacauuggaaagaagcgaaaaugcuucuagacaacaucaacacaccugaaggcaucauaccuucaauguucgagccggaaagagaaaaaguggaugcaauagauggggaauaucguuugaggggcgaagccagaaaaacauucguggacuuaaugagacgcggcgaucuaccugucuggcuugcuuauaaaguugcugccgaagggauaaauuacgcagaucggcguuggugcuuugauggaauuaaaaauaaccaaauuuuggaggaaaacgucgaaguagagauauggacaaaggaaggugaaagaaagaaacuuaaaccucgauggcuugaugcgcgcauuuacagcgacccauuagcacuuaaagaauuuaaagaauuugcagcaggacgcaaaucuuuaacgcugaaucuaauaacggaaauggguagacuccccacauuuaugacgcagaaaacucgugaugcccuagacaauuuggcuguuuugcauacugcugaagccgguggaagggcuuauaaucacgcauugucagaacuaccagagacacuugaaacgcugcuauuauuaacgcuucucgccacuguaacugguggaaucuuccuauucuuaauguccggacgagguauuggaaagaugacgcucgggauguguuguauaauuacggcgaguauuuuacuaugguaugcacaaauacaaccccauuggauagcagcgagcaucauauuagaguucuuuuuaauuguuuuguuaauaccggaaccagaaaagcaaagaacgccacaagacaaucaacugacauauguaguuauagcaauuuuaacagugguagcagcaaccauggcuaaugaaaugggauuucucgagaagaccaaaaaggacuugggauuagggucuauugccacacaacaacccgaaucuaauauucuagacauagauuugagaccagcaucagcauggaccuuauaugcaguugcaacgacuuuuaucacccccauguugagacauucuauagaaaauucuucagugaauacuuccuuaaccgcaauagcgaaucaagcaacagucuuaaugggucuagguaaaggguggccauugaguaagauggauaucgggguaccccuccuagcaauagguugcuauucacaaguuaacccaauaacacuuacagcugcauuauugcuuuugguagcucacuacgcaaucauuggcccaggccuacaggcuaaagcaacucgcgaagcacagaaaagagccgcagcuggaauaaugaaaaauccuacgguagaugggauaaccgucauagauuuagauccuauuccguaugaccccaaauuugaaaaacaacugggucaagugauguuauuaauccuaugcgugacucaaguguuaaugaugaggacuacuugggcacuuugugaagcauugacacuugcaacagguccaauaucuacucuaugggaaggaaauccgggucguuucuggaauacaacaauagcggucucaauggcuaauauuuuccgagggucauaucuagcuggagcuggccuccuuuuuaguauaaugaaaaacaccacgaacaccagaagagguaccggaaacauaggugaaacuuugggagaaaaauggaagucgcgccuaaacgcucuuggcaaaucugaguuucaaaucuauaagaaaagcggcauccaagaaguggaucgaacauuagccaaagagggaauaaaacggggcgaaaccgaucaucaugcagucucucgagguuccgcuaaauugagaugguuuguagagaggaauaugguaacgccagaggggaaaguaguggaccuagguugugggagagguggauggucguauuauugcggagggcucaaaaauguaaaagaagucaagggcuugacaaagggagguccuggucacgaagaacccauuccuaugaguacuuacggauggaauuuaguacgguuacaaaguggugucgacguauuuuucauaccuccagagaaaugugauacucuucuaugcgacauuggagaauccagcccaaaccccacaguagaagcuggaaggacccuacggguuuuaaaucuuguugaaaauuggcugaauaauaacacccaauucuguauaaaaguguugaaucccuauaugccgucuguaaucgagaaaauggaagcccuacagagaaaguacggaggagcccuagugagaaauccacucucuaggaauaguacgcaugagauguacugggucaguaaugcaucagguaacauaguuucauccguuaauaugauaucaaggaugcucauaaauagauuuacgaugcgacauaagaaagcaacuuacgaacccgauguugaucucgguucugggacuagaaauauugguauugaaagcgaaguaccuaaucuagauauaauagguaaaaggauagagaaaauaaaacaagaacaugagacauccuggcauuacgaccaagaucauccuuauaaaacuugggcauaccaugggucauaugaaacaaaacagacaggaucugcaagcuccaugguuaaugguguuguaaggcuccuaacaaaaccgugggauguccuuccaacaguuacucagauggcgaugacagacacaacacccuuuggccaacagagaguauuuaaggagaaaguagauacaagaacgcaagaaccgaaagaaggcacuaaaaagcuaaugaaaauaacugcggaaugguuauggaaagaauuagggaagaagaaaacuccuaggauguguaccagagaagaauuuacgcguaagguaagaaguaacgcagcguuaggcgcuauuuuuacagaugaaaauaaauggaagagugcaagagaagcgguagaagacuccagauuuugggaauugguggacaaagaacggaaccuacauuuagaaggaaaaugugagacuugcguauauaauaugaugggaaaaagagagaagaaacuaggagaguuugguaaagccaaaggaucaagagcuauaugguauaugugguuaggugccagguuccuggaauuugaagcacuuggcuuucugaaugaagaucauugguucucacgagaaaauucuuuaaguggaguugaaggagagggacuucauaaacuaggguauauuuugcgagacgugagcaagaaagaggguggagcuauguaugccgaugauacugccggaugggacacgaggauuacccuagaagaucugaaaaaugaggagauggucacuaaucacauggaaggugaacacaagaaauuagcagaagcaauauuuaaauuaaccuaucaaaauaagguaguccgaguacaaagaccuacuccuagaggaacuguaauggacauaauaucacgccgugaucaaagaggaagcggacaaguuggaacauauggauuaaauacguuuacuaacauggaggcucaauugaucagacagauggaaggagaaggaguuuucaagaacauacaacaucuuacagugacugaagaaguagcuguacaaaauuggcuagcacgcguagggcgugaacgucuaucuagaauggcaauaucaggagaugacugcgucgucaagccauuggaugauagauuugcuaacgcuuuaaccgcccuaaaugacauggguaagauuaggaaagauauacaacagugggaaccaucuaaaggauggaacgacuggacacaagugccauucuguucacaucauuuccaugaacuaauaaugaaagacggacguguccuagugguacccuguaggaaucaagacgagcugauaggacgggccaggauuucccaaggcgcagguuggucucuaagagaaacggcguguuugggaaaaagcuaugcacaaauguggagcuuaauauauuuccaccgacgugaccuacgauuagcggcuaaugcgauuugcucugcuguaccaucgcauuggguaccaacgucaagaacgacauggagcauccacgcaaaacacgaauggaugaccacggaagauaugcugacgguauggaaucgagucuggauacgagaaaauccuuggauggaagauaaaacaccaguagaaucuugggaagaaauucccuaccuagguaaaagagaggaucaauggugugguagcuuaauuggcuuaaccucucgagcaaccugggcuaaaaauauccaagcagcuauaaaccaaguccguucauuaauuggcaacgaagaauauaccgacuauaugccaucuaugaagcgguucaggcgcgaagaggaagaagccgguguccuaugguaa

SEQ ID NO: 22343 - RNA, 9876 nt, Artificial Sequence
  derived and/or modified CDS sequence (opt6) from DENV-2__GQ868623__SS-prME
agugcagguaugauuauuauguuaauaccaacuguaauggcuuuccacuuaaccaccagaaauggggaaccucacaugauagucggaauacaagaaaaaggaaaaagccuacuauuuaaaacagaagauggugugaauaugugcacguuaauggcuauggaucuaggugaacucugugaagauacaauaacauacaaaugcccucuauuaagacagaaugaaccugaagauauagacugcugguguaauagcacaucaacauggguuacguacggaacuuguacaaccaccggggaacacaggagagagaaacgaucaguagcgcuagucccccauguaggaaugggucuugaaacacguacggaaacuuggaugucuucggaaggagcauggaaacaugcucaacgaaucgaaacguggauauugaggcauccaggauuuacaauaauggcugccauauuagcauauacaauuggaacaacacauuuccaaagagcacugaucuucaucuuauuaacagcuguagcuccuagcaugacgaugagaugcauuggaauauccaaccgagauuucguagaaggaguuaguggagguucauggguugacaucguauuggaacaugguaguugcguaacaacaauggcuaaaaauaaaccgacccuagacuuugaacuuaucaaaacagaagcuaaacaaccggccacgcuacggaaauacuguauagaagccaaauuaacgaauacaaccacagaaaguagguguccaacccaaggugaaccaagccucaaagaagaacaagauaaacgauucgucuguaaacacucaaugguugacagggguuggggaaauggaugcggucuguuugguaaaggaggcauuguaacgugugccauguucaccuguaagaaaaauauggagggaaaaaucguucaaccugagaaucuugaauauacuaucgucguaacaccccauucaggcgaagaacaugccguaggaaacgauacugguaaacauggaaaagaaauaaaaguaacgccgcagaguucuaucacagaggcggaacuaacaggauauggaacagugaccauggaguguagcccccgcacugguuuagauuucaaugaaaugguauuauuacagauggaaaauaaagcauggcuuguucaucgccagugguuuuuagaucuaccccuaccaugguuaccaggggcugacaaacaaggaucuaauuggauucagaaagaaacccuuguuacauucaaaaauccucacgccaagaaacaagacguaguggucuuagguucacaagaaggugcaaugcacacagcacuuacgggagcgacagaaauucaaaugucuagcgguaaccuuuuauuuacuggacaucuaaaaugucggcuaagaauggacaaauuacaauugaaaggaaugucauacaguaugugcaccgguaaauuuaaagucguaaaagaaaucgcugaaacucaacauggaacaauagucaucagagugcaauaugaaggagacggauccccuuguaaaauuccauuugaaauuauggacuuagagaaaagauauguuuuaggccgucucauaacaguuaauccgauaguuacagagaaagauagucccguuaacaucgaagcagaaccaccauucggagacagcuacauuauaauagggguugagccgggacagcuaaaacuaaacugguuuaagaaagguagcucuaucggacagauguuugagacaacgaugagaggggcuaaaagaauggccaucuuaggagacacugccugggacuuuggaucuuuaggaggggucuuuacauccauuggcaaagcacuccaccaaguuuucggagcuauauacggagcggcauuuucaggaguuuccuggaccaugaaaauucugauagggguaauaaucacauggauagguaugaacucaagauccacgucgcuuucaguaucauugguccuggugggaaucguaacauuauaucucggaguaauggugcaggcugauaguggcuguguuguaaguuggaagaacaaagagcuuaaaugcgguucgggcaucuucauuaccgauaauguacacaccuggacagagcaauauaaauuucaaccggagaguccauccaaacuagcaagcgcaauccaaaaggcacaagaagaagguauuugcgguauaagauccguaaccagacuugaaaaccuuauguggaaacagauaaccccagaguugaaucauauacucgcagaaaacgaaguuaaacuuaccauaaugacaggugauaucaaagguauaaugcaggcaggaaaaagaagucuucgaccacaaccaacggaacuaaaauacuccuggaaaacuuggggaaaggcuaaaauguuaaguaccgaaagccauaaucagacguuucuaauugauggcccagaaacugcagaauguccgaacacgaaccgagccuggaacucccuugaaguugaggauuacgguuucggaguuuucacaacaaauauauggcucaaacugaaggaaaagcaagaugcguuuugugauagcaaacugaugucggcugcaauaaaagauaaccgugcuguccacgcagacauggguuacuggauugagucagcacuaaacgauacauggaaaauugaaaaggcgagcuuuauagaagucaaaaacugucacuggccaaagucccauacacucuggagcaauggaguuuuggaaagcgaaaugaucauucccaaaaacuuggcaggaccgguaucacaacauaacuaucgaccaggauaccauacgcaaaucgcggggccuuggcauuuagggaaacuagaaauggauuucgauuuuugcgauggaaccacaguaauaguaacugaagauugcgggaaccgcgggccaucacugaggacuacaaccgcaucaggaaaauugauaaccgagugguguugccgaucauguacccuaccaccuuuacgauaccgaggagaggacggaugcugguauggaauggaaauacguccucuuaaggaaaaagaggaaaaucugguaaauagucuaguaacugccggacauggacaaguugacaacuucucucuaggaguacuaggacuagcacuauucuuagaagaaaugcuaagaacgcguguuggcacgaaacacgcuauccucuuaguugccguuagcuuuguaacauugauaacgggaaauaugaguguaaaagaccuaggacgagugguaguuaugguuggugcgacuaugacagaugauaucggcaugggaguuacuuaucucgcauuauuggcagccuuuaaaguccggccaacuuucgcagcgggucuacuucugaggaaacugaccucaaaagagcuaaugaugacaacuauaggaauagucuuacugucgcaaaguacaauaccagaaacuauacuagaacuuacagaugcgcuagcccuagguaugaugguacuuaaaaucguacgggacauggaaaaauaucaguuagcaguaaccauaauggcaauacuaugugucccaaaugcugucauauugcaaaaugcuuggaaagucucaugcacaauucuugccgucguaagcgugagcccacuacugcugacaucuucacaacagaaaacggacuggauuccgcucgcguuaacuauaaaaggccuaaacccaaccgcaauauuuuuaacuaccuuaaguagaacaaacaagaaacgaaguuggccauuaaaugaagcaauaauggcuguaggaaugguaagcauacuugcuucaucacuuuuaaagaacgauauaccuaugaccgguccuuuggucgcuggaggucuacugaccgucugcuauguauuaacgggacgauccgccgaccuagaguuagaaagagcaacugauguaaaaugggaagaccaagcagaaauaucuggaucaucgccaauacuuucaauaacgaucucagaggacggaucaaugucgaucaaaaaugaggaggaggagcaaaccuuaacaauucuaauacgaacaggacucuuaguaaucucuggauuauuuccaguuaguauucccauaacugccgcugcgugguacuuaugggaaguuaagaaacagagagcgggaguuuuaugggauguucccagcccgccaccgaugggaaaagcugaacuggaagacggugccuaccgcauaaaacaaaaaggcauucuaggcuauagucaaauaggggcugguguuuacaaagaaggcaccuuucauacgauguggcauguuacaagaggggcagucuuaaugcauaaaggcaaaagaauagaaccgagcugggcagaugugaagaaagacuuaauaucuuacgguggugguuggaaacuugaaggggaguggaaggagggagaagagguacaagucuuagcauuggaaccugguaaaaacccaagagccguccaaaccaagccuggccuauucaaaacgaacacagggacuauuggugccguaucguuggacuucaguccaggcacuucggguuccccgauaauagacaaaaaggguaaaguagucggguuauaugggaauggagugguaacgcgauccggagcauauguaucggcuaucgcacaaacagaaaaaucuauugaagauaacccugaaauagaagacgauauuuucaggaaaagaagguuaacgaucauggacuuacauccuggcgccgggaaaacaaaaagguaucuaccagccaucgucagagaagccaucaagcgaggucuccggacguuaauauuagcuccaacucggguaguagcagcugaaauggaagaagcauuaagaggauuaccaauucguuaucaaaccccugcaauuagggccgagcauacaggacgugaaauugucgaccuuaugugucacgcgacuuucacgaugagauuauuaaguccaguuagaguuccaaauuauaacuuaauaaucauggacgaagcacacuuuacagauccugcuucaauugcugcaagaggauacauaagcacaaggguagaaaugggcgaagcagcgggaauauuuaugacugccacaccaccaggaaguagagaccccuucccacaaucaaacgcaccaauaauugaugaggaaagagaaauuccggaacggucauggaacucaggccaugaauggguuacugauuuuaaagggaaaacugugugguucguuccuuccauuaaagccggaaacgauauagcugcaugucucaggaaaaauggaaagaaaguaauacaguuaucaagaaagacuuuugauagcgaguaugucaaaacaaggacgaacgauugggacuucguuguuacaacugauaucucagaaaugggagccaauuucaaggcagaaaggguaauagauccaagacguugcaugaaaccaguaauccuuacagacggcgaagaaagagugauacuugcuggaccaaugccaguuacacauucuucugcagcacagagacgaggacgcaucgguagaaaucccaaaaaugaaaaugaccaauacauuuauaugggggagccuuuagaaaacgacgaggacugugcucauuggaaagaagcgaagaugcuacuggauaacauuaauacgccugaaggaaucauaccaucaauguuugagcccgaaagagaaaaaguagacgcuauagacggagaguauagguugagaggugaagcgaggaagaccuucguugacuuaaugcguaggggugacuuaccaguuugguuggcauauaaaguugcagcagaagguaccaauuaugccgacagacggugguguuucgauggaauuaaaaauaaccaaauacuugaagagaacguugaaguugagauuuggaccaaagagggagaaaggaagaaacuaaaaccccgauggcuggacgccaggaucuauagugacccucuggcauuaaaagaauuuaaagaauuugcagcagggcgaaaaucauuaacacucaaucuaauuaccgaaaugggacggcuccccacguucaugacacagaaaacaagagaugcgcucgauaaccuugcuguacuacacacagccgaagcaggaggacgagcauauaaccaugcccuaucugagcuaccagaaacacuggaaacucuacugcuuuugacacucuuagccacuguaacaggaggcauauuucuauucuuaaugaguggacguggcauaggcaaaaugacacuaggaaugugcugcauaauaacagcuuccauucuucuuugguaugcucaaauacagccucacuggauugcagccucaauuauauuagaguucuuucuuauuguucuguuaaucccagagcccgaaaaacaacguacaccucaagacaaucaguuaacguauguaguaauugcaauucuaacuguaguagcagcaacaauggcuaacgaaaugggauuccuagaaaagacuaagaaagaucucgggcuaggaucaauugcaacacaacaaccagaaagcaacauccuugauauagaucucagaccagccucggcguggacgcucuacgcagucgcgacgacuuuuguuacaccgaugcugagacacaguaucgaaaacucauccguaaacguuucucugaccgcaauagccaaccaggccacggucuugaugggccuugguaaagguuggccccuaucaaaaauggauauugguguaccauuacuggcaaucggguguuauucgcaaguaaacccuaucacuuuaacagcugcacuucugcuacuuguggcucauuacgccauaauugguccaggcuuacaagcaaaagcgaccagagaggcucagaaaagagcugcagcggguauaaugaaaaacccuacgguagacgggauaacuguuauagacuuggaccccauacccuacgaucccaaauucgaaaaacaacuaggacaagugauguuauuaauucuauguguaacacaagugcuaaugaugcgaacaacuugggcucuuugcgaggcauuaacguuagcuacuggaccaauauccacacuaugggaaggaaauccggggcgauucuggaacacaacaaucgccguuucuauggcuaacauuuuucggggcaguuacuuggcaggagccgggcuacuuuucucaauaaugaaaaacacuacgaauacaaggaggggaacggggaauauuggcgaaacacucggcgaaaaguggaagucaagacugaacgccuuaggcaaaucugaguuccaaaccuauaagaaauccggaauacaagaaguggaccguacccuagccaaagaagggauaaaaagaggggaaaccgaccaucaugcgguuucaagggguagugccaaauugaggugguucguagaaaggaauauggugacuccugagggaaaaguuguagaucuaggcuguggucguggaggcugguccuauuauugugguggacuuaaaaacguacgagaagucaaaggucuaacuaaaggaggaccaggacaugaggaacccauuccaaugucaacguauggauggaacuuaguaagacugcaaucuggagucgacguguucuuuauaccuccagaaaaaugcgacacccuucuaugcgacauuggagaaagcaguccaaauccaacagucgaggcuggcagaacauuacggguguuaaaucugguagaaaacuggcuuaauaauaacacucaauucuguauaaaaguuuuaaacccuuauaugccaucgguaaucgagaaaauggaagcauugcaaaggaaacacggcggugcauuaguuaggaauccauugucgaggaacucuacccacgaaauguauugggugagcaaugcgucagggaacauugugucgucgguaaacaugauuucuagaaugcuaauuaaccgauucacuaugagacauaagaaagcuacauaugaacccgacguagaucucggaucuggaacaagaaauaucgggauagagucugaaauacccaacuuggauauaaucggcaaaagaauagagaaaauaaaacaagagcaugaaacuucauggcacuaugaucaagaucauccauauaagacaugggccuaucacgguucguaugaaacaaagcaaaccggaucagccucaucaaugguaaauggggucguccgguuacuuacaaaacccugggauguccuuccgacggucacucaaauggcaaugacggacacgaccccuuuuggucaacaaagaguuuuuaaagagaagguagacacucgaacgcaagaacccaaagagggaaccaagaaacugaugaagauuacagcagaguggcucuggaaagagcuuggcaagaagaaaacuccaagaauguguacgcgugaagaauuuacuaggaaaguuagaucuaaugcugcucuuggagcaauauuuacagaugaaaacaaguggaaauccgcccgggaagcaguugaagacucacgcuucugggaauuaguggaucgagaaagaaaccuacaucuagaaggaaaaugcgagaccugcguguacaauaugaugggaaagcgcgaaaagaaacugggagaguucgggaaggcaaaagggagccgugccauaugguacauguggcucggggcgagguuuuuggaauuugaagcacuaggguuucuuaaugaagaucacugguuuaguagagaaaauagcuuaagcgggguagaaggugaaggacuccacaaguuagguuauauauuaagagacguaucuaagaaagaagguggagcuauguaugcagacgauacagcagguugggacacaagaauuacacucgaagacuuaaagaaugaagagaugguuacuaaucauauggaaggugaacauaagaaacuugccgaagcaauauuuaaacuaacuuaccaaaauaaaguuguucgcguacaaaggccaacuccuagaggcaccguaauggacauaauaagucggagagaccaaagaggaucuggacaagugggaacauacggucuaaauacauucacaaauauggaagcucaacuaauaagacaaauggaaggugaaggaguauuuaagaauauacaacaucuuacagcuaccgaagaaguagcgguacagaacuggcucgcuagaguagguagggaacgacuaucgaggauggcaauaaguggggaugauuguguuguaaaaccguuagaugacagguuugccaacgccuuaaccgcauuaaaugacauggguaagauaagaaaagacauucaacaaugggaacccucuaagggauggaaugacuggacccaaguaccguuuugcagccaucauuuccaugaacuaauaaugaaggauggaaggguccuaguagugccauguagaaaucaagaugaauugaucgguagagcaagaauuagccaaggugcuggauggucacuuagagaaacggcgugccuaggcaaaucauacgcgcaaauguggagcuuaauguauuuucacagacgggacuuaagguuagcagcgaacgccauaugcucagcaguaccaagucauuggguaccaacgucacgaacaacguggaguauacaugcuaaacaugaguggaugacuacugaagacauguuaacagucuggaaucgaguuuggauaagagaaaauccauggauggaagauaaaacaccgguugaaucgugggaagagauaccuuaccucggcaagagagaggaccaaugguguggcagcuugauaggacuaacuucaagagcuaccugggccaaaaauauucaagcugcaauaaaucagguacguagucuuauaggaaaugaagaauauacugacuauaugccaagcaugaaacgauuucgacgagaggaagaggaagccgguguucuaugguga

SEQ ID NO: 22344 - RNA, 9876 nt, Artificial Sequence
  derived and/or modified CDS sequence (opt6) from DENV-2__GQ868624__SS-prME
ucagcggggaugauaauaauguuaauuccuaccgucauggcauuucauuuaacuacgcgaaauggugaaccacacaugauuguaggaauacaagaaaaaggaaaaagccuacuauucaaaacggaagacggaguuaauaugugcacauugauggcuauggaucucggagaguugugcgaagauacaaucacguacaaaugcccauuacuacgccaaaacgaaccagaagauauugauuguugguguaacucaacgagcacaugggucacguacggaacguguacuacuacgggggaacacagacgagagaaaagauccgucgcacuuguaccgcacguaggaaugggguuagaaaccagaacagagacuuggaugaguagcgaaggcgcauggaaacaugcacaaaggauugagacauggauacuuagacaucccgguuucacuauaauggcagcaauauuggcguauacaauaggcacaacacacuuucaacguguacugaucuucauucuacuuacggcaguggcaccaucaaugacgaugcgaugcaucgguaucagcaaccgagacuuuguugaagggguaucuggggguagcuggguugacauaguuuuagagcaugggucgugcgucacaacaauggccaaaaauaaaccgacucucgacuucgaacugauaaaaacagaagcgaaacaaccugcaacauugaggaaauacuguaucgaagcgaaacuaacaaacacaacgacagaauccagaugcccgacgcaaggagaacccagcuuaaaagaggaacaggacaaacguuuuguaugcaaacauucaaugguugauagagguugggguaaugguuguggacuauucgguaaaggaggaaucguaacaugcgcuauguuuacauguaagaaaaacauggagggaaaaauaguacaaccugagaauuuagaauauacaauagucguaacaccacacucgggcgaagaacacgcuguagggaacgacacuggcaaacaugggauggagaucaaaguaacaccucaaucgaguaucacagaggcggaguugacaggguaugggacgguaacaauggagugcaguccaagaaccgguuuagauuuuaaugaaaugguguuacuccaaauggaaaauaaagcaugguuagugcacagacaaugguucuuggaucucccacuaccuuggcuuccuggugcugauaaacaagagucaaacuggauacaaaaagaaacguuggucacguuuaaaaacccccacgcgaagaaacaagacguaguggucuuaggaagccaagaaggagcaaugcauacagcauuaacaggugcuacagaaauccagaugaguucgggaaaucuccuauuuacggggcaucuaaaaugcaggcuuagaauggacaaauuacaauugaaaggaaugaguuauaguauguguacagggaaauucaaaguggugaaagagaucgcggaaacgcaacacggaacuauaguaauccgaguacaguaugaaggagaugguucuccuugcaaaaucccuuucgaaauaauggaccuugagaaaagauacguucuaggacgauugauuacgguaaacccaauuguaacugagaaagacagcccaguaaauauagaagccgaaccgccauucggugacucuuauauaaucauaggaguggaaccuggacaauugaaauugaacugguucaaaaagggaagcagcauaggccaaauguucgagacaacgaugagaggagcaaaaaggauggcuauauuaggagauacugcaugggauuuuggaucucuuggaggcgucuuuacgagcaucggcaaggcacuacaucaaguauuuggagcaauuuacggagcggcuuucucaggaguaucauggacaaugaaaauucuaauaggaguuauaauaacauggauaggcaugaacucuagaucgacaagucucaguguuagucucguacuuguagguauaguuacccuauacuugggugugaugguccaagccgacucuggcugcgugguaucguggaaaaauaaagaacuaaaaugcgggaguggcaucuuuauaacagauaauguucacaccuggacagaacaguacaaauuccaaccagaaucaccaucaaaacuugcuagugcaauacaaaaagcgcaagaagaaggcaucuguggaauaagaucugugacucggcuagaaaauuugauguggaagcagauaacaccagaauugaaucauauucuugcagagaacgagguaaaacuuacaauaaugacaggugacauuaaaggaauaaugcaggcaggaaaacguucucuccguccacaaccaacggaauugaaguauucauggaaaacuugggguaaagcuaaaaugcuauccacggagucuuacaaccaaacuuuccuaauagauggaccagaaacugcugagugccccaauacuaaccgcgcauggaacucgcucgaaguagaggauuauggguuugguguuuuuacaacaaacauauggcuaaaauugaaagaaaaacaagacgcauucugcgauucaaaauugaugagugcagcaauuaaagauaauagggcaguacaugccgauaugggauacuggauagaaucagccuuaaaugacaccuggaaaauugagaaggccucauucauagaagucaagaauugccauuggccgaaaagccauacccucugguccaauggagugcucgaaucagaaaugauaauaccuaaaaaucucgcaggucccgucucacaacauaauuaucggccuggauaccauacacagauagcuggaccuuggcacuuagguaagcucgaaauggacuucgauuucugugacgguacaaccgugauuguuacggaagauuguggaaaccgagguccaagccuucgaacuacaaccgcaagcggaaaacuuauaacagaaugguguugucgaaguugcaccuuaccaccauuaagguaucgaggagaagaugguuguugguauggaauggaaauacggccacuuaaggaaaaggaagagaaccuaguaaauagucuagucacagcaggccacggucaaguagauaauuucagucuggguguccuggggauggcuuuauuuuuagaggaaauguuaagaaccagggucggcacgaagcaugcgauccucuugguggcuguaucauuuguuacacuuauuacaggaaauaugucuuuuaaggauuuaggcagaguagucgugauggugggagcuaccauggccgaugacauugggaugggugucacguauuuagcacuccuugcagcuuuuaaaguccgaccaacguucgcugcuggauugcuccuucguaaauuaacauccaaggaauuaaugaugacuacuaucggaauaguauuauugucucagucaacaauaccagaaacgguccuagaacuaacagaugcuuuagcauugggaaugaugguucuaaaaauagucagaaauauggaaaaauaucaacuugccguaacaauuauggcaaucuugugcgugcccaacgccgugauccugcagaaugcuuggaaaguuagcuguacaauacuugcuguaguaucugugagcccuuuauugcuuacaaguucccagcagaaaacagauuggauaccacuagcacuaacaauaaaaggacucaauccuacagcgauauuucuaacuacgcuuucaaggacgaacaagaaaagaucauggccgcuuaaugaggcuauuauggccguaggaaugguguccauacuugcaucgaguuugcuuaaaaaugauauuccaaugaccggaccgcuaguugcuggaggacuacuaacgguuugcuauguguuaacuggaagaagcgcugaccucgaauuggaacgagcaacugaugucaaaugggaggaucaggcagaaauaagcgguaguaguccaauauuaagcaucaccaucucagaagacggcagcaugucaaucaaaaaugaagaagaggaacaaacuuuaaccauauugauacggacuggacuacugguuauaagcggauuauucccaaucaguauaccuauaacggcagccgcaugguaucugugggaagucaagaaacaaagggccgguguguugugggauguuccaucaccaccacccauggggaaagcagaauuggaggacggggcguauagaauaaaacagaaagguaucuuaggcuacucacaaauaggugcgggaguguacaaggaaggaacuuuccacacaauguggcauguaacacgaggcgcaguuuuaaugcacaagggcaagaggauagaaccuucaugggcggaugucaaaaaggaucuuauuaguuauggaggggguuggaaauuagaaggugaguggaaagaaggagaagaagugcaagucuuagcauuggaaccggguaagaauccccgugcaguccaaacgaagccaggauuauuuaaaacgaauacagguacaauaggagcaguuagucuagauuucaguccagguacgagugguuccccgaucauagacaagaaaggcaaagucguaggacuguauggaaauggaguagucacgaggaguggugcauacguaucggccauagcucaaacagagaaaagcauugaagauaauccagagauagaagacgacauauuccgaaaaagaagauuaacaauuauggaccugcacccaggagcagguaaaacaaagagauauuuaccugcaauaguuagggaggccauaaaacgagguuuaagaacacucauuuuagcaccuaccagaguugucgcugccgaaauggaagaggcauuaagggggcugcccauuagauaucaaacgccugcaauuagggcggaacacacagggagagaaaucguagaucuuaugugucaugcaacauuuacgaugcgacuacugucacccgucagaguaccaaauuauaaccucauaauaauggaugaagcacacuuuacagaccccgcaucaauagcggcaaggggauauauuucaacucgaguagaaaugggggaagcagccgguauauuuaugacggcgacacccccuggcucaagggauccauucccucagaguaacgcaccaauuaucgaugaggagcgcgaaauaccagagcguucuuggaacucaggacaugaguggguuacagacuuuaagggaaaaacagucugguuuguaccuucuauuaaagcuggaaacgauauugcagcauguuugaggaaaaaugggaagaaaguaauacaauuaagucguaaaaccuucgauagugaauauguaaaaacgagaacgaaugacugggauuucguagugacaaccgauauuucggaaaugggugcuaauuucaaagcagaacgcguaauugaucccagaagaugcaugaaaccgguaauauuaacugacggagaagaacgcgugauacuggcaggaccgaugccagugacucauuccagugcggcucagcgacguggacguauuggucgaaauccuaagaacgaaaaugaucaauacauauacaugggugaaccauuagaaaacgaugaagauugcgcccauuggaaggaggcaaaaaugcuacucgauaacauuaacacccccgaaggaauuauuccaaguauguucgaaccggagcgagaaaaaguggaugccauugauggagaguaucguuuacgaggagaagcgaggaaaaccuucguagaucuaaugaggcgaggagacuuaccgguaugguuagccuauaaaguugcagcggaaggaauaaauuaugcugacagacgcugguguuucgacgguauuaaaaacaaccaaauuuuagaagaaaacgucgaaguggaaauauggacuaaagaaggagagaggaagaaacucaaaccacguugguuagacgcaagaauauauuccgacccauuagcucugaaagaauuuaaagaguuugcugcaggucguaaaucacuaacccuaaauuuaaucacagagaugggcagauuaccgacuuuuaugacccagaaaacgagggaugcacuagauaaucuggcuguuuugcacacagcggaagcuggugggagagcauacaaccacgcgcucucagaauugccagaaacucuggaaacucuauugcuccucacacuacuggcaacaguuacgggaggaauuuuucucuuucuaaugaguggucguggaaucgguaagaugacuuuaggcauguguugcaucauaacggcaucaauacuguuaugguaugcacaaauacaaccucauuggauagcagccaguauuauacuugaguucuuuuugauuguccuacuaauaccugaaccugagaaacaaaggacgccccaagauaaccagcuaacuuauguuguaauugcaauccucacugucguagcagcuacaauggcgaaugagaugggcuuccuagaaaagaccaaaaaggacuuagggcuagguucuaucgcuacacaacaaccugaaucgaacauacuggauauagauuuaaggccagcaagugccuggacccuauaugcuguugcaaccacauucguaacacccauguuaagacacucuaucgagaacucuucuguaaaugugagucuaaccgcgauugccaaccaagcuaccguacuaaugggucuaggaaaagguuggccgcuaucuaaaauggacauaggcguaccauuacuugccauagguugcuauucucaaguuaauccuauuacacuuacagcugcucuccuccuauugguagcacauuaugcgaucauaggaccgggccuacaagcaaaagcgacgagagaggcucagaaaagagcagcagcuggaauaaugaaaaauccuacggucgauggaauaacagucauugaucuagaccccauaccauaugauccaaaauucgagaagcagcuaggucagguaauguugcugauucuauguguaacacaaguucucaugaugcguaccacaugggcucuaugugaagcgcuaacgcuagcaacaggaccuauaucuacauugugggagggaaacccuggaagauucuggaauacuaccauagcaguaagcauggcuaacauauuucguggaagcuaucucgcgggagcuggucuuuuguuuaguaucaugaaaaauacgaccaauacgaggagaggcacugguaauaucggagaaacgcuaggcgaaaaauggaagucucgacuuaaugcguuaggaaaaucagaauuucaaauauauaaaaagucugguauucaggaaguugaucgcacgcuagcaaaggaagggauuaagaggggagagacagaucaccaugccguaaguagggguucagcaaaguuacgaugguucguagagagaaauauggucaccccagaaggaaaaguaguugacuuaggguguggaagagguggcuggaguuauuacuguggagggcugaaaaacgucagagaaguuaagggucuaaccaaaggagggcccggccacgaggaaccuauacccaugaguacguacggauggaaucuuguccgucugcaaucuggcguugacguguucuuuauaccuccagaaaaaugugacacguuacuaugugauauaggugaaucuucaccgaauccaaccguagaagcaggaagaacacugagagugcuuaaucuaguagagaacugguuaaauaacaacacccaguuuuguauuaaaguccuuaauccauauaugccaucggugaucgagaaaauggaagccuugcaacgaaaauauggcggugcacuuguacguaauccuuuaucacgaaacaguacgcacgaaauguauugggugaguaaugcuagcgguaacauagugucaucaguaaauaugauaaguaggaugcucauaaauagguuuaccaugagacauaagaaagcgacauacgaaccggacgucgacuuggggagugguacgcgaaauauaggaauagaaagcgaaauuccgaaucuagacauaauugguaaacgaauagagaaaauuaaagaggaacaugaaacaaguuggcacuaugaucaagaucauccuuauaaaacuugggccuaccauggaaguuaugaaacaaagcaaacggguucugccaguucaaugguuaacggagucguuagacuacuaacaaaaccaugggacguauuaccaaccguaacgcaaauggcuaugacagacacaacgccuuuuggucagcagcgcguuuuuaaagaaaaaguagacacucgaacacaagagccaaaagagggcacgaagaaacucaugaaaauuacagcagaauggcuuuggaaagaacuuggcaagaagaaaacaccccggaugugcacccgugaagaauuuacgagaaaggugcgcucuaacgcagcacuuggggcaauuuuuacugaugagaauaaauggaaguccgcaagggaggcaguagaagacucuagguuuugggaacuuguggauaaagaaagaaaccugcaucucgaaggcaaaugugaaaccugcguauauaacaugaugggaaaacgugagaagaaauuaggugaauuugguaaagcuaaaggcucgagagcaauuugguauaugugguugggcgcucguuuucuugaguuugaagcacugggauuucuaaaugaagaucacugguucaguagagaaaauucccugucggguguugaaggagaggguuuacauaaacuuggauauaucuuacgagaugugucuaagaaagaagguggggcaauguacgccgacgauacggcuggaugggauacccggaucacauuagaggaccugaaaaacgaagaaauggugacgaaucauauggaaggcgaacacaagaaacuagccgaagcgauuuuuaaacuaacauaucaaaacaaggugguaagaguacagagaccgaccccucggggcacuguaauggauauaauuagucggcgagaccaacgugguucuggccaggugggaacguaugggcuuaacacuuuuacgaacauggaggcccaguuaauacgucaaauggaaggugaaggaguauucaagaauauccaacauuugacagugacggaggaagcugcuguacaaaauuggcuugcuagagugggaagagaaagacucucuagaauggcaaucucaggagaugauuguguaguuaaacccuuagaugauagguucgcuaacgcccuuacagcuuugaaugauaugggaaaaauacguaaagauauacagcagugggagccgucuaaaggcuggaaugauuggacucaaguaccuuuuuguucacaucacuuucacgaguuaauaaugaaggacggucguguuuugguuguaccauguagaaaucaagacgaacucaucggcagagcacggauaagccaaggggcaggauggagccucagagagaccgcuugccuaggaaaaucguaugcgcagauguggucauuaauguauuuucauagaagagaucugagacuugccgcaaacgcaauuuguagugccgucccuagucauugggugccuacgucuaggacgacgugguccauacaugcaaaacacgaauggaugacaacugaagauaugcucacaguauggaacaggguguggauuagggaaaacccguggauggaagauaaaacaccaguggagucuugggaagagauaccauauuuaggcaaaagggaagaccaauggugcgggagucuaauuggucuaacaaguagagcuaccugggccaagaauauucaagcagcuauaaaccaaguaagauccuugauuggaaacgaagaguauaccgacuauaugccgucuaugaaacgguuucgacgugaggaagaggaagcugggguuuuaugguaa

SEQ ID NO: 22345 - RNA, 9876 nt, Artificial Sequence
  derived and/or modified CDS sequence (opt6) from DENV-2__FJ639717__SS-prME
ucggcaggaaugauaauuaugcugauucccaccguaauggcuuuccacuugacuacucggaauggggaaccgcacaugauaguuggcauacaagaaaaagguaaaucgcuauuauuuaaaacagaagacggcguaaauaugugcacauugauggcaauggauuuaggagaauuaugcgaagauacuauaaccuacaaaugucccuuguuaaggcaaaaugaaccggaagauaucgacugcuggugcaacucgacaaguacaugggucaccuaugguacauguacaacaacaggggaacaucgaagagaaaaacgcagcguagcacucguuccacauguaggcauggguuuagaaacaagaacagaaacuuggaugucaagugaaggcgcuuggaaacacgcgcaaagaauagaaaccuggaucuuacgucacccuggcuucacaauaauggcagcaauauuggccuauacgauuggaaccacgcauuuucaacgcgcauuaauauuuauuuuacuuaccgccguugcuccaucaaugacaaugagguguauaggcauaucaaauagagacuuuguggaagguguuagugguggaaguuggguagacauagugcuagaacaugggagcuguguuacaacuauggcuaaaaacaaaccgacauuagauuuugaauugauaaaaacagaggcuaaacaaccugccacucuuagaaaauauuguauugaggcaaaauuaacaaauacuaccacagaaucuagaugcccuacacaaggcgaaccuucauuaaaagaagaacaggauaaaagauuuguuugcaaacacucaaugguagacaggggcuggggaaauggcuguggacuguucggaaaaggaggcauaguaacgugugcgauguucacauguaagaaaaauauggaaggaaaaaucguacagccggaaaaucuagaguauacaauuguaguuacaccacacucgggugaagaacaugcagucggcaaugauaccgggaaacauggcaaagagauaaaaguaaccccacaaaguucgauaacagaggcagaacuaacgggguacgguacuguaacaauggaauguucgccuaggaccggcuuagacuucaaugaaaugguucuacugcaaauggaaucgaaagcgugguuagugcaucgccaaugguuucuagaccugccauugccauggcugccaggcgcagauaaacaaggaucaaauuggauacaaaaagaaacuuuaguuacuuuuaaaaacccacacgcuaagaaacaagauguugugguuuuagguucgcaagaaggagcaaugcauacagcauuaaccggagcaacagaaauccaaaugucauccgggaaccuccuuuuuacuggucaccuuaaaugcagacugcgaauggacaaacuacaacugaaaggaaugaguuacaguaugugcaccgguaaguuuaagguggucaaagaaaucgcugaaacacagcauggaacaaucguaauuagaguucaguacgagggggauggaucuccuuguaaaauucccuuugaaauuauggaucuagagaaaagauauguauuggguagauugaucacugucaauccgauaguuacugagaaagauaguccggugaacauagaggccgaaccgccauucggugauucauauauaauaauagguguugaaccaggucaauuaaaauuaaauugguuuaaaaagggcucaucuauuggacagauguuugaaacuacaaugagaggagcuaaacgcauggcuauucuaggagauacagcgugggauuuuggaucuuuaggagguguauuuacaagcauaggaaaagcgcuacaccaagucuucggugccauauauggagccgcuuucucggggguaagcuggacuaugaagauuuuaauaggcguaauuauuacauggaucgggaugaacagucgaaguacaucauuaaguguuagucuaguccucgucgggauagucacuuuauacuuaggaguuauggugcaagcagacaguggcuguguggugaguuggaaaaauaaagaguuaaaauguggaagcgguauuuuuaucacagacaauguucauacauggacagaacaauacaaguuucaaccugaaucgccgucuaaauuggcaucugcuauacaaaaagcucaggaagaagggaucugugggauaagauccguaacucgauuagaaaaucuaauguggaaacaaauaacaccagagcucaaucauauacuagcagaaaacgaagucaaacugacaauuaugacaggggacauaaaaggaauuaugcaagcaggaaaaagaucauugcgaccgcaaccaaccgaauugaaauauucauggaaaaccuggggcaaggcuaaaaugcucucuacagagucgcauaaccagacauuuuuaaucgacgguccugaaacugcugaaugcccaaauaccaauagagcguggaacucucucgagguugaagauuaugguuuuggggucuuuacgaccaauauaugguuaaaauuaaaagagaagcaagaugcauucugcgacagcaagcuaaugucggcagccauaaaggauaaucgagcgguacaugcugauaugggauacuggauagaaucagcuuugaaugauacauggaaaauugaaaaggcaucguucauagaggugaaaaacugucacuggccaaagucgcacacacuuuggaguaaugguguucuugaauccgaaaugauaauacccaaaaauuuggcgggucccguuagccagcacaauuauagaccgggauaucacacgcaaaccgccgggccauggcaccuugguaaacuagaaauggacuuugauuuuugugaugguacaaccguuauagucacagaagauuguggaaacaggggacccagcuugagaacaacaacagcaucaggaaaacugauaacugagugguguugccgaagcuguacauuaccacccuugagguacaggggagaggacggauguugguauggcauggagauucgacccuuaaaggaaaaggaggaaaaccuugucaauucucuuguuacugcagggcacgggcaaguugauaauuuuucauuaggaguauuggguauggcccuauuucucgaagagaugcugcgaacgaggguagguacaaaacaugcaauuuuacugguggcggugucuuuugugacauugauaacuggaaacaugucguuuaaagaucucggacgugugguaguaaugguugguacgacaaugacagaugauauaggaauggguguuacauauuuagcgcuacuagcagcguuuaaaguccgaccuacuuucgcugccggcuuguuauuaagaaaguuaaccagcaaagaguuaaugaugacuaccaucggaauugucuugcucucgcagucaacaauaccggaaacaauucucgaguuaaccgaugcauuggcgcuagguaugaugguccuuaaaauagucagagauauggaaaaauaucaacuagcagugacaauuauggcaauauuguguguaccuaacgcaguaaucuugcagaacgcauggaagguaaguugcacuauucuggcgguaguaucuguuucgccacuguuacuuacaucaucccaacagaaaacugauuggauaccacuugcucuuacuauaaaaggccucaauccgacggcaauauucuuaacuacgcucaguaggacgaauaagaaacgcaguuggccacugaaugaggcgauaauggcaguagguauggucaguauauuagcgagcucucuuuugaaaaacgauauuccaaugacugguccauuaguggcggguggucuacucacaguauguuauguauuaacuggccggucugcagaucuggaacuagaaagagccacagacguaaagugggaagaccaggcggagauuucugguucaaguccgauuuugaguaucacaauaucggaagauggcucgaugucgaucaagaacgaagaagaagaacagaccuugacuaucuuaauaagaacuggucuacucguuauaucaggauuauuccccgucaguauaccuauuacggcggccgccugguaccuaugggaagugaagaaacaaagagcuggaguacuuugggaugucccuuccccuccuccaaugggaaaagcagaguuagaagauggagcguauagaaucaaacaaaaagguauauuaggcuacucucaaauaggggcuggaguuuauaaagaaggaacuuuccauacaauguggcauguaaccagaggggcggugcuaaugcauaaaggaaaacgaauugaaccaaguugggcggacguaaagaaggaccuuauuucuuaugggggaggguggaaacuagaaggugaguggaaagaaggggaagagguccaaguauuagccuuggaaccagggaaaaacccacgagcaguccaaacuaagccaggccucuuuaaaacaaacacaggaacaauaggugcggucucauuggauuuuucaccugguacaaguggcucuccaauaauagacaagaaaggaaaagugguaggacuuuauggcaauggggugguaacucgcuccggagccuauguuucugcuauagcacagacggaaaagucgaucgaggacaacccugagauagaagaugacauuuucagaaaacgaagacuuacaauaauggaucugcacccaggcgcggggaaaacaaagcgcuaucuuccagcgauaguaagagaagcuauaaaaagaggucuaaggacgcuuauccuggcucccacaagaguaguagcggcugaaauggaggaggcuuuaagaggucucccgauucgguaucagacaccagcgauccgagcugaacauacagggagagaaauaguagauuuaaugugccaugcaacauuuacaaugcgauuacuuaguccuguaaggguucccaacuacaacuugaucauaauggacgaagcucacuuuacagacccggccucgauagcagcucgugguuauaucucaaccagaguagaaaugggagaagcagccggcauauucaugaccgcgaccccuccugguaguagagacccguuuccgcaaucgaaugcaccuauaauugacgaagaacgugaaaucccggagagauccuggaauacaggucaugaguggguaacugacuuuaaagggaaaacaguaugguuuguaccgucuaucaaagcagguaacgauauugcugcuuguuugcgcaaaaacgguaagaaaguuauacagcucucgaggaaaaccuucgacuccgaauauguuaaaacaagaacaaacgauugggauuuuguagucaccacagauauaagugaaaugggagccaauuucaaagcagaaagggugauagacccaagaaggugcaugaaaccagucauucuaacagacggagaagaacggguuauacuagcgggaccaaugccgguaacgcauucaagcgcggcacaacggcguggucgaauaggaagaaauccgaaaaacgaaaacgaccaguacauuuauaugggagaaccccuugaaaaugacgaagacugugcucauuggaaggaagcuaaaaugcugcuagauaacauuaacacuccagaggguauuauuccaaguauguuugaacccgaacgggaaaaaguagaugccaucgauggugaauaccgguuacgaggcgaagccagaaaaacauucgucgaccucaugagaagaggagaccuuccgguuuggcuagccuacaaaguggcugcagaaggaauaaauuaugcugauaggcgaugguguuuugaugggauuaagaauaaucaaauucuagaagagaauguagaaguagaaauauggaccaaagaaggcgaaaggaagaaacucaaaccacguuggcuagaugcacgaauauauagcgacccucucgcuuuaaaggaauuuaaagaguucgcagcaggucguaaaagccucaccuuaaaucuaaucaccgaaaugggcagacuacccaccuucaugacucagaaaacucgagaugcacuagauaaccuagcaguacuccacacagcggaagccggaggucgggcauauaaucaugcauuaagcgaacugccagaaacccuagaaacguuauuacuguuaacauuguuagcgacuguaacaggugguauauuuuuguuucucaugagcggacgagguauugguaaaaugacacuaggaauguguugcauaauaaccgccucgguucuucucugguaugcacaaauucaaccccauuggauugccgcuaguauuauucucgaguucuuuuuaauaguacuuuuaauuccggaacccgagaaacaacggacaccacaggacaaucaguuaaccuauguagucauugcaauucugacuguaguagcagcaacuauggcaaaugaaaugggauuucucgaaaagacgaagaaagauuuaggucucggauccauagcaacacagcagccagaauccaacauccuagauauagaucuacgaccggcaucagccuggacauuauacgccgucgcgacaaccuuuguaacaccaaugcugcgacacagcauagaaaauucaagcguaaauguuucauuaacggcuauugcuaaucaagcgacaguauuaaugggucuaggaaaaggauggccauuaucaaaaauggauaucggaguuccauuauuagcuauaggcuguuauagucaaguaaauccaauuacccugacagccgcccuacuuuuacucguagcucauuaugcuauaaucggaccaggacuucaagcaaaggcaacaagggaagcccagaaaagagcggcagcgggaaucaugaagaauccuacaguugauggaauuacaguaaucgaccuugaucccaucccuuaugacccgaaauuugaaaaacaauugggacaaguuaugcuucuaauucugugcgucacacaggugcuaaugaugagaaccaccugggcauugugcgaagcguuaacacuugccacagguccaaucucuacauugugggaaggaaacccuggccguuuuuggaauacaacuauugcgguaucaauggcuaauauuuuccguggcagcuacuuagcuggagcagggcuacuauuuucaauuaugaaaaacacgacuaauacaagacgaggaacaggcaauauaggggaaacgcuaggugaaaaauggaaaucacgacucaaugcacuuggcaaaucugaauuucaaaccuauaagaaaaguggcauacaagaagucgacaggacuuuggcaaaagaaggcaucaaaaggggugaaacugaccaucaugcuguuucgcgagggucggcgaaacugaggugguucguagaacgaaauauggugacaccugaagguaaaguagucgauuuaggaugugggcgcgggggcugguccuacuauugcggaggacucaaaaacguucgggaaguuaaaggacucacuaaagggggacccggacaugaggaacccauaccuaugucaaccuauggguggaauuugguacgguuacaaucgggcguagauguauuuuucauaccgcccgaaaaaugugauacuuuauuaugugacauaggggaaaguaguccuaaucccacaguugaagcaggaagaacacugcgagucuuaaaucuuguggagaacuggcuaaauaauaacacucaguuuugcauuaaaguuuuaaauccuuauaugccauccgugaucgagaaaauggaagcccuacaacguaaauaugguggcgcucuuguacgaaauccacuuagccgcaacucgacucacgagauguauuggguaagcaaugccucagguaacauaguuucaucagucaacaugauaucacggauguugauuaaucgcuuuacuaugaggcacaaaaaggcgacauacgaaccagacguugaccugggcagcgguacuagaaauauaggaauagaaagcgagauaccaaacuuagauaucauugguaaaagaauagagaagauuaaacaggagcacgagacauccuggcacuacgaccaggaucacccuuacaagacaugggccuaucaugguucauaugaaaccaaacaaacagggucagcuucaaguauggugaaugguguaguaagguuguuaacaaaacccugggauguccuaccuacaguaacucagauggcaaugaccgauacuaccccuuucggccaacaaagaguauucaaagaaaaaguagacacaagaacacaggaaccaaaagaagguacgaagaaacuaaugaagauaacagcagaaugguuauggaaagaauuggggaaaaagaaaacccccagaaugugcaccagagaagaguucacacgaaaaguaaggucgaaugcagcacucggagcgauauuuacugaugagaauaaguggaaaagcgcgagagaagccgucgaagauagcagauucugggaguugguugacaaggagaggaaucuacacuuagaagggaaaugugaaaccuguguuuauaacaugauggguaaaagagagaagaaacuaggcgaguucggcaaagccaaaggauccagagcuauaugguauauguggcuaggagcacgcuuccuagaguuugaagcucucggauuucuuaaugaggaucacugguuuucuagagaaaauuccuuaagcggaguagaaggugagggacuacauaaacuaggauauauauuaagggacgugaguaagaaagaagggggugcaauguaugcagaugacacugcgggaugggacacccgaauuacacuagaagacuugaaaaaugaggaaauggugacgaaucacauggaaggagagcauaagaaacuagcagaagcuauauuuaaacucacuuaucagaauaaagugguccgagugcagcguccuacaccuagagggacuguaauggauauaaucucacgcagggaucaaagaggaagugggcaagugggaacauauggccuaaauacauuuacuaacauggaggcucaguuaauccgacaaauggaaggggaaggaguuuucaaaaacauucaacauuuaacugcaacugaggaaguagcuguucaaaauuggcucgcacggguggguagggaaagacugucgagaauggccaucucaggugacgauugcgugguuaaaccauuagaugaccguuucgcuaacgcacucacggcgcugaacgacaugggaaaaauaagaaaggacauacaacagugggaaccuagcaagggauggaaugacuggacccagguaccauucuguagucaucauuuccaugaacuuauaaugaaagaugguagggucuuaguugugccgugccgaaaucaagaugaacuuauagggagagcaaggauaagucaaggagcuggauggucgcuucgagaaacggcgugucuugguaaaucauacgcacaaauguggucucuaauguacuuucaucggagagaucuaagauuagcagcaaaugcaauauguucugcagugccaagccacuggguccccacuucaagaacaacguggucuauucaugcuaagcaugaauggaugacuaccgaagacauguugacaguguggaauaggguguggaucagggagaauccguggauggaagacaaaacaccuguggaaucaugggaagaaauuccguacuuaggaaaaagggaagaucaguggugcgggucacuaauaggcuugacgaguagagcaacuugggccaaaaacauacaagccgcaaucaaucaggugaggucccuuaucgguaacgaagaauacacagacuauaugccuucaaugaaaagguuuagaagagaagaggaagaagccgguguauugugguag

SEQ ID NO: 22346 - RNA, 9876 nt, Artificial Sequence
  derived and/or modified CDS sequence (opt6) from DENV-2__FJ639718__SS-prME
agcgcugguaugauuauuaugcuaauuccgacuguaauggcguuucaccucaccacgagaaacggugaaccacauaugaucgugggaauacaagaaaaagguaaaagucucuuauucaaaacggaagauggagugaauauguguacucucauggcuauggaucuaggugaauuaugugaagauacuauaacuuauaaauguccacuuuuaagacaaaaugaaccugaagacauagauugcugguguaacaguacuucaacauggguuacauauggaaccuguacaacgaccggagaacaucgaagggagaaaagaucaguagcacugguaccucauguaggaaugggacucgaaacaagaacagaaacuuggaugucaagugaaggagcuuggaaacaugcucaacgaauugaaacauggauuuuacgacauccaggauuuacaauaauggcugcaauauuggcauauacgauagggacuacucauuuucaaagaguacuaauuuuuauucuacuaacagcuguugcaccaagcaugacgaugagaugcaucggaaucucuaaccgugacuuuguugaaggagugucuggaggaagcuggguagacauaguuuuagaacauggaaguuguguaacgacaauggccaaaaauaaaccgacucuagacuucgaguugaucaaaacagaagcgaaacaacccgcgacauugagaaaauacuguauagaagcuaaacuaacaaacacaacaacugaaucccgguguccuacucaaggagagccaucauuaaaagaggaacaagacaaacgauuuguauguaaacacagcaugguggaccgggguugggguaacgguugcggguuauucggaaaaggagggauaguaacgugugcaauguuuacauguaaaaagaauauggaaggaaaaauaguccagccggagaauuuagaauauacaauaguaguaacuccacacucuggagaagaacacgcggucggcaaugauacuggaaaacacggcauggaaaucaaaguaacaccucaaagcucaauuacagaggcagagcugacaggguaugggaccguaacgauggaauguucaccaagaacugggcucgacuucaaugaaaugguacuacugcaaauggaaaauaaagcaugguuaguccaccgacaaugguucuuagauuugccacuaccuugguuaccgggagcagauaaacaagaaucaaauuggauucagaaagaaacccuugucacguucaaaaauccucaugccaagaaacaagacgugguuguauuaggcagccaagaaggugcuaugcacaccgcacucacaggugcaacagaaauucaaaugucgagugggaauuuauuauuuacaggacaccuaaaaugucggcuuagaauggauaaauugcaauugaaaggaaugaguuauucuauguguacuggaaaauuuaaaguuguaaaagaaaucgccgagacgcaacacggaacaauagugauaaggguacaauacgagggagauggaucaccuuguaaaauucccuuugaaauaauggaucuggagaaaagguacguuuuagggcgccuuaucacaguaaauccuauaguaacugagaaagauuccccaguuaacauagaggccgagcccccauucggagacuccuacaucaucauagguguugaacccggccaacuaaaacuaaauugguucaagaaaggcagcaguauuggacaaauguuugaaaccacuaugcguggcgcaaaaagaauggcaauucuaggugauacggcuugggacuucgguucucuaggcggcguguucacuucgauugggaaagcccuucaccaaguguucggagcuauauacggagcugccuuuaguggcguaucauggacaaugaaaauacuaauugguguuauaauaacauggauugguaugaacucacgaucgacaagccuaaguguaucccuuguacuugucggaauaguaacacuuuauuuaggaguuaugguucaggcggacucaggcugcgucguuaguuggaagaauaaggaauugaaaugcggaucugguauauucauuaccgauaauguacauacauggacggaacaauacaaauuccagccugaaaguccaaguaagcuggcuucagcaauacaaaaagcccaagaggagggcauaugcggcauuagaagcguaacuaggcuagaaaauuuaauguggaaacaaaucacuccagaacucaaccauauauuggcggaaaacgaagugaaauugaccauuaugacgggagacauuaaggguauuaugcaagcagggaaacgguccuugcgcccacaaccaacugaauugaaauauuccuggaagacaugggggaaggcuaaaaugcuaaguacagaaaguuauaaccagacguuccuaaucgacgguccagaaacugcggaaugucccaauacuaauagagcauggaacuccuuggaaguggaagauuauggauuuggggucuuuacaacgaacauuuggcuaaaacucaaagaaaagcaggacgccuucugcgauagcaagcuaauguccgccgcaaucaaggauaaucgugcaguacacgcugauaugggcuauuggauugaaucagccuuaaaugauacauggaaaauagaaaaggcuucauuuaucgaagucaaaaauugucacuggccaaaaucucauacuuugugguccaaugggguuuuggaaagugaaaugauuauccccaaaaaccuggcgggaccagucucucagcacaacuacagaccggguuaccacacucaaaucgcaggaccauggcaccugggcaaacuagagauggacuucgauuuuugcgacggaaccacgguaauaguaacggaagauuguggcaaccgaggaccgucacuucgaacaacuacugcauccgggaaacuuauaacggagugguguuguagaucauguacauuaccaccccugagauauagaggugaagauggauguugguacggaauggaaauucguccgcucaaagaaaaagaagaaaaucucguuaauaguuuaguaacagccggacauggacagguagauaauuucaguuuaggaguguuaggaauggccuuauucuuggaagagaugcuaagaacucgugucggaacaaagcacgcuauauuauuaguagcugucagcuuuguuacucuuauaacagggaacaugucguucaaagauuuaggacgaguaguggucaugguaggggcgacaauggcugacgacauugguaugggugucaccuauuuagcccuucucgcugccuuuaaagugcgucccacauucgcggcagguuuauuacuccgaaaauugacaucgaaagaacugaugaugacaaccaucgggauaguauuauuaucucaaucuacuauaccggaaacgguacuugaacucacagacgcccuugcacuaggcaugaugguacucaagauagucagaaauauggagaaauaucagcuugccguaacaaucauggcuauauugugugugccaaaugccguaauauuacaaaaugcauggaagguaucuugcacaauucuagccguuguaucagucagcccccuacuauuaacguccucccagcaaaagacugacuggauuccccuugcgcucacaauuaagggccuaaauccaaccgcuauauuucuaacuacccuuucucgaacaaacaagaaaagaucauggccauuaaaugaggcaauaauggcagugggaaugguaagcauauuagccagcucgcuccucaaaaaugauauuccaaugacuggaccuuuagucgccgggggacuauugacagugugcuaugugcugacaggcagaucagccgaucucgaauuggaaaaagcaacagauguaaaaugggaagaucaagcugaaauaucaggaucgucuccgauccuaagcauuaccauuagcgaagauggaucuaugucgaucaaaaaugaagaagaagaacaaacucuaacuauacuaauaagaaccggucuauuaguuauaaguggguuauucccaauaucaauaccaauaacggcugccgccugguacuuaugggaagucaagaaacagcgagccggaguucuaugggacguuccaagcccuccaccaaugggaaaagcggagcuagaagauggugccuaccgaaucaagcagaaaggaauauugggauauagccaaauaggugcaggaguguauaaggaggggacauuucauacuauguggcaugucacaagaggggcaguacugaugcauaaagguaagcgcauagaacccucaugggccgaugugaaaaaggauuuaauaagcuauggagguggguggaaacuugaaggagaauggaaagagggagaggagguucagguccuggcacuagagccgggcaaaaauccaagggccguccagacgaaaccuggacuguuuaaaacuaauacaggaacuaucggugcgguaagucuggacuucagucccggcaccagcgguucuccgauaauagauaagaaaggaaaaguagucggacuauacgggaaugguguagugacuagauccggagcauaugucagugcgauagcgcaaaccgaaaaaucaaucgaagacaaccccgaaauagaagaugauauuuuccgcaagcgucgccucacaaucauggaucuccacccuggcgcaggaaaaacaaaaagguaucuaccagcgauaguaagggaggcaauaaaacgcggucucagaacgcuuauauuggccccaacgagaguaguugcagcugaaauggaagaagcauuaagaggauuacccauccgauaucaaacucccgcuauucgagcugaacauaccggccgggaaauuguagauuuaaugugucaugcuacauuuacaaugcgucugcuauccccgguuagaguaccaaacuacaaucucauuaucauggaugaagcccacuuuacugauccggcuagcauagccgcaagaggauacauaaguacgagaguugagaugggugaagcagcuggcauauucaugacugcgacaccaccagguucgagagauccguuuccucagucuaacgcuccuauaauagaugaagaacgugaaauaccagaaagaucauggaacucaggacaugaaugggugacagauuuuaaaggaaaaacuguuugguucguuccgucaauaaaggcugggaaugacauagcagcauguuugaggaaaaaugggaagaaaguaauacaacuaucaaggaagacuuuugauucagaauacguaaagacaaggacuaaugauugggauuuuguaguaacuacagauaucuccgaaaugggagcaaauuucaaggcugaacgaguaauagauccaagaaggugcaugaagccaguuauauuaacagauggagaggaacgcgucauauuagcaggaccaaugccagucacccauucgucagcggcucagcgaagaggacguauuggucgaaauccaaagaaugaaaaugaccaauauauuuauaugggagaaccacuagaaaaugaugaggauugugcacacuggaaggaagcaaaaaugcugcuggauaauauuaacacgcccgaaggcauaauaccaagcauguuugaacccgaaagggaaaaaguggaugccauagauggcgaauaucgacuaagaggggaagcacgaaaaacauuugucgaucuaaugcgaagaggagaucuaccaguauggcuggcuuacaagguugcugcugaaggcauaaauuacgcagauaggaggugguguuucgacggaauuaaaaauaaucaaauacuagaagaaaacguggaaguugagaucuggacuaaagaaggagaaaggaagaaacuuaaaccacguuggcuggaugcucgaauauauucggacccacuugcccucaaagaauuuaaggaguucgccgcaggacguaagagcuugacauuaaauuugauuacugaaauggggaggcuucccacauucaugacgcagaaaacgagggaugccuuagauaauuuagcuguccuacauacugcggaggccggcggaagggcauauaaucaugcauuaagcgagcucccagaaacgcuagaaacguuauuacuacugacuuuguuagcgacagugaccggaggcauauuuuuauuucuaaugucuggaagagggauaggaaaaaugacacucggcaugugcugcauaaucacggcgucaauacugcucugguacgcacagauacaaccgcacuggauagcggcaucuauuauacucgaguucuuuuuaauuguucuucucauacccgaaccggaaaagcaacgaacuccacaagacaaccaacugacuuacguggugauagcuauuuuaaccgucguagcagcuacuauggcaaacgaaauggguuuucuagagaaaacuaagaaagaucucggguuaggaucgauagccacacagcaaccugaaaguaauauacuagauauugauuugcgaccugcaucagcuuggacauuauaugcaguagcaacuacuuuuguuacuccuaugcuaagacacuccauagaaaacucaagcgucaacguaucauuaacggcgauugcaaaccaagcuacuguauuaaugggcuugggaaagggauggccacuaucaaaaauggacaucggagucccauugcuagcaauuggauguuauucgcaaguuaauccaauaacucucacugcugcacuacuucucuuaguugcucacuaugcgauaauuggaccuggucuacaagcaaaagcgacacgugaagcacagaaaagggcggcugcgggaauaaugaagaauccaacaguggauggaauaaccgugauugauuuagaucccaucccauacgauccuaaauucgaaaagcaauuagggcagguaaugcuguugauacuaugcgugacucaaguauugaugaugaggacaacuugggcccuuugugaggcacuuacgcuugcuacagguccgauauccacguugugggaggguaaccccggaagauucuggaauacaacgauugcuguuaguauggcaaauaucuuucgaggguccuaucuagccggugcgggccuacuauuuucgauaaugaaaaauacuacaaacacuaggagggguacagggaauauuggggaaaccuuaggcgaaaaguggaagucucgacuuaaugcacuggguaagucagaauuucaaauuuauaagaaauccggcauccaagaaguagaucgaacccuugcaaaagaaggaaucaaaagaggcgagacugaccaucaugccgucuccagagguuccgccaaacuaagaugguucguugaacgcaauauggucacaccagaagguaaagucguugauuuaggaugugggaggggagguuggucguauuacuguggugggcucaaaaaugugcgagaagugaaaggacuaaccaagggaggacccggccaugaagaaccaauaccaaugucaaccuaugguuggaauuuaguaagacuacaaucugggguagacguauucuuuauaccuccggagaaaugugauacgcuccuaugugacauuggcgaaucgucuccuaacccaacuguagaagcuggcagaacuuuaagagugcugaaccugguagagaacuggcucaacaauaacacacaauucugcauaaaggugcuaaacccauauaugccuagugugauagagaaaauggaggcacugcaaagaaaauacgguggcgcauuaguacggaacccacuuucuagaaauucuacucaugaaauguauuggguaaguaacgcgucagguaacauagucagcucgguuaauaugaucucaagaaugcuaauaaaucgauucacaaugcgacauaagaaagccacauaugaaccugacguagaccuaggaucuggaacgaggaacauugguauugaaagugaaauacccaauuuagauauaauagguaaaagaauagagaaaauaaaagaagaacacgagacuucauggcauuacgaucaggaccauccuuacaaaacaugggcuuaccaugguucauacgagacaaaacaaacaggaucagcaucaagcaugguaaacggaguaguaagguuacugaccaagccgugggacguauuacccacaguaacucagauggcaaugacugacacaacaccuuucggacaacaaagaguauucaaagagaaaguagauacgagaacacaagaaccaaaagaaggcacuaagaaauuaaugaaaauaaccgcggaauggcucuggaaagaauuaggcaaaaagaaaacuccgcgaaugugcacacgagaggaauuuacacgcaagguuaggaguaaugcagcauuaggcgcgaucuucacugaugaaaauaaauggaaauccgcuagggaggccguggaagauaacagguucugggaguuaguagacaaagaaagaaauuuacaucuagaagguaaaugcgaaacaugcguuuauaacaugauggggaaaagggaaaagaaguuaggcgaauuuggaaaagcaaaagguucaagagcaaucugguacauguggcuuggagcacgauuccucgaauuugaagcauuagguuuucuuaacgaagaucacugguucagcagagagaacagucugucaggaguagagggugagggacuucauaaguuagguuauauacuaagagauguaagcaagaaagaagguggggcgauguaugccgacgacacagcaggcugggauacaagaaucacacuagaagaucucaaaaaugaagagaugguaacaaaucacauggaaggggaacauaagaaacuagccgaggcuauuuucaaacuuacauaucaaaauaaagucguucguguacagcgcccaacgccgcgaggcacuguaauggacauaauaucaagaagggaucaacgggguagcggacaaguugguaccuauggauuaaauaccuuuaccaacauggaggcgcaacuaaucaggcagauggaaggggaaggugucuucaaaaacauucaacauuugacagugacggaagaagcggcaguccaaaacuggcuagcaagaguuggacgagaaagguugucacggauggcaauuuccggugacgauugcguuguaaaaccccuugacgaccgcuuugcgaaugcacugacagcauuaaaugacauggggaaaaucagaaaagacauucaacaaugggaaccgucaaaaggguggaacgacuggacgcagguaccguucugcucucaucauuuccacgagcuaguaaugaaagacggacgcguauuggucguuccuugucgaaaucaagacgaauugauaggccgcgcaagaaucagucaaggugcgggguggagccuaagggaaaccgccuguuuaggcaaaaguuacgcucaaauguggagccugauguauuuucauagacgugaccuaagguuagcggcgaacgcgauuuguucagcgguaccaagucauuggguuccuacaaguaggacuaccuggucaauacacgcaaaacaugaguggaugacaacagaagacauguugacaguguggaaccguguuuggauaagggaaaauccauggauggaagacaaaaccccuguagaauccugggaagaaauccccuaucuaggcaaaagagaagaccaaugguguggaucuuuaauaggguuaacuagcagggccacgugggcuaaaaauauucaagcugccauuaaucaagucaggucacugauaggcaacgaagaguauacagacuauaugccaucaaugaagagauuccguagggaagaagaagaagcgggcguacuaugguga

SEQ ID NO: 22347 - RNA, 9876 nt, Artificial Sequence
  derived and/or modified CDS sequence (opt6) from DENV-2__GQ868625__SS-prME
ucggcagggaugauuauuaugcuuauaccgacuguuauggcuuuccaccugacaacacgaaacggugaaccacauaugaucguggguauacaagaaaaagguaagucacucuuauuuaagacagaagacggugugaauaugugcacacugauggcuauggaccuuggcgaacugugcgaggauacuauuacauacaaaugcccuuuauuaagacaaaacgagccagaggacauugacuguugguguaauucaacuucgacauggguuacuuacgguacaugcaccacuacuggagagcauagacgugaaaaaagaucugucgcuuuagugccucacguagggaugggacuagaaacaaggacugaaacauggaugucuucugaaggggcauggaaacacgcucaaagaauugaaacguggauacuuaggcacccugguuucacuauuauggcugccauacuggccuacacgaucggaacaacacacuuccaaagagucuuaauauucauacuuuuaacagcaguugcaccaaguaugacaaugcgcuguauaggaaucucgaaucgagacuuuguugaagguguuucagggggaucauggguggauauuguauuagaacacggaaguugcguaacaacuauggcaaagaauaaaccaacgcuagauuuugagcuaauaaaaacagaagcuaagcaaccagcgacguugaggaaguacugcauugaagccaaacuaacaaauacuacaacugagucacgcuguccaacacaaggugaaccuucauuaaaagaagagcaagauaaaagauucgucugcaaacauucaaugguugaccgaggauggggaaauggauguggacuuuuuggaaaaggaggaaucgucacuugugccauguuuacuugcaaaaaaaauauggaaggcaaaauaguccaaccagaaaaucuagaauacacuauaguaguaacgccacauucaggugaagaacacgcaguaggaaacgacacugggaagcauggaauggaaauuaagguaacaccucagucgucaauaacagaggcugagcucacagguuaugguacuguuaccauggaguguucaccaagaacaggacuagacuuuaacgaaauggucuuguugcaaauggaaaauaaagcauggcucgugcaccgucaaugguuuuuagauuuaccuuuaccauggcuacccggagcagauaaacaagaaucuaauuggauacagaaggaaacgcucguuacuuuuaagaauccucaugcaaaaaaacaagauguagucgucuuaggaucacaagaaggugcuaugcauacugcauuaacuggugcaacagaaauacaaaugucuucaggaaaucugcuuuucacgggacaucuaaagugucgauuacgcauggauaaauugcaguuaaaaggcaugucauacagcaugugcacaggaaaauuuaaaguaguaaaagaaauagcggagacucaacacgguaccauagucauacguguccaauaugaaggcgacggcagcccuugcaaaauacccuuugaaauuauggauuuagaaaaacgauauguccucggccgucucauaacagucaauccgauugucaccgagaaagauucaccaguaaauaucgaagccgaacccccuuucggagacucuuauaucaucauaggaguugaaccaggucaauuaaagcuuaauugguucaaaaaagguucaucgauugguagaauguuugaaacaaccaugagaggcgccaaaaggauggccauucugggagacaccgcuugggacuucgggucgcuaggagguguuuuuacgucaauuggcaaagcguuacaucaaguuuuuggagcgauauacggggcagcauuuucuggaguaucauggacuaugaaaauacucaucggugucauaaucaccuggauaggaaugaacucacgaucgacgucacucucaguuaguuuaguacucguagggaucguaacgcuauaccuuggagugaugguccaagccgauucaggaugugucgugucuuggaaaaauaaagaauuaaagugcgguucugguauauuuauaaccgacaauguucacacauggacggaacaauauaaauuucaaccggaaagcccuaguaaacuugccucugcaauacagaaagcacaggaagagggaauauguggaauaagaucaguaacccggcucgaaaacuugauguggaaacaaauaacgccggaauuaaaccauauccuagcugaaaaugaagucaagcucaccaucaugaccggggacauuaaggguauaaugcaggcugguaaacggucauugagaccccaaccuacagaauuaaaauacucuuggaaaaccuggggaaaagcaaaaaugcuaucuacugaaucauauaaccaaacauuuuuaauugacggaccugaaacagcugaauguccuaacacuaaucgggcuuggaacucauuggaagucgaagacuauggauuuggcguauuuacuacaaauauuuggcuuaaguuaaaggagaaacaagacgcguucugcgauucaaaguuaaugagcgcagccauaaaagacaaucgcgcaguccaugccgauauggguuauuggauagagagugcacuuaaugauacauggaaaauagaaaaggcaucauuuauugaagucaaaaauugccauuggccaaaaucccauacccuauggaguaauggugugcuggaaagcgaaaugauaauacccaaaaaccuagccgguccagucucccaacacaauuaccgaccaggauaccauacacaaauagcggggccauggcaucuaggaaaacucgagauggauuucgauuuuugugacggcacgacuguuauuguaacggaggauuguggcaacagaggccccucauuaaggacaacaacagcuucagggaaacucauaaccgaguggugcuguagaagcuguacacucccgccacuaagauauaggggcgaagacggcuguugguacggaauggagaucagaccccuaaaagaaaaagaagaaaauuugguaaauucccuagugacagcuggacauggccaaguugauaauuucucgcuaggagugcucgguauggcguuguuuuuggaagaaaugcuaagaacaaggguaggcacaaaacacgcaaucuuacuaguugccguaagcuuuguaacucucauaacagggaacaugucuuuuaaggaucuagggcgaguugugguuaugguuggcgcaacaauggcugacgauauaggaaugggaguaaccuacuuagcacuucuggcagcguuuaaaguaagaccuacauucgcugccggccuucuucuacggaaauuaacaucaaaagaauuaaugaugacaacuauagggauaguucuucuaagucaaucuacuauuccagaaacaguccuggaacugacugacgcucuugcuuugggaaugaugguucucaaaauaguuagaaacauggaaaaauaucaacuugcgguuaccaucauggcaauccuauguguaccuaaugcugucaucuugcaaaacgcuuggaaaguaaguugcacaauauuagcagucguuucggugagcccauuguuauuaacgagcucacaacagaaaacagacuggauaccacuggcucuaacaauaaagggucucaacccaacugcuauauucuuaacuaccuuaucacgcaccaacaagaaacgcuccuggccguugaacgaagcaauaauggcuguaggaaugguaaguauacuagcaaguucuuuguuaaaaaacgauauacccaugacaggcccuuugguagcagguggacuguuaacaguauguuauguguugacugggagaucggcagauuuagaacuagaacgagcaacagauguaaagugggaagaucaagcggaaauauccgggaguucgccaauacucucaaucacuauaucagaagauggcucgaugagcauaaagaacgaagaggaagagcaaacccuaacuauacucauacguaccggucuauuagugaucagcgggcuauucccaauuaguauaccaauaacagcagccgcgugguaucuuugggaagucaaaaagcaacgagccgguguccuaugggauguuccgucacccccacccauggguaaggcggaauuggaagacggagcuuauagaauuaaacaaaagggaauacuuggauauagccaaauaggcgcuggaguguauaaggaggguaccuuucauacaauguggcacgugacuagaggugccguguugaugcauaaaggaaagcguaucgagcccagcugggcagacguuaaaaaggauuuaauaaguuauggggguggcuggaaacucgaaggggaauggaaagaaggagaggagguucaaguacuagcauuagaaccagguaagaacccgagagcgguucaaacaaaaccgggacuauucaagacuaauaccggaacaauaggcgcuguaucauuagauuuuaguccaggaacauccgguucgcccauuauagauaaaaaagguaagguuguuggauuguacggcaauggcguagucacaagaaguggagccuacgugagugcgauagcacagacggaaaaaucaauugaagacaacccugaaauugaagaugauauauucagaaagcgcagacucaccauaauggauuuacauccaggugcugguaagacuaaacgauaccuuccugcuauuguuagagaagcaauaaagagaggacuaagaacuuuaauuuuagcccccacucguguaguggcugcagaaauggaggaagcacuuagggggcuaccaauccgauaucaaaccccagcaauucgugcugagcacacaggccgggaaauaguagaucuaaugugccaugcuacuuuuacuaugagguugcuuagucccgucagaguaccuaacuauaaccuaauaaucauggaugaagcacauuuuacagacccugcaagcauugcugcacgagguuauaucucuacucggguggagaugggagaagccgcgggaauauuuaugacagccaccccacccggcagucgagacccuuucccucaaucgaacgcaccaauaauagaugaagaaagggaaauuccggaacgaucuuggaacuccgggcacgaaugggugacagauuucaaaggaaagacaguaugguucgugccaucgaucaaagcaggaaaugauauagcugcauguuugcgaaaaaauggaaagaaaguuauacaguugucaagaaaaacauuugauucagaauaugucaaaacacgaacaaacgauugggauuucguagugaccacagauauaagcgaaaugggagcaaauuucaaggcagaaagaguuaucgauccaagaagguguaugaaacccguuauauuaacagacggagaggagcgaguaauuuuggccggaccuaugccaguaacucauuccucagcagcccaaagaaggggacggauugguagaaauccgaaaaaugaaaaugaucaguacaucuauaugggagaaccccuagaaaaugaugaagacugugcacauuggaaggaagccaaaauguugcuagauaauauuaauacaccggaagguaucauaccaagcauguuugaaccggagcgugaaaaaguggaugcaauagauggagaguacagacucagaggagaagcucguaaaacauuuguagaccucaugcguagaggugaccuucccguuugguuggcauauaaaguagcagcugaaggaauaaauuacgcagaucggagauggugcuucgauggcauaaaaaauaaccaaauccuagaggagaauguugagguagaaaucuggacaaaggaaggcgaaaggaagaaauuaaaaccucgauggcuugacgcgcgaaucuacucagauccacucgcgcuaaaagaauucaaagaauucgcggcaggucggaaaucacugacauuaaauuuaauuacggagaugggccgguuacccacuuuuaugacucaaaaaaccagagacgccuuggauaaucuugcugugcugcacacugcagaagcuggggguagagcguauaaucaugcucuaucagaauugccugaaacguuagaaacuuuguuacuccugacacuuuuggcuacggucacgggaggaauuuuccuuuucuuaauguccgggagaggcauaggcaaaaugacucuaggcauguguugcauaauaaccgcaucaauauuauuaugguacgcacaaauucaaccacacuggauagcugcuucgaucauccuugaauucuuccugauaguacuccugauaccagagccugagaaacaaagaacaccucaagacaaccaauuaacauacguuguaaucgcaauccuaacggucguagcugcaacaauggccaaugagaugggauuccuagaaaaaacgaaaaaagauuuaggccuagguuccauugcaacacaacaaccggaaaguaauauauuagacauagacuuaaggccagcgucagcuuggaccuuauacgcagucgcuaccaccuuuguaacuccuauguugagacauaguauugagaacaguaguguuaacguaagucuaacggcaauagcaaaccaggcgacaguauugauggggcuugguaagggcuggccuuuaagcaagauggauauagguguuccauuacuagcaaucggcugcuauagccaaguaaacccaauaacuuuaacagcagcuuugcuauugcuuguugcacacuaugcuauaauagguccgggauuacaggccaaagccacaagggaagcccaaaagcgagcagcugcaggaauaaugaaaaauccaaccguugauggaauaacaguaauagaucuugacccuauuccauacgauccgaaauuugaaaaacagcucggucaaguaaugcuuuuaauauugugcguaacucaaguccuuaugaugcguaccacuugggcacucugugaggcguuaacacuugccacuggacccauuucuacacuaugggaaggaaaucccggacgcuuuuggaacacgacgauagcgguguccauggcgaacauuuuccgcgguagcuaucuugcaggugcgggucuauuauucaguauaaugaaaaauacuacuaauacucguaggggaaccggcaacaucggagaaacgcuuggugagaaauggaaaucaagauuaaaugcacugggcaagagcgaguuucaaauauacaaaaaaaguggaauccaagaaguugaucggacuuuagcaaaagaagguauaaaaagaggagaaacugaucaccaugcaguuagucgaggaagcgcaaaacuuagaugguuuguggaacgcaauauggucacaccagaaggcaaaguugucgacuuagggugcggacgcggaggauggucauauuauuguggaggacuaaaaaauguaagagaagucaaaggacuaacaaaaggagggccgggacacgaggaaccuauaccaaugagcaccuacggguggaacuuaguucgucuccaaucuggaguugaugucuucuuuauacccccagaaaaaugcgacacuuuauuaugcgacauaggcgagaguaguccuaauccuacuguagaagcagguagaaccuuaaggguacuaaaccugguugaaaauugguuaaauaacaacacucaauucuguauaaaaguacugaauccuuauaugccaagugugauagagaaaauggaagcauuacaaagaaaauauggcggugcacuaguacgcaauccuuuguccagaaacucuacacacgaaauguauuggguuucgaaugcaucggguaauauuguaaguucaguaaacaugauauccaggauguugauuaauagauuuacgaugcgacacaagaaggcaacuuaugaaccugacguugaccuaggauccggaacaaggaauauagguauagaaucagagauuccaaacuuggauauaauuggaaaaaggauugagaaaauuaaggaagagcacgagacuucauggcauuacgaucaagaucacccguauaaaacaugggcguaucacgggucuuacgagacaaaacaaacuggcucagcaagcaguaugguaaacggugugguucguuuauugacaaaaccuugggaugugcugcccacgguaacccagauggcgaugacggauacaacuccauucggacaacaacguguuuucaaagaaaaaguagauacacguacccaggaaccaaaagaagguaccaagaaacuaaugaaaauuaccgcggaguggcuauggaaggaauugggaaaaaaaaagaccccccgcauguguacgcgagaagaauuuaccagaaaagugcgcaguaaugccgcguuaggagccauauucacugaugaaaauaaguggaaaucugcaagagaagcugucgaagauagucgauucugggaguugguagauaaggaacguaacuuacaucuggaaggaaaaugcgagaccugcgucuacaauaugaugggaaaaagagaaaaaaaguugggcgaauucggaaaggccaaggguagcagagcaauaugguauauguggcucggagcgagauuuuuggaguucgaagcacuagguuuuuugaaugaagaccauugguuuucuagagaaaauucauuaagcggaguggaaggagaaggcuuacauaaauuaggcuacauacuucgagacguuaguaaaaaagaaggcggggcuauguacgccgaugauacugcagggugggacacgagaaucaccuuagaagaccugaagaacgaagaaaugguaacaaaucacauggaaggcgaacacaaaaaacuugcagaggcuauauuuaaacuuacguaccaaaauaaggucguaagagugcaacgcccaaccccucguggaacagucauggauaucaucucaagacgugaucaaagagggucugggcaaguaggcacauauggucuaaauacuuuuaccaacauggaagcacaacuaauacgccaaauggaaggagagggcguauucaaaaacauucagcaucuuacagucacugaagaagcagccgugcaaaauuggcuagcacgcguaggcagggaaagauuaucaagaauggcuauuucaggagaugauuguguggucaaaccuuuggaugaucgauucgcuaacgcauugaccgcccucaacgauauggguaagaucaggaaagauauucagcaaugggaaccuagcaaggguuggaaugacuggacccaagucccuuucuguucacaucauuuucaugaauuaguaaugaaagaugguaggguauuaguugugcccugucgaaaccaagacgagcuaauaggccgugcuagaaucagucaaggugcgggguggucacuaagagaaacggccugccuggggaaaaguuaugcccagaugugguccuuaauguauuuucauaggcgcgaucuuagauuagcugcuaaugccaucugcuccgcagugcccucccacuggguuccaacaagccgcacaacuuggaguauacacgcuaaacaugaauggaugacgacugaagacaugcugacuguguggaaccguguuuggauacgagaaaacccuuggauggaagauaaaacuccaguugagaguugggaagaaauacccuauuuaggcaaaagagaagaccagugguguggaagccugauaggucucacgucucgagcaaccugggcaaaaaacauccaagcagccauuaaccaaguucggagcuuaaucggaaaugaggaauauaccgauuacaugcccuccaugaaacgcuuccgaagagaagaagaggaagcuggugucuuaugguaa

SEQ ID NO: 22348 - RNA, 9876 nt, Artificial Sequence
  derived and/or modified CDS sequence (opt6) from DENV-2__KF955401__SS-prME
agcgcugguaugauaauuaugcucauaccgacaguaauggccuuccauuuaacaacuaggaauggugagccacauaugauugucggcauacaagaaaaaggaaaaucuuuauuauuuaaaacagaagauggaguaaacaugugcacucuuauggccauggaucucggugaacuuugcgaagauaccauaacuuacaaaugcccauugcucagacaaaaugagccagaagauaucgauuguuggugcaacucgacauccacguggguaacguauggaaccuguaccacuacaggagaacauagacgagaaaaaagaucagucgcauuaguuccccacguuggaaugggacuagaaacgagaacagaaacauggaugucaagcgagggagcuuggaaacacgcccaacgcauagaaacuuggauauugagacauccaggauucacaaucauggcugccauacuagcauauaccaucggaacaacucacuuucagagaguacuaauuuucauuuuauuaacagcaguagcaccgucuaugacaaugagaugcauaggaauuuccaaucgagauuuuguggaaggugugucugguggaucauggguugauauugucuuagaacaugguagcugugucaccacuauggcuaaaaauaagccuacacuagauuuugaacuaauaaaaacagaggccaaacagccagcaacuuugagaaaauacuguauagaggcuaagcuaacuaacacuacuacagaaaguagguguccuacacaaggagagcccucucucaaggaagaacaagauaaacgguucguuugcaaacacuccaugguagaucgcggcuggggcaauggaugcggauuauucggaaaaggugggauagucacaugcgccauguucaccugcaaaaaaaacauggaagggaagauuguccagccugaaaacuuggaauauacaauaguagucacaccacauucaggagaagaacaugccgucggcaacgauacuggaaagcauggaauggaaauuaaagucacuccacagucaaguauaacugaagccgaacugacugguuauggaacaguuacaauggaauguucaccccgaacuggacuagauuuuaacgagaugguacuucuacaaauggagaauaaggcguggcuugugcauaggcaaugguuucucgaucugccucuuccguggcuuccuggugcagacaaacaagaaaguaauuggauucaaaaggagacccucgugaccuucaaaaacccacaugcaaaaaaacaagauguugucguacuaggaagucaggaaggugcuaugcacacagccuuaacuggggcaacugagauucaaauguccucggggaacuuguuguuuacuggacaucugaaaugucgacuaagaauggacaaacuacaauuaaaaggcaugucauauaguauguguacagguaaauucaaaguugugaaagaaauugcugaaacccaacacgguacaaucguuauacgaguacaauacgaaggugauggcagucccuguaagaucccuuuugaaauuauggaccuugaaaaaagauacguuuugggacgucugauaaccguaaacccuaucguuacugaaaaggauucaccaguuaauauagaagcugagccuccauuuggugauucauauaucauaauagguguggaacccggucagcucaaacugaauugguucaagaaaggaucaucuauuggccaaauguuugagaccacuaugaggggcgcaaaaagaauggcgauccuaggugacaccgcaugggauuuuggaucauuggggggcguauuuacgucaauuggaaaagcgcuucaucaaguguucggagcgaucuacggaguggcauuuaguggaguauccuggacgaugaagauauuaauagguguaauuauaacguggaucgguaugaauucacgcucuacuucauuaucuguaucucuaguccugguuggcauaguuacucuuuauuuagguguuaugguacaagcggauuccggaugcgucguaagcuggaagaacaaggaguuaaaguguggaucugggaucuucauuacggacaauguccauaccuggacggagcaguauaaauuccaacccgaaaguccuagcaaacuagcaucagccauacaaaaagcucaagaggaaggaauuugcgguauaagaagugucacaaggcuugaaaauuuaauguggaagcaaaucacgcccgagcuuaaccauauuuuagccgagaacgaaguuaagcuuacaaucaugacaggugauaucaaaggaauuaugcaagcaggaaagagaucacuuagaccacaaccaacagaacugaaguauucuuggaaaacguggggaaaggcuaaaauguuguuuacagaaaguuauaaucagacuuuuuuaauagauggcccugaaacagccgaaugccccaauaccaaucgugcauggaacaguuuagaaguagaagacuauggauucggcgucuuuacuacuaacauaugguugaaauuaaaagaaaagcaggaugcuuuuugcgauucaaaauuaaugucugcugccaucaaagacaaucgugcaguucaugcagacaugggguauuggauugaaucugcgcuaaaugauacguggaagauagagaaggcuuccuucauagaaguaaaaaauugccauuggccaaagucccacacacuuuggaguaacggaguacucgaaucggaaaugauaauaccgaagaaucuugccggaccagugucacaacauaauuauagaccgggcuaucauacccaaauugcuggcccauggcaucugggaaagcucgaaauggauuuugacuuuugcgacgggacuacgguuaucguuacagaggacugcgggaauagaggaccgagucuaaggaccacaacagcgucaggaaaacuuauaacugaaugguguugcagaucguguacacuacccccauuaagguaccgaggagaagaugguuguugguauggaauggaaauucguccucuaaaagaaaaagaggaaaaucuaguaaauucauugguaacggcuggacauggccaaguagauaauuucucgcuggggguacuuggcauggcacuauucuuggaagagauguugcgaaccagaguaggaaccaagcaugcgauucuccuuguagcagucagcuucguaacacuaaucacagguaacaugagcuucaaggaucucggaagagugguaguuaugguuggagcaacaauggcagacgacauagguaugggaguuacauaccuugcucuauuagcagcuuucaaaguaagacccacauuugcugccgggcuacuacuacguaaauuaaccucaaaagaacugaugaugacgaccauuggcaucguguuauuaagucagucaacaauaccggaaacaguacuagagcucacagaugcauuggcccuaggaaugauggugcugaagauaguaaggaauauggagaaauaucaauuggcuguuacaaucauggcuauacucuguguaccaaaugccgugauucuacaaaaugcuuggaaggucucuugcacaauccuugcaguugugucgguaucccccuuacuacuuacgagcagucaacaaaaaacagacuggaucccacuggcuuuaacgaucaaaggacuaaacccaacggcuauuuuucuaaccacgcugucgcgaaccaauaagaaacgauccuggccuuuaaaugaagcgaucauggcaguaggaaugguaucuauccucgcaucaucauuauugaaaaaugacauucccaugacaggcccgcuaguagcaggcggauuacucacuguaugcuauguucuuaccggacguucugcugauuuagaacucgagcgugcgacugacgugaagugggaagaucaagccgaaauaucagggucaagcccuauucuaucaauuaccauuucagaggacggcucgaugucaauuaaaaaugaagaagaagaacaaacacuaacuauuuuaauccguacuggauugcuagugauuaguggcuuauuuccuauaagcaucccaauaacugccgcagcaugguauuuaugggaaguuaaaaaacagagagcaggcguucugugggacguaccaagucccccaccaauggguaaagcugagcuagaagauggggcguauagaauuaaacaaaaaggcauacuugguuacagucaaauuggagcgggagucuacaaggaagguacuuuccauacuauguggcacgucacuaggggagcaguacugaugcacaagggaaaaagaauugaaccaucaugggcggauguuaaaaaggauuuaauauccuauggagggggauggaaguuggagggugaguggaaagaaggugaagaaguucaaguauuagcauuggaaccaggcaaaaauccucgcgcggugcaaacaaaaccagggcuauuuaaaacuaacaccgguacuaucggagcuguuucauuagauuuuuccccgggaacuucugguucaccaauaauagauaaaaaaggaaaaguuguuggacucuacggcaauggcguggugacacgaaguggagcuuacguaucagcuauugcacaaacggaaaaaagcauugaagauaauccugagaucgaggacgauauauuuagaaagaggagacugacaauuauggaucuacacccgggugcuggaaaaaccaagagauauuuacccgccauuguacgagaggcuauaaaaagagguuuacgaacauuaauacuagcaccaacgagagucgucgcagcagaaauggaagaagcguuaagaggucuuccaauacgauaucaaacaccagcuauucgugccgaacauacagggcgggaaauaguggaucugaugugucacgcaacauucacaaugagacuacuuuccccgguacguguaccuaauuauaaucugauaaucauggaugaggcacacuuuacugauccagcaagcaucgcggccagagguuacauuucaacaagaguagaaaugggugaagcugcagguauuuucaugacagccacacccccuggaaguagagauccuuuuccacaaaguaaugcuccaauuaucgaugaggagagagaaauaccggaaagaagcuggaacuccggacaugaguggguuacugauuuuaaaggaaaaacgguaugguuuguucccucaauuaaagcagggaaugauauagcagcauguuugaggaaaaauggaaaaaagguaauacaauuaucacgaaaaacguucgauagugaguacguaaagacucguacaaacgauugggacuuuguaguuacaaccgacauaagcgaaaugggagccaauuuuaaagcagaaagggucauagacccaagaaggugcaugaaaccaguaauccucaccgacggcgaagaaagaguuauauuagcugguccaaugcccguuacacauaguucagcggcucagaggaggggucgaauuggccguaacccuaaaaaugagaacgaccaauauauauacaugggugaaccccuggaaaacgacgaagacugugcacauuggaaagaagcaaaaaugcuauuggauaacauaaauacaccggaaggaaucauuccauccauguucgagcccgaacgugaaaaaguagacgcuauugacggagaguauagacuccgaggagaagcacguaaaacguuuguugacuuaaugagacgaggcgaucuuccaguauggcuagcauauaaaguugcugccgaaggaauuaacuaugcagaccggcgaugguguuucgauggaaucaagaauaaccagauucucgaagaaaaugucgagguugagauauggaccaaggaaggagagcgaaaaaaacuaaagcccagguggcuagaugcccguaucuauagugacccacuugcauuaaaagaauuuaaagaauuugcggcaggacgcaaaaguuuaacguuaaaucuuauuacagagauggguagauuacccacuuucaugacacaaaagacacgugacgcacuagauaacuuagcuguacuucacacggcugaagcagguggacgagcauacaaucacgccuuaagugagcugccagaaacuuuagaaacgcuauuacuauuaacauuauuagcgacuguaacaggagguauauuccucuucuugaugagcgguagaggaauuggaaagaugacacucgggauguguuguauaauaacggcuuccauucuguuaugguaugcacagauacaaccgcauuggauugcggccucuauaauuuuagaauuuuuucuaaucguacuacuaauuccugaacccgaaaaacaaagaacaccgcaggauaaucaacuaaccuacgugguaauagcuauauuaaccguaguagcagcaacuauggcaaaugaaaugggguuucuagaaaaaacgaaaaaagacuuaggcuugggcaguauagcgacccaacaaccagaaucgaauauucuugauauugaucugcggccagcuucugcauggacacucuacgcaguggcuacaacuuuuguuaccccaaugcuucgacauuccauagaaaauuccucaguaaacguaucguuaacugcuauagccaaccaagcgaccguauugauggggcucgggaaaggguggccauuaagcaaaauggacauaggaguaccacuauuagccaucggguguuacagccaagucaauccuauuacacuaacugccgcuuuacuauuacuugucgcacauuacgcaauuauaggaccgggcuuacaagccaaagcgacaagagaagcgcaaaaacgagccgccgcugguauaaugaaaaacccgacuguugacggcauaacuguaaucgacuuagaucccaucccauaugacccgaaauuugaaaaacaacuaggucaagucauguugcuaauccuaugugugacacaggugcuaaugaugcguacaacuugggcacucugcgaggcccuuacccuugcaacagguccaauaagcacccuaugggaaggcaaccccgguagguucuggaacacaacaaucgcgguuaguauggcgaauauauucagagguucguaucuggcaggugcuggccucuuguucaguaucaugaaaaauacaacaaauacgcgacgaggaacuggaaauauuggagaaacucuaggagaaaaguggaaaucacggcugaacgcccuaggcaaaucggaguuccaaauuuauaaaaaaagugguauccaagaaguggaucguacgcuagcuaaagaagggauaaaacggggcgaaacugaccaccacgcggucucgaggggaucggccaaacuacgaugguuuguugagcgaaacaugguaacgccggaagguaaaguagucgaccugggaugcggccgugggggguggagcuauuacugcggaggauuaaaaaaugugagggaggugaagggauuaacgaaaggagguccaggacacgaagaaccgauuccuauguccacauaugguuggaacuuagugagacugcagagcggagucgauguauucuucauacccccugaaaaaugugauacuuuauuaugcgauauaggugaaagcagcccaaacccaacuguggaggcaggucgaacccuacguguacuuaaccuaguugaaaauugguuaaauaacaauacgcaauuuugcauaaaaguuuuaaauccguacaugccaucaguuaucgaaaaaauggaagcuuuacaaaggaaauacggcggugcauuggugagaaauccauuaucucgaaauuccacacaugaaauguauugggugaguaaugccagugguaacaucguaucuaguguaaauaugauaaguagaauguuaauaaaucgauucacaaugagacacaaaaaagcaacguacgagccagauguagauuuggggagcggcacacgaaauauaggaauagaauccgaaacaccgaaucuagacauaauagguaagcgaauagaaaaaauaaaggaagaacacgaaaccucauggcacuaugaccaggaucacccguacaaaacgugggcuuaucaugguucuuaugagacaaagcagaccgggucggccaguaguaugguaaauggagucguucgacuucuuacaaaaccaugggaugugcugccgaccgugacucagauggcaaugacggacacaacccccuucggccaacagagaguauucaaggaaaaaguugacacucgaacgcaagaaccaaaagaggggacaaaaaaauuaaugaaaauaacggcagaauggcuuuggaaggaacuggguaagaagaaaaccccuagaaugugcacccgcgaagaguuuacccguaaaguacggucaaaugcugcccuuggggccaucuuuacugaugaaaacaaauggaaauccgcucgcgaggcaguugaagauagccgauuuugggaacugguagauaaagaacgcaaucuacaccuugaaggaaaaugugaaacuuguguauauaacaugaugggaaagagagagaagaaguugggggaguuuggaaaagcaaaaggaaguagagcgaucugguacauguggcucggagcuagguuucuagaauucgaagccuuaggauucuuaaacgaagaucacugguuuaguagagagaauucacucagugggguagaaggagaaggacuacacaaacugggguauauauuaagagacguuucuaaaaaggagggaggagcaauguacgcugacgacacugcagggugggacacucgaaucacgcuagaggaccucaaaaacgaagaaaugguaacaaaucacauggaaggcgaacauaaaaaacuggcagaagcaauauuuaaacuaacguaccaaaauaaaguagugagaguacagcgacccacaccucgagggacaguuauggacaucauuucaaggagagaccagcgaggcucuggacaagugggaaccuaugggcuuaacacguucacaaauauggaagcacaacuuauuagacaaauggaaggagagggcguuuucaagaauauccaacaucuaaccgugacggaggaagcagcagugcaaaacuggcuagcaagagucgguagagaacgucuaagcaggauggcuauuagcggagacgauugugucguaaaaccgcuggaugauagauuugcuaacgccuuaacggcuuuaaaugacauggguaagauuagaaaagauauacagcaaugggaacccaguaagggauggaaugacuggacacagguaccauuuugcucucaccauuuccacgagcuaaucaugaaggauggacgagugcucguaguaccaugccguaaucaagacgaauuaauuggaagggccagaauaucucaaggcgcuggauggucacugagagaaacagcaugcuuagguaaguccuaugcacaaauguggagccuaauguauuuccauagaagagaucuccgguuggcugccaaugcaauuugcagugccguaccaucacauuggguaccaacaucaagaacuacuuggucaauacaugcuaaacacgaauggaugaccacugaggacauguugacaguuuggaauagaguuuggauacgagagaauccauggauggaggacaaaacgccggucgaaaguugggaagaaaucccguauuuagguaaaagagaagaucaauggugcggaagcuuaaucggacugacaucaagagcuacgugggccaagaacauucaagcugcaauaaaucagguacguucucugauaggaaacgaggaguauacagauuacaugcccucaaugaagcgauuuaggagagaggaagaagaagcuggcguuuuaugguaa

SEQ ID NO: 22349 - RNA, 9876 nt, Artificial Sequence
  derived and/or modified CDS sequence (opt6) from DENV-2__JF730047__SS-prME
agcgcaggaaugauuauaauguuaauaccuacagugauggcuuuucauuugacaacacggaauggugaaccccauaugauuguugguauucaagaaaaaggaaagagcuuacucuucaaaacugaagauggaguuaauauguguacauuaauggcaauggaccuaggagaacuuugugaagauacuaucacuuacaaaugcccgcucuugaggcaaaaugaaccugaagauaucgacugcuggugcaauucuacauccacguggguuacguacggaacauguacuacuacaggcgaacauaggcgggagaaacgcucagucgcguuaguaccacauguuggcaugggauuagaaacacggacugaaacuuggaugucgucugagggcgccuggaaacaugcacaacgaauagaaacauggauauugcgucauccuggauucacuauuauggcggcuaucuuggcauacacaauugggaccacacacuuucaaagagcguugaucuuuauacuauuaacugcgguagcaccaagcaugacaaugagauguauagguauuucgaacagggacuuuguagagggcguaaguggaggaaguuggguugauauuguacuagaacacggaucuugcguuacgacaauggccaaaaacaaaccuacauuagacuuugagcuuaucaaaacagaggcgaaacagccugcgacuuuaagaaaauauuguauagaagcaaaauuaacaaauacuacaacagaaagccgcuguccaacucaaggcgaaccgucuuugaaagaagaacaagauaaacguuuuguuuguaaacacucaauggucgaucggggguggggaaauggaugcggcuuauucgggaaaggaggaauugucacgugugcuauguucaccuguaagaaaaauauggaaggcaaaauagugcaaccggagaaucucgaguacacaauugucguuacaccacacucuggcgaagaacaugcuguuggaaaugacacgggaaaacauggaaaagaaaucaaagugacaccacaaucgagcauaaccgaagccgaacuaacugguuauggaacuguuacaauggagugcaguccaaggacaggucuagauuuuaaugaaaugguccucuuacaaauggaaucuaaagccuggcucguccaucgacagugguucuuagaccuaccacuuccauggcuaccuggugcagauaaacaaggaucuaauuggauccagaaagagacguuagucacauuuaaaaauccacaugccaagaaacaggaugugguaguguuaggaagccaagagggggcaaugcacacagcguuaacaggcgcaacggaaauacagaugaguucggggaaucuacuauuuacaggucaccuuaaaugcagacuccguauggauaaacuccaacuaaaaggaaugucauacucaauguguacaggaaaauucaaaguuguaaaagaaauugccgaaacacaacaugggacaauagugauaaggguucaguacgaaggagacgguagccccugcaaaauaccauucgaaauuauggacuuagagaaaagguacguacuaggacgauugauaacggucaacccgaucguuacugagaaagauagcccaguaaauauagaagccgaaccaccguuuggugacaguuauauaauuauuggaguagagcccggucaacuaaaauuaaauugguucaagaaagggaguagcauaggacaaauguuugaaacgacaaugagaggagcaaaacgaauggcuaucuugggcgacacagccugggauuuugggucauuaggcggaguuuuuacaucaauugggaaagcacuucaucaaguauucggcgcuauuuacggagcugcuuucagcggcguuucguggacuaugaaaauccuaauagggguaauaauaacuuggauagguaugaacagccgcagcacaucuuuaucgguaaguuuaguucuagugggaaucgugacccuauaucucggcguaaugguccaagcagauaguggauguguagucucauggaaaaauaaagaauuaaaaugcggcuccggaauauuuauaacggacaauguacacaccuggacggaacaguacaaauuucaaccagagaguccuagcaaauuagcaagcgcuauacaaaaagcccaagaagaagggauuuguggaauaagaaguguaacaagauuggagaaccugauguggaaacaaauuacaccagaacuaaaucacauauuagccgaaaaugaaguaaaauuaaccauuaugacuggcgauauuaaaggcauuaugcaagcaggaaaacgcaguuuacgcccacaaccuacggagcucaaauacucauggaaaacauggggaaaagcgaaaaugcuuaguaccgaaucacauaaucagacuuuucucauagauggaccggaaacagcugaaugcccaaacacuaacagagcauggaauaguuuagaaguagaggacuacggauuuggaguauuuacuacaaauauauggcuaaaacuaaaagagaaacaagaugcuuuuugcgacuccaaacugaugucugcggcaauaaaagauaauagggcuguucaugcagacaugggauacuggaucgaaagugcguuaaacgauacauggaaaauagaaaaggccaguuuuauagaaguaaagaacugucacuggccuaaaagccauacucuauggucaaacggaguucucgaaagugagaugauaauaccuaaaaauuuggcuggcccagugagucaacauaacuaucgaccuggguaucacacucagaccgccgggccauggcaccucgguaaauuagaaauggauuuugacuuuugcgacggcaccacuguuauagugacggaggauuguggaaaccgggguccgagccuccgcacgacaacggcgucaggaaagcucauaacagaaugguguuguagaucaugcacucugccaccccuaagguauagaggggaggauggauguugguacggcauggagauacggccucugaaggaaaaagaagaaaaucuugucaauucacuuguaacagcaggccacggacaaguggauaauuuuagucugggaguuuuagguauggcccuuuuucuugaagaaauguuacgaacacggguaggcacuaaacaugcuauauuacuugucgccgugucauucguuacacuuauaacaggcaacauguccuuuaaggaccugggacguguaguaguuaugguggggacuacaaugacugaugacauaggaauggguguaaccuaccuagcccuauuagccgcauuuaaagugcgucccacauucgcugcuggucuauuguuaaggaaauugacaaguaaagaguugaugaugacaacuauagggauuguacuauuaucacagaguacaauucccgagacuauuuuagaacucacugacgcccuugcucuagggaugauggucuuaaaaauaguaagggacauggaaaaauaucaacuagcagucacgaucauggcaauacuauguguaccaaacgcggucauccugcaaaacgcguggaaagugagcugcacaauacuagcugucguaucuguuuccccacuacuacuaacgagcagccagcagaaaacagacuggauuccauuagcacucacuauuaaaggucucaauccaacugcgaucuucuuaaccacccugucuaggacaaauaagaaacgaagcuggccacucaaugaggcaauaauggcaguuggaaugguuuccauccuagcgucaucauuacugaaaaaugacauaccuaugaccggacccuugguagcugguggucuauuaacuguauguuacguauuaacggguagauccgccgacuuggaacuagagcgagccaccgacguaaaaugggaagaccaagcugagauaucaggaucaucaccaauuuuaucaaucacaauauccgaggauggaucaaugucaaucaaaaaugaagaggaagaacaaacacuaacaauuuugauacgaaccgguuuacucguaaucagcggauuauuuccaguuucuauucccauuacagcggccgccugguaucucugggaaguaaagaaacagcgagcgggaguacugugggacguaccaucaccacccccgaugggcaaagccgaauuagaggauggggcuuacagaaucaagcaaaaagggauuuuaggauacucgcaaauaggggcaggaguauacaaggaaggaaccuuucacacuauguggcaugucaccagaggggcagugcuaaugcauaaaggaaaaagaaucgaaccuucgugggccgacguuaagaaagacuuaauuucauaugggggaggguggaaauuagaaggagaauggaaagagggugaagaaguacaaguccuggcccuugaaccugguaaaaacccaagagcagugcagacaaaaccaggcuuauuuaaaaccaauacaggaaccaucggagcuguuagccuagauuucagucccgggacaaguggaagcccuauuauugauaagaaaggaaaagucguuggauuauacgguaaugguguuguaaccaggaguggcgcuuaugucagugcaauagcgcaaacggagaaaaguauugaggacaacccagagauagaggacgacauauuuaggaaacgucgcuugaccauuauggacuugcaccccggugcaggaaagacaaaaagguacuugccagcgaucguccgugaagcaaucaagagaggauuacgaaccuuaauacuggcaccaacucgcguaguggcugcggagauggaggaggccuugcguggucucccaauacguuaccaaacucccgcuauccgcgccgaacauacugggagggaaauaguagaccucaugugccaugccacuuuuacaaugagguuacuaaguccgguaagaguuccuaacuacaaucuuauuauuauggaugaagcccacuucaccgacccagcuucaauugcugcaagaggauacaucucaacccgcguagaaaugggugaggcagcaggcauauuuaugacagcgacaccacccggcucaagagauccguuuccacaauccaaugcaccuauuauagaugaagaacgagaaauaccugaacgauccuggaauaccgggcaugaguggguuacugauuuuaaaggaaagaccgugugguuuguuccgaguaucaaagcaggcaaugauauugcugcauguuuaaggaaaaacggcaagaaaguaauacaacuaaguagaaagaccuuugauagugaauacguaaaaacaagaacaaaugauugggauuucguuguaaccacagauauaagugaaaugggugcuaauuuuaaagcagagcgaguaauagaccccagacguugcaugaaaccuguaauauuaacagauggugaagaacgaguaauacuggcgggacccaugccgguuacacacaguucggcggcacagagacggggucgaauagggaggaauccuaaaaaugaaaaugaccaguacaucuacaugggagagccacuagaaaacgaugaggacugugcucauuggaaggaagcaaaaauguuacuugauaauauaaauacaccggaaggaauaauaccuaguauguuugaacccgagagagaaaaaguagaugcuauugacggagaauauaggcuucgaggugaggcgcguaagacuuucguagauuugaugcgaagaggggacuuaccuguaugguuagcauacaaagucgcagcggaagguauaaauuaugcagaccgcagauggugcuuugaugguaucaaaaauaaucaaauauuagaggaaaauguugaaguagaaauauggacuaaagaaggagaacggaagaaacuuaaacccagaugguuagaugcaagaauauacucagauccccuagcauuaaaagaauuuaaagaauuugccgcuggucggaaaagccugaccuuaaauuugauuacugaaaugggccgccucccaacauucaugacucagaaaacgcgggacgcacuagauaauuuagcuguguuacauacugccgaagcaggaggcagagcguauaaucacgcacucagugagcuacccgaaacgcuggaaacacuucuacuacuuacauuacuagcuacgguaaccggcggaauauuccuauuucuuaugagcggacgaggaauagguaagaugacacugggcauguguuguauuaucacagcgaguauacuccuaugguacgcucaaauucaaccucacuggauugccgcuucgauaaucuuggaguucuuccuuaucguacuccucauaccagagcccgaaaaacaacgaacgccacaagauaaucaacuaacguauguaguaauugcaauacuuacuguaguggcugcgacgauggcuaacgaaaugggauuccuggagaaaaccaagaaagaccuaggguuaggaucaaucgcaacgcaacaaccugaauccaauauuuuagauauagauuuacguccugcuucugcuuggaccuuguaugccgucgcgacuacguucguaacaccaauguugcgccauaguauugaaaauaguucaguaaacguuucacucacagcgauagcaaaccaagccacuguguuaaugggacuaggaaagggauggccccucucaaaaauggacauuggaguaccgcucuuagcaauuggauguuacucccaaguaaacccgaucacccucacugcagcacugcugcucuuggucgcacauuaugcuauaauaggaccaggacuccaagcaaaggccacgcgggaagcucagaaacgugcugcggcuggaauaaugaagaacccgaccgucgacggaaucaccguaaucgauuuagauccaauaccauacgauccuaaauuugaaaagcaauuaggucaagucaugcuccugauccuauguguuacacaaguauuaaugaugcgaacuacuugggcacuuugugaagcauuaacacuagcuacgggcccuauaucuacauuaugggaaggaaacccuggacgauucuggaacacaacaauugcgguuucaauggcaaacauuuucagaggaaguuauuuagcaggagcuggacuacuauuuuccauuaugaaaaacacuacaaacaccagacgggguacaggaaacaucggagagaccuugggagagaaauggaagaguagauuaaacgcauuaggaaagucugaguuccaaacuuauaagaaaucggggauccaagaagucgauagaacauuagcaaaagagggaauuaagagaggugaaacagaccaccaugcuguaagccgcggcucagcaaaauuacgaugguucguagaacgcaauaugguaaccccagagggaaagguuguggaucucgguuguggccgugggggaugguccuauuacugcgggggacucaaaaauguccgugaaguaaaaggucuaacgaaaggaggaccugggcaugaagaaccaauucccaugagcacuuauggauggaaucuaguacgauugcagucagggguugacguauucuuuauaccgccugaaaaaugugauacacuguugugugacaucggggaaagcaguccaaauccuacgguagaagccggaagaacauugaggguacugaaucugguggaaaauugguuaaauaauaauacacaguuuuguauaaaaguacucaacccauauaugccgagcguuauagagaaaauggaagcauuacaaagaaaauaugguggagcacugguuagaaauccucugaguagaaauuccacacaugaaauguauuggguaucaaaugcuagcgggaacauuguaucaagcgugaauaugauaucaagaaugcuaauuaauagguucacgaugagacacaagaaagcgacguaugagccagacguagaccuuggaucaggaacccgcaacauagguauagagagcgagauaccaaaccuagacauuaucgguaaaaggauagagaaaauaaagcaggaacacgaaaccucguggcauuaugaccaggaucauccauacaaaacaugggcuuaccacggaaguuacgaaacgaaacaaaccgggucugcaagcucaaugguaaacggagucguaaggcuacuuacuaagccaugggauguuuuaccaacaguaacacaaauggcuaugacagacacaacacccuucggacagcaacguguguuuaaagaaaaaguagauacuagaacacaagaaccaaaagaagguacuaagaagcucaugaaaauaaccgcagaauggcuguggaaagaauuaggcaagaagaaaacaccuagaaugugcacucgagaagaauuuauuagaaagguaagaucaaacgcugcccuaggggcaauuuuuacagaugaaaauaaauggaaaucagcucgugaagcgguagaagacucgcgguucugggaauugguggacaaagaaaggaaucuacauuuagaaggcaaaugcgagacuuguguguauaauaugauggguaaaagagagaagaaacucggagaauuuggcaaagccaaaggaucgagagcgauaugguacaugugguuaggugcucgauuccucgaauuugaggcuuuaggauucuuaaaugaagaucauugguucucacgcgaaaacucacuaucuggugucgaaggugaaggacugcauaaacuuggcuauauucuccgagauguuaguaagaaagaaggaggagcgauguaugccgaugauacugccggaugggacacacgcaucacacucgaagaucugaaaaaugaagagaugguaacaaaucacauggaaggagaacacaagaaacuagccgaagccaucuuuaagcuaacuuaucaaaacaagguugucagaguacagaggccaaccccacgcggaacuguaauggauauaaucagcaggagagaucaacguggcucuggccaagucggaacauacggucuaaauacauuuaccaauauggaggcacaguugauaagacagauggagggagaaggugucuuuaagaacauacaacauuugaccgccacagaagagguagcggucaaaaacugguuggccagagucggaagagaaagauuaaguaggauggcaauuagcggugacgacuguguugugaagccucuagaugaccgcuuugcuaaugccuuaacugccuuaaaugauaugggaaaaaucagaaaagauauacagcaaugggagccaucaaaggguuggaaugacuggacacaaguuccauucuguucucaccauuuucacgaauuaauuaugaaggauggaagaguguuaguaguaccaugccgaaaucaagacgaauuaaucgggagggcaaggauuucgcaaggcgcaggcuggucucuaagagaaacagcgugcuuggggaaaucuuaugcacaaauguggucucuaauguacuuucaucguagagaccugcgauuggcugcaaacgcuauauguucagccgucccaucacacuggguucccacaagucguacaaccuggaguauacacgccaagcaugaauggaugacgacagaggacaugcucacaguauggaauagaguauggauacgagagaacccauggauggaagauaaaaccccagucgagucuugggaagaaauucccuaucuaggcaaacgagaggaucaauggugcggcucguugauuggcuuaaccagcagagcuacaugggccaaaaauauccaagcugcuauuaaccaaguucgaucacucauagguaaugaagaauauacggauuacaugccaaguaugaaacgguuccgccgagaagaagaagaagcaggggucuuaugguaa

SEQ ID NO: 22350 - RNA, 9876 nt, Artificial Sequence
  derived and/or modified CDS sequence (opt6) from DENV-2__JF730048__SS-prME
ucagcggguaugauuauaaugcuaauuccuacggugauggcauuccaccuaacaacccggaauggugaaccucacaugauaguugguauacaagaaaaaggaaaaucauuacuuuucaaaaccgaagauggagugaauauguguacacuaauggcaauggauuuaggagaauuaugcgaagauacaauaacuuacaaaugccccuuacuacgacaaaaugaaccagaagauaucgauugcuggugcaauucaacaaguaccuggguuacguaugggacauguacuaccacuggagaacacagacgugagaaaagaaguguggcuuuagucccucaugugggcaugggguuggaaacccggacugaaacuuggaugucguccgaaggcgcauggaaacaugcucagcguauugaaacuuggauucuucgacacccggguuucacuaucauggcugcaauucuagcauauaccauaggaacgacccacuuucagagagcauugauauuuauucuacuaacagcuguggcaccuucaaugacuaugagauguauaggaauuucaaaucgagacuuuguggaaggugugucuggaggcucauggguagacauaguauuagaacaugggucuugugucacuacaauggccaaaaauaaaccaacauuagacuucgaguuaauuaaaacugaggcaaaacaaccagcaaccuuaagaaaauacuguauugaggcuaaacuaacuaacaccacaacugagucuagauguccaacacaaggagaaccaagucugaaagaagaacaggacaaaagauucguauguaaacacucgaugguggaccgaggauggggcaaugggugcggccuauuugguaaaggaggcauagucacaugugcaauguuuacauguaagaagaauauggaagggaaaauaguucagccagaaaaccuagaguauacuaucgucgucacaccccauagcggagaagaacacgccguaggaaacgauacgggcaaacauggaaaagagaucaaaguuacuccucaaucgagcauaacagaagccgaauuaacuggauaugggaccgucaccauggaauguuccccaagaacggggcuggacuuuaaugaaaugguacuucuucaaauggaauccaaagccuggcuaguucaucgccaaugguucuuagaucuuccauuaccaugguuacccggagccgauaaacaaggauccaauuggauacaaaaagaaacacuuguaacuuuuaaaaacccccaugcuaagaaacaggaugugguagucuuaggaagccaagagggggcaaugcacacggccuugacuggagcgacagaaauccaaaugagcagcgguaacuuauuguuuaccggucauuuaaaaugccggcuccgaauggauaaauuacaacugaaaggcaugagcuauaguauguguacugguaaauucaaaguugugaaagaaauagccgagacucagcauggaacuauaguaauccggguccaauaugaaggugauggaucacccugcaaaaucccuuuugaaauaauggaucucgagaaacguuauguccuaggacgucugauuacugugaauccuauaguuacugagaaagauagcccuguuaauauugaagccgaaccacccuucggagacucauacaucauuaucgggguagaacccgggcaacuaaaacuaaauugguucaagaaagggucaaguauaggacagauguuugaaacaaccaugcguggagcgaaaaggauggcaaucuuaggcgauacagcuugggauuuugggucacuagggggaguauucacaucgauuggaaaagcauuacaccaaguauuuggggccaucuauggugcggcauuuuccgggguaaguuggacuaugaaaauccuaauaggcgucauaauuacuuggauaggaaugaacuccagaaguacaagucuaagugucucauuaguacugguaggaauagucacauuauacuuaggugugaugguccaggccgacaguggcuguguaguaucauggaagaacaaagaacuuaaaugcgguagcggaauauucauaaccgacaaugugcauacuuggacugagcaauauaaguuccaaccggaaucccccucaaaauuggcuagugcaauccaaaaagcucaagaagaagggauuuguggaauuagaucaguaacaagacuagaaaauuugauguggaaacaaauaacaccagaacuaaaccauauuuuagcagaaaaugaaguuaaacuaacaauuaugacaggugacauaaaaggcauaaugcaggcuggaaaaagaagccuccgaccgcaaccuacagaauuaaaauauucguggaaaacauggggaaaagcuaagaugcuuucaaccgagucacacaaucaaacauuucuaauagacgggccugaaaccgcggaaugccccaauacuaacagagccuggaauagcuuagaagucgaagauuacggguuuggcgucuuuaccacaaacauuuggcuuaaguuaaaagagaaacaagacgcauucugugacucgaaauugaugucagccgcgauaaaggacaacagggcgguccacgcagacaugggauacuggaucgaaucggcccuuaacgauacauggaaaauagaaaaagcgagcuuuaucgaaguuaaaaauugccacuggcccaaaagccacacacuauggagcaacgggguccucgaaagcgaaaugauaaucccuaagaacuuggcagggccugucucgcaacauaacuauagaccuggauaccauacgcaaacagcgggcccuuggcauuuaggcaagcuagaaauggacuucgauuuuugcgauggaacaacagucauaguaacagaagacugugguaaucgcggcccaucuuuacguacaacgacagcaagugguaaauugauaacugaaugguguuguagaaguuguacacuuccuccauugcgauaccguggagaagacgggugcugguacggcauggaaauacgacccuugaaggaaaaggaagaaaaucuaguaaauucauuaguuacugccgggcacggucaaguagacaacuuuucgcugggcguauuaggaauggcauuauuccucgaagaaaugcuuagaacucgcguugguacaaaacaugcaauucucuugguagcaguuucauucguuacccuuauuacuggcaacaugucuuucaaggauuuaggacguguggucguuaugguaggaaccacuaugaccgaugauauugguaugggagucacuuacuuagcauuauuagcugcauucaaaguuagaccaaccuuugcagcggguuuauugcuucguaaacuuacauccaaggaacuuaugaugacuaccauugggauugucuuauugucgcaaucaacaaucccagaaacaauauuggaauuaacggacgcuuuagcacucggaaugaugguguuaaaaaucguaagagacauggagaaguaucaacuagcgguuacuauaauggcuauauuaugcguucccaaugcagugauuuuacagaacgcauggaaaguaaguuguaccaucuuagcagugguuagcgucaguccuuuguuacuuaccucuagucaacagaaaacugauuggauaccgcuagcuuugacuaucaagggacuuaauccaacggcaauauuccuaacaacccuaagcagaacaaauaagaaaagaucauggccacuuaacgaagcuauuauggcgguaggaaugguuucaauccuggcauccagccuacucaaaaacgacauaccaaugacugggccccucguugcaggaggacuccuaacaguuuguuacguacucacaggaaggucagcugauuuagaacuugagagagcuacagaugugaagugggaagaccaagcagaaauaucuggaucgucuccgauucugucgauaacuauaagugaagaugguuccaugucgaucaaaaaugaagaagaagaacaaaccuuaaccauccuaauacguacaggccuccuuguaauaaguggacuuuucccugugucgauucccauaacagcugccgcgugguaccuaugggaagucaagaaacaacgugcaggagucuuaugggauguuccgagcccaccgcccaugggaaaagcugaacuggaggacggcgcuuauaggauaaaacagaaggguauuuuaggcuacucacaaaucggugcugguguauacaaagagggaaccuuccauacuauguggcaugucacaaggggagcaguccuaaugcauaaagggaagcgaauagaaccuucaugggcugauguuaagaaagacuugauaucauaugggggcggcuggaaacuagaaggagaguggaaggaaggcgaggaagugcaaguacuugcguuggagccgggcaaaaauccuagagcaguacagacaaaaccaggacuuuucaagacuaacacuggaacuauaggggcgguuucauuagacuucucuccagguacaucaggaucaccaauaaucgacaagaaagggaaagucguuggacuauacgguaauggagugguaacucgauccggugcauauguauccgcaauagcucaaacagaaaaauccauugaggauaacccagagaucgaagaugauauauuccgaaagaggagacuaacaauaauggaccuucauccaggggccggaaaaaccaaaagauacuuacccgcaauugucagggaagcaauaaaacguggucuacgaacucugauacuagcgccuacuagaguugucgcggcagaaauggaagaggcuuuaagaggacuucccauaagguaccaaacgccugcaauccgugcggaacauacaggaagagaaauuguagaucuaaugugccaugcaacauuuacuaugcgccuauugaguccuguacgaguuccgaauuauaaucuaauaaucauggaugaagcacauuuuacagauccggcaucaauagcugccaggggguauauuaguacacgaguagaaaugggugaagcugcaggcauuuucaugacugcuacacccccuggauccagagauuccuucccgcaaucuaaugcuccaaucauagaugaagaacgagaaauaccagaacggaguuggaauacggggcaugaauggguaacggacuuuaaaggaaagaccguuugguucguaccaagcaucaaggccgguaacgauaucgcugcauguuuaaggaaaaauggcaagaaaguuauacaguuaagcagaaagacauucgacucagaguaugucaaaacgagaaccaaugauugggauuucguaguaacgacagacauaagugaaaugggugcuaauuuuaaagcagaacggguaauagacccaaggagaugcaugaaacccguaauauuaacagacggugaagaaaggguaauccuagcuggcccgaugccaguaacacauagcuccgccgcacagaggagaggacgcauaggccgcaaucccaaaaacgaaaacgaucaauauauauacaugggcgagccacuggaaaaugaugaagauugugcucauuggaaagaagcaaaaaugcuacuagacaauaucaacacccccgagggcaucauaccgucaauguuugaacccgaaagagaaaaaguggacgcaauagauggagaguaccgcuuaagaggcgaggcgcgaaaaacauuuguugauuuaaugagacgaggagauuugcccguuugguuggcuuauaaaguugcugcugaaggaauuaauuaugcugaucggaggugguguuuugauggaauuaaaaauaaucaaauauuagaagaaaauguggaaguugaaauauggacuaaagaaggagaaaggaaaaaguuaaagccaaggugguuggaugcaaggauauacuccgacccauuagcccucaaagaauuuaaggaguucgccgcggggcgaaaaagucugacccuaaaucuaaucacagaaaugggcagauuacccacguuuaugacacagaaaacuagagaugcuuuagauaaccuugcagucuuacauacagcagaagcgggugggagggcguauaaccacgcucugucagaauuaccagaaacucuagaaacauuauuauuacuuacacucuuggccacugugacagggggaauauuuuuauuuuuaaugucuggacgaggcauaggcaagaugacguuaggaauguguugcauaauaaccgccucaauucugcuaugguaugcucaaauacaaccucauuggauugcagcgucaauaauucuagaguucuuucuaauaguucuguuaauaccugaaccugaaaaacaaaggacuccacaagacaaccaacuaacauauguagucauagcuaucuugacagucguagcugccacaauggcuaaugagaugggauuucuagaaaagacuaagaaagaccugggucuaggaucgauugcuacacaacaaccugaaagcaacauucuggauaucgauuugagaccagcuucagcuuggacuuuauacgcagucgcgacaacauucguuacaccgaugcuaagacauucaauagaaaacagcucggucaacgucucucuuacagccauagccaaucaagcaacuguacugaugggcuuagggaaaggauggccacuuuccaaaauggacauuggagugccacuguuagcaauaggguguuauagucaaguaaauccgauaaccuuaacagcagcauuacuauuguuagucgcccauuacgcuauuauaggucccggauugcaagcaaaggcuacuagggaagcucaaaaacgagcugccgcagguauaaugaagaacccgacugucgacggaauaacuguaauugauuuagaucccauucccuacgaccccaaguucgaaaaacaacuuggucaaguuaugcuguuaauauuaugcguaacucaaguucuuaugaugcgaacuacaugggcucuaugugaagcguuaacucuggcaacaggccccauaucgacgcuuugggagggaaauccaggaagauuuuggaauacgacaauugcagucucaauggcaaacauuuuucgagguaguuaccucgccggugcgggacuucucuuuaguauuaugaagaauacgacuaauacacguaggggcacuggcaacauaggagaaacgcuaggugaaaaauggaaaucaagauuaaacgcauuggggaaaucggaguuccaaacuuauaagaaaaguggaauacaagaagucgaucgaacguuagcaaaagaaggcaucaaacguggcgaaacagaucaccaugcuguaucuagagguucagccaaacugcguugguucguggaaaggaauauggucacaccagaagggaaaguagucgaucuaggauguggaagaggaggguggaguuauuauugcggaggucucaaaaaugugagagaggucaaagguuugacgaaagguggaccaggacacgaggagcccauccccaugucaacauauggguggaaccuagucagauuacaaucuggaguagaugucuucuuuauaccaccagaaaaaugcgacacccucuugugugacauaggagaaagcucaccaaauccgacaguagaggcuggacguacguugaggguacuuaacuuaguagaaaauugguugaacaacaacacgcaauuuuguauaaaaguacugaaccccuacaugccuucaguuauugaaaagauggaagcgcuucaacgaaaguaugguggagcauuagugagaaacccucugucuaggaacucuacucacgaaauguauuggguaucaaaugcgagcggcaauauaguaucaaguguaaauaugauuuccagaaugcuuauaaaucguuucacaaugcgucauaaaaaggcgacauaugagccggacguagaccuuggaucuggaacgagaaauauagguaucgaaagugagauaccaaacuuggacauuaucgguaaacgaaucgagaagauaaaacaggaacacgaaacgucguggcauuaugaucaagaucauccauauaaaaccugggcuuaccacggcaguuaugagacaaaacaaacggggagcgccagcaguaugguuaaugggguugugagauuacuuacgaaaccgugggacguauuacccaccgucacacaaauggcgaugacagacacgacaccguuugggcaacaaagaguuuuuaaagaaaaagucgauacccgaacgcaagaacccaaggaaggcaccaagaaacuaaugaaaauuacggccgaauggcuauggaaggaauuagguaaaaagaaaacuccgagaaugugcacacgagaagaguucacgagaaaagucaggaguaaugcugcauuaggagcaauauucacagacgaaaauaaguggaaaagugcacgugaagcaguugaagauagucgguuuugggagcugguagacaaggaaagaaaucuacaucuagaagguaaaugugaaacuugcguguauaacaugauggguaaacgagagaagaaauuaggagaguucggaaaagcaaagggaagccgggcuauaugguauaugugguugggggccagauuuuuggaauuugaagcauuaggguuuuuaaacgaagaucauugguuuagucgugaaaauucacugagugggguagaaggagaagggcuccacaaauuaggauacauucuacgagauguuaguaagaaagaaggaggugcgauguacgcagaugauacagccggcugggauacucguaucacucucgaagacuuaaagaaugaggaaaugguuacaaaucauauggaaggugagcauaagaagcuagccgaggcaaucuucaaacugacuuaucaaaacaagguugucaggguacagaggccuacaccucgugguacgguuauggacauaauuagucggagggaccaaagggggaguggacaaguugguacauacggacuuaacacauuuacgaacauggaagcgcaacuaauaaggcaaauggaaggugaagggguauuuaaaaauauacaacaucucacugcaacugaagagguugcagugaagaauuggcuugccaggguaggccgugaaagguuaucaagaauggcaauuagcggcgacgauugugugguaaagccauuagacgaucgauuugcuaacgcauuaacagcgcucaaugacaugggcaaaauaagaaaagauauacaacagugggaacccucaaaggguuggaaugauuggacacaagucccauuuuguagccaucauuuccaugaacuuauaaugaaagaugguaggguguuaguaguuccgugccguaaucaagacgaauuaauaggaagggcacgaauaucacaaggagcaggguggucauuacgugaaacugcaugcuuaggaaaaagcuaugcucaaauguggucauuaauguauuuucaucguagggacuuacguuuagcagcuaacgcgauauguucugcgguaccgagucauuggguaccgacaaguagaaccacuuggaguauacacgcaaaacaugaauggaugacgacagaagacaugcuaaccguauggaauaggguauggaucagggagaacccauggauggaagacaagacacccgucgaaucaugggaagaaauaccuuacuuaggcaaacgugaagaucaauggugcgguucauuaauaggauuaacuagcagagcgaccugggcuaagaauauacaagcugcuauaaaucaaguaagaucgcuaaucggaaaugaagaauacacagauuacaugccaucaaugaaaagauuccggagggaagaagaagaagcagggguacucugguaa

SEQ ID NO: 22351 - RNA, 9876 nt, Artificial Sequence
  derived and/or modified CDS sequence (opt6) from DENV-2__KF955402__SS-prME
agugcuggaaugauaaucaugcuuauuccaaccguuauggcauuccaucuuacuacgaggaacggugagccccacaugauuguaggcauccaagaaaaagguaaaucacuacuauucaaaaccgaagaugggguaaauaugugcacauugauggcuauggaucuuggcgaauugugugaagauaccauuacauauaaauguccauuacuccgacagaaugaaccugaagacauugauugcuggugcaacagcacaucaacuuggguaacauauggaacuuguacuacuacaggugaacaccggagagagaaaagaaguguggcauuggugccacacguaggaaugggccuugaaacucgaacggaaacuuggauguccucggaaggugcguggaagcaugcacaaaggaucgagacauggauucucaggcauccaggcuucacaauaauggccgcaauauuagccuauacaauaggaacaacucauuuccagagagucuuaauuuucaucuugcuuacagcaguagcaccuucaaugacaaugcgauguaucgguauuuccaaccguguuuuuguugaagguguuagcgguggaucauggguugauaucguacuggaacacggauccugcguaacaaccauggcgaaaaacaaaccaacauuggauuucgaauugauaaaaacugaagcgaaacaaccagcaacacuaaggaaauauuguaucgaagcaaaacuaacuaacacuacuacagagucuagauguccgacccaaggcgaacccucacuuaaagaagaacaagauaaaagguucguauguaaacacucgaugguagaucgaggauggggaaaugguuguggacuauuuggaaaggggggcauagucaccugugcuauguuuacauguaaaaaaaauauggaagguaaaauaguccaaccggaaaaucuugaauauacaauuguggucaccccacauucuggagaggaacaugcaguaggcaaugauacaggaaaacacggaauggaaauaaagguuaccccacagaguaguauuacugaagccgaauuaacugguuauggcacaguuacgauggaauguucaccaaggacugguuuagauuucaaugaaaugguauugcuccagauggaaaauaaagcuugguugguacauaggcaaugguuucuugaccuuccauugccaugguuaccgggagccgacaaacaagaaucuaacuggauucaaaaagagaccuugguaacuuucaaaaauccacaugccaagaaacaggacguggucgucuuaggaagccaagagggugcuaugcauacggcauugacaggagcuacggaaauacaaaugucaaguggaaaucuacuguuuacuggacaucuuaaauguagguugaggauggacaaacuccaacucaaagguaugucuuauucuaugugcacagguaaauucaaaguuguuaaggaaauagcggaaacacagcacggaacuaucguaauaagaguacaauacgaaggugacgguaguccguguaaaauucccuucgaaauuauggacuuagagaaacgguaugucuugggacguuugauaaccgucaaucccauuguaacagagaaagauucaccuguaaauauagaagcggagccaccuuuuggugauucauauauaaucaucggcguugaaccaggacaacugaaacuuaacugguucaaaaaaggaaguucaauaggucaaauguuugaaacuaccaugagaggugcaaaacguauggcuauucuaggggauacagccugggauuuugggucguuaggaggaguauuuacaaguauaggaaaggcacugcaucaaguguuuggcgcaauuuauggcguagcauuuaguggaguuagcuggaccaugaaaauuuuaaucggcgugauaauaacauggaucgggaugaauucucguucuacaucacuaucgguaagccuuguacuuguuggaaucgugacacuuuacuugggaguuaugguacaggcagauaguggguguguuguaaguuggaaaaacaaagaacucaaguguggaagugggauauuuauaacugauaauguccacaccuggacugagcaauauaaauuccaaccagaaucuccgagcaaguuagcgagcgcaauucaaaaagcccaagaagaagguaucugcggaauuagaagcguuacaaggcuggaaaaccugauguggaaacagauaacaccggaguuaaaccauaucuuggcggaaaacgaaguaaaacuaacuauuaugaccggagauauuaagggaauaaugcaggcaggaaaaagaucuuugaggccacagcccacugaauuaaaauacucguggaagacauggggaaaagcgaaaaugcugucuacagaaagcuauaaccaaacauuucuuaucgaugguccagaaacugcagaguguccaaacacaaaccgggcauggaauagccuggaagucgaagauuacggauuugggguguucacgacaaauauaugguuaaaguuaaaggaaaaacaggacgcauucugcgacucgaagcuuaugucagcggccauaaaggauaauagagcuguacaugcugauaugggauacuggauagaaagugcguuaaacgauacguggaaaaucgaaaaggcaucauucauagaaguuaaaaacugucauuggccgaagucccauacauuguggaguaaugguguacuugagucggaaaugauaauucccaaaaaucuagcaggaccuguuucacagcacaauuacagaccgggauaucauacccaaauagcaggaccuuggcaucuagguaaacuugaaauggauuuugauuuuugugauggcacuaccguuauaguaacggaagacuguggaaauagaggaccgucucuuagaacuaccacugcuucggguaaauuaaucacagaauggugcugcagauccuguacguugccaccucuacguuacagaggcgaagauggcuguugguauggaauggaaauucggccgcuaaaggaaaaggaagaaaaucuagucaacucuuuggugacagcuggacacggacagguagacaauuuuucgcucgguguguuaggaauggcguuauuucuggaagagaugcuaagaacaagagucgguacuaaacaugccauuuuacuaguagcaguaaguuuuguuacuuuaauaacuggaaauauguccuuuaaggacuuagggcgaguagugguuaugguaggagcuacuauggcugaugacauaggcaugggagucacauaucuugcauuauuggcagcauucaaggugagaccaacauuugcggccggccuuuuauuaagaaaacuaacaaguaaggaacuaaugaugacgacgauugguaucguguuacuaagucagucgaccauucccgaaacaguucuggaauuaacugacgcacuagcauuaggaaugaugguacuuaaaauuguuagaaauauggagaaauaucagcuagcggugacgauaauggcuauccuauguguacccaacgcggugauauugcaaaaugcuuggaaaguuaguugcacaauacuagcuguugucuccguaucgcccuuauuauuaacauccucucagcaaaaaacugauuggauaccauuagcccuaacuauaaaaggacugaacccaacugcuauuuuccuaaccacacuaucccguacgaacaagaaaagaucauggccucuaaacgaagcuauaauggcugucggcauggugucuauacuugcaucuucucuacuuaaaaacgacauaccaaugacggggcccuuagucgccgggggacuuuuaacuguuuguuacguauuaaccggaaggucagcggauuuagaacuagaaagagcaacagaugugaagugggaggaucaagcugaaauuucagggucgaguccuauucugaguauuacaauaagugaagauggauccaugucuauaaaaaacgaagaagaagaacagacgcuuacaauauuaauaagaacaggacuacuagucauaucuggacuuuuccccauaucaauuccaauaacggcagccgcaugguauuuaugggaaguuaagaaacaacgagcaggaguacuaugggaugucccuucucccccccccaugggaaaggcugagcuugaagacggcgcauauaggauuaaacaaaaaggcauucuaggguacagccaaaucggcgcgggaguauauaaagaaggaaccuuucauaccauguggcacgugacuagaggugcgguuuuaaugcauaaaggaaaacgaauagaaccaaguugggcagacgugaaaaaagauuuaauaucauauggagguggauggaaguuagaaggagaauggaaagagggugaggaaguacagguccucgcgcuggaaccgggaaagaauccaagagcuguacagacaaagccgggguuauuuaaaacuaauacuggcacuaucggcgcgguaagucucgacuucaguccggguacaucuggaagcccgauaauugauaaaaaaggaaaaguugucggacuauaugggaacggcguaguaacgagaucgggggcuuauguaucagcuauagcacaaacggagaaaagcauagaagauaacccagaaauagaagaugacauauuuagaaaacggcgccuaacuauaauggauuuacaccccggggcuggcaaaacuaagagauacuuaccagcaaucguaagggaagcaauaaaaaggggacuuagaacauuaauucuugcgccgacaagagugguugcugcagagauggaagaggcauuacggggauuaccaauuagguaccaaacaccggcgaucagagcagaacacacgggaagagagauuguagaucugaugugucacgcaacauucacaaugcgcuuauugaguccagugcguguaccaaacuacaaucugauuauaauggaugaagcgcacuucacugauccggcaucaauugcugcccgcggauauauauccacgaggguugagaugggcgaagcagccgguauuuuuaugacugcuacacccccaggguccagggauccguucccacaaucaaacgcuccgauuauugaugaggaaagagagauuccggaacgaaguuggaauuccggacaugagugggucacagacuuuaaaggcaaaacaguaugguuuguaccaucaauaaaagcaggcaaugacauugccgcauguuuaagaaagaacgggaagaagguuauucaauuaucgcgaaagacuuuugauuccgaauacgucaagacaagaacuaaugacugggacuuugucguaacaacagacauaagcgaaaugggagcaaacuuuaaagcugaaagggugauagauccaaggagauguaugaaaccagugauauugacagacggggaagaacggguuauccuagcaggcccaaugccaguaacgcauuccucugcggcgcaaagaagaggcagaauagguagaaacccaaaaaacgagaaugaccaauacauauauaugggcgaaccauuagagaaugacgaagacugcgcacauuggaaagaagcuaaaaugcuuuuagauaauauuaauacaccagaggggauuauuccuagcauguuugaaccagagcgcgaaaagguagaugccauugauggugaguauagguugagaggagaggcaaggaaaacguucguagaccugaugagaagaggagauuuaccugucuggcucgcguauaagguugcggcagaagggaucaauuacgccgauagacguuggugcuucgacgguauaaaaaauaaucaaauacuggaagagaauguugaaguagaaauauggaccaaagaaggugaaaggaagaaacuaaaacccagaugguuggacgcaagaauauauucggacccacuagcacucaaagaguuuaaggaauuugcugcggggagaaaaagcuuaacauugaaucucauaaccgaaauggggaggcuuccaacauuuaugacacaaaagaccagggacgcguuagacaaucuggcaguauuacacacagcagaggcaggugggagagcuuauaaccaugcucuaagugaacugccagagacgcuggagacccuucuacuauuaacacuucuugcaacugugacaggaggcaucuuucuauuccuaaugucaggcagagggauaggaaaaaugacguuagggaugugcuguauaauaacugcuucgauacuauuaugguacgcucaaauacaaccccauuggaucgcugcaucaauaauucuagaauuuuuuuuaauaguccuuuuaauucccgaacccgaaaagcaacgaacaccucaagauaaucaauuaacauaugugguaauugcuaucuugacaguaguagccgcaacuauggcgaacgaaauggguuuuuuagaaaaaacuaaaaaagaccuagggcuaggaucaauagcuacacaacagccggaauccaacaucuuagauauagauuuacgcccagcauccgcauggacucucuaugcagucgcuacaacauuuguaacuccgaugcuaaggcauucaauagaaaauuccaguguaaacguuagcuuaacggcaauagcaaaccaggcuaccgucuuaaugggcuuaggaaaaggauggccguuaagcaaaauggacauagggguuccucuacuagccauagggugcuauagucaaguaaacccaauaacacucaccgcugccuuauuauuguugguagcccacuaugcuauaauaggaccuggacuucaagcaaaagcaacuagagaagcacagaaaagagccgccgcuggcauuaugaaaaacccaacaguagacggcauaacagugauugaccuggaucccauaccauaugacccaaaauucgaaaaacaacuagggcaagugaugcucuugauacuuuguguaacacaaguucucaugaugaggacuacaugggcgcuuugcgaagcucugacuuuagcaaccggaccaauaaguacacuuugggaagguaauccgggacgauucuggaauacaacgauugcgguuucuauggcaaauauuuuucgagguucauauuuagcuggagccggauuacuguuuucaaucaugaaaaauacaaccaauaccaggagggguacagguaauauaggagaaacuuugggugaaaaguggaaaucacguuuaaacgcccucggaaaaucagaauuucaaauauauaaaaaaaguggaauacaagagguagaccgcacauuagccaaggaagguauuaaaagaggagaaacugaucaucacgccguaucaagaggcagugcuaaacugagaugguuuguggagcguaacaugguaacaccagaagggaaagugguagaccuaggaugcggucgagguggauggucauacuacugugggggcuugaagaacgucagggaaguaaaaggauuaacaaaaggcggaccggggcacgaagaaccaauaccgaugaguaccuaugguuggaaucuaguucggcuacagucaggaguugacguauuuuuuauaccgccagagaaaugcgauacacuuuuaugugauauaggugaaagcagcccaaauccuacugucgaagcaggcagaacgcuacgugugcuuaaccuagucgaaaacuggcuuaacaauaauacucaguucugcauaaaaguacucaacccuuauaugccaucaguaauagaaaagauggaggcucuucaacgaaaauaugggggugcucuaguacggaauccacuaagucgaaauucaacacaugaaauguacugggucaguaacgcaaguggaaauauugucucaagugucaauaugauaagccggauguugauaaaccgguuuacaaugagacauaagaaagcuaccuaugaacccgauguagaucuuggaucugggacccgaaacauagguaucgaaagcgagacaccaaaucuugacauaauagguaagcgaauugaaaaaauaaaagaagagcacgaaacaucauggcacuacgaccaggaccauccauauaagacgugggccuaccaugggucauacgagacuaaacaaacaggaucugcaucaaguauggucaauggcguaguucgacuacuuacaaaaccaugggauguacuccccacggucacacaaauggcaaugacggacacuacuccauucggucagcaaagaguauuuaaggaaaaaguagauaccagaacucaagaacccaaagagggaacaaaaaaacuaaugaaaauaaccgcugaaugguuauggaaagaacuugggaagaaaaaaacgccucggauguguacaagagaagaguucaccaggaagguuagaaguaaugcggcucuaggugccauauucacugacgagaacaaauggaaaucagcaagagaagcagucgaagacagcagauucugggaauugguugauaaagaacgcaauuuacaucucgaaggaaaaugugaaacaugcguguauaauaugaugggaaaacgagaaaagaaacuaggggaauucgguaaggcuaaagggagucgcgcuauuugguacauguggcucggggcuagauuucuagaauucgaagcucuuggauuucuaaaugaggaucauugguuuucacgagaaaauaguuugucuggaguagaaggugaggguuuacacaaauugggauauauacuacgcgaugugucaaaaaaagaaggaggggcaauguaugcagacgauacagcuggaugggauacacggaucacguuagaagauuuaaaaaacgaagaaaugguaacuaaccacauggaaggagagcauaaaaaauuagcagaagcaauauuuaaauuaacauaucaaaauaaagucguaaggguacaacgaccgacaccacgagguacuguuauggauauaauaagucgaagggaccagcggggcagcggucagguaggaacauauggcuuaaacacauucacaaauauggaggcgcaacuaauuagacaaauggaaggugaagggguauucaagaacauucaacacuugacagucaccgaagaggcggcaguacagaauuggcuugcacgcguaggaagagaacgucugagucguauggcaauuaguggugaugacugcguaguuaagccacuagaugaccgcuuugcuaaugccuuaacugcacuaaaugacauggguaagaucagaaaggacauucagcagugggagccuuccaagggauggaaugacuggacucagguaccauucuguucccaucacuuccacgaauugauaaugaaagacggaagggugcuaguggugccaugcagaaaucaagaugaauuaauuggaagagcacguauuagucagggcgcugguuggucucuaagggaaacagcgugccuggguaagaguuaugcccaaauguggucguuaauguacuuucaucgccgagauuuacgcuuggcugcgaacgcgauaugcagugcaguuccuucgcauugggucccuacuaguagaacgacguggagcauacacgcgaaacacgaguggaugacuacugaggauaugcuaacgguguggaaccguguuuggauaagggaaaauccguggauggaagauaaaacaccuguugaaucuugggaagaaauacccuaucuugguaaacgggaagaucaguggugugguagucucauuggccucacuucaagagccaccugggcgaagaauauacaagccgcgaucaaccaagucagaagucuaauaggaaaugaagaauacacagacuauaugccaucaaugaagcgguuuaggagagaggaggaagaagcagguguacucugguga

SEQ ID NO: 22352 - RNA, 9876 nt, Artificial Sequence
  derived and/or modified CDS sequence (opt6) from DENV-2__FJ898460__SS-prME
acugcggguguaauuguaaugcuaaucccuacugcaauagcauuucaucugacgacuagaaauggugaaccucauaugauuguggggagacaggaaaaaggaaaaucauugcuuuuuaaaacggaagacgggguaaauauguguacucugauggcaauugauuugggagaauuaugugaagauacuauaacguauaaauguccacuguuacgacaaaaugaaccugaagauauagauuguuggugcaauaguacuucuaccuggguuaccuacgggacuuguacuaccaccggagaacaucgacgugaaaaacggucugucgcuuuaguuccucacgucggaaugggacuagaaaccagaacagagaccuggauguccagugaaggagcuuggaaacacguacaaagaaucgaaacuuggauucuccggcacccuggauuuacaauaauggcugcaauauuagcuuauacaauugguacgacucauuuucaaagagcucuuauauuuauuuuguugaccgcuguagcacccucaaugacaaugaggugcauaggaauuaguaauagggauuucguagagggaguaagcgguggauccuggguggacauaguccuggaacacggaagcugcguuacgaccauggccaaaaauaaaccgaccuuggauuuugaauuaaucaaaacagaagccaaacagcccgcaacucuaaggaaauacugcauagaagcaaaacugacaaacacaacaacagaaucucgaugcccaacacaaggggaaccgucguuaaacgaagaacaagauaaaagguucauauguaaacauucaauggucgauaggggauggggaaacggauguggauuauuuggaaaaggaggaauagucacaugugcgauguucaccuguaagaaaaacauggaggggaaaguagugcagccagaaaauuuagaguauacaauaguaauaacaccccauucgggugaagaacacgcaguaggaaacgauacugguaaacaugggaaagagaucaaaaucacuccccaaucaaguauaaccgaagccgaauuaacaggcuacgguacugugacgauggagugcagcccgcguacuggccuagauuuuaaugaaaugguauuacuacaaauggaggauaaagcauggcuuguccacaggcaaugguucuuggauuugccucuaccaugguuaccaggggccgauacacagggaucuaauuggauacaaaaagagacucucguaacauuuaaaaauccucaugccaagaaacaagacguggugguuuuaggaagccaagagggggcgaugcauacagcucuaacuggagcuaccgaaauucaaaugucaagcgguaaccuauuauuuacaggucacuuaaaauguagauuaagaauggauaaauuacaguuaaaagguaugagcuacucuauguguacaggaaaauuuaaaaucguuaaggaaauagccgagacacagcacggcacaauagucauacggguccaguaugaaggagaugggagucccuguaaaauuccguucgaaauaacagacuuagaaaaacgccaugugcuggguagguuaauaaccgucaaucccauaguaacagagaaagauucaccgguuaacauagaggccgaaccaccauuuggagacagcuacauaauaaucggaguugaaccaggacaguuaaaacuuaacugguucaagaaagggucaucaaucggucaaauguuugaaacaaccaugcgaggagcaaagagaauggcaauuuuaggagauacggcaugggacuucgguucucuaggaggcguuuucacaaguauagguaaagcauugcaucaaguauuuggggcgauauauggagccgcauuuaauggagucuccuggacuaugaaaaucuuaauaggcgucauuauaacuuggauugguaugaauagccguaguacaaguuuaucagugagucuugucuuaguaggaguugucacacucuaccucggagcuaugguacaggcugacucaggaugcguagucagcuggaaaaacaaagaauugaagugcgggaguggcauuuucauuacugauaauguucauacauggacugaacaauauaaauuccaaccugaaucgccaucaaaacucgcgucggccauucaaaaggcacaugaagagggcauuugcggaauuagaucagugacaagacuagaaaaucucauguggaaacaaaucacgccggaguuaaaucacauauuaagugaaaaugaaguaaagcucaccauaaugacuggugauauaaagggaauaaugcaagcgggcaaacguagucugagaccacagccaacugaacucaaauauucuuggaaaacuuggggaaaggcuaagaugcugagcacagaaucucauaaucagacuuuucuaauugauggaccagaaaccgcugaaugcccgaacacuaauagagcuuggaacagucuagagguagaagacuauggauuuggcguguuuucuacaaauauaugguuaaaauugcgagagaaacaggacguauuuugcgacuccaaacuaaugagugcugcaaucaaagauaauagagcaguccaugcggacaugggauauuggauagaaucagcuuuaaacgauacauggaaaauggagaaagcaucguucauagaggugaaaaguugccacuggccgaagagucacacucuuuggucaaauggaguauuggaaucggaaaugauuauaccgaaguccuucgccggaccuguaagucaacauaacuauagaccaggauaucauacccagacagccggaccauggcauuuagggaaguuggaaauggauuucgacuuuugcgagggaacuacuguagucguaacggaggacugcggaaacagggguccaucacuaagaacaacuaccgcuagugguaaacuaauuacugaaugguguugucguucaugcacacuaccuccccuaagguaucgaggagaagacggcugcugguauggaauggaaaucagaccacugaaagaaaaggaggagaaucuaguaaauagcuuagugacagcagggcauggccagauagacaacuuuucguuagggguauuggguauggcacuauucuuagaagaaauguuaagaacuagagucgguacaaaacaugcgauacuacuuguugcggugucuuuuguaacacuaauuacagguaacaugaguuuuagagaucuugguagagugaugguaaugguaggugcuacaaugacagaugauauaggaauggguguaacauaucuggccuuauuggcugcuuuuaaagugcgucccacauuugcggcagguuuauuacuaagaaaacuuacaucaaaagaauuaaugauggcgaccauagggauagcccuucucucacaaagcacuaugccugaaacuauauuagaauuaacggaugcauuagcgcuggggaugaugguccuuaagauaguaaggaacauggaaaaauaccaauuggcaguaaccauuauggcaauaaguugcgucccgaaugcaguaauauugcagaaugcauggaaaguuaguugcacaaucuuggcagcaguuucaguaagucccuugcuguugacaucaucccaacaaaaggcagauuggauaccucuagcacugacgauaaaaggacuuaacccaacugcaauauucuugacaacauugagucguacaagcaaaaagaggagcuggccacuaaacgaagcaauaauggcuguagguauggugaguauucuagcuucaaguuuacucaagaaugauauuccuaugacugguccucuuguagcuggaggccuguuaacgguauguuacguauuaaccggaagaucggcugaccuagaacuagaaagggcagcugauguaaaaugggaggaccaagcugaaaucagcggaagcuccccuauauugucgauaacaauaagcgaggauggaagcaugaguaucaaaaacgaagaggaagaacagacacuaacaaucuuaauccgaacuggccuauuggucauaagcgggguauuuccuguaucuauuccuauuacagccgccgcaugguaccuaugggaggucaagaaacagcgagcagggguccugugggauguaccguccccgccuccaguuggaaaagcagaauuagaggacggugccuauagaauaaaacaaagaggaauccuggguuacagccaaauuggggcaggaguauauaaagaagguacauuccauaccauguggcacguaacaagaggcgcgguuuugaugcaucgugguaagagaauagaaccuaguugggcggauguuaagaaagauuugaucaguuacgguggcggauggaaguuggaaggagaauggaaagaaggggaagaaguccaaguacucgcauuagagccuggaaagaauccaagggcaguccaaacaaaaccaggaauauuuaaaacaaacacagguacaauaggugccguaucacuugauuuuagccccgguacaaguggaucuccgauuguugaucgcaaggggaaaguagugggauuguacggaaauggaguaguaaccagaaguggagcauacguuuccgcaauagcacagacugaaaaaucuauugaagauaacccugaaauagaggaugacauauucaggaagaaaagauuaacgauaauggacuuacaccccggugcggguaaaacgaaacgcuacuuaccagcgaucguaagagaagcaauaaaaagagguuuaagaacccucauacucgcacccacccggguuguugcggcggaaauggaagaggcuuugcggggacuacccauaagguaucaaaccccagcgauacgagcggagcauacugguagagaaaucguagaccuuaugugccacgcaacguuuacaaugcgacuucuuucaccaguaagagucccaaauuauaaucuaaucauuauggacgaagcacauuuuacagacccagcaagcauagcagcgcgagguuauauaucgacccgaguagaaaugggugaagccgcgggaauauucaugacugcuacuccucccgguucuagagauccauucccucagucaaacgccccuauuauggacgaggagagagagauaccagaacguuccuggaacuccggacaugaauggguuacagauuuuaaagguaaaacugugugguucguaccaucaaucaaggcaggaaaugauauagcagcgugucuuaggaagaacggcaagaaggugauacagcuaagccgaaaaacuuuugauagcgaauaugugaaaacaagagcgaaugauugggauuuugucguaacaacggauauuagugagaugggagcgaacuuuaaagccgaacguguaaucgauccacgaagaugcaugaagccaguaauacucacugauggagaagaaagaguuauacuugcaggcccuaugccuguuacccauucuucagcagcccaacgucgggguagaauugggcgaaacccgaagaacgaaaacgaucaguauaucuauaugggcgaaccacuagaaaaugaugaagauugugcacauuggaaagaggcgaaaaugcuccuagacaauauuaauacaccugaaggaauuaucccaucaauguuugagcccgaacgggaaaaaguagacgcuaucgauggggaguauagacuacggggagaagcaagaaaaacuuuuguugaccucaugcgacguggugauuugccgguuugguuagcauauaaagucgcagccgaaggcauaaauuaugcagauagaaagugguguuuugaugggauuaagaauaaucagauacuagaggaaaauguugaaguagaaauauggacuaaggaaggggaaaggaagaaauuaaaaccuaggugguuagaugcgagaauauauuccgacccacuugcucucaaagaguucaaagaguuugcagcuggacggaaguccuugacauuaaaccuuauuacugaaauggguagauuacccacguucaugacccaaaaggcaagaaacgcccuagauaauuuagcaguucuacacaccgcagaagcagggggcagagcauacaaccaugcacugucagaacuaccggaaacucuagaaacguuguuauuacucacauuauuagcgacugucaccgguggaauauuccucuuucuaaugucugguaaaggaauuggaaaaaugacucuaggaauguguugcauaauaacugcuucaauuuuauuaugguacgcacaaauucaaccucauuggauugccgcaagcauuauacuagaguuuuuccucauaguucuauuaauuccagaaccggaaaaacagcgaacaccccaagacaaucagcucacauauguuguuauagcaauacuaacaguaguagcggcuacgauggccaaugagaugggauuuuuagaaaagacuaagaaggaccuaggguuaggcucuaucacuacacaagaaucagaaucaaacauacuagauauagauuuaaggccugccucugccuggacacuuuaugcaguugcaacuacuuuugucacaccaauguugcgccauucuauagagaacucaucggucaauguaagucugacggcaauugcaaaucaagccacuguauuaaugggccuagggaaaggauggccacuauccaaaauggauaucggaguuccacuacuugcuauaggauguuacagccaagugaauccaauuacacugacugcagcuuuguuacuucuuguggcacauuacgcuauaaucgguccagggcuacaagccaaagcaaccagggaagcucagaaaagagcugccgcgggcauuaugaagaauccgacagucgaugggauaacuguaauugauuuagagccgauacccuacgaucccaaguucgaaaagcaacuagggcaaguaaugcuguuaauacucugcguuacccaaguacuaaugaugcgaacgaccugggcccuuugugaagcgcuaaccuuagccacaggaccaauaucuacacuaugggaaggcaauccagguagauuuuggaacacaacgauagcagucucaauggccaacauauucagaggaagcuaucucgcuggcgcaggacucuuauucucuaucaugaaaaauaccacuaacacgagaagaggaacaggaaacauaggggaaacguuaggagaaaaauggaagucaagacuuaaugcauugggaaagagugaguuucaaauauauaagaaaagcggcauucaagaaguugauaggacacuagcuaaagaaggaaucaaaagaggagagacggaucaucaugcgguaucuagaggauccgcaaaacuaagaugguucguagagagaaauaugguaacaccagaagguaaaguaguagacuuaggauguggaagaggcgguuggucguacuacugcggaggacucaaaaacgugagggaagugaagggccuaaccaagggaggacccggucaugaagaacccguuccaaugaguacguacggauggaaccuagugcggcuccaaucgggcguagaugucuuuuucaccccgccugaaaaaugugauacauuauugugcgauaucggcgaaucgucuccgaacccuacaaucgaggcagguagaacucucagaguccuuaaucuggucgagaauugguuaaauaauaacacucaauucuguauaaaaguacuuaacccguauaugcccaguguaauagagaaaauggagacucuacaacgcaaauauggaggugcccuuguucguaacccccuaucuagaaauucaacacaugaaauguacugggucucaaaugcaacuggaaauauuguuaguucgguuaacaugaucucuagaaugcugauuaauagauuuacaaugaaacacaagaaagcaacauaugagcccgacguggaucuaggauccggaacuaggaacauaggaauagaaucugaaacuccaaaucuagauauaaucggaaaaaggauugagaaaaucaaacaggaacacgagacaucguggcacuaugaccaagaccaucccuauaaaacaugggccuaccauggcagcuaugaaacuaaacaaacggguagugcaucaucgauggugaacggaguaguuagacugcugacuaaaccaugggacgugguaccaaugguaacucaaauggcuaugaccgacacaacuccguucggccaacaacgaguguuuaaagaaaaagucgacacacgaacgcaagaaccaaaagaaggcacuaagaaacugaugaaaauaaccgccgaaugguuguggaaagaauuaggcaagaagaaaacuccuaggauguguacaagagaagaguucacgaagaaaguaagguccaaugcagcucuaggugcuauuuucaccgacgagaacaaauggaaaagugcaagggaagccguggaagacggaagauuuugggaauuagucgaccgagaacgcaauuuacaucuugagggaaagugcgaaacguguguauauaauaugaugggaaaaagagagaagaaacuuggggaguucggaaaagcuaaaggcucacgggcaauaugguauaugugguuaggagcgcguuuccuagaauuugaagcauuaggauucuuaaaugaagaucacugguuuagccgaggaaacagucucucaggaguggagggagagggccuacaucgcuuaggcuacauacuaagagaaguuggcaagaaagaagguggggcgauguaugcagaugacacagcggguugggacacaagaauuacucuagaagacuugaaaaaugaggaaaugguaacuaaucacaugaaaggugagcacaagaagcuagcagaagcaauauucaaacuaacauaucagaauaagguuguacgaguacagagaccaacaccaagaggcaccgugauggacauuauuucaagaagagaucaaaggggaucaggucaaguaggaacauauggauuaaauacuuucacaaauauggaagcccaacucaucagacaaauggaaggagaaggaauuuuuaaaaguauucaacaucuaacagcaacagaagaaauugcaguacaaaauuggcuugcaagaguagggagggaaagauuaagucgaauggcgaucaguggugacgauugugugguaaagccaauagacgacagguucgcaucagcucuuaccgcuuuaaacgacaugggaaaaguacgcaaggacauucaacagugggaaccaucucgaggguggaacgauuggacacaaguccccuuuugcagucaccacuuucaugaguuaguuaugaaagacggaagagugcuugucguaccuuguaggaaucaggacgaguuaauuggacgcgcaagaauaucacaaggagcgggauggaguuugaaggagacggcaugucuugggaaauccuacgcacaaauguggacccugauguacuuucauagacgugaucuacgccuagcagcuaaugcgauuuguuccgcaguaccaagucauuggguaccaaccucaagaacaacguggucaauacacgcuaaacaugaguggaugaccacagaagacauguuagccguguggaacagggucuggauccaggagaauccuuggauggaagauaaaaccccggucgaaaguugggaagaagugccauaucugggcaagagagaagaccaguggugcggcucguuaauugggcuuacuuccagagcaacgugggcaaagaacauucaaacugcgaucaaucagguuagaagccugauagguaaugaagaauauacagauuauaugccaucgaugaaaagguuuagacgagaagaagaagaggcuggaguucugugguga

SEQ ID NO: 22353 - RNA, 9876 nt, Artificial Sequence
  derived and/or modified CDS sequence (opt6) from DENV-2__FJ882602__SS-prME
acagcagggaugauuauuauguuaauaccaacugcaauggcuuuucauuugaccacuagaaauggagaaccucacaugauaguuagucggcaggaaaaagguaaaucacugcuuuucaaaaccgaagacggagucaauauguguacauugauggcaauggauuuaggugaacuuugugaagauacaauaacauauaauuguccgcuuuuacgacaaaaugaaccagaagauauagacuguugguguaacuccaccucuacauggguuaccuacggaacaugcacagcuaccggcgaacaccgccgcgaaaaacgaucuguugcguuaguaccacauguggguauggguuuagaaacgcguacagaaacauggaugaguucagaaggcgcguggaaacaugcccaacgcauagaaacuuggauuuuaaggcauccagguuuuacaauuauggccgcaauacuagcguacacaauuggaacaacauauuuucaaagaguacugauauuuaucuugcugacggcgguugcacccuccaugacuaugagaugcauagggauuaguaaucgcgauuucguagaaggagucuccggugggaguuggguggacauuguucuagaacacgguuccuguguuacaacuauggccaaaaacaaaccaacacuagacuucgaacuaauaaaaacggaagcaaaacagccagcaacauuacgaaaauauugcauagaagcuaaauugacgaacacuacgacugcuucaagauguccaacacagggugaacccucacuaaacgaggagcaagauaaaagauucguuugcaaacacaguaugguagacagaggaugggggaauggcugcgggcuauucggcaaaggaggcaucgugacaugugcaauguucacguguaagaaaaauauggaagguaaaaucguacaaccagaaaaucuggaauacacuaucguaauuacgccccauucaggagaggagaaugcaguagguaaugacacggguaaacauggaaaagagauuaaagugaccccacaaagcaguauuacggaggccgagcuuacaggauaugguacgguaacuauggaauguagcccgcggacagguuuagacuucaacgaaaugguguugcugcaaauggaaaacaaggcuugguuaguucacagacaaugguuucuagaucuuccguugccuuggcuuccaggcgcagauacacaagguaguaauuggauacaaaaagagacauugguaacguuuaaaaauccacacgcaaagaaacaagacguaguaguacuaggaucccaagagggggcuaugcauacugcauuaacaggugcuacagaaauccagaugucaagcgguaaccuacuuuuuaccggccaccugaaaugucgccuaagaauggauaaacuucaacuuaaaggaaugaguuauucgaugugcacgggaaaauuuaaaguuguuaaagagaucgccgaaacccaacauggaacuauagugauaaggguucaauaugagggagauggcaguccauguaaaaucccauucgaaauuauggaucuagagaaacgacauguguuaggaagacuaauaacaguuaaucccauuguuacugagaaggacagcccuguuaauaucgaagcugaaccaccauuuggagacucauauauuaucauuggagucgaaccaggacaauuaaaacuaucaugguucaagaaaggaaguaguauaggccaaauguuugagacaaccaugaggggugccaaacgaauggccauucugggugauacugcuugggacuucgguucauuagguggcgucuuuacaucaauugguaaggcacugcaccaagucuucggagcuaucuacggggcagcauucucaggaguuuccuggacaaugaagauacuaaucggagugguuauuacauggauagggaugaacucaagaucaacaaguuugucaguagcuuuagugcuaguaggagucgucacgcuauaucucggaguuaugguacaagcagacagcggauguguagucucauggaagaauaaagaauuaaagugcgggaguggaauauucauaaccgauaauguucauacauggacagaacaauauaaauuucagccagagagccccaguaagcuagccucagcuauccagaaggcacacgaagaagguauuugcggcauacgcagcguuaccagauuagaaaauuuaauguggaaacaaauuacaccugaauugaaucauauuuuaagcgaaaaugaaguuaagcuaacaauuaugaccggagauauaaaggguauuaugcaagcugguaagagaucgcuaaggccccaaccaaccgaauuaaaauauaguuggaaaacuuggggcaaagcaaaaaugcuaucaacagagccccauaaucagacauuucucauugauggcccugagacagcagaaugcccuaauacaaaucgagccuggaacagcuuggaaguugaagauuacgguuuuggcguauuuacaacaaacauaugguuaaaacugaaagaacgacaggacguauuuugcgacucuaaacuaauguccgcagcgauaaaggauaauagagcuguacaugccgacaugggguacuggauugagagcgcauuaaaugauacauggaagauagaaaaggccucauucauagaaguuaaaagcugccauuggcccaagagccauacguuauggagcaauggcguauuggagagugagaugauaauaccgaaaaacuucgcuggaccaguaucucaacauaacuaucgaccgggauaucacacucaaaccgcaggaccguggcaccuuggaaaguuagaaauggauuuugacuucugcgaagguacuacaguuguaguuacugaagacuguggcaaucgugguccgagucuucgaacuacgacagcgagcggcaaacugauuacagaaugguguugucggaguugcaccuugccaccccuuagauaccguggugaugauggaugcugguauggcauggaaauaagaccccuuaaggaaaaagaagagaaccuaguuaacaguuugguuacagcuggauacggucaaaucgauaacuucucuuuagggguccuggggauggcccuauuuuuagaggaaauguuaagaacgcgaguggggaccaaacaugcaguccuguuaguugcgguaaguuucaugacucuuauuacaggaaacaugucauuuagagauuuaggucggguugugguuauggugggagcugcuaugacagaugauauaggaaugggaguaacguacuuagcauugcuugcagcuuucaagguccgacccacauucgcugccggauugcuauugcguaaacuuacuagcaaagagcuaaugaugacuacgauaggaauaguccuucucucucagucaaccauaccagagacaauacuagaauuaaccgaugcucuagcacuaggaaugaugauucucaagauaguccgcaauauggaaaaauaucaguuagcagucacuaucauggcaauccuaugcgugccgaacgccguaauauuacaaaacgccuggaagguaagcugcacaauucuugcugugguuucuguaagcccauugcuucuuacaaguagucaacagaaggcagauuggauaccauuagcguuaaccaucaaaggucucaauccaacggcuauuuucuuaacuacacuaaguagaaccaauaagaaacgauccuggccucuaaacgaagcaauuauggcaguaggaauggugucaaucuuagcgucaucuuugcuuaaaaaugacauaccaaugacugggccauuagucgcgggaggauuacuaacuguaugcuacguuuuaacuggacguuccgcagaccuugaauuagaaagggcagcagauguuaggugggaagaucaggcagaaaucucgggguccagcccuauacuaucuauaacaauaagugaagauggguccaugucuauuaaaaacgaagaggaagaacaaacacugacgauccuaaucagaacaggucucuuaguuaucucaggguuguuuccaguaucaauaccaauuacggccgcagcuugguaucuaugggagguaaagaaacaaagagccggcguccuuugggacgucccaucgcccccaccuguuggaaaagcugagcuagaggacggagcauaccggauaaagcagaaaggcauucuaggauauucacagauaggagcaggagucuacaaagaggguacauuccacacaauguggcacguaacaagaggagcgguguugaugcauaagggaaagagaauagagccgucaugggcggacguacguaaagauuuaauauccuaugguggcgguuggaaacuugaaggugaauggaaagagggugaagagguacaaguauuagccuuagagccugguaaaaauccuagagcuguacaaacaaagccaggcuuauuuaaaacaaacaccggcaccauaggugcuguauccuuagauuuuucaccagguaccucgggaaguccuauaguagauaaaaagggaaaaguugugggucuauauggaaauggagugguaacaagaaguggaaccuauguuucugccauagcccagacugagaaaucuauugaagacaaccccgaaauugaagaugauauuuuccgcaaaagaagacucacaaucauggaucuacaucccggugcuggaaaaacuaaaagauauuuaccagccauaguaagggaagcaauuaagagagguuuaagaacgcuaauucuugcgccgacaagaguaguagcagcugaaauggaggaagcauuaaggggcuugccaauacgauaucaaacgccugcuauucgggcugagcauacuggucgcgaaaucguagaccugaugugucacgcgacauuuaccaugcguuuacuaaguccaguccgugugccaaauuauaauuuaaucauaauggaugaagcacauuuuacagauccggcaaguaucgcugcaagggguuacaucaguacaagaguagaaaugggcgaagcggcaggaauauuuaugacagccacacccccuggaucgagagauccauuuccucaaaguaaugcgccuauaauggaugaggaacgugagauuccagaaaggucauggaauagcggccacgaauggguaacagacuuuaagggcaaaacaguaugguuugugccuucaaucaaagcaggcaaugauauagcggccugucuacguaaaaaugguaagaaagugauccaacugagcaggaaaacauuugauuccgaauauauuaaaacuagaacaaaugacugggauuuuguagucacuacugauauaucagaaaugggcgcuaauuuuaaagcggaaagagucauugauccacgacgaugcaugaaaccgguuauauugacugacggagaagaacgaguaauacuggcaggaccuaugccuguaacacacaguagcgcagcucaacguagaggaagaauagguagaaacccuaaaaacgagaaugaccaauacauauacaugggagaaccacuagaaaacgaugaagauugugcgcauuggaaagaagcuaagaugcugcuagauaauauaaauacaccagaagggauaauaccaucgauguucgaaccugagagagagaagguugacgcaauugacggugaauacaggcucagaggagaagcccgaaagacuuuuguagacuugaugaggcgaggggaccuaccagucugguuagcuuauaggguagccgcagagggaauuaauuaugcagaccgacgcugguguuuugacgguauuaaaaauaaucaaauauuagaggagaauguagaagucgaaauuuggacgaaagaaggagagaggaagaaauuaaaacccagguggcuagaugcaaggauauauucagaucccuuagccuuaaaagaauuuaaagaauuugcugcaggaagaaagagcuuaaccuuaaaucuuauuacagaaaugggaagacucccaacuuuuaugacacagaaagcucggaacgcucuggauaaccuagcaguauuacacacagccgaagcuggcggcagagcuuauaaucacgcguuaagugaacuaccugaaacuuuagagacguuacuacugcuaacacuacuugcgacaguaacgggaggaauauuuuuauucuuaauguccgguaaaggaauuggaaaaaugacccucggaauguguugcauuauaaccgcgucgauacuacuaugguaugcgcaaauacagccacauuggauagccgcgaguauuauauuggaguucuuucuaauuguauuguugaucccggaaccugaaaaacaaaggacuccucaggacaaccaacuaacuuauguggucauugcuauucucacgguaguugccgcgacaauggcaaacgaaaugggauucuuggagaaaaccaagaaagaccuuggcuuaggaaguauugcuacgcaacagccagagucaaauauauuggauauagacuugaggccggcaagugcuuggacacuauacgcugucgcaacgacauucauuacuccaaugcuuagacauucuauagagaauagcucagucaacguuuccuuaacagccauagcaaaucaggccacagucuuaaugggacuuggaaaagguuggccguugucuaagauggacauaggaguaccacuacucgcuauaggauguuacagccaagucaaucccaucacuuugacagccgcccuacuacuauugguggcacauuacgcgauuaucgguccgggguugcaggcgaaggcuacucgcgaggcgcagaaaagagccgcggccgguauuaugaaaaacccaaccguagauggaauaacuguaaucgauuuggaccccaucccauaugacccuaaauuugaaaagcaacuaggccaaguuaugcuguuaguacuaugugucacacaaguguugaugaugaggacaacgugggccuuaugcgaagcucuaacuuuagcaacuggccccauaucaacguugugggaaggcaauccggguagauucuggaauacuaccaucgcugugagcauggccaauauauuucgcgguucauauuuggcgggugcagggcuucuauuuucuauaaugaaaaauaccacuaacacaagaaggggaaccggaaauacuggagagacauuaggugaaaaguggaagaaucgacuaaaugcccucggaaaaucagaauuucaaauuuauaagaaaucaggaauacaagaaguagauagaacauuagcuaaggaagguauuaaacgaggagaaaccgaucaucacgcaguaucuagaggcucugcuaaacuuaggugguucgucgaaagaaaucuagucacaccugaaggcaaggucguagaucugggcuguggccgaggcggauggaguuauuauugugguggacuaaagaacguacgagaggucaaaggauuaaccaaaggugggccaggucacgaagaaccuauuccaaugaguacauacggcuggaaucugguacgacuucaguccggggucgauguauucuuuacuccucccgaaaaaugugacacacuguuaugugauauuggcgagaguucaccgaauccuacuguagaagcgggaagaacucuucgaguguuaaaucuagucgagaauugguuaaacaauaacacccaauuuugcauuaaaguguuaaacccguacaugccuagcguuauagaaaagauggaagccuugcaacggaaauaugguggugcccugguucgaaauccacuaucaaggaacucaacacaugagauguacugggugucgaaugcuaguggaaacauuguaucaagugucaacaugauaucaagaauguugauaaaccguuuuacaaugcgacauaagaaagccacguaugaaccagacgucgacuuaggaagugggacaagaaauauaggaaucgaaucagaaacuccaaaccuagauauaauaggaaaaaggauugagaaaauaaaacaggagcacgagacuucguggcacuacgaucaggaccauccuuacaaaacaugggcauaccauggaagcuaugaaacgaaacaaaccgggucagcgaguucaaugguuaacggcguagucagguuacuuacaaaacccugggacguuauacccauggucacacaaauggcgaugacagauacgacuccuuucgggcagcagagaguguuuaaagagaaagucgauacucgcacacaagaaccuaaggaagggacaaagaaacucaugaaaaucacagcagaauggcuguggaaagaacuagguaagaagaaaacaccgagaaugugcacccgugaagaguucaccaggaaaguaaggucuaaugccgcauuaggugccauuuuuaccgacgaaaacaaguggaaaagcgcgagagaagcgguagaagacucccgauuuugggaauugguggauaaagaacgaaaucuacaucucgaaggcaaaugugaaacaugcguguacaacaugaugggaaaacgagagaagaaauuaggagaguucggaaaagcgaagggguccagagcuauaugguauaugugguuaggggcgagauucuuagaauuugaagcauuaggauucuuaaaugaggaucauugguuuucucgggaaaacucauuaucggggguagaaggagaaggucuacacaaacugggauauauauuaagggauguuuccaagaaagaggguggcgcgauguaugcagacgacacugcagggugggacacgaggauaacuuuagaggaucucaaaaaugaagaaaugguuacuaaccacauggaaggggaacacaagaaacuagcugaggccauuuucaaauuaacauaccagaauaaggugguccggguacagcgcccaacuccuagaggaacggucauggauauaauaucccgacgggaccaaagagguagugggcaaguggguacauauggacuaaauacuuuuacgaauaugggggcucaguuaauacgucaaauggaaggagaagaaguauuuaaaggcauucaacaucuaacugcuacagaagaaauugcaguucaaaauugguuagccagaguaggaagagagcgacuaucaagaauggcgauaucaggagacgauugcguuguaaaaccgcuagaugaccguuuugccucugccuugacugcccuaaaugauaugggcaaggugagaaaagauauacaacagugggaaccuucgcgugguuggaaugauuggacucaaguucccuuuugcucgcaccauuuccacgaacuuauaaugaaagauggaaggguacugguuguccccugucgaaaccaagaugaauuaauaggucgugcucguauuucacaaggugcagguuggagucuccgagaaacugccugucuugggaaaucauacgcacaaauguggucacuuauguauuuccaucgaagagaucugaggcuugcggcgaacgcaauauguucagcggugccaagucauuggguuccuaccaguagaaccacauggucuauucaugcaagacaugaguggaugacgaccgaagacauguuaacugucuggaauagaguauggauucaagaaaauccuuggauggaagauaaaacaccaguugaaucaugggaagaaauacccuaucuagggaaacgagaagaucaguggugcggauccuuaauaggccuaacaucucgggcaacuugggcgaaaaauauacagacugcgauaaaucaagugagaagccuaauagggaaugaagaauacaccgauuauaugcccucaaugaaacgauuccgaagagaagaagaagaagcgggaguucuaugguaa

SEQ ID NO: 22354 - RNA, 9876 nt, Artificial Sequence
  derived and/or modified CDS sequence (opt6) from DENV-2__GQ252676__SS-prME
acagcaggcguaauaaucauguuaauacccacugcaauggcguuucaccugacaacccgcaauggugaaccucauaugauugugaguaagcaagaaaaaggcaaaaguuuacucuucaaaaccgaagaaggaguaaacaugugcacgcuuauggcaauggacuuaggagaguugugcgaagacacaauaacauauaacugucccuuacuaagacaaaaugaaccggaagacaucgauuguugguguaacucaacaucuacaugggugacguaugggacuuguaccgccacuggagaacacaggagagagaaaaggagcguagcauugguaccacacguaggaaugggccucgaaacacggacagaaacauggauguccucggaaggagcguggaaacacgcacaaagaauagaaacauggauauugagacauccagguuuuacaaucauggcugcaauacuagcuuauaccaucgguacaacguauuuccaaaggguacugauauuuauacuucuuacagcaguugccccaucgaugacgaugagauguaucggaauuucaaacagagacuuuguagaaggcguuucagggggaucauggguagacauagucuuagaacauggcucauguguuaccacuauggccaaaaauaaaccuacacuggacuucgaauugauaaaaacagaagcuaagcaaccagccacgcuuagaaaauauugcaucgaagccaaacuaacuaauacaacuacagcuagucgcugcccaacacaaggagaaccuucguugaaugaagagcaagauaagcgauucguauguaaacauucuaugguagauagagggugggguaacgguuguggcuuguuuggaaaaggaggcauaguaacuugugcaauguuuaccugcaaaaagaauauggaaggaaaaauaguucaaccagaaaauuuggaauauacuaucguuguaacuccgcacucaggcgaagaaaacgcagucggcaacgauacagggaaacauggcaaagagauaaaaguaacaccacaaaguucuaucacggaagccgaacuaacaggauacggaacugugacaauggaguguucaccaagaacggguuuggauuuuaacgaaauggugcuacugcaaauggaaaacaaggcauggcugguccauagacaaugguuuuuagaucugccacuaccuuggcuaccgggugcugacauucaggguucgaacuggauacagaaggaaacucuaguuacuuuuaaaaauccacaugcuaagaaacaagaugugguuguacucggaagucaagaaggggcuaugcauacugcucuaacaggugcaaccgaaauacaaaugaguaguggaaaucugcuguuuacuggacaccuuaaaugccgauuaaggauggauaaacugcaacuaaaaggcaugucauauucaaugugcacugguaaauuuaaaguaguuaaagagauugcagagacucaacauggaacuauaguaguuagaguccaauaugagggcgaugguuccccuuguaagauuccauuugagauaauggauuuggaaaagaggcaugugcuaggacguuuaauaacugucaacccuauuguuacagaaaaagauucaccuguuaauauugaagcugaaccacccuucggagauucuuacauaauaauaggaguugagccaggucaauugaagcuaucaugguuuaagaaagggaguaguauaggacaaauguuugaaaccacuaugagaggggccaaaaggauggcgauucugggugacacggcuugggauuuuggcucguugggaggagucuuuacgucaauuggaaaagcacuucaccaaguuuuuggagcaauauacggagcugcauucucuggcguuaguuggacaaugaagauacuaaucggcguuguaaucacuuggauuggaaugaacucccgaagcacuucccugaguguaucacuaguacuaguuggugugguaacucuguaucuggguguuaugguacaagccgauucuggcugcgucgugagcuggaaaaauaaagaguugaaguguggcucaggaaucuucaucacugacaauguccauacauggaccgagcaauauaaauuccaacccgaaucuccaucaaaauuagcaagcgcuauacagaaagcucacgaagaggggauuugcggaauuagaagugugacgcggcuugagaaucuuauguggaaacaaauaacgccugaguugaaccauaucuuaagugaaaacgaaguaaaacucuccaucaugacuggcgauauaaaaggcauaaugcaagcuggaaaaagaucgcuucguccgcagccuacagagcuaaaguauaguuggaaaacaugggguaaggcaaaaauguuaucaaccgaaccacauaaccaaacuuuccugauagauggacccgagacugcugaauguccaaacacuaauagagcuuggaacagcuuggaaguugaagauuauggauuuggaguauucacgaccaacauauggcuuaaauuaaaagaaaggcaggacguguucugugauucuaaguuaaugucugcagcaaucaaagacaacagggcuguacacgcugacaugggcuauuggaucgaauccgcauuaaacgauacauggaagauagaaaaagccaguuuuauagaaguaaaaucuugucauuggccuaaaucacacacauuauggucgaauggaguguuagagucagaaaugauaauaccaaaaaacuuugccgguccugucucacaacauaacuacagaccgggauaucacacacaaacugcagguccauggcauuuagguaaauuggaaauggauuucgacuuuugcgaagguacuacgguugugguaacugaagacugcgguaacagggguccaaguuugcgaacuacuacugcguccgguaaacucauuacagaauggugcuguagaucaugcacgcuuccaccacuucgauaucgcggagaggaugguuguugguacgguauggaaauacgaccucuuaaagaaaaagaagaaaauuuggucaauaguuuagugacagcgggccauggucaaauagauaacuucagucuggguguucuagguauggcucuguuuuuggaggaaaugcucagaacaagggucgguacuaaacacgcaguacuuuuaguagcaguaucauucaugacuuuaauuaccgguaacaugucuuuuagagaucuaggacgggugaugguuauggugggcgcggcaaugacagaugauauagguaugggaguuacauaucuugccuuacuggcggcauuuaagguaagacccacguucgcugcugguuuauugcucagaaagcuaacaucaaaagaacuaaugaugacgacuaucggaaucguauuacugagucaaucaaccaucccugaaacaauauuagaacucacagacgcucuugcccuagggaugaugauuuuaaaaauuguccgcaacauggaaaaguaucaacucgccgucacuauuauggcaauacuauguguaccuaaugcagugauauuacaaaaugcauggaagguaaguugcacuauauuagcugcagucagcguuucacccuuacuccuaacuaguucccaacaaaaggcggauuggauuccuuuggcuuugacgauaaaaggcuugaacccaacagccauuuuucuaacuacacuaaguagaacuaacaaaaaacggucguggccacuaaacgaggcaauuauggcagucggaaugguauccauacuagcuuccucccuauuaaaaaaugauauaccuaugacugguccguuaguagcgggaggacuacuaacagugugcuauguacucacaggcagguccgcagaucuagaacuugaacgagccgcagacguuaggugggaagaucaagccgagauuucaggaagcucgccaauacuaaguauaacaauuagcgaagacggaaguauguccauuaaaaacgaagaggaagagcaaacacucacuauucuaauccggacuggauuacugguuaucaguggucuauuuccaguaagcaucccaauuacggcagcagcaugguaucuaugggaggucaaaaaacagagagcagguguuuuaugggauguuccgucaccaccgccaguaggaaaagcugaauuggaggauggcgcuuaccgcauaaaacaaaaaggcauuuuaggcuauagccaaauuggagcagguguuuacaaagaggggacguuucacacaauguggcacgugacacgaggagcaguacuaaugcauaaaggaaagagaauugaacccucaugggcggaugucagaaaagauuuaauaaguuacgggggaggguggaaguuggagggugaguggaaggaaggagaagaaguacaaguauuagcauuagagccuggaaagaacccgcgggcaguacagacaaaaccaggacuuuucaaaacaaacacuggaacaauaggggcagugagucuugauuucucuccugggaccaguggguccccgauuguugacaaaaaagguaaagucguaggacuauauggaaauggugucgucacuagauccgggacguauguaucagcgaucgcgcaaaccgaaaaaucuauugaagauaaucccgaaauagaagaugacauuuucaggaaaaaacgccuaacaauaauggaucugcauccaggggccgguaaaacuaaaagauaucuaccagcaauuguaagagaagcaaucaaaagggguuugcguaccuuaauacucgcacccacacgcguagucgcggcugaaauggaagaagcccuaagaggucuucccauaagauaccaaacacccgcaauuagggccgagcauaccggcagggaaaucguugacuuaaugugccaugcuacguuuaccaugcgacuacuaaguccaguacgaguaccaaauuacaaccugauaaucauggaugaagcucacuuuaccgauccagcaucuauagcugcgcgaggcuacaucagcacaagaguagagaugggugaagccgcggguauauuuaugacagcaacaccaccuggaaguagagauccauuuccgcaaucaaaugccccaauaauggacgaagagcgggaaauaccugaacguucuuggaacaguggucaugaauggguaacagauuucaaggguaagaccgucugguucgucccaaguauuaaggcuggcaaugacaucgcugcuuguuugagaaaaaacggaaagaaaguaauacaacuaagccguaagaccuucgacagugaauauauaaaaacacgcaccaaugauugggacuuuguuguuacgacggauauuucagaaaugggugcuaauuuuaaagcagaaagaguaauugacccgcgacguuguaugaaaccaguuauauugaccgauggagaagaacgagucauacucgcgggcccaaugcccguaacccacucaagcgcggcucaacgacgcgggagaauuggcaggaauccaaaaaacgaaaaugaucaguauauuuauaugggagaacccuuagaaaaugacgaagacugugcacauuggaaagaagcgaaaaugcugcuggauaauauuaacacaccggaaggcauaaucccuagcauguuugaaccagaaagggaaaaaguugaugcaaucgauggagaauaccgcuuaaggggagaagccaggaaaacauucguugacuuaaugaggagaggugaucuaccaguauggcuagccuauaggguagcugcagagggaauuaacuaugcagaccggcgcugguguuuugauggaauaaaaaacaaccaaauuuuagaagaaaacguagaaguagaaauauggacgaaagagggcgagagaaagaaacuaaaaccgagaugguuggacgcaagaauauauagugauccacucgcacuaaaagaguuuaaggaauuugcugcaggaagaaaaucacuuacuuuaaaccuuauuacagaaaugggcagacuacccacauuuaugacacaaaaagcacgaaacgcacuagauaaccuggccguucuucacacagcagaagcuggaggaagagcguauaaccaugcccucagugagcuaccggaaacauuggaaacacuucuacuauuaacuuugcuagcgacaguaacagguggcauauuuuuauuuuugauguccggaaagggaauaggcaaaaugacacucggaauguguuguauuauaaccgccucuauacuacuaugguaugcucagauacagccacauuggaucgcagcguccauaauacuggaguuuuuucuuauaguauuauuaauaccggaaccagaaaaacaaagaacaccacaagacaaccagcuaacuuacguggugaucgcuauucuaaccguaguagcugcaacaauggcgaaugaaaugggcuuucuggaaaagacaaaaaaagauuucggcuugggaucaauagcuacacagcaaccagaauccaauauacuugacauugaccuucgucccgcuucagcuuggacacuuuaugcugucgcaaccacauuuauaacuccaaugcucagacauucuauugagaauagcucagugaacgucucguuaaccgcaauagcaaaucaagcaacagucuugaugggucucgguaaaggguggccgcuaaguaaaauggacauaggagucccgcuauuagccauuggauguuauagccaaguaaaucccauuaccuuaaccgcugcacuccuacuauuagucgcacauuacgcuauaauuggaccaggacuucaagcaaaagcaacgcgcgaagcucaaaaacgagcagcugcaggaauaaugaaaaauccuacgguagacgggauuacaguaauugaucucgacccaauaccauaugauccuaaauucgaaaaacaguuaggucaagucaugcuuuuaguacuaugcgugacucaaguauuaaugaugcguacuacgugggcacugugugaagcauugaccuuagcuacugguccgaucucuacccuaugggagggaaaucccgggagauuuuggaauacaacuauugcagucuccauggcaaacauuuuuagagguuccuaucuagcaggagcaggauuacucuuuucaauuaugaaaaacaccacaaacacaaggcgcgggacugguaauacuggggaaacucuaggggaaaaauggaaaaaucgacuuaauucuuugggcaaaucugaguuccaaauuuacaaacgaucgggaauucaggaaguagaccguacacucgccaaggaagggauuaaaagaggagaaacggaucaucacgccguaaguagaggaucugcaaaacugcgaugguuuguggaacguaacuuaguuacuccagaagggaagguagucgaccuaggaugcggaagagggggauggaguuauuacuguggagguuugaaaaauguaagagaagugaaaggucuaaccaaagggggcccaggacaugaagagccaauucccaugucaacuuauggauggaaucucguaagauuacagucgggcgucgacguauucuuuacaccuccggaaaagugcgauacuuuacuaugcgauauuggagaauccaguccgaacccaacaguagaagcaggcagaacuuugcgaguauuaaauuuaguagagaauuggcuuaauaauaacacacaauucugcauuaagguauuaaacccuuauaugccaagcguaauagagaaaauggaaacgcuucaaagaaaauacgguggugcgcuaguuagaaacccacugagccggaacuccacccaugaaauguacuggguaagcaacgcaucugguaacauaguauccucgguuaauaugaucucccguauguuaauaaauagauuuaccaugcgacauaaaaaggcaaccuaugagcccgauguggaucuugguucaggcacaagaaacauaggaauagagucugagacccccaaccucgacauaauagguaaaagaauagagaaaauaaaacaagaacacgaaacuucuuggcauuacgaucaagaccauccguauaaaacaugggcauaucacgggagcuacgagaccaagcagaccgggagugcgucauccauggucaauggcgugguacgacucuuaacaaagccaugggaugucauaccuauggucacgcagauggcgaugacugauacaacaccuuuugggcaacaaagaguuuuuaaagaaaaggucgauacacguacacaagagccuaaagagggaacuaagaaguuaaugaagauuacagcagaauggcucuggaaagaauuaggaaagaaaaaaacuccuaggauguguacucgugaagaauuugcacguaagguacguuccaacgcagccuugggugccaucuucacagaugaaaauaaauggaagagugcacgagaggccgucgaagacucaagauuuugggaacuagucgauaaagaacgaaaucuacauuuagaaggaaagugcgagacaugugucuauaauaugaugggaaaaagagaaaaaaaaaucggagaauuugggaaagcaaaaggaucucgcgccauuugguauaugugguuaggagcgagauuuuuagaguuugaggcucuaggguucuuaaaugaagaccacugguuuucaagagagaacagucuguccgggguagaaggcgagggccuucauaaacucgguuacauucuccgagaaguaaguaaaaaagagggaggcgcaauguacgcugaugacacagccgggugggacacgcgaauuacguuagaggaccuaaaaaacgaagagauggugacgaaccauauggagggcgagcauaaaaaguuagccgaggcgaucuuuaaacuaacauaucaaaacaaaguaguacgaguacaacgacccacuccaagagguacugucauggacauaaucagcagacgugaccaaaggggaagcggucaagucggcacauauggauugaauacuuucacaaauaugggugcucaauugauaagacagauggagggagagggagucuuuaaagguauacaacaccuaacagcgacggaagaaguugccguccaggauuggcuagcacgcguaggucgagaacgacugagucgaauggcaauauccggagaugauuguguuguuaaaccauuagaugauagguuugccucagcucucacggcacucaacgauauggguaaaguuagaaaagacauucagcaaugggaaccaagcagaggcuggaaugacuggacccaggucccuuuuugcucgcaucacuuccaugagcuuauaaugaaagacggaagagugcuagucguacccugcagaaaucaggacgaauuaauuggucgagcgaggauaucucaaggggcggguuggagucucagggaaacagcaugccuggguaaauccuacgcucaaauguggucccuaauguacuuccauagacgcgauuuacgucuagcagcaaaugcuauaugcucugcggucccaagccacugggugccuacgucacgaacgaccuggucaauucacgcaagacacgaguggaugacaaccgaagacaugcuaacgguguggaaccgcguuuggauucaagagaacccauggauggaagauaagaccccuguagaauccugggaagaaauaccauacuuagggaaacgagaagaucaguggugcgguaguuuaauuggacuaacaagucgggcaacgugggcgaaaaauauucagacagcaauaaaucaaguaagaucacuaauuggcagcgaggaauacacagacuauaugccgaguaugaaacguuuucgaagggaagaagaagaggcggguguacugugguaa

SEQ ID NO: 22355 - RNA, 9876 nt, Artificial Sequence
  derived and/or modified CDS sequence (opt6) from DENV-2__GQ252677__SS-prME
acggcggggguaauaauaauguuaauaccaacugcuauggcauuucaccuaacuacacgaaauggagaaccacacaugauaguaaguaaacaggaaaaagguaaaucauuacuauuuaaaacagaagaaggaguaaacauguguacuuuaauggcaauggaucuuggugaauuaugcgaagacacaauaacauauaauugcccgcugcuacgucaaaacgaaccggaagauauagacuguugguguaauuccacaaguacuuggguuacauacggaacuuguacagcaaccggcgagcauaggcgcgagaaaaggaguguagcgcuaguaccucacguugggaugggacuagaaacucguacugaaacuuggauguccagcgaaggagcuuggaaacacgcccagcgaauagaaacuuggauauuacgucauccaggauuuacgauaauggcagcuaucuuagccuauacaauagguacuaccuacuuccaaagaguuuuaauauuuauccuucuaaccgcuguagcaccaucuaugacaaugcgcugcauagguaucucaaauagagacuuuguggaaggggugucgggagggaguuggguagauauuguauuagaacacggaucguguguaacaacgauggcgaaaaauaaaccaacauuggacuucgaacuaauaaaaaccgaagcaaaacagccugccacauuaagaaaauacugcauagaagcaaaauuaaccaauacaacgacagcaaguagaugcccuacucagggugaaccaucucuuaacgaagaacaggauaaaagauuuguguguaaacacucaaugguagauagagguugggggaacgggugcgguuuguuuggaaaaggagggauuguuacgugcgcgauguuuacuuguaagaaaaacauggaaggaaaaauaguucagccugaaaacuuagaauauacgauuguugugacuccacauagcggggaagaaaaugcagucggaaaugacacagguaaacaugggaaagaaauaaaagucacuccccaaucaucaauaacugaagcagagcuaacgggauacggcacgguaaccauggaauguucaccacguacuggguuagauuuuaacgaaaugguauuauuacagauggaaaauaaagccuggcucguacaccgccagugguuuuuagaccucccccuaccuuggcuaccaggcgcagauauucaaggcagcaacuggauacaaaaagaaacucugguaacguuuaaaaauccacaugcuaagaaacaagauguagucgucuuaggaagucaagaaggugcuaugcauacugcucuuacuggagcgacugaaauccaaaugagcucuggaaaucuauuauuuaccggucaucugaaaugcagauuaagaauggauaaauuacagcuuaaaggcaugucuuauaguauguguacugguaaauuuaaaguagugaaagaaauugcagagacucagcauggaaccauuguuguucggguacaauaugagggagaugguucuccgugcaaaauaccauuugagaucauggaccuggagaaacgacaugucuuaggacgacuuaucacuguaaauccaauugucacugaaaaagacucgccuguuaacauagaggcagaaccaccauucggagauucauauauuauaauugggguagaaccuggacaacuaaaauuaaguugguuuaagaaagguaguucaauagggcaaauguuugaaacuacuaugcggggcgcaaaacgaauggcuauuuuaggcgauacugcaugggacuucggaucauuaggcgguguauuuacaucaaucggcaaagcauuacaucaaguuuuuggagcgauuuauggagccgcuuuuucagguguuuccuggacuaugaaaauauugaucggaguuguuauuaccuggauagguaugaauagcagaucuacaucacuaucuguuagcuuagugcuuguuggcguaguuacucucuaccucggagugaugguucaagcugacaguggaugcguaguuucauggaaaaauaaagaauuaaaauguggaagugggauuuuuauuacagacaacguucacacguggaccgagcaguacaaauuucagccagagucaccaagcaaauuagcgagugccauucaaaaagcccaugaagagggaauaugcgguauacguucaguaacaagguuagaaaauuugauguggaaacaaauaacgccugaguuaaaccacauauuaagcgaaaaugaagucaaauuaaguauaaugacaggggauauaaaaggaauuaugcaggcagggaaaagauccuuacggccacaaccuacagaauuaaaguacagcuggaagacauggggaaaagcaaaaaugcuuaguacugaaccacacaaucagacuuuucuuauagaugguccugagacggcagaaugucccaauacaaaccgugcguggaacucacuagaaguugaagacuaugguuuugggguuuuuacuacuaauauaugguuaaaauugaaagaaaggcaagacguauucugugacucaaaauugaugagcgcagcgaucaaggauaauagagcaguccaugcagauaugggauauuggauugaaagcgcacugaacgauacuuggaaaaucgagaaggcaucauuuauugaaguaaagagcugccauuggcccaaaucucacacacuuuggaguaauggaguauuagagucugaaaugaucauuccaaagaacuucgcgggaccugucucacagcacaacuaucgaccgggauaucauacucaaaccgcagguccauggcauuuaggaaaauuagagauggacuucgacuucugugaaggaacgacugucgucguuacugaagacugcggcaacaggggcccaucauuacgaacuacaaccgccucagguaaauuaaucacugaauggugcugccggagcuguaccuugcccccacuaagguaucguggagaagacgguuguugguacgggauggaaauacgaccgcucaaagaaaaagaagaaaacuuaguuaacucauuggugacagcaggacacggccaaaucgauaacuucucacucggaguuuuggggauggcacuuuucuuagaagaaauguuacgcacaagaguggguacaaagcacgcuguccuauuaguggcugucucauuuaugaccuuaauaacagggaacaugaguuuccgagaccuaggacgaguaaugguuauggucggagcagcaaugacagacgacauugggauggggguaaccuauuuagcucucuuggcagcguuuaaaguuagacccacauucgcagccggacuacuacuacgcaagcuaacaagcaaagaguuaaugaugaccacaaucggcaucguacuacucucacaaaguacuauuccugagacgauucuugagcuaacugaugcauuggccuugggaaugaugauuuuaaaaauaguacguaauauggaaaaauaccaacuggcaguaacaaucauggcaauacucugcguuccaaaugcgguuauauugcagaacgcauggaaaguaagcuguacuaucuuagcagcaguaucggucucgcccuuacuacugacaucgagucagcaaaaggcagauuggaucccacucgcacuaacgauaaaaggccucaacccuacagcuaucuuucugaccacccucucccggaccaacaagaaacgaucauggccucugaacgaggccauaauggcagugggaaugguuuccaucuuggcaaguagccuucucaaaaacgacauaccaaugacaggcccucuaguugccggcggauugcugacuguaugcuauguauuaacaggcaggagugccgaucucgaacuugaaagggcggcugacguucgaugggaagaucaagccgaaauuuccgguucaucgccaauauuaucuauaacaauuagcgaagaugguucaauguccaucaaaaacgaggaggaagaacaaacauuaacaaucuuaauucguacaggucuauuaguuauaucaggcuuauuuccugugucuauaccaaucacagcggcggcuugguaucuaugggaggucaagaaacaaagagccggcgucuugugggacguaccaucgccuccuccggucggaaaggcugaacuagaggauggagcguaccgcauaaaacaaaaaggaauacuuggcuacucacaaauaggcgcaggaguguauaaggaggguacauuucacacgauguggcacgucacaagaggcgcgguucuaaugcauaaaggcaaacgaaucgagccaagcugggcagauguuagaaaagauuuaauaucuuaugggggaggauggaaauuggaaggggaauggaaggaaggagaagaaguacaagucuuagcauuagaaccgggcaaaaacccccgagcuguacagaccaaaccaggucuauucaaaacaaauacagguacaauaggcgcgguuagucuggacuucagcccugguacaagugggucccccauaguggauaagaaaggaaagguaguaggauuauaugguaacggaguuguaacaaggucaggaacuuauguuucugcaauugcgcaaacagaaaaaucuauugaagauaacccugagauugaagacgauauauuuagaaagaaacgauuaacaauaauggauuugcauccgggggcuggaaaaacaaaaagguacuugccagccauugugcgugaagcaauaaaacguggacugagaacucuuauuuuggcacccacacguguuguagcugcagaaauggaagaggcuuugcgaggauuaccaauaagauaucaaacuccugccauacgcgcagagcauaccggaagagaaauaguagacuugaugugucaugcaacuuuuacaaugagauuauuaucacccguacgaguuccaaauuauaauuuaaucauaauggacgaggcucauuucacugacccggcaaguauagcugcaagaggauauauuuccacuagagucgaaaugggagaagccgccggaauauuuaugacagcgacgccgccuggcucgagagacccuuuuccccaaagcaaugcuccgauuauggaugaggagcgagaaauaccagaaagauccuggaacaguggucaugaauggguuacugacuucaaagggaaaacgguaugguuuguacccucaauuaaagcgggaaacgacauugcagcaugucucaggaaaaauggcaagaaaguuauacaauuaucaagaaaaacguucgacucggaauauauaaaaacucgaacuaaugauugggacuuuguagucacaacugauauaagugaaaugggcgcuaauuuuaaagcagaaagaguaauagacccccguagauguaugaagccuguaauauugacagauggagaggagcgggucauccuagcaggaccgaugccaguuacucauucaucagcagcucagcgccgugguagaauaggaaggaaccccaaaaacgaaaaugaucaauauauauauaugggggaaccauuagaaaacgaugaagacugugcucauuggaaagaagcaaagauguuacuugacaauauuaacacaccagaaggaauaaucccauccauguucgaaccagaaagagaaaaaguggaugcuauagauggugaguaucgucuaagaggagaggcucguaaaacauucguagaucuaaugagacgaggagaucuaccuguauggcuugcauauaggguagcagcugaaggaaucaacuaugcggaucgacguuggugcuuugacggaaucaaaaauaaucaaauccuagaagagaacgucgagguugaaauuuggaccaaagaaggugaaaggaagaaacucaaaccuagguggcucgacgcaagaauuuauucggacccucucgcauugaaagaauuuaaagaauuugccgccggaagaaaaagucugacauuaaaccuuauuacagaaauggguagauuaccuacuuucaugacacaaaaagcgcguaacgcauuagauaaccuggccguccugcacaccgccgaggcugguggccgggcuuacaaccaugcauuaagugaguuaccggaaacccuggaaacguuacuacucuuaacucuacuggccaccguaacaggugguauauuucuauuccuaaugucgggcaagggaauagguaagaugacucuaggaauguguuguauaaucacggcaucaauucuguugugguacgcacagauucaaccucauuggauugcggcuucaauaauauuagaguucuuucuuauaguacuguuaauaccagaaccugaaaaacagaggacaccgcaagauaaccaauuaacauauguuguuauagccauauugacaguuguggcagcgacgauggccaaugaaaugggauuuuuggagaaaaccaagaaagauuuugguuuaggauccauagcaacgcagcaaccagaaaguaacaucuuagacauagaccugcggccugcaagugccuggacccuauaugcgguagcuacuacuuucauuacaccaauguuacgacauucgauugaaaauaguagugugaauguaucgcuaacugcuaucgcaaaucaagcgacgguacuuauggggcuuggaaaagguuggccacuauccaaaauggacauagguguaccucuguuagcaaucggaugcuacagucaaguaaaccccauaacucuaacugccgcguuacuccucuuaguagcacacuaugcuauaauuggaccgggauuacaagcuaaggcaacgagagaagcacagaaaagagcugcagcuggcauuaugaagaauccuacaguagacgguaucacgguuaucgaccuagauccuaucccuuacgauccuaaguucgaaaaacaauuaggacaggugauguuauuaguauuaugcguaacgcagguauuaaugaugagaacuacaugggcccuaugugaagcauuaacgcuagcgaccgguccgauuucaacauuaugggaagguaacccagggcguuucuggaauacaacaauugcaguuucuauggcaaacauauucagagggucuuaucuugccggagcagguuugcuauucagcauaaugaaaaauaccacgaauacccgcaggggcacggguaauacaggggaaacauugggagaaaaauggaagaauagauuaaacaguuuaggaaaaagugaguuccaaauauauaagcgaucaggaauccaggaaguugacaggacauuggcaaaagaaggaaucaaaagaggggaaacugaucaucaugcaguuucuagaggguccgcaaaauuaagaugguuuguagaaaggaauuuaguaacacccgaaggaaaaguaguggacuuaggcugcggaaggggcgguuggucuuauuacuguggcggccucaaaaacguaagagaaguuaagggccuaaccaaaggaggaccuggacaugaagaaccuauaccaaugaguaccuauggauggaaucuagugaggcugcagagugguguugacgucuuuuucaccccaccagaaaagugcgacacauuauuaugugauaucggugaaaguuccccuaauccaacaguugaagcugggcgaacauuacgugucuuaaaccuggucgaaaauuggcuaaacaacaauacucaauucuguauaaaagucuugaaucccuacaugccauccguaauugagaaaauggaaacuuuacaaaggaaguacgggggagcccuggugagaaauccucuuucacgcaauaguacccacgaaauguacugggucaguaaugcuagugggaauaucguaagcaguguaaacaugauaucaagaaugcucauaaacagauucacaaugagacauaaaaaggcaacuuacgaaccagacgucgaccucgggagcggcacaaggaacauagguauugagucugaaacuccaaacuuggacauaaucgguaaaaggauagagaaaauuaaacaagaacacgaaacaucuuggcauuaugaucaggaccacccguauaagacuugggcauaccacgguucuuacgaaacaaaacagacaggcucagcgucuagcauggugaauggaguggucagguuacugacuaagccaugggacguaauuccaauggucacacagauggccaugacagauacgacucccuuuggucaacaacgaguauucaaagaaaaaguggauacucggacacaagagccgaaggaaggaaccaagaaacuaaugaaaaucacagcagaguggcuauggaaagagcuaagaaagaagaaaacaccaagaaugugcacaagagaggaguucgcgcgaaaaguccgcuccaaugcagcauugggcgcaauuuucacagaugaaaacaaguggaaauccgcccgagaagcaguugaagacagccgguucugggaauuaguagauaaagagagaaacuugcaucuggaaggaaaaugcgaaacgugcgucuauaauaugauggggaaacgagagaagaaaauaggagaguuuggcaaagcaaaagguaguagagcuauaugguauaugugguuaggagcuagauuuuuggaguucgaagcauuaggauuuuuaaacgaagaucacugguuuagccgugaaaauucacucucuggaguugaaggugagggauuacauaaacuuggcuacauacuucgagaaguaucuaaaaaggaaggaggggcaauguacgcugaugacacagcuggcugggauacccgaauaacccuugaagauuugaaaaaugaagagaugguaaccaaccacauggaaggcgaacauaagaaacuagcggaggccauauuuaaauuaacauaucaaaacaaaguaguaagagugcaaagaccaacaccaaggggaacaguuauggauaucauuucacggcgagaucaaagggguucaggccaagucgguacauaugguuuaaacacguucacgaauaugggagcccaauugauucgccagauggaaggagaaggcguauucaaaggaauacaacaccucacagcaacugaagaggucgccgugcaggacugguuagcccgcguaggaagggaacgacuaucuagaauggcuauaucaggcgacgauuguguagugaaaccccuagacgacagauuugcaagcgcacuaacggcauuaaaugauaugggcaaaguuagaaaagacauccaacaaugggaacccaguaggggauggaaugauuggacacaggucccguucugcagccaccauuuucaugaauugauaaugaaagauggacgaguucuuguaguaccauguaggaaucaagaugaacuaauaggacgagcgagaauuagucaaggcgcagguuggucacuacgcgaaacagccugucucggaaaaagcuaugcucaaauguggucccuaauguauuuucauagaagggaccuaagacuggccgcaaaugcaauuuguagugcagugccaagucauugggucccaacaucacgaacaacauggucaauccaugcccgucacgaguggaugacaaccgaagacaugcuaacggucuggaaucgaguguggauacaagaaaauccauggauggaggauaagacuccaguugaaagcugggaagaaauaccauacuuggggaaaagagaagaccagugguguggauccuuaaucggauugacaucacgcgcuaccugggcgaaaaauauccagacugccauaaaccaaguaagaucauuaauaggauccgaagaguauacugacuauaugccuaguaugaaacgcuuuagaagggaagaagaagaagccgguguacuuugguga

SEQ ID NO: 22356 - RNA, 9876 nt, Artificial Sequence
  derived and/or modified CDS sequence (opt6) from DENV-2__FJ898438__SS-prME
acugugggaguuauaguaauguuaauaccuacugcaauggcauuucauuuaacuacuagaaacggggaaccacauaugaucguagggagacaagaaaaagggaaaagccuauuguuuaaaacugaagacggggucaauauguguacacuaauggcaauugaucuaggugaacuaugugaagauacaauaacauauaaaugcccauuauuacgucaaaacgaaccagaagacauagacuguuggugcaauaguacaaguacauggguuacuuacgggacauguagcacaacuggugaacaucgcagagagaaaaggucaguagcguuagugccacacgugggaaugggauuggaaacacgaaccgaaacuuggaugaguucagaaggagcauggaaacauguacaacggauugaaacauggauuuuacggcacccuggcuuuacuaucauggcagcgauacuugcuuacacaauugguacaacacauuuucaaagagccuuaauauuuauccuguuaacagcaguugcgcccucaaugacaaugagauguauagguauaucuaaucgggacuuuguggaaggggucagcggggguucguggguugacaucguucuagaacauggaagcuguguaacaacgauggccaaaaauaaaccuacgcuagauuuugaauuaauaaaaacagaagcuaaacagccugccaccuuacguaaauacugcauagaagcaaaauuaacgaacacuacaacagagucacgguguccaacccagggugaaccuucguuaaaugaagaacaagauaaacgcuuuauuuguaaacacagcaugguggauaggggaugggguaauggauguggucuauucggaaaaggaggaaucgucacuugugcuauguuuacaugcaagaaaaauauggaaggaaaaguagugcagcccgaaaacuucgaauauacaauaguaauaacaccacacaguggagaagaacacgcgguagguaaugauacagggaaacacggaaaagaaauaaaaauaacuccacaauccucaauaacugaagccgaacuuacaggcuacggcacggugaccauggaauguucaccaagaacaggacuugacuucaaugagauggucuuauuacaaauggaggauaaagcauggcugguucauagacagugguuccuagaucuuccuuuaccuugguuaccaggcgcagacacccaggggaguaauuggauucaaaaagaaacuuuggugaccuuuaaaaacccacaugccaagaaacaagaugugguuguauuaggaucacaagaaggcgcuaugcacaccgcguuaaccggugcgaccgaaauacagaugagcagcggaaauuuauuauuuaccggucaccuaaaauguagauugagaauggauaaacuccagcuuaaaggaaugaguuauagcaugugcaccgguaaauuuaaaauugugaaagaaaucgcggaaacacagcacggaacaaucguuauaagaguacaauaugaaggugacggcaguccauguaaaaucccauucgagauuacugacuuagaaaaacgucauguguuagggagauuaaucacaguuaauccaauuguuaccgaaaaagauagcccgguuaacaucgaagcagagcccccauuuggagacuccuauauuaucauuggaguugaaccaggacagcuaaaacuaaacugguuuaagaaaggaucaagcauaggacaaauguuugaaacaacgaugcgaggagcgaaacggauggccauccucggggauacagcaugggacuuuggaucguuaggagggguuuuuaccucuaucgguaaagcgcuacaucaaguauucggcgcaauauauggagccgcguucuccggggucaguuggacgaugaaaauucuaauuggaguuauuauuacauggauuggaaugaacagcaggagcacgagcuugucaguaaguuuaguucucgugggcguaguaacccuauaucuaggagcgaugguccaagcagacaguggauguguaguuagcuggaaaaacaaagaauuaaaauguggaucaggcaucuucauuacagacaauguacauacauggacagaacaauacaaauuccaaccggagucaccgagcaaacuugcaucagccauacaaaaagcgcacgaagaaggcauuuguggaauacgaucgguaacucgguuagagaaucugauguggaaacagauaaccccagagcuaaaucauauauugucagaaaaugaaguaaaacuuacuaucaugacaggagauaucaaagggaucaugcaagcuggaaaaagauccuuacgaccacagccuacggaacugaaauacaguuggaaaaccugggguaaagcaaagaugcuuucgacagaaagucacaaccaaacauuucugauugaugggccggaaacugcagagugcccaaacucuaacagggcuuggaacaguuuagaagucgaagauuauggauucgguguauuuacaacgaacauuuggcugaaacugagggagaaacaggauguauuuugugacucuaaacucaugagugcggcgauuaaggauaaucgcgcaguucacgccgacaugggguacuggauagagucagcgcucaaugacacauggaaaauggagaaagcaucuuuuaucgagguaaaaucaugucauuggccaaaaagucauacucuauggaguaacggaguacuugaaucugagaugauaauacccaaaaauuuugcuggucccguaagucaacauaacuaucgaccaggauaccauacacaaacugcaggaccuuggcaucuuggaaaacuagagauggauuucgauuucugcgaagguaccaccguagucgugaccgaagauugcggaaauagagggccgagucugagaaccacaacagccucagggaaacuaauaacugaaugguguugccguagcugcacguuaccuccucuaagauaccgaggggaggauggauguugguacgggauggaaauacgccccuuaaaagagaaagaagaaaaccuaguaaauucauuagugacggccggacauggccagauugauaauuuuucucugggaguucuagguauggcccucuuuuuggaagagaugcuaagaacaaggauaggaacaaaacaugccauccuauuaguggcagcgucauuugugacccugaucacaggaaauaugucguucagagaucuuggccgaguuauggugauggugggugcaacaaugacugaugauauagguaugggaguuacauacuuagcucuacuugcggcauuuaaagugcggccuacauucgcagcgggauugcuacugaggaaacugacgucgaaggagcuuaugauggccacaauagguauagcacuacucucucaaagcacgauaccagagacuauacuagaauuaacugacgcacuagcucuggguaugauggugcuaaagauaguucgaaacauggagaaauaucagcuugccguuacaauaauggcuauaucguguguaccuaaugcuguuauccuucaaaacgcuuggaaaguaucauguaccauccuggcagcaguaucaguaucgcccuuauuacuaacuucaagucagcaaaaagcagacuggauaccucuagcguugacuauaaaagguuugaauccaacggcuaucuucuugacaacucuaagcagaacuucuaagaaacgaucguggccacuaaacgaagcagugauggccguuggcaugguaaguauauuggcuucuagcuuacuuaaaaaugauauaccgaugacaggaccauuaguagccggaggccuccucacugucugcuacgugcuaacaggaagaucugcagaucucgagcucgaaagagcggcugaugugaaaugggaagaucaagcagaaauaucggguucaaguccaaucuuaucgauaacuauaagcgaagauggguccaugaguauuaagaaugaagaagaggaacaaacacuuacgauacuaauccgaacaggccuauugguaauuaguggaguuuuuccgguaaguaucccaauaacagcagcggcuugguaccuuugggaaguuaagaaacaaagagcugguguucuaugggauguaccuuccccacccccgguagggaaagcggaacucgaagauggcgcauauagaauaaaacagcgugguauacuugguuacagucaaauaggagccgggguuuauaaagaagguacguuucauacgauguggcauguaacccgaggagcuguauugaugcauagagggaaaagaaucgagccguccugggcugacgucaagaaagacuuaauauccuauggagggggauggaaacuagaaggagaauggaaagagggagaagaaguccaaguauuagcacuagagccggguaaaaauccaagggcuguccaaacuaaaccaggaauauucaagacaaauacggguacgauuggcgcaguuagucuagauuuuagcccuggaacgaguggaucacccaucguugauagaaaagggaaaguaguaggacuauaugguaauggaguaguuacacggucgggagcguaugugucagccauagcacaaacugagaagucuaucgaagauaaucccgagaucgaagacgacaucuucagaaagaaacgacuaacaauuauggauuuacacccgggagcagguaaaacuaaaagguaccuuccagcuauaguaagggaagcuauaaagagagggcugaggacgcuuauuuuggcaccuaccaggguaguugcagccgagauggaagaggcuuuaagaggucuuccaauuagauaucaaaccccugcuauuaaaacagaacacacuggcagagaaaucguugauuuaaugugucacgccacauuuacaaugcgucuacucucuccaguaagaguuccuaacuauaacuuaaucauaauggacgaagcccauuuuacagauccugcuaguauagccgcacgaggauauauaucaacaagaguagaaaugggggaagcugcggggauuuuuaugacagcgacaccgccagguucuagggauccauucccacaaucgaaugcuccuauaauggaugaggaacgagaaauaccggaaaggaguuggaacucaggacaugaaugggugacagacuuuaagggcaaaacuguuugguucguuccuucgauuaaagccggaaaugauauugcagcaugcuugaggaaaaauggcaagaaaguaauacaacuaucaagaaaaacguuugacagcgaauacgucaaaacucgggccaaugauugggauuuuguuguaacuaccgauauuucggaaaugggggcuaacuucaaagcggaaagggugaucgaccccagacgaugcaugaaaccugugauauuaacagacggugaagaaagagucauccucgcaggaccaaugccagucacccacagcucggccgcgcaaaggcgaggcagaauaggccgaaaccccaaaaaugaaaaugaccaauacauauauaugggcgagccauuagagaaugaugaggacugcgcucacuggaaagaagcaaaaaugcuguuagauaacauaaacacaccggaagguauuaucccaucaauguuugaaccagaacgagagaaaguugacgcuauugacggagaauauagauugcgcggagaggcacguaaaacuuucguugacuuaaugagaagaggagauuuaccuguauggcucgcguacaaaguugccgcagaaggcaucaacuacgcugauagaaaauggugcuucgaugggauuaaaaauaaccaaauacuagaagagaacauggaaguagaaauauggacaaaagaaggagaaagaaagaaacuaaaaccaaggugguuagaugcucguauauacucggauccgcuagcccuaaaggaauuuaaagaauuugcagcagguagaaaaucguuaacucuaaaucuaauaacugagaugggcagacuucccacguucaugacgcagaaagcccgaaaugcacuugauaauuuggccguacuccauacggcggaagcagggggacgugcuuauaaccaugcguuaagcgaauuaccugagacacuagaaacccuccuguuauuaacacuccuugcaacagucacgggagggauauucuuauuuuuaauguccggaaaaggaaucggcaaaaugacauuaggcauguguuguaucauaacagcaagcauauuacuuugguacgcccaaauccagccccauuggaucgcugcaucaauaauucuugaguucuuucugauaguuuugcuaauaccagaaccggaaaaacaaagaacuccacaggacaaccaauuaacguacgucguuauugcaauacuaaccgucguagcggccacaauggccaacgaaaugggauuucuagagaaaacaaagaaagacuuaggucuuggaucaaucacuacacaagaaagcgaaaguaacauacuggacauugauuuacgacccgcaucagcauggacuuuguacgcuguagcaacuacauucgugacgccaaugcugcgucauuccauagaaaauucaagcguaaacgucucucucacagccauagcuaaucaggccacaguacucaugggccuugggaagggauggccacuaucaaagauggauauuggaguaccucucuuggcgauuggguguuacucccaagugaauccaauaacccuuacagcagcuuuacuacuucuagucgcgcauuaugccauaauagggcccggacuccaggccaaagcuacaagggaagcgcagaaaagagccgcagcaggcauaaugaaaaacccuacugucgauggaauuacgguaauugacuuagaaccaaucccauacgauccaaaauucgagaaacaauugggccaagucauguuacuaauauuguguguaacacaaguauuaaugaugagaacaacaugggcuuuaugcgaggcccuuacauuagcaacaggaccaauaaguacauuaugggaaggcaauccaggacguuuuuggaauacgacaauugcaguaagcauggcaaauaucuucagaggaagcuaucuggcaggggcaggccuguuauucagcauaaugaaaaauacuaccaauacacgacgaggaacuggcaauauuggugagacauuaggagaaaaauggaaaucuagacucaaugcgcugggcaaauccgaauuucaaauauacaaaaagucagggauucaagagguugauagaacccuagccaaagaaggaauaaagcguggagaaacugaucaucaugcaguaaguagaggaagcgcuaaauugaggugguuuguugaacggaacaugguuacuccugaggggaaggugguggaucuagguugugggagaggaggguggucguauuauugugggggccucaaaaauguuagggagguuaagggacuuacuaaaggaggaccgggacacgaggagccaauacccaugucaacguacggcuggaacuuaguacgauugcaaucaggaguugauguauucuuuacuccuccagaaaagugugacacgcuauugugugauauaggagaaagcucaccgaauccuaccauugaggcaggucgaacauugcguguccucaauuugguugaaaauuggcuaaauaauaauacucaauucuguauuaaaguauugaacccauacaugccuagcguaauagagaaaauggagacacuacaacgaaaguauggaggggcguuagucaggaacccgcuaucacguaauucaacccaugagauguacuggguaucuaacgcgacggggaauauaguuucaaguguaaauaugauuucacgcauguugauaaauagauuuaccaugaaacacaagaaagccacuuacgaaccagauguagaucuaggaaguggcacaagaaacaucggcauugaaagcgagaucccuaauuuggacauuauaggaaagagaauagagaaaaucaaacaagaacaugagacgagcuggcacuaugaucaggaccauccauauaaaacgugggcuuaccauggaaguuaugaaacaaaacagacagggagcgcuuccaguaugguaaacggcgucgucagauugcuuaccaagccuugggacguaguaccaaugguuacacaaauggcgaugacggacacaacgcccuuuggucagcaaagaguuuuuaaagaaaagguugacacucgcacgcaagaaccaaaagaagggaccaagaaauuaaugaaaaucacagcugaauggcuauggaaagaauuagguaaaaagaaaacuccaagaaugugcacaagggaagaguucacaagaaagguaagaucaaacgcugcccucggugccaucuuuacagaugaaaauaaguggaagucagcgagggaagcggucgaagaugggagauuuugggaauugguagaccgagaaaggaauuuacacuuagaaggcaaaugcgaaacauguguguacaauaugaugggcaaacgagagaagaaacucggugaguuugguaaggcuaagggaucaagggcaauaugguauauguggcuuggugcccgguucuuggaauuugaagcccuaggauuuuuaaacgaagaucauugguucucccgagggaauaguuuaucaggaguugagggggaaggacuacaucgcuuaggauauauauuacgggacgugggcaagaaagaagggggagccauguacgcggacgauacagcaggaugggauacgagaauaacauuagaagaccuaaagaacgaggagaugguuacuaaccacaugaagggugaacacaaaaagcuagcugaagcaauauuuaaacuuacguaucaaaauaaaguugucagaguacaaagaccaacaccgcgaggcacagugauggauaucauaagucggcgagaucaacgagggagugggcaaguagguacauauggcuugaacacguuuacgaacauggaagcccaacucauacgucaaauggaaggagaagguauuuuuaaaucgauccagcacuuaacagcgacagaggaaauagcaguucaaaauuggcuagcgagaguaggucgggagcgauuaucgaggauggcaaucucaggagacgauuguguagucaaacccauagacgauagauucgcgagugcccuaacugcucugaaugauauggguaaaguaagaaaggacauucaacagugggaaccaucaagaggcuggaacgauuggacccagguccccuucugcagucaccacuuucaugaguugguuaugaaagaugguagaguacucgugguaccauguagaaaccaagaugagcuaauaggccgugcacgcauaagucaaggagcaggcuggaguuuaaaggaaacggccugucuuggaaaaucauaugcgcaaauguggacuuuaauguauuuucacagacgugacuugaggcucgcagcgaacgcuauuuguuccgcaguaccaucacauuggguccccacuucgaggacgacguggucaauccacgccaagcaugaguggaugacgacggaagacauguuagcaguauggaaccgaguuuggauacaagaaaacccuuggauggaagacaaaaccccaguagaaaguugggaagaaguacccuaucuuggaaagagggaagaucaauggugcggaucgcuaauuggucucacaucaagagcaaccugggcuaaaaacauacaaacugccauaaaucaaguaagaaguuuaauaggaaaugaggaauauacagauuacaugcccagcaugaagagauuucggagggaagaggaggaagcuggaguucuaugguga

SEQ ID NO: 22357 - RNA, 9876 nt, Artificial Sequence
  derived and/or modified CDS sequence (opt6) from DENV-2__GQ199893__SS-prME
acggcaggggucauaguaaugcucaucccaacagcaauggcguuccauuuaacgacaaggaacggugaaccucacaugaucguaggacggcaagaaaaagggaagucucuucuuuuuaaaaccgaggaugggguaaauaugugcacacuaauggcgauugaucucggagagcuaugcgaagauacgauuacauauaaauguccacucuuacgucagaacgaaccugaagauauagacugcugguguaacaguacuagcacgugggucaccuauggaacauguacgacaacuggggaacaucgaagagagaaaagaucuguagccuugguaccacauguugguauggggcuagaaacgagaacggagacuuggaugaguucagaaggagcuuggaaacacguucagcguaucgaaaccuggaucuuaagacacccggguuuuacuauaauggcagcgauacuugcguauaccaucggaaccacucauuuccaaaaagcguuaauauuuauuuuacuaacagcaguggcuccgucuaugacaaugcgauguauaggaauuaguaaccgagauuuuguagagggcguuagcggugggucauggguugauaucguacucgaacauggaucuuguguaacaacgauggccaaaaacaaaccaacucuagauuucgaacuuauuaaaacagaggccaaacagccagcuacauuacgaaaguacuguaucgaggcaaaauuaacuaacacaacuacagagucacguugcccaacacaaggagaaccuucguuaaaugaagaacaggacaagagauuuaucugcaaacauaguaugguagauagaggaugggguaauggaugugguuuguucgguaaaggugggauugugacgugcgcaauguucaccuguaagaagaacauggaaggaaagguuguccaaccagaaaaccuugaguauacaauaguaauaacgccacauucuggggaagagcaugccguuggcaacgacacugguaaacacgggaaggagauaaagauaacaccacagucuucuaucacagaagcugaacucaccggauaugggacuguaacaauggaauguaguccaagaacagggcucgacuuuaacgaaaugguuuugcuacaaauggaagauaaagcuugguuaguacaucggcagugguuccuugauuuaccauuaccauggcucccaggagcagauacucagggaucuaauuggauacaaaaagaaacuuuaguuacauucaagaacccacacgccaaaaaacaagaugucguugucuuaggaagucaggaaggcgccaugcauacagcauugacaggagcaaccgagauucaaaugucaagugguaaucuuuuauuuaccgggcaucuaaaaugucgacugcgaauggacaaauugcaacugaaagggaugaguuacucgauguguacaggaaaauuuaagauaguuaaggaaauugcggaaacacaacauggaacaauagugauaagagugcaauaugaaggagacggaagcccgugcaaaauaccauuugaaauuacggaucuugaaaaaaggcacguauuaggcagguuaauuacggugaauccgauaguaacugaaaaggacagcccgguuaauaucgaggcagaaccaccguucggagacucauauauuaucauagggguugaaccaggucaacuuaaguuaaauugguuuaagaaaggaucgaguauaggccaaauguucgaaacuacaaugagaggugcaaagcgaauggccauacuaggggacacugcuugggauuucggcagcuuaggcggaguuuuuacgucaauugguaaagcccuccaucagguguuuggagcaauuuacggagcagccuuuucuggugugucauggaccaugaaaauacucauaggagucauuaucacuuggauugguaugaauagucguucgacaucguuaagcguaucccuagugcuaguugggguuguaacauuauaccuaggugcgaugguccaagcagacucagguugcguugugucuuggaaaaauaaagaauuaaaaugugggucaggaauauucauaacagacaaugugcacacauggaccgaacaguauaaguuccaaccagaaaguccuucuaaauuagcuagcgccauacaaaaggcacaugaagaaggcauuugugguauaagaucaguaacgagacuugaaaaccuaauguggaaacagauuacacccgaauugaaucacauacuaucggaaaaugaggugaaguuaaccaucaugacaggagauauaaaaggaauaaugcaagcggggaaacggagucuuagaccacaacccacggaguuaaaguacucguggaaaacauggggaaaagcaaaaauguuaucgacagaaagucauaaucaaacuuuucucauagacgguccugagacugcugaaugucccaauaccaauagggcuuggaauagccuugaaguugaagauuauggauuugguguguuuacgacaaacauauggcugaaacuuagggagaaacaagacguauuuugugacagcaaauuaaugucugcagccauuaaagacaauagagccguacacgcugauaugggauauuggauagagagugcacuaaaugauacuuggaagauggaaaaagccucguuuauagaaguaaaauccugucacuggccgaagucucacacucucuggucgaauggaguucuggagagugaaaugauaauaccuaaaaauuuugcagggccugucagucaacauaauuaucgcccuggauaucauacccagacagcagggccuuggcacuuggguaaauuagaaauggacuuugaccuaugcgaggguaccacaguugucguuacagaagauuguggaaacagaggccccagucugaggacuaccacugcaucuggaaaacuuaucacagaaugguguugucggaguuguacgcuaccaccacuacguuauaggggugaggaugguuguugguauggaauggaaauucgaccucuaaaagagaaagaggaaaaccuaguaaacucucuaguaacugcugggcacggacagauagauaacuuuagcuuagguguacuuggcauggcauuauuucuugaagaaauguugcguacgagaauugguacuaaacacgcaaucuuauuaguugcugugagcuuugucacucugauaaccggcaacaugucauuuagagaccuagguagaguuauggucaugguaggcgcgacuaugacggaugauaucgggaugggagucacuuaucucgcacuuuuggcagcuuucaaagugcguccaacguucgcagcagguuuacuucuacguaagcuuacuucaaaagaauuaaugauggcgacaauagguauugcuuugcugucucaguccaccauaccagaaacaauacucgaauuaacugaugcacuugcgcuuggaaugaugguauugaaaauaguuagaaauauggaaaaauaucaacuggcagucaccauuauggcgauaucauguguaccuaaugcagucauauuacagaaugcauggaaagucagcuguacaauucuugcagcaguuuccguaucaccauuauuauuaacaucaagucaacaaaaggcugacuggauaccacuggcacuuacaauuaagggcuuaaacccaacagcuaucuucuuaacuacuuuaucacgcacaaguaagaagagaaguuggccuuuaaacgaggcaauaauggcgguaggcaugguuagcauacuagccucgucucucuuaaaaaaugacauaccgaugacaggaccuuuaguagcaggggguuuauugaccguauguuacguucuuacaggaagaagcgcagaucuagaacuggaaagagcggcugacguuaaaugggaagaucaagcagagauuucgggcucaucgccaauccuuaguaucacaaucucugaagacgguaguaugaguauaaagaacgaggaagaagaacaaacauugaccauacuaauacggacuggucuauuagucauuucugggguauuuccuguaaguauuccaauaaccgcugcugcgugguacuuaugggaggugaagaagcaaagggcgggagucuuaugggacgugccaucaccaccaccgguagaaaaagccgaauuagaagacggugccuacagaauaaaacagcgggggauuuuaggguacagccaaauaggcgcaggcgucuacaaagaaggcaccuuucacacuauguggcaugucacuaggggugcaguuuuaaugcauagaggaaagcgaauagaaccaaguugggccgacguuaaaaaagaucucauuucuuacggcggaggguggaaacuugaaggcgaguggaaagagggcgaagagguacaaguccuagcuuuggagccggguaagaauccuagagcaguucaaacgaaaccaggcauuuuuaaaacaaacacuggaacuauaggagcggucucguuggacuucagcccaggaacuaguggaaguccaauuguagaccgcaaaggaaaagucgugggacuuuacggaaacggcguugugacucgaucgggugcguacguguccgccauagcgcagacagaaaaaaguauugaagacaaccccgagauagaagaugacauuuuucgaaaaaaaaggcuuacuauaauggauuuacaccccggggcaggcaagacaaagcgcuacuuaccagcaauaguacgggaagcaauaaaacgaggacuaagaacccuaauacuagcaccaacacgaguuguugcugcugaaauggaagaagcacuaaggggacuuccaauacgauaucaaacgccugcuauaaaaacugaacauacaggacgcgaaauaguagacuuaaugugucaugccacuuucacaaugcgacuacuaagcccaguaagggucccuaauuauaaccuaauaauuauggacgaagcucauuuuacagauccugcuagcauagcagcgcguggguauauaucuacacgaguugagaugggcgaagcggcagguauauuuaugacagcuacgccgccagguucgcgagauccauucccucaauccaacgcaccaauuauggacgaggaaagagaaauaccugagcguagcuggaauuccggacaugaguggguaacugauuucaaagguaaaacgguaugguucguaccaaguauuaaagcggggaaugauauugccgccuguuugagaaagaaugguaagaaaguuauacaguuguccagaaaaacguucgauagcgaguauguaaaaacaagagcaaacgauugggacuuuguagugaccacugacaucucugagaugggggcgaacuuuaaagccgaaagaguaauugaccccagacgcugcaugaaacccguaauuuugacagacggugaggagagaguuauauuggcaggacccaugccuguuacacauagcuccgcugcacaacgucggggacggauaggacgaaacccaaagaaugaaaaugaucaguacauuuauaugggggagccgcuagaaaacgacgaagacugcgcucauuggaaagaggcuaaaaugcuauuagacaauauuaauaccccagaaggaauaauaccuaguauguuugagccugaaagggaaaaaguggaugcgaucgacggggaauauagacuuagaggugaagcaagaaaaacauuuguugaucuuaugaggagaggagaccugcccguaugguuggcuuacaaggucgcugcugaggguauaaauuacgcugaccggaaaugguguuucgaugggauaaaaaauaaucaaauucucgaagagaacauugaaguagagauuuggacaaaagaaggagaacgaaagaaacuaaagccaagaugguuagaugcucggauauauagcgauccuuuagcuuuaaaagaauucaaagaauuugcugcaggucguaaaagcuuaacacuaaaucuuaucacagaaauggggagauuacccaccuuuaugacucagaaagcacguaacgcguuagauaaucuagcgguguuacacacugcagaagcuggaggaagggcuuacaaucacgcccuaucugaacugccagagacacuagagaccuugcuacuuuuaacccuacuggcuacuguaacaggagggauuuuccuguuccuaaugucagguaaaggaaucggaaagaugacuuuaggaaugugcuguauaauaacugcaucaauucuacuaugguaugcgcaaauucaaccacacuggauugcugccagcaucauuuuggaguucuuuuuaauuguguuauugauaccagagccagagaagcaacguacuccccaggauaaccaacugacauaugucguuauagcgauacugacaguggucgcagcaacuauggcuaaugagauggguuuuuuggaaaaaacaaagaaggauuuagguuugggaaguauaacuacucaagagagugaaucgaacauacuagacauagaucuacguccagcuagcgcauggacgcuguaugcaguagcuacaacuuuuguuacaccaauguuaagacacaguauugaaaacucaucggugaacguuucacuaacagccaucgcuaaucaagcuacaguauuaaugggccuaggcaaaggauggccacuuaguaagauggauauaggaguaccucuucuagcaaucggauguuauagccaaguaaacccaauaacauugacagcugcguuguuacuacuaguggcacauuaugcgauuauaggaccugggcuccaggcuaaagcuacacgagaagcacagaaaagggcagccgcagguauuaugaagaauccgacgguugaugggauuacaguuauagaccuugagccuauacccuacgauccaaaauuugaaaaacaacugggacaaguuaugcuucuaauauuaugugugacacaaguauugaugaugaggacuacgugggcacuuugugaagcauuaacguuggcuacugggccgauaagcacgcuaugggagggaaaccccgguagauucuggaacacaaccauagccguuagcauggcgaauauauuucggggaucguaccuugcuggugcaggauuacuauuuagcauuaugaagaacacaaccaauacgagaagaggaaccgggaauaucggugaaacucuuggggaaaaauggaaaaguagacuaaacgcccucgggaagucagaauuccagguuuacaagaagucaggcauacaagaagucgauagaacacuugcgaaggaggguauuaaaaggggagagacagaucaucaugcuguuaguagagguucagcaaaauuacguugguuugucgaaaggaacaugguaacgccagaggggaaaguuguggauuuaggcuguggaagaggaggguggucuuacuacuguggggggcuaaaaaauguaagagaaguaaaaggccuaacgaaagggggaccaggucaugaggaaccaauaccuauguccaccuacgguuggaaccuggugagguugcaaaguggaguagauguauuuuucacaccaccugaaaaaugugauacucuacuaugugauauuggcgagucuucacccaauccaacaauagaagccggccguacguuaaggguuuugaaccuuguggaaaauugguuaaauaauaacacacaauuuuguauaaaaguccuaaacccauauaugccaucgguaauugagaaaauggaagcguugcaaaggaaauauggaggggcguuaguacggaauccauuauccagaaauaguacacacgaaauguauuggguaucaaaugcuacuggaaauauagugucuuccguaaauaugauaucaagaauguuaauaaacagguuuacgaugaaacacaaaaaagcgaccuaugaaccugauguagauuuagguucagggacaagaaauauuggaauugaaucggagauucccaaccuagauauaauagguaagagaauagaaaaaauaaagcaagaacaugaaacaucuuggcauuaugaucaagaucauccuuauaaaaccugggcauaucauggaucauacgaaacaaaacagaccgguucugcuuccucaauggugaauggaguaguuagacugcuuacuaaaccaugggacgucguaccaaugguaacacaaauggcuaugacagauacuacaccuuucggucagcagcgaguauucaaggaaaagguggacacgagaacucaagagcccaaagaagguacuaagaaauuaaugaaaaucacugcggaguggcuauggaaggaauugggaaaaaaaaaaacaccucgaaugugcacccgagaagaauucacaagaaaggucaggaguaaugccgcuuuaggugcaauauuuacagaugaaaauaaguggaaaucagcccgggaagcugucgaggaugggcgauuuugggaacucgucgauagggaacggaacuuacaccucgaaggaaaaugcgaaacaugcguuuauaauaugauggguaaacgugagaaaaaauugggggaguuugguaaagcuaaggggucgagagcgauuugguauauguggcuaggggcgcguuuccuagaauucgaagcacucgguuucuugaaugaagaucauugguuuucaaggggaaacagucuaaguggaguagaaggcgaagggcuacaucgacuuggauauauauuaagagacguaggcaaaaaagaagguggagcaauguaugccgaugauacagcaggaugggauacaagaauaacucuugaagauuuaaagaaugaagaaauggucacgaaucacaugaaaggagaacacaaaaagcucgcagaggcaauuuuuaaacuaaccuaccaaaacaaaguaguucgaguacagcggccaaccccaagagggacaguuauggauauaauuagcaggcgugaucaaagggguucagggcaaguagguacguacgguuuaaauacuuucacuaauauggaagcgcaauugauacgacagauggaaggggaagggauauuuaaaaguauucaacaucuuacagcaacggaggaaauagcaguccaaaacuggcuagcaagaguaggccgagaaagacucuccagaauggcuauaaguggugacgauugcguaguaaaacccauagaugauagguuugcaagugcccuaacggcguuaaaugacauggguaagguacgaaaagauauccaacaaugggagccgagucgggguuggaaugauuggacucaagugccuuuuuguucucaucauuuucacgaacuagugaugaaagauggcagaguguugguaguuccaugucguaaucaggaugaauuaauuggcagagcucgaauuucgcaaggugcuggguggagccuuaaagaaacggcuuguuugggcaagucauaugcucaaauguggaccuugauguacuuucaccgacgggaccuaagacucgcugcaaacgccaucuguucagcugugcccccacauuggguaccaacgagucguaccacauggucaauacaugccaagcaugaauggaugacaacggaggauauguuggcagucuggaauagaguauggauacaagaaaauccauggauggaagacaagacaccaguugaaaguugggaagagguaccauaucuaggcaaaagagaggaucaaugguguggcucauuaaucggucuaacuucuagagcgacaugggcuaaaaacauucaaacagcgauaaaucagguaagaucucuaauagggaaugaagaguauacagauuacaugccaucaaugaagcgauuucgaagggaggaagaggaagcuggaguguuaugguga

SEQ ID NO: 22358 - RNA, 9876 nt, Artificial Sequence
  derived and/or modified CDS sequence (opt6) from DENV-2__GQ199894__SS-prME
acggcaggggucauaguuauguugauucccacugcgauggcauuucaucuuacaacacgaaauggugaaccgcauaugauaguuggaaggcaagaaaaagggaaaagucuuuuauuuaaaacagaagauggggucaacauguguaccuugauggcaauugaccuaggagaacuaugcgaagacacgauuacguauaaauguccauuacuaagacaaaacgaaccugaagauauagauuguuggugcaauagcacaucaaccugggucaccuacgguacgugcacuacuacuggagaacacagaagagagaaacgaagugucgcgcuagugccacacguagguauggggcuggaaacgagaacagaaacuuggaugucuagugaaggugcuuggaaacauguacaaagaauagaaaccuggauauugcgucauccaggauuuacuauaauggcagcgauacuagcguauacaauagggacaacucacuuccagaaagcacuaaucuuuauauuacuaacagcaguugcaccaucaaugaccaugagauguauaggaaucuccaacagagauuuuguagaagggguuucaggaggauccuggguugacauugugcuagaacacggaucaugcgugacaacuauggcgaaaaacaaaccaacauuggauuuugaauugauuaaaacagaagcuaaacaaccugcuacucuacgaaaauauuguaucgaagcgaaauuaacuaauaccacuacagaaagcagaugcccgacucaaggagagccuucuuuaaaugaagaacaggauaaacguuuuauuuguaaacacucaaugguugacagaggauggggaaaugguugcgggcuuuucggcaaaggcggaauaguuacgugugcgauguucacauguaagaaaaauauggaaggaaaaguuguucaaccagaaaaucuugaauacaccauaguuauaacgccacauaguggagaagaacacgcagugggaaacgauacaggaaaacauggaaaagaaaucaaaauaacuccgcaaucaaguaucacagaagccgagcuuacaggauauggaacaguuacaauggaauguaguccacgaacaggacuggauuuuaaugaaaugguauuauuacagauggaagauaaagcaugguugguucauaggcagugguuuuuagaucuaccauuaccuuggcucccgggagcugauacccaagguagcaauuggauucaaaaagagacauuaguuacuuucaaaaacccgcacgcgaagaaacaggacguuguuguacugggaagucaagagggugcaaugcacaccgcauuaacaggagccacugaaauucaaaugucuagugguaaucucuuauucacaggucauuuaaaaugcagacugagaauggacaaacuacaacuaaaagggaugaguuacucaaugugcacuggaaaauuuaaaauagucaaagaaauugcagaaacacagcacgguacaauuguuauaagagugcaauacgaaggagacggcucuccgugcaaaauaccguuugagaucacugaccuugaaaaacgacacguuuuggggcgucugauuacagucaacccgauaguaacugaaaaagauuccccuguuaauauagaggcagagccucccuuuggcgacagcuacaucauuauaggcguggaacccggucaacuaaaacuuaacugguucaagaaagguuccaguauuggacagauguuugagacaacuaugcgcggggcaaaacguauggcaauauuaggggacacagcgugggacuucggaagucuagguggagucuucacauccaucggcaaagcacuacaucaaguauuuggagcgauuuacggggcggcauuuuccggggucaguuggacuaugaaaaucuuaaucggaguaauuauaacauggauaggcaugaacagccggucaaccagucugucaguaucguugguucucguaggcguuguaacacuauauuugggagcuaugguccaggccgauucuggguguguagucucauggaaaaauaaagaauuaaaaugcgguucagguauauuuaucacagacaauguacacaccuggacggaacaauacaaauuccagccagagucuccuaguaaacuagcuagcgcuauucaaaaagcgcacgaagaaggcauaugcgguauaaggagcguuacucgccuagaaaaccuaauguggaaacaaauuacaccugaauuaaaucauauacuaucugagaaugaaguaaaguuaaccauuaugacgggcgauauaaaaggaaucaugcaggcugguaaaagaagccugcgaccccaacccacggagcuuaaguacaguuggaagaccugggggaaagccaaaaugcuaucuaccgagucgcacaaccaaacuuuucuaauagauggacccgagaccgcagaauguccaaauacuaaucgugcuuggaauagucuagagguugaggacuaugguuucggcguauucacuaccaauauuuggcuaaaacugcgagaaaagcaagaugucuuuugugauucgaaguuaaugagugcagcaaucaaggacaaucgcgccgugcacgcagacauggguuacuggauagaaucagcguuaaacgauacuuggaaaauggaaaaggcgagcuucauugaaguuaaaaguugucauuggccgaaaucucauaccuuauggagcaacggaguucuugaguccgaaaugauaauaccaaaacauuucgcaggaccaguaagucaacauaauuacagaccagguuaccacacacaaacggccggaccuuggcaccuaggcaaauuagaaauggauuuugaccugugcgaagguacgacaguaguuguaacggaggauugcggaaacagaggaccaucccuacguacuacgacugccaguggaaaauuaaucaccgaguggugcuguaggaguuguacauugccuccccuaagauacagaggagaagacggauguugguauggaauggaaauuaggccacuuaaagagaaagaggaaaacuuagucaauucacuuguaaccgccggucacgggcaaauugacaauuucaguuuggggguguugggaauggcuuuguuccuagaagagaugcugagaacuagaauaggcaccaagcaugccauauugcugguagcggcaaguuuuguaacguuaaucacaggaaauaugagcuuucgagaucuaggacgaguuaugguuaugguaggcgcaacuaugaccgaugacauaggaaugggaguuacauauuuggcacuuuuagccgcuuuuaaagucagaccaaccuuugcagcuggguugcugcucagaaaacugacaagcaaagaguuaaugauggccaccauugggauugcuuuauuaagccaaagcacgaucccagagacaauuuuagaauugaccgaugcccuggcacucggaaugauggucuugaaaauaguuagaaauauggaaaaauaucaacuggcagugacgauuauggcuauaucaugugugccaaacgcaguaauacuucagaaugcuuggaaaguuaguugcacuauucuagcggcuguaucaguuagccccuuacuacuaacauccucacagcagaaggcagauuggauuccccuugcauuaacuauuaagggacuaaaccccacagcuauauuuuugacgacacuaagucguaccaguaagaaaagaaguuggccauuaaaugaagcuauaauggccguaggaauggugucuauacuggcaucgucgcuucucaaaaaugacaucccgaugacuggaccauuagucgcuggaggguuauuaacaguaugcuauguuuuaacaggaagaucagccgaucuagaacuugagcgugcugcggauguaaaaugggaggaucaagcagaaauuucagguucaucuccaauauuaaguauaacuauauccgaagacggauccauguccauaaagaaugaagaagaagaacaaacauugacuauacuaauuagaacaggucuccugguaaucucagguguauucccgguaucaauaccaauuacugcagcagcaugguaccuaugggaagugaagaaacagagagccgguguuuugugggauguccccuccccacccccuguggaaaaagcggagcuagaagacggcgccuaccguauuaaacaaagaggaauacuuggcuacucucaaauaggcgccggugucuacaaagaagguaccuuucauacuauguggcaugugacacguggcgcugugcucaugcauagaggaaaaagaauagaacccaguugggcugacguaaagaaagaccuuauaucuuacggaggugguuggaaauuagaaggagaauggaaagaaggcgaagaaguucaaguacuagcauuagaaccaggcaaaaacccuagagccguccaaacgaaaccagguauauuuaagacaaauacagguacuauaggcgcaguaucuuuagacuuuucuccaggaacaagcggcagcccaaucguagauaggaaaggaaaagucguuggauuauaugguaauggggugguaacaagaucgggugcauaugucucagcuaucgcgcaaaccgagaaaaguauagaagacaaucccgaaaucgaagacgauauauucaggaagaaacgacugacgaucauggaucugcauccgggggcaggaaaaacuaaacgauauuuaccggcgauugucagggaagcaauuaaaaggggcuugcgaacauuaauacuagcuccgacccgcguagucgcagcggagauggaggaagcacuacgagguuuaccuauucgauaccaaacccccgcuauaaaaacagaacauaccgguagagagauaguggauuuaaugugucacgcuacuuuuacaaugagacuguuaucacccguccgaguaccaaauuauaaccugauuauaauggaugaagcgcacuuuacagacccugcgucaaucgcagcacgaggguauauuagcacaaggguggaaaugggagaagccgcggggauuuuuaugacagcaacuccaccaggaucaagagacccauucccucaaucuaaugcaccaauuauggacgaggaacgugaaauaccagaaagaagcuggaacucuggucacgagugggugacugacuuuaaagguaagacaguaugguuuguuccaagcauuaaagcgggaaaugacauagcggccugccuucgcaaaaauggcaagaaaguaauacaacucucgagaaaaacauuugacagugaauauguuaagacuagagcuaaugauugggacuuuguagugacaacggauauaagugaaaugggcgcaaacuuuaaagcagaaaggguaauagacccacguagauguaugaaacccguaauacuaacugacggugaagaacgagugauacuagcagguccaaugccugugacucauaguucagcagcucagaggcgcggcagaaucggaaggaauccuaaaaaugaaaaugaucaguacaucuauaugggcgaaccacuggaaaacgaugaagacugugcucacuggaaagaagcaaagauguuacuugauaauaucaauacuccggaaggcauuauaccuuccauguuugaaccagaaagagagaaaguagaugcaauagauggggaguaccgauuaagaggugaggcuagaaaaacguucguagacuugaugcgucguggagaccuucccgugugguuagcguauaaaguagcagccgaaggaaucaauuaugcggaccguaaaugguguuucgauggaaucaaaaauaaccaaauacuagaggaaaauauagaaguugaaauauggacaaaagaaggagaaagaaagaaacucaaaccacggugguuagacgcgagaauauacucagacccacuagcauuaaaggaguucaaagaauuugcugcgggucgaaagagccuaacccucaauuugaucacugaaauggguagacugccgacuuuuaugacacaaaaagcgagaaaugcucucgauaauuuagcaguauuacauacugcagaggcugguggacgcgcuuauaaucaugcacugagugaacucccagaaacacucgaaaccuuacuacuacuaacucuauuagcuacaguaacaggcgggauauuucuauuucucaugucagguaaaggaaucgggaaaaugacguuaggaauguguugcauaauaacagcuucaauauuguuaugguacgcccaaauccagccccauuggauugccgccucaauaauacuggaauuuuuccuaauaguguuacugauuccggaaccugaaaaacaaagaacuccgcaagauaaucagcuaacuuauguugucaucgccauuuugacaguaguagcagccacaauggcaaacgaaauggguuuucucgagaaaaccaagaaagaucugggcuuagguagcauaacuacacaagaaucugaaaguaacauccuagacauagacuuacguccggcgucagccuggacauuguacgcaguugccacaacauuuguuacaccgaugcuaagacauuccauagaaaauaguucgguaaacgugagcuuaacugcgauugcaaaccaagcgaccguauugaugggacuagggaaaggcuggccccugucuaaaauggauauuggagucccauuauuagcgauaggaugcuauucucagguaaaucccauaacuuuaacagcggccuuauuacuuuugguugcacauuacgcaauaauugguccaggccuacaagccaaagcaacaagagaagcacagaaaagggcugcagcaggaauaaugaaaaauccuacaguagaugggaucacugucaucgacuuagaaccaauuccguacgauccaaaguuugagaaacaguuaggacaaguaauguugcuaauauuguguguuacgcagguauuaaugaugcggacaacuugggcccucugcgaagcauuaacucuggcaaccggcccaauaaguacauuaugggaaggcaauccugguagauuuuggaauacuacaauagcgguaucuauggcuaacauauuccgaggcaguuacuuagcgggagcuggacucuuauuuucaauaaugaaaaauacaacaaacacuagacgaggcacuggaaacauuggagaaacguugggagaaaaauggaaaucacgucucaacgccuuagguaaaagugaauuucaagucuacaagaaaucugguauucaagaaguugauaggacucuagcuaaagagggaauaaaaagaggagaaaccgaucaccacgcugucucccguggaagugcaaaauuacgcugguuuguagagcgcaauaugguuaccccugaggguaaaguaguagacuuagguugcggaagagguggauggaguuauuauugcggaggccucaaaaacguaagagaaguaaaagggcugacaaaagggggccccggccacgaggaacccauuccgaugaguacuuauggcuggaaccuaguacgccuacaaucgggcguagauguauucuucacaccacccgagaagugcgacacacugcuaugugacauuggcgagucgagcccaaauccaacaaucgaagcaggaaggacacuccgaguuuuaaacuuggucgagaauuggcucaacaauaacacccaauuuugcauaaaaguguugaacccauauaugccaaguguaaucgagaaaauggaagcucuacaaagaaaauacgguggggccuuaguaaggaauccgcucucucgaaacagcacucaugaaauguauuggguaagcaaugcaacgggaaauauuguuucaagugugaauaugauaucuaggaugcuaaucaaucgauucacaaugaaacauaagaaagcuacauaugaaccagauguagaucuugggucaggcacccgaaacaucgggauugaaucggaaaucccuaauuuagacauaauaggaaaaaggaucgagaaaauaaaacaggaacaugagacaagcuggcacuacgaucaggaucauccguauaaaacaugggcuuaccaugggucauaugaaacuaaacaaacuggaucugcgucaagcaugguuaaugguguuguaagacucuugacaaaaccaugggauguagugcccaugguaacucagauggcaaugacagauacaaccccguuuggucagcaacgaguuuuuaaagaaaaaguagauacuagaacacaagaaccgaaagaaggcacaaagaaacugaugaaaauuaccgcagaaugguuauggaaagaauuaggcaagaagaaaacuccgaggaugugcacaagggaggaguucaccaggaaaguuagaucaaaugcagcuuuaggugcuaucuuuacugaugaaaauaaauggaaaagugcuagagaagcaguagaagauggucguuucugggaguuaguggacagagaacgcaaucuccaucuagaaggcaaaugugaaacuugcguguacaauaugaugggaaaaagagagaagaaauuaggcgaguuuggaaaagcgaaaggaagccgugccauaugguacaugugguuaggugcgagauucuuagaauuugaagccuuaggguucuuaaacgaagaccauugguucucaaggggaaauagucucucaggugucgaaggcgaagguuugcaccgauuagguuauaucuuacgagacguaggaaagaaggaaggcggagccauguacgcggaugauacagcagguugggacacacgcauaaccuuggaggaucucaaaaaugaagaaauggucacaaaccacaugaaaggagagcacaaaaagcuagcagaagcaauauucaaauuaaccuaccagaauaaaguagugagaguacagcggccaaccccacgaggcacaguuauggauaucaucucuagacgugaucaacgaggaucaggacaaguuggaaccuacggucucaauacuuuuaccaauauggaagcacaacuaauuagacaaauggaaggggaaggaauuuuuaaauccauucaacacuugacagcaacagaggagaucgcaguccagaauuggcucgcgagaguagguagagagagacucucucgcauggcaauaaguggagaugacuguguaguaaaaccaauugacgauagauucgcuucagcgcuuacugcacuaaaugauaugggaaagguaagaaaagauauacagcaaugggaaccgucgagaggauggaaugacuggacucaaguaccauucugcucgcaucacuuccaugaacucgugaugaaggauggacggguccuuguagugccaugcagaaaucaagacgaguuaauaggacgagcuagaauaagucaaggagcgggguggucacucaaagagacugccugccuaggaaaauccuacgcgcaaauguggacguuaauguacuuccaucggagggacuuaaggcuagcggcuaaugccauaugcagugcggugccgccacauuggguaccaacgaguagaacuacuuggucaauacacgcuaaacaugaguggaugacaacugaggacaugcuggcaguauggaauagaguauggauucaagaaaauccauggauggaagauaaaacaccaguugagucuugggaagaaguaccauaucuaggaaaaagagaagaccaauggugcggaagucuuauuggcuugacaagucgcgcgacaugggcuaagaacauacaaaccgcgaucaaucagguuagaucacuaauugguaacgaagaauauacagacuacaugccaucaaugaaacgcuuucgacgagaggaagaagaagccgguguacuuugguaa

SEQ ID NO: 22359 - RNA, 9876 nt, Artificial Sequence
  derived and/or modified CDS sequence (opt6) from DENV-2__FJ898439__SS-prME
acggcuggagugauuguaauguuaauaccaacggcaauggcauuccaucuuaccacucggaacggcgaaccacauaugaucguaggucgccaagaaaaagggaaaucgcuauuguucaaaacugaagauggcguaaauauguguacauuaauggcaauugaucuaggugaauugugugaggauacgauaaccuacaaauguccacuacugcgacaaaaugaaccagaggauauugauuguuggugcaacucaaccuccacuuggguaaccuacgguacgugcucgaccacaggagaacauagaagagagaaacggucaguugcauuaguaccucaugucggcaugggacuggagacaagaaccgaaacguggaugaguuccgaaggagcuuggaaacauguccagcgaauagaaacauggauccuaaggcauccaggauucacaauuauggcagcgauacuggcuuauaccaucggaacuacacacuuucaacgugcucugaucuuuauucuauuaacugcaguugcaccaucgaugacaaugagauguauuggaauaagcaaucgagacuuugucgaaggcguuucagguggaucuuggguagauauuguuuuggaacaugggucaugcguuacaaccauggcaaaaaacaagcccacauuagacuuugaguuaaucaaaacagaagcgaaacagccagccacacuaagaaaauacuguauagaagcaaaauuaacuaacaccacaacagaaaguagauguccgacacagggagagccgagccuuaaugaagagcaagauaaaagauucauauguaaacacuccaugguagauagaggauggggaaauggcugcggccuuuuugggaagggugggauuguuaccugugcaauguuuaccugcaaaaagaacauggaaggaaaaguuguucagccagaaaaucuagaauacacaauagucauuacaccccauaguggugaagagcaugcugucggaaacgauacuggcaaacacggaaaagaaauaaaaauuacaccacaaaguucaauaacggaggcagaguuaaccggcuacggaacggugaccauggaaugcuccccgcggacuggacuagauuucaaugaaauggugcuucuacagauggaggauaaggcguggcuuguacauagacaaugguuccuugacuugccccuaccuuggcuucccggagcagacacucaagggagcaacuggauucagaaggagacacugguaacauucaagaauccacaugccaagaagcaagaugucguagugcuggggagucaagaaggugcaaugcauacugcauugaccggagcaacagaaauacaaaugucuuccggaaacuuauuguucacuggucaucugaaaugcagacuuagaauggauaaauugcaacuaaaagguaugucauauuccauguguacaggaaaauuuaagauaguuaaagaaauugcagagacacaacacggaacuauagucauacgcguacaguaugaaggcgacgguucaccuuguaaaauuccuuuugaaauaacugaucuugaaaaaagacauguauuaggaagacugauaacaguuaauccaaucguaacugggaaggauucuccggugaacauugaagcggaaccaccuuucggcgauucuuauauaauuauaggaguggaacccggccagcuaaaacuuaauugguuuaaaaaaggaaguuccauuggucaaauguuugaaacgacgaugagaggagcgaaaagaauggcuauacucggugauaccgcaugggauuuugguagucuagggggcgucuucacuucaauaggaaaagcucuucaccaaguuuucggggcaaucuacggagcagccuucucaggcgucaguuggacuaugaaaauacuaauuggaguaauaauaacuuggauugguaugaauucccgcucuaccagcuuaucuguaagucuaguuuugguagggguaguuacacucuauuugggggcaaugguucaagcugauucaggaugcguagucucauggaaaaacaaagaacuuaaguguggauccggaauauuuauaacugauaacguacauacguggacugaacaauacaaauuccagccugagucgccuucuaaauuagcgagugcaauacaaaaagcgcaugaagaaggaauuuguggcauccgaagugucacacgccuagaaaaccugauguggaagcaaaucacacccgaacugaaccacauucugagcgaaaacgaaguaaaauuaacgauuaugacuggcgauauuaaagguaucaugcaagccgguaaacgaagccugaggccucaaccuaccgagcugaaauacucauggaagacauggggaaaggcaaaaauguuaaguacagaaucucauaaccaaacguuucucauagacggaccagagacagccgaaugcccaaacacgaauagggccuggaauucccuagaagucgaagauuacggauuuggcguauucacaaccaauauauggcuaaaacugcgcgaaaaacaagauguauucugcgauuccaaguuaaugagcgcugccauaaaagacaaucgugcgguccacgcggauauggguuacuggauagaaucagcacuuaacgauaccuggaagauggaaaaggcuaguuuuauagaaguaaagagcugucauuggccaaaaucacauacguuauggagcaauggggugcuagaaucugagaugauuauuccgaaaaauuuugcaggcccaguaagucagcacaacuauagaccaggguaccacacucaaaccgcugguccguggcacuuagggaaacuugaaauggauuucgaucucugcgagggaaccacaguugucguaacggaggacuguggcaaucgaggaccaucacuacguacgacaacggcgagcggcaagcuuauaacggaauggugcugucguucauguacauuaccgccacuuagauaccgaggagaagaugguugcugguacggaauggaaauacguccacuuaaagaaaaagaggaaaauuugguaaauucucugguaaccgccggacauggccaaguugauaacuuuucccuaggcguacugggaauggcucucuuucuagaggaaaugcuucgaacaaggauuggaaccaaacaugccauucugcuaguagcagcaucauuugugacacuaauaaccgguaauaugucauuucgagaucugggacgggugaugguaauggucggagcgacuaugaccgaugauauagguaugggggugacauaucuggcgcuuuuggcugccuuuaaaguucgccccacauuugcugcuggauugcuguuaagaaaacuuacaaguaaggaacuuaugauggcuacuauaggcauagcccuguuaucgcaaucaacaauaccagaaacaauauuagaauuaacggaugcauuagccuuggguaugaugguacuaaaaauuguccguaacauggaaaaguaccaacuagcaguaacuaucauggcuaucucauguguccccaacgcaguaauacuacagaaugcguggaaaguuucaugcacaaucuuagccgcuguaucaguuucuccauuguuacuaacaaguucccaacaaaaagcggauuggauucccuuggcauuaacuauaaaaggauuaaauccuacggcuaucuuccucacaacucuuagucgcacuuccaaaaaaaggagcuggccccuuaaugaagcgguaauggcagugggaaugguaucuauacuugcgagcucucuucuaaaaaaugauauuccgaugaccggaccuuuaguugcuggcggacuauuaacgguauguuacgucuugacuggccgaucggcagauuuagagcuagaacgugcugcagaugugaaaugggaagaccaagcugaaauaagcggguccucgccgauccuuuccauaaccauaucggaagauggcucaaugucaauuaaaaacgaagaagaagaacaaacauuaacgauuuuaauaaggaccggcuuacuaguaaucucaggaguguucccaguaaguauaccgauuacagcagccgcaugguauuuaugggagguuaaaaaacagagagcaggugucuuaugggacguaccaucgccgccgccgguagagaaagcagagcuagaagacggugcuuauaggauaaaacaacguggcauacuagguuauagucagauaggagcagggguauauaaagaaggaacauuucauaccauguggcacguaacucguggcgcugugcuuaugcauagggguaaaagaauugaaccuucuugggcagacguaaaaaaagauuuaaucaguuaugguggaggguggaaacuagaaggagaauggaaagaaggagaagagguacagguacucgcauuggagccaggaaagaauccgcgggcgguucaaacuaagccagguaucuucaaaacgaacacaggaacaauaggcgcagucucgcucgacuuuaguccugguaccaguggaagcccuauaguagaccggaaaggaaagguaguuggauuauacggcaauggaguagucacgcgcuccggggcauacgugucagcaauugcucaaacagaaaaaucaauugaggauaacccagagauagaagacgauaucuucagaaaaaaaagacuuacaauaauggaucuccaccccggagcaggcaaaacaaaaagauauuuaccagcaauaguuagagaagcgaucaaacgaggacuccguacauuaauacuagcuccaacacgaguaguagcugcugaaauggaggaggcuuuacgaggacuuccaauacguuaucaaacaccggcaauaaaaacagagcacacuggccgagaaaucguggacuugaugugucaugcaacauuuaccaugagacuccuuucuccuguacguguaccuaauuauaauuuaauaauaauggaugaagcccauuucacagaccccgcuagcaucgcagccagaggauauauuagcacucgagucgaaaugggggaagcagcaggcauauuuaugacagcaacuccuccaggaaguagggacccauuuccacagaguaaugcgccuauaauggaugaagaacgagagauaccugaaagauccuggaacucuggacacgagugggugacggacuucaagggaaagaccgucugguuugugccaucgauaaaggccgggaacgauauugcugccugucucagaaaaaacggcaagaaaguuauacaguugucaagaaaaacguucgacucagaguauguaaagacccgagcaaaugauugggauuuugugguaaccacagacauuucagaaaugggcgcaaacuucaaagccgaaagggucauagacccuaggagguguaugaaaccuguaauuuuaacugauggcgaagagcgaguuauucuugcaggaccaaugccgguuacucauuccucagcugcucagagacgaggaagaaucggacgcaaccccaaaaaugaaaaugaucaguauauauauaugggugaaccguuagagaaugaugaagauugugcucauuggaaagaagcuaaaauguuacuagauaauauuaauacucccgaaggaaucaucccaaguauguucgaaccagaacgagaaaaaguagaugcgauagauggggaauacagauuaagaggagaagcaagaaaaacauuugucgauuuaaugagacgaggggauuuaccggucuggcuagcuuacaaagucgccgccgaagggauaaacuacgcagauaggaaauggugcuucgaugguauaaaaaauaaucagauuuuggaagagaauauggaaguagagauuuggacaaaagagggagaacguaaaaaguuaaagccgcgguggcuggaugcacgaauauacucagauccuuuagcuuuaaaggaauuuaaagaauuugccgcuggaaggaagucauuaacgcucaaccuaauuacggaaaugggucgacuacccacuuuuaugacccaaaaggcucguaacgcuuuagacaaccucgcaguacugcauacggcagaaacaggcggcaaagcauauaaucacgcccuaagcgaguuaccggagacuuuagagacauuauuguuacuaacacuucuagcgaccgucacaggagguauauuucuauuuuuaaugucugggaaagguauagggaaaaugacgcuugguaugugcuguauaauaacagccucaauucugcuaugguacgcacaaauucaaccgcauuggauagcagcaucaauaauucuagaauuuuuuuuaauaguacuauuaauuccugaaccugaaaaacaaagaaccccacaagauaaccaacuaacuuacguggucauagcgauuuugacaguaguagcagcuacaauggccaaugaaaugggauuucucgaaaaaacuaaaaaggauuuaggauucggaaguauuaccacacaagagucugaaagcaauauuuuagacauagaccucaggccagcaagugccuggacacuauaugcagucgcaacuacuuucgucacucccaugcuucgacacagcauugaaaauucuucggucaaugucucacugaccgccaucgcgaaucaggcuacagugcuaaugggcuuaggcaaaggauggccccuaucuaaaauggauauaggcguaccucuguuagccauagguugcuauucacaggucaauccaauaacccuaacugcagcgcuccuucucuugguugcucauuaugccauugugggucccggccugcaggccaaagcaacucgagaagcacaaaaaagagcugcggcagguauuaugaaaaauccaacgguagacgguauuacagucauagacuuagagccuauaccauaugacccaaaauucgaaaagcagcugggccagguaaugcucuuaauuuuaugcgugacucaaguucuaaugaugagaacaaccugggcccuaugugaggcauuaaccuuagcaacagggccaaucaguacgcuaugggaggggaaccccgguagauucuggaauaccaccauugcaguauccauggcaaacauuuuccgugggucguauuuagcaggcgcaggccuuuuauuuuccauaaugaaaaacacaacaaauacuagaagagggacagguaauauaggagagacacugggagagaaauggaaaucucgucuaaaugcauuggguaagucugaguuucaaauuuacaagaagucugggauccaagaaguagacagaacacucgcaaaggagggaauaaaaagaggggaaacagaucaccaugcuguuagcagaggcucugcaaaacuacgaugguuuguugaacguaauauggugacaccggaagggaaaguuguagauuuagguugcggcaggggcggcuggucuuauuacugcggaggguuaaagaauguccgagaaguuaaaggguuaacaaaaggaggaccuggacacgaagaaccaaucccaaugagcaccuacggauggaauuuaguaagguuacaaucaggagucgauguguucuuuacacccccggaaaaaugugacacccuucugugugacauuggagaaagcaguccuaauccaaccauagaagcaggucguacauuaagaguucuuaauuuaguagaaaacugguuaaauaacaauacacaauucugcauaaaaguacucaauccauauaugccgucagucaucgaaaaaauggaaacguuacagcguaaguacggaggugcauuaguacggaacccuuuaagcagaaauucaacacacgaaauguacuggguguccaacgcgacaggaaauauaguuucaucgguaaacaugauaucuaggauguuaauaaauagguucacaaugaagcauaaaaaggccacuuacgaaccggauguggaccuuggaagcggaacuagaaauauaggaauagaaagcgaaaucccgaaucuugacaucauuggcaaaagaauugagaaaauaaaacaggaacaugagacuucauggcauuaugaucaagaucauccauauaaaacgugggcauaucauggcucuuacgaaacaaaacagaccggcagcgcaaguucaaugguaaacggagucgugaggcuguugacgaaaccuugggacguaguacccauggucacgcaaauggcaaugacagacacaacaccauucggucaacaaagaguguuuaaggaaaaaguagacacgcgaacccaagaaccuaaggaagguacaaaaaaauuaaugaaaaucaccgccgaaugguuauggaaggaacugggaaaacguaagacuccucguauguguacacgugaagaauuuacaagaaagguuagaucuaaugcugcgcucggagcaauauuuacugacgaaaauaaauggaagagugcacgcgaagccguagaggauggacgauuuugggaacucguagauagagaacgaaacuuacacuuggaaggaaaaugugagacauguguauauaauaugaugggaaaaagagaaaagaaacucggagaauuugguaaagccaaagggucacgagcuaucugguauauguggcuaggcgcuagauucuuggaauuugaagccuuaggauuucuuaaugaagaucauugguuuaguagagggaauagcuuaagcggugucgaaggagaaggucuccauagacuuggguacauacuaagagacguaggcaagaaggagggcggcgcuauguaugcagaugauacagccgguugggauaccagaauuacguuagaagauuuaaaaaaugaggaaaugguaacuaaccacaugaagggagagcauaaaaaacuagccgaagcaauauuuaaacuuacauaccaaaauaaagucguacgaguacagcgaccaacaccucgcgggacaguuauggacauuauaagcagaagggaucaacgcggaucaggacaaguugguacguauggguugaauacuuuuacgaauauggaagcgcaacuaauucgccaaauggagggcgaaggaauuuucaaaucuauacaacaucucacggccacagaagaagucgcaguucaaaauuggcuugccagggugggucgugaacgauuaucaagaauggcuauauccggugaugauugcguuguaaaaccuauagaugaccgauucgccagugcguuaacugcguugaaugauauggguaaaguccgaaaggauauucaacaaugggagccuucgcggggguggaacgauuggacucaaguaccuuucuguagccaccauuuccacgaguuaguaaugaaagacggacguguuuugguagucccaugucguaaccaagaugaauuaaucggacgggcccgaauuucacaaggugcaggauggucguuaaaagagacugcuuguuuaggaaaauccuacgcucaaauguggacacugauguacuuucacaggagagaccuacgacuggcggcuaaugcaauaugcucagcaguacccucccauugggucccgacuaguagaacgacauggucaauucacgcaaagcacgaguggaugacuacagaggauauguuagccguauggaauagaguguggauucaagaaaauccuuggauggaagacaaaacccccgucgaaagcugggaagaagucccauaccuaggaaaacgggaggaucaauggugugguucucuaauugguuuaaccucccgcgcaacuugggcaaaaaauauucaaaccgcaauaaaucagguucggucauugauagguaaugaagaauauaccgacuacaugccaaguaugaagagauuucgucgggaggaagaagaagcuggaguacugugguaa

SEQ ID NO: 22360 - RNA, 9876 nt, Artificial Sequence
  derived and/or modified CDS sequence (opt6) from DENV-2__GQ868588__SS-prME
acugcuggaaugauaauaaugcugauuccaacuguaauggcauuucacuuaaccacuagaaacggagaaccucauaugauaguuucaagacaagaaaaaggaaaauccuuauuauucaaaacuaaagauggaacuaacauguguacgcuuauggcacuagaccuuggagaacuaugcgaagacacaaucaccuacaaaugcccuuuucuaaaacaaaaugaaccagaagauauugauuguuggugcaacaguacaagcacaugggucacauauggaacguguacaacaacuggagaacauagaagagagaaaaggucaguagcucuagucccacauguaggcauggguuuagaaacgagaaccgaaacauggaugaguucugaaggagcauggaaacaugcacaacguauagaaacguggauuuugcgacauccgggauuuacuaucauggcagcuauauuggcguauacgauaggaacaacccauuuccaaagaguauuaauuuuuauucuauuaaccgcaauugcuccaaguauggcaaugagguguauagguauaagcaaccgagacuuuguagaagguguaucaggaggaucguggguugauauaguuuuagaacauggauccugcgugacuacaauggccaaaaauaaaccuacguuagauuuugaacuaauaaaaacagaagcuaaacagccugcaacucuuagaaaauauugcauagaagcaaaacuaacaaacacuacaacagauucacgcuguccuacccagggcgaaccaacguuaaaugaagaacaagacaaaagauuugucuguaaacauucaaugguugacaggggaugggguaaugguuguggguuguuuggaaaaggagggauaguaacuugugcaauguuuacauguaagaaaaauauggaagguaaaauuguucaaccggaaaauuuggaauauacagugguuauuaccccgcacucuggugaagaacaugcugugggaaaugauacagggaaacaugguaaagaagugaaaaucacaccccaauccaguauaacugaagcggaacuaacuggauacgguacgguuacgauggaauguaguccuagaacaggucuagauuuuaaugaaauggugcuacugcaaauggaagauaaggcuugguuaguacaucgacaaugguuuuuagauuuaccguugccuuggcugccuggagcagauacacaaggaaguaauuggauacaaaaagaaacucuagucacuuuuaagaauccucaugccaagaaacaagaugugguuguuuuaggaagucaagaaggagcaaugcauacagcucucacaggagcaacggaaauacaaaugaguucaggcaaucuauuguuuacagggcauuuaaaauguagguugcggauggauaaacuucaauuaaagggaaugucauauaguauguguaccggcaaauuuaaaaucguuaaagaaaucgcagagacccagcacggaaccauaguaauuaggguacaguacgaaggcgacgguaguccauguaaaauccccuuugaaauaauggaccucgagaaaagacacgugcucgggaggcuaaucacuguaaacccgauugucacggagaaagauaguccagucaacauugaagcggaaccaccuuuuggcgauucauacauaauaauaggaguagagccagggcaacucaaacuagacugguuucgaaaaggauccucuaucggccaaauguuugaaacaaccaugcgcggugcaaagagaauggcuaucuugggggacaccgcaugggacuucggaucacuaggugguguauuuacaucaauuggaaaggcuuuacaccaagucuuuggagcuauauacggugcggccuuuucuggcguuaguuggacuaugaaaauccuaauaggggugauuaucaccuggauaggaaugaacucaagaagcacgucucuuucagucagccuaguauuaguugguauaguaacuuuauacuuaggugugaugguacaagcagauucaggauguguaguuuccuggaaaaauaaggaauuaaagugcggauccggcauuuuuguaaccgacaauguucauacguggacagaacaauauaaguuccagccugaaucgcccagcaaauuagcuagcgcgauucaaaaagcucaugaagaaggcaucugugggauuaggucaguuacaagacuagagaacuuaauguggaaacaaauaacuagcgaacuuaaucacaucuuaagugaaaacgaagugaagcucacuaucaugacuggugacauaaaaggaauaaugcagguaggaaaaagaucacugcgaccacaaccuaccgaauuaagguauaguuggaaaaccuggggcaaggcaaagaugcugaguacagagcuccacaaucagacauuccuaaucgacgguccugaaacugcggaguguccaaacacuaacagggcauggaauagcuuagagguagaagauuacggauucgguguauuuaccacuaacaucuggcuacgauuaagagaaaaacaagacguguuuugcgauagcaaguugaugagugcagcaauaaaggauaaccgggccguacacgccgauaugggauauuggauugagagugccuuaaacgacacguggaaaauugaaaaagcauccuuuaucgaaguuaaaucuugccauuggccgaaaagucauacuuuauggucuaaugguguccuggaaagugaaaugguaauucccaaaaauuucgcaggucccguaagucagcacaauaaucgcccuggauaucacacucagaccgcagguccguggcaucuagggaaacucgaaauggacuuugauuucugcgaggguacuacagucguugucacggaagaaugcggaaaccgggggccgagucuccgaaccacgacggccucggggaaacuaauaaccgagugguguugucgaagcugcacauugccaccccuaagauauaggggugaagauggauguugguaugggauggaaauaagaccgcuuaaggaaaaagaagaaaaccuuguuagcucucuagugacagccggacacggacagaucgauaauuuuagucuugggauacuuggcauggcauuauuucuagaagaaaugcugagaacuagaguaggcacaaaacacgcgauccugcuaguagcugucagcuuuguuacauuaauuacuggaaauaugucguuuagagaucuagggagaguuauggucauggugggugcuaccaugaccgacgauauagggauggguguaacuuaucuugcccuccucgcugccuuuaaagucagaccgacauucgcugcaggauuauuauugcggaaacuuacuucaaaagaauuaaugaugacuaccauagguauaguacuauugagucagucaucaauaccagagacgauauuggaacuuacagacgcccuagccuuaggaaugaugguacucaaaaugguaaggaacauggaaaaauaucaauuagcggucacaaucauggccauuuuaugcgugcccaaugcagucaucuuacagaaugccuggaaagugaguuguacuauauuggcaguaguuucuguuucaccacuccuucuaacgucuucccaacaaaaggcagauuggauuccacuagcucuaaccauuaaagggcuaaauccgacugcuauuuuucuaacuacuuuaucgcgaacaaguaagaaaaggucguggccauuaaaugaagcgauaauggcuguggggauggucucaauacuagcaucaucgcuguugaaaaaugacaucccaaugacagggccuuuaguagcggguggacuacuuaccguaugcuaugugcuaacaggacggucagcggaucuagaauuggaaagagcaaccgauguaaaaugggacgaccaagcagagauaagcggauccucaccgauccuuucaauaacaauuucagaagacgguaguaugagcauuaaaaaugaagaagaagaacaaacguuaacaauacuaauaagaacugggcuguuggugauaucuggauuauucccuguaucgaucccgauaacggcggccgcaugguacuuaugggaggucaagaaacagcgcgcggggguauuaugggacauuccaaguccgccaccaguaggaaaagcugaacuagaagauggcgcguaccgaaucaaacagaaagggauacuuggcuacucgcaaauaggugcugggguguacaaagaaggaacuuuucacacgauguggcauguuacaagaggagccgucuuaaugcacaaagguaaaagaauagaaccuaguugggcugauguaaagaaagaucucauaucuuaugggggaggcuggaaauuggaaggugaauggaaagagggggaagaaguacaaguucuagcauuagaaccuggcaaaaauccacgagcgguucagaccaaacccggacuauuucggacuaauacagggaccauaggagcagucuccuuagacuucuccccggggacaaguggaucacccauagucgauaagaaaggaaaagucguuggcuuauauggcaauggggugguuacgcgcucaggcgcguaugugucagccauugcccaaaccgaaaaauccauugaagacaacccagagauagaagacgacauuuucaggaaacgaaggcucacuauaauggaucuacauccaggcgcaggaaaaacaaagaaauaccuucccgcaauuguuagggaggccauuaaaagagguuuacgaacuuuaaucuuagcuccaacucggguaguugccgcugaaauggaagaagccuuacgaggcuugccaauaagguaccaaacucccgcuauacgcgcggaacacacuggaagagaaauagucgauuugaugugucaugcaacauuuacuaugcgauuacucucaccuauacgagucccaaacuacaauuugaucaucauggacgaagcacauuuuacagauccggccagcaucgcagcgcguggauauaucaguacucgaguagaaaugggagaagcagcugguaucuuuaugacugcaacaccuccagggucucgggauccauucccucaaucuaaugcaccuaucauggaugaagaaagagaaauaccagaacgaaguuggaacucaggacaugaauggguaacggauuuuaagggaaaaacugugugguuuguaccaucuauaaagacaggaaacgacauugcagcaugucuuaggaaaaaugguaaaagagugauacaauugucuaggaaaacauucgacagcgaauauguaaaaacaagaacaaaugacugggacuuugucgugacaacagauauuucggaaaugggcgcaaacuuuaaagcagagcgagugauugauccacgucgcuguaugaaaccaguaauucuaaccgauggggaagaaaggguaauacucgccgguccaaugccaguaacacauagcuccgcggcacaaagaaggggcagaaucggacgaaacccgagaaaugaaaaugaucaauauauauauaugggagaaccauuggaaaacgacgaagauugugcacacuggaaagaagcuaagaugcuauuggauaauauaaacacuccagaaggaauaauaccaaguauguuugaaccagaacgagaaaaagucgacgcaauagauggagaguauaggcuaagaggagaggcaaggaaaacuuucguugaucuaaugcggagaggagaccuaccggucuggcuugcguauaaaguagcaucagaaggcauaaauuacgcugauagaaggugguguuucgacggaaccaggaacaaucaaauacuggaagaaaauguagaaguggaaaucuggacaaaagaaggugaacgaaagaaacuaaagccuagaugguuagaugcucguauauacagugauccccuagcccugaaagaauuuaaagaguucgcggcuggaaggaagagucuaacucucaauuuaauaaccgaaaugggccgacucccuacguuuaugacucagaaagccagggaugcgcuggacaaucuggcaguacuucauaccgcagaagcgggugguaaagcguauaaccaugcauuauccgaacuuccugaaacauuagagacucuauugcuguuaacuuuguuagccacaguaacugggggaauauuuuuauucuuaaugucuggacgugggauaggcaaaaugacgcucggaaugugcugcauuaucacggcaaguauauuauuaugguacgcucagauucaaccucacuggauagcugcuuccauaauauuggaguuuuuccucauaguauugcuaaucccugaaccagaaaaacaaagaacuccacaggauaaccaauuaacguacguuauaauagcaauucucacugucgucgcagcaaccauggcaaacgaaaugggauuccuagagaaaaccaagaaagaccucggucugggacauauagcaacccaacaaccugaaagcaacauucuagacauagauuuacggccggcuucggcauggacucuauacgcuguggcaacuacuuuuauuacaccgaugcuaagacacagcauugaaaacaguuccgugaaugugagucuaacggccauagcaaaccaggcaacaguccuuaugggacuaggaaaaggcuggcccuuaucuaagauggauaucggggucccgcucuuggcgaucggcuguuacucgcaagucaauccaauuacauugacugcugcauuauuacuucucguggcucacuaugcaauaauagguccaggccuccaagcaaaagcgacaagggaagcacaaaaacgagcagcggccgguauuaugaaaaacccaacaguagacgggauaacugucauugacuuggaucccauucccuaugauccgaaauuugagaaacaguuaggucaaguaaugcugcuuguuuugugcgugacacagguauuaaugaugaggaccacaugggcgcuaugcgaggcacuuacuuuggcaaccggcccaguuucgaccuuaugggagggaaacccaggacgguuuuggaacacuacaaucgccgucuccauggcaaacauauuuagaggaucauaucucgcuggggcaggcuuacuuuuuagcauuaugaaaaauacuacaucaacacgccgaggcacugguaacauaggugaaacucuuggagaaaaauggaaaaguagacugaaugccuugggaaaaagcgaauuucagauauauaagaaaucagggauacaagaaguggaucggacccuugcaaaagaaggcaucaagagaggagagacagaucaccacgcaguaucaaggggcagcgcaaaacuccggugguucguagaaaggaaucuaguaacaccagaggggaaaguaguugauuugggauguggacgaggaggguggucauacuacugcggaggacucaaaaauguaagagaaguaaaagguuuaacuaaggguggcccuggucacgaggaacccauaccaaugaguacguacgguuggaauuuaguacgacuacaauccggagucgacguauucuuuguaccgccagaaaagugcgacacacuacuuugugauauuggagaauccaguccuaacccuacaguagaagcagggagaacuuuacgagucuuaaaucuugucgagaacuggcuuaacaauaacacgcaauucugcgucaagguauuaaauccuuacaugcccucaguaauugaaaggauggaaacauuacaaagaaaguaugguggugcucucguaaggaauccccucucuaggaacuccacccacgaaauguacuggguaucgaaugcaagcggaaacauaguaagcaguguaaauaugauuaguaggaugcugauaaauagauucacaaugagacacaaaaaggcuacauaugaaccagauguggauuuaggaucuggaacccgaaauauuggaauagagucugaaacuccgaauuuagauauuauuggaaaacgcaucgagaaaauaaaacaggagcaugaagcaagcuggcacuaugaucaagaucacccuuacaaaacgugggcuuaucacggaucauaugagaccaaacaaacagguucagcgaguagcaugguuaaugggguggucagguuauuaacgaagccaugggauguugucccaaugguaacacaaauggcaaugaccgacacgacaccguucgggcaacagaggguauucaaagagaaagucgacacucguacucaagaacccaaagaaggaacuaagaaauugaugaaaauaacagcagaguggcuauggaaggaauugggcaagaagaaaacuccucguaugugcacgagagaggaguucaccaagaaaguaagaaguaacgcugcuuuaggggcaauauuuacugaugaaaauaaauggaaaucagcccgugaagcuguugaagauaauagguucugggagcuagucgauaaagaacggaaucuacaccuggagggaaaaugcgaaacauguauauacaacaugaugggaaaacgggaaaagaaauuaggugaguucggcaaagcaaagggcucuagagcaauaugguacaugugguugggugcuagauuucuagaguucgaagcauuagguuucuuaaaugaggaucauugguucucucgagagaauaguuuauccggcguugaaggggagggucuucacaaguuggguuauauauugagagaagugucaaagaaagagggaggagcuauguacgccgaugauacagcagguugggauaccaggauuaccauagaagaucucaaaaaugaagaaaugauuacgaaucacauggcaggagagcauaagaaauuggcggaagcgauauuuaaacuuacauaccaaaacaaaguuguaagaguccaaagaccuacuccgagaggaacgguaauggauauuauuagucgucgugaucaaagaggaagcgggcaaguuggaacuuacggccucaacacuuuuacuaacauggaggcacaacucauacgacaaauggaaggagaaggcauauuuaaaucaauucaacauuuaaccgcgagcgaagaaauagcaguacaggauuggcuuguccgaguaggccgggaaagauuaucccggauggcgauuucaggagaugauugcguuguaaaaccacuagacgaccgcuucgcuagggcacuaacugcacuaaacgauauggguaaaguaaggaaagauauccaacaaugggaaccuucuagaggauggaaugacuggacacaaguacccuucuguucacaccacuuucaugagcucauuaugaaagauggucguauauuaguggucccgugccgaaaccaggaugaacuaauagguagggcgagaaucucgcaaggagccggcuggucacuccgugaaacagccugucuuggaaaauccuaugcucaaauguggagucuuauguacuuccauaggagagaccuuagacuagcagcaaacgcaauuuguagugccguaccaucgcauuggguaccaacaaguaggaccacuuggucaauucaugcgagccaugaguggaugaccacggaggacaugcugaccguauggaauagggucuggauacuugaaaacccauggauggaagauaaaacgcccguugaaucuugggaagaaaucccuuauuuagggaaaagagaggaccaaugguguggcucucugauaggucuaacaucgagagcuacuugggccaaaaacauacaaacagccauaaaucaaguacgaagucuaauaggcaacgaagaauacacagauuacaugccuaguaugaaacgauuuagacgagaagaagaagaagccgguguacugugguaa

SEQ ID NO: 22361 - RNA, 9876 nt, Artificial Sequence
  derived and/or modified CDS sequence (opt6) from DENV-2__GQ868590__SS-prME
acagcugggaugauuauaauguuaauuccuacaguuauggcuuuccauuugacuacccggaauggagaaccacauaugauaguaagucggcaagaaaaagguaaaucucuucuauuuaaaaccaaagauggaacaaacauguguacguuaauggcaauggauuuaggcgaauugugcgaggauacaauaacuuacaaaugccccuuuuuaaaacaaaacgaacccgaagauaucgacuguugguguaauaguacaaguaccuggguaacguacgguacaugcacuacaacgggagagcaccggagagaaaaacguuccgucgcauuaguaccacauguaggaauggggcuagaaacacgaacggagacguggaugucuagugaaggggcauggaaacacgcucaacguauugaaacguggauacugagacacccaggguuuacuauaauggcagcaaucuuagcauauaccauuggaacuacacauuuucaacgaguccuaauauucauacuauugacugccauugcgccaaguaugacaaugcgaugcauagggauaucgaauagagacuuuguugaaggugugaguggaggcucguggguggauaucguauuggaacacgguaguuguguaacaacuauggccaaaaauaaaccaacacuugauuuugaguugauaaaaacugaagcaaaacaacccgcuacacucagaaaauacugcauagaggccaaauugaccaauacaacaacagacucuagauguccaacacaaggggaaccaacauugaaugaagaacaagauaaaagguucguaugcaaacauucaaugguagauaggggcuggggcaacggaugcggucuauucggaaaagguggaauuguuacaugcgccauguuuacaugcaagaaaaauauggaggguaaaaucguccaaccagaaaaucuagaguauaccgucguuauuacaccucauucaggugaagaacaugcaguaggcaaugauacagggaaacauggcaaagaaguuaaaauaacgccccaauccucaaucacagaagcugaacugacaggauacgguaccguaacaauggaauguuccccucgcacuggacuggauuucaacgaaaugguguuauugcaaauggaagauaaagcauggcuuguucaccgacaaugguucuuagaucuaccacuaccuuggcucccaggagccgacacacaaggaucuaacuggauccagaaagaaacuuuaguuacguuuaagaacccgcaugcuaagaaacaagauguuguuguucucgggucucaagaaggugcuaugcauacggcucuaacuggugcaaccgagauacaaaugaguaguggcaaucuauuauucacaggacaccucaagugcagacuucggauggauaaauuacaauuaaaaggcaugagcuauucuaugugcacggggaaauuuaaaauagugaaggaaaucgcagagacacaacauggaacaauuguaauucgaguccaauacgaaggggauggaagcccuuguaaaauaccauuugaaauaauggauuuagagaaaagacacguauuagggagacugauaacggucaacccgauaguuacagaaaaagacucgccagugaauauagaggccgaaccgccauucggcgauucguauauaauuauugguguugaaccgggacaguugaaacucgauugguuuaagaaaggaucuuccaucggacaaauguucgaaacuacaaugagaggcgcuaaacguauggccauuuuaggugacaccgccugggacuuuggaucacuugguggaauguucacgaguauagguaaagcccuucaccagguauucggugcaauauauggagcugcguucucgggcgucagcuggaccaugaaaauauuaauuggagucauaauaaccuggauaggaaugaacucgagaaguacgucgcucagugugucgcucguacucguaggaaucguuacgcuguacuugggcguaaugguacaagcagauucugguuguguaguaagcuggaaaaauaaagagcugaaaugcggcagugguaucuucguuaccgauaacguccauacauggacggagcaauauaaauuucaaccugaauccccguccaaauuagcuagugcaauucaaaaagcacaugaagaaggaauaugcgguauaagaagugugaccagauuagaaaaccugauguggaaacaaauaacccccgagcucaaucacauacucuccgagaacgaaguuaagcuaacaauaaugacaggggacacuaaaggaauaaugcaaguggggaaaagaucauuaagaccacagccaaccgaacuacgauacucuuggaagacauggggaaaagcaaaaauguuaccaacagaauuacacaaucaaacauuccuuaucgacggaccagagacugcagaguguccaaauacuaaccgagcguggaacucacuagagguagaggacuauggcuuugguguauucacaacaaacauaugguugagauuacgggagaaacaagacguauuuugugacucuaaacuuaugagugcugcgauaaaggacaauagagcaguacaugcugauauggguuauuggauagaauccgcacuaaacgacacauggaaaaucgagaaagccucauuuauugaagugaaaagcugucauuggccuaaaucucauaccuuauggaguaaugguguucuggagagcgaaaugguaauaccaaagaaccuagcggguccugugagucaacauaacaauagaccuggauaccacacucaaacugccggcccauggcaucucgguaaacuugaaauggauuuuaauuuuugugaagguacaacgguaguggugacugaagagugcgguaaucgaggucccucguuacguaccacaacagccagugggaaguuaauaaccgaauggugcugccgaaguugcacacuuccaccacuacgauauagaggugaagauggauguugguaugguauggagaucaggccgcuuaaagagaaagaagagaacuuaguaagcagucuagugacagcaggacauggacagauugauaacuucagucucggaauuuuagggauggcucucuuucuagaagaaaugcugcguacuagaguaggaacaaaacacgccauacuauuggucgcuguaucauuugucacacuaauuacaggaaacaugucuuucagagaucuggguagagucaugguaauggucggggcaaccaugacggaugacauuggaaugggagucacuuacuuagcguuacucgccgcauauaaagugcguccaacauucgcugcaggccuacuccugagaaaacugacuagcaaagaauuaaugaugacgacgauagguaucguuuuguuaagccaaucauccauaccggaaacuauuuuggaauuaacagaugcauuggcacucggaaugaugguacuaaaaaugguacgcaauauggaaaaauaccaacuggccguaacgauaauggccauauuaugcguaccaaaugcuguaauccuucaaaaugccuggaaagugucuugcacuauauuggcaguugucuccguaucaccccuacuacugacaucgucucagcagaaggccgauuggauaccacuggcucucacaauaaaggguuugaacccaaccgcaauauuuuuaacaacacuaagcagaacaucaaagaaacgcucauggccacuuaaugaagccauuauggcgguaggaauggugucaauccuugcuucuagccuuuuaaagaacgauaucccaaugacggguccauuaguagcagggggccuucuaacaguauguuauguacuaacggggaggucagcagaucuugaauuggaaaaagcuacagauguuaaaugggacgaccaagcugaaauaagugggucaagcccaauacuuucgauaacaauuucugaagauggaucaaugaguauuaaaaacgaagaggaagaacaaaccuuaacaaucuuaauacgaacuggacuauuaguaauaucaggcuuauuuccggucaguaucccuauaacggcagcugcaugguaccuaugggaggucaagaaacaacgagcgggcguacucugggauguuccaucuccaccuccaguaggcaaagcagaauuggaagauggcgcauauagaauaaagcaaaaagguauacucggcuauucucaaauaggugcuggaguuuauaaggaggguacguuucauacuauguggcauguaacuagaggagcaguucuuaugcauaaggguaaaagaauugaaccuucgugggccgacguaaagaaagaccuuauaaguuaugguggaggauggaaguuagagggggaauggaaagaaggagaggaaguacaaguacuugcccuagagcccgggaaaaacccuagagccguccaaaccaagccuggucuuuuucgcacaaauaccggaaccauaggugcgguaagccuagauuuuucgccugggaccucuggcucaccgauugucgacaagaaggguaaggugguaggauuauauggaaacggaguagucacaagaucaggagcauaugucagcgcaauagcgcaaacugaaaaaucaauugaagauaauccagaaauagaagaugacauuuucagaaagcgacgcuuaacaauaauggauuugcauccaggggcugguaaaaccaagaaauaccuacccgcaauaguuagggaagcaauaaaaaggggacuuagaacauuaauuuuagcgcccacaagaguggucgcugccgagauggaggaggcucuacgaggacuuccuauucgcuaccaaacgccugccauuagggcugaacauaccggcagagaaauuguagaucucaugugucacgcaacauucacuaugagauuauuaucuccaauaagggucccuaauuauaaucuaauaauaauggaugaagcccacuuuaccgacccagccaguauagcagccaggggauacauaagcacacgagucgaaaugggugaagcugcaggcaucuucaugacggcuacaccacccggcaguagagacccguuuccgcaaucaaacgcuccgauaauggaugaggaacgggagaucccagaacgcucauggaacuccggacacgaaugggucacggauuucaaaggaaaaacggucugguuuguaccaagcauaaaaaccgggaaugacauagcggccuguuuacggaagaaugggaaaagagugauacaacucagccgaaaaacuuuugacagugaauacgucaagacucggacaaaugacugggauuuuguuguaacuacagacauuucugaaaugggugcuaauuuuaaagcagaaagggucauugacccacgccgauguaugaaacccgucaucuuaacggacggggaggaacgaguuauucuagcagguccgaugccuguaacgcauucgagugcagcgcagagaagggggcguaucggaaggaauccuagaaaugaaaaugaucaguauauauacaugggcgaaccgcuggaaaacgaugaagauugcgcgcauuggaaggaagccaaaauguuauuggauaauauuaauacacccgaagggaucauaccuucuauguuuggucccgaaagagaaaaaguagaugccauagauggggaauauagacuuagaggagaagcuaggaaaacauuuguugaauuaaugaggcggggagaccuuccaguauggcuagccuauaaaguagccuccgaagguauuaacuacgcagaucgccgcuggugcuuugacgguacacguaauaaucaaauauuagaagaaaauguggaaguagaaauuuggacuaaagaaggagaaaggaagaaauuaaaaccccgauggcuugacgcacgaauauauucagaucccuuagcucuuaaagaguucaaagaauuugcagcgggaaggaaaucauugacacuuaauuuaauaaccgaaauggguagacucccaacuuucaugacccaaaaggcuagagaugcgcucgacaaccuugccguuuuacauacagcagaagcgggagguaaagcauauaaucaugcacugucagaguuaccagagacuuuagaaacauuguugcuacuaacgcuacucgcuacaguaacaggggguauuuuucucuuucuaaugagcgguagaggaauagggaaaaugacacuagggauguguugcauuaucacagcuucgauucuacuaugguacgcccaaauccaaccucacuggauagccgcaaguaucauccuugaguucuuuuuaauaguuuugcuuauucccgaaccugagaaacaaagaacaccucaagacaaccaacugacauauguuauaauagcgaucuuaacaguaguagcugcaacaauggcgaacgagaugggauuuuuagagaaaacaaagaaagaccuggggcuuggccauaucgccacccagcagccugagucaaacauccucgacauagauuuacgaccagcuuccgcauggacccuguacgcaguagcuacuacuuucauuacaccuaugcuacggcauucaaucgagaacucaucaguaaaugugucacuuaccgcaauagcuaaccaagcuacugugcucaugggcuuagguaaaggauggccuuuaaguaaaauggacauuggaguaccuuugcuugcaaucggcuguuauucacaaguaaauccaauaacauuaacagcagcgcuuuuacuauuaguugcucauuaugcaauaauaggaccaggcuuacaagccaaagcaacucgagaagcacagaaaagagccgccgcuggcauuaugaaaaauccuacuguugauggaauaaccguaauagauuuagauccaaucccauaugacccaaaauuugagaagcagcucggacaaguuaugcuguuaguacuauguguaacucagguucuuaugaugagaacuacuugggcacuuugcgaagcauuaacccuggcuacuggcccaguuagcacccugugggaagggaacccaggaagauucuggaacacuacuaucgcagucucuauggcaaauauauuuagagguucuuaucuagcgggugcaggacugcuauuuucuauaaugaagaauacgaccucuaccagaagaggaacggguaacauuggcgaaacacuuggagagaaauggaagaguagauuaaacgcucucgguaaaucugaauuucagaucuauaagaaaagcggaauccaagaaguagauagaaccuuagcaaaagaagggauuaaacggggagaaaccgaucaccaugcaguaucaagagguucagcaaaguugaggugguuuguagaaagaaaucugguaacuccagaaggaaagguugucgauuuagguugcggacgagguggauggaguuacuacuguggaggauugaaaaacguucgagaggucaagggacuaacaaaaggagguccaggucaugaagaaccaauaccaaugucuacuuacggauggaaucucguaagacuccaaucagggguagauguuuucuuuauaccaccagagaaaugugauacuuugcuaugugauauuggagaaucaagcccuaaccccacgguagaagcaggacguacacugaggguccuaaaucugguagagaguuggcucaauaauaacacgcaauuuuguguaaaaguacuaaauccauacaugccauccguaauagagaggauggaaacauuacaacgaaaguaugguggagcucuuguuagaaacccccuaaguagaaacaguacacacgagauguauuggguuucuaaugcaagugguaaugugguuucaaguguuaauaugauuucaaggauguuaauuaacagauuuacaaugagacauaagaaagcaacuuacgaacccgaugucgaccuagguucugguacuagaaacauaggaauugaaagcgagacaccaaaccuggacauaaucggaaagagaaucgaaaagaucaaacaggagcaugaggcaucuuggcauuaugaucaagaccaccccuacaaaaccugggcauaucauggcucauacgagacaaaacaaacgggaucugcgagcucaaugguuaacggagugguacgucuccuaacuaaaccuugggauguaguaccaauggugacucaaauggcuaugacagauaccacaccuuuuggucaacaaagaguauuuaaagagaaagucgauacacgcacacaagaacccaaagaaggcacaaagaaacuaaugaaaaucacggcugaguggcucuggaaagagcuagguaaaaagaaaacgcccagaauguguacaagggaagaauuuacuaagaaaguucggaguaacgcugcgcugggagcgaucuucacagaugaaaacaaauggaaaagcgcacgcgaagcaguagaagauaaccguuuuugggaacuuguagauaaggaacguaauuugcaucucgaagguaaaugcgaaacauguguauacaauaugauggguaagcgugaaaagaaguugggcgaauuugguaaagcuaaggggucuagggcuauaugguacauguggcugggagcuagauuucucgaguucgaagccuuaggcuuuuugaacgaggaucauugguuuuccagagaaaacaguuuauccggaguugaaggugaaggucugcacaaacuuggauauauacugcgagaaguaagcaagaaagagggaggugcaauguaugcagaugacacggcuggaugggauacgagaauuacaauagaagaccugaagaacgaagaaaugauuacuaaucauauggccggugagcauaagaaacuagcagaggcgauauuuaaacugacauaucagaauaaagucguaagaguacaaagaccaacccccauuggaaccguuauggauauuauaucuagaagagaccaaagaggaaguggucaagucgggacauacggguuaaacacuuucacgaauauggaggcacaacuaauuagacagauggaaggugaggguauuuucaaauccauacagcacuuaacugcaucggaggaaauugcaguacaagauugguuaguacgcguagggagggaaaggcugucuagaauggcaauaucaggugaugauuguguaguuaaacccuuagaugacagauucgcccgagcguuaacugcauugaacgacauggggaaaguucgcaaggauauucagcaaugggagccaucaagaggcuggaacgauuggacgcaagugccauuuuguagucaccacuuccacgaauugauaaugaaggauggaagaacgcuaguagugcccuguagaaaccaagaugagcugauuggacgagcacgaauaucgcaaggggcugguuggagccuucgagaaacagccugucucggaaaaucuuacgcucaaauguggucucuaauguacuuccauagacgugaucuuagacuugcagcaaaugcgauauguagcgcggucccgagucacuggguaccgacaucaaggacaacauggucuauacaugcuagucaugaguggaugacgacugaagauauguugacaguuuggaauagaguauggaucuuggaaaaccccuggauggaagauaaaacucccguugaaucuugggaagagauaccguauuuagguaagagagaagaucaguggugcggaucuuuaauaggccuaaccucgcgggcaacaugggcgaaaaauauacaaacugcuauaaaucaaguccguucauuaaucggaaaugaagaauacacugauuacaugccuucuaugaagcgauuuagaagagaggaagaggaagcggggguauuaugguga

SEQ ID NO: 22362 - RNA, 9876 nt, Artificial Sequence
  derived and/or modified CDS sequence (opt6) from DENV-2__GQ868497__SS-prME
acagcaagcguaauagugauguuaauaccaacuguaauggcauuccaccucacaaccagaaacggagaaccgcauaugauaguaggaagacaagaaaaaggaaaaagucuucuuuucaaaacagaagauggagugaacauguguacucuaauggcaauagacuuaggagaacuaugugaagacacaauaacuuauaaauguccgcuacuaaggcagaaugaaccugaagauauugauugcuggugcaauagcacuuccacuuggguaaccuaugggacaugcucgacaacuggagaacacagaagggaaaaacgaagcguugcucuaguaccacacguugguaugggccucgaaacacguaccgagacauggauguccagcgaaggagcauggaaacaugugcaaaggauugaaacuuggauacuaagacacccuggauuuacuauaauggcagcaauucuugcauauacaauugguacaacucauuuucaacgcgcccucauuuucauauuacugacagcuguagcgccaagcaugacgaugcgguguauugguauaucuaaucgggauuuuguagaagggguaagcggcggcagcuggguagacauaguguuagaacaugguaguuguguuaccacgauggccaaaaauaaaccaacguuggauuuugaguuaauuaaaaccgaggcuaaacagccagcaacguuaagaaaauauuguauugaagccaaacuaacgaacacuacaacggaaucaagauguccuacccaaggggaaccuaguuugaaugaagaacaagauaaaagauucaucuguaaacauucaaugguugaccguggguggggcaacgggugcggccuauucgguaaagggggaauaguuaccugugcuauguuuacauguaagaaaaauauggaagggaaaguaaugcaaccggaaaaccuggaauauacaauaguaauuacaccacacucuggagaagaacacgccguugguaacgauacaggaaaacauggaaaagagauaaaaaucacgccacagucaucuauuacagaagcggagcuuacuggauacgguacuguaacuauggaauguucuccccggacagguuuagacuucaaugaaaugguucugcuccaaauggaagauaaagcauggcugguacauagacagugguuuuuagauuuaccauuaccauggcucccaggugcagauacacagggcaguaacuggauacagaaagagacauugguaaccuuuaaaaauccacaugcgaagaaacaagauguagugguccucgggucgcaggaaggcgcuaugcauacagcguuaaccggagcuacagaaauacagaugucaucugguaaucuccuguucacuggacaccuuaaaugucgguugcguauggacaaacuccaacuuaaaggcaugucguacucgaugugcacugguaaauuuaaaauuguaaaagaaauagcggaaacccagcaugggaccaucgugauuagaguccaauaugaaggggacgggucgccaugcaaaauaccauuugaaauuacugauuuagaaaaacggcacguguuaggaagauuaauaacgguaaacccaauaguaacagaaaaagauucaccaguaaauauagaggcggaaccuccguucggggacagcuauauaauuauaggaguugaaccaggacagcuaaaacucaacugguuuaagaaagguagcucaaucggucaaauguuugagaccacuaugagaggugcaaagaggauggcuauucugggagauacugcaugggauuucggaucauuaggcggaguauucacaaguauugguaaagcgcuacaucaaguauucggugcaauuuauggugccgcauuuucgggaguaucauggacaaugaaaauuuugauuggaguuauaauaacauggauuggaaugaacucaagauccacgucgcuuaguguuaguuugguuuuaguaggcgucgugacgcuuuacuuaggagcaaugguucaagcugacagcggauguguuguuucuuggaaaaauaaagaacucaagugugggaguggaauuuuuauaacagauaauguacacacauggacagagcaauauaaauuccagccagaaagucccucaaaauuagcaucagccauacaaaaggcucaugaagaagguauaugugguauacgaucgguuaccagacuagaaaacuuaauguggaaacaaauuaccccugaacugaaucauauucugucagagaacgaagugaagcuaacuauaaugacaggagauauaaaagguauaaugcaggccggcaaacggagucuaagaccacaacccacagaacuuaaauauaguuggaaaacuuggggaaaagcaaagaugcuguccacggaaucacacaaucagacauucuuaaucgacggaccggaaacagcagaauguccaaauaccaaucgcgcauggaacucauuagaaguggaagauuauggauucggcguguuuacaacaaauaucugguugaaauuaagagaaaagcaggacgucuuuugugauaguaaauuaaugagcgcagcuauuaaagauaacagagccguacaugcugacaugggguauuggauagaguccgcacugaacgauacguggaaaauggagaaagcaaguuuuaucgaggucaaaagcugucacuggccgaagucccacacucuguggagcaaugguguuuuagaaucugaaaugauaauucccaaaaauuucgccggcccgguuucacagcauaauuauaggcccggauaccacacgcaaacagccgggccguggcauuuggguaagcucgagauggacuuugacuucugcgaaggcacaacaguaguagugacagaggauugcgguaacagaggcccaucguuacguacuacuacggccaguggcaaacuaauaacagaguggugcugccgaaguugcacucuacccccucuuagauauagaggugaagacgguuguugguacggaauggaaauucgaccccugaaggaaaaggaagaaaaccuaguuaauagccucgucacggcuggacacggucagaucgacaacuucucucuaggugugcuugguauggcacuguuucuagaggagaugcuucgaacuagaaucggaacaaagcacgccauauuauuaguugcggcuagcuucguaacgcuaauaacaggaaacaugucauuucgugaucuaggaagagugaugguuauggugggagccacaaugacagacgacauaggcaugggcgucacguaccuggcccuacuggcugccuuuaaaguuagaccaacauucgccgcgggucuauuauuacgaaaacugacaaguaaggaauugaugauggcaaccaucggaauagcucuacuaucccaaucaacaaucccagagacaaucuuagaauugacggacgcgcuagcacuugguaugaugguuuuaaagauuguucgcaauauggaaaaauaccaguuggccguaacaaucauggcgauaagcuguguaccuaacgcaguuauacuucaaaaugcuuggaaaguuaguuguacaauccucgcugcaguaucaguaagccccuuauugcuuacguccucgcaacaaaaagcagauuggauaccacuagccuuaaccauaaagggccuaaacccaacagccauauuuuugacaacuuuaucucgcaccucuaagaaacgaagcuggccacuaaaugaagccguaauggccguuggaauggugucuauauuagcaaguucucuucuaaagaaugacauucccaugacgggaccauuaguagcuggcggauuacuaacgguauguuacguucuaacaggacgaucggcagaucuagaacuagagcgugcagcagacgugaaaugggaagaucaagcugaaauuucuggaucgucaccaauccuaaguauaaccauaagugaagacggcucaaugucagucaaaaaugaggaagaagaacaaacacuaacgauauuaauaaggacaggacuauuggucauaucagguguauuuccuguaaguaucccuauuacugcagccgcaugguacuugugggaagucaagaaacagagagcuggaguacugugggauguaccuaguccgccaccgguugagaaagcagaauuagaagauggagccuacagaauaaaacaacgggguauauuagguuauucgcaaauaggcgcggguguauauaaagaaggaacauuucauacuauguggcauguaacgagaggagccguauuaaugcacaggggcaaaagaaucgagccaucaugggccgauguuaagaaagaucuaauuaguuauggggguggauggaaacuagaaggagaauggaaagagggagaagaaguacagguccucgcacucgaaccugggaaaaacccccgcgcgguacaaacaaagccaggaaucuucaaaaccaauacagguacuauuggggcgguaagccuugauuucagcccaggcacuagcggcaguccuauuguagacagaaaaggaaaaguaguagggcuauauggcaaugguguaguaacuaggucaggggcuuaugugucugcaaucgcacaaacagaaaaaucgauagaggauaauccugaaauagaagaugacauauucaggaagaaaaggcucaccaucauggacuuacauccuggcgcaggaaaaaccaaaagauaccuaccugcaauaguaagagaagcgauuaaacgaggauuaaggacacuaauccuagcacccacaagggucguagcggcagagauggaggaagcacuaaggggauuacccauucgguaccagacuccugcuaucaagacugaacauacaggacgugaaauaguggacuugaugugucacgcgacguucacuaugcgcuuacucucuccaguucguguaccgaacuauaaucuuaucauaauggacgaagcacacuuuaccgauccggcaaguauagcggcacgaggguauauuucuacaagaguggagaugggagaagcagcagguauauuuaugacggcgacuccaccaggaagccgagacccauuuccgcagucaaaugcaccuauaauggaugaagagagggaaauuccagaaagaagcuggaacuccgggcaugaauggguaacugauuucaaaggaaaaacaguaugguucguacccucaaucaaagccgggaaugauauugcagcaugcuugaggaaaaauggaaagaaaguuauacagcuuaguagaaaaacuuuugauucagaauaugucaaaacacgggcaaaugauugggacuuuguugucacaacugauaucagcgaaaugggcgcaaacuuuaaggcugagcgcguaauugauccccguagauguaugaagccuguaauauuaacggacggagaagaaagaguuaucuuagcaggacccaugccagugacccauucaucggcagcacaacggcgagguagaauaggucguaauccuaaaaaugaaaacgaccaauacauauacaugggggaaccucuugagaaugacgaggauugcgcccauuggaaggaggcuaaaauguuguuagacaauauaaauacaccagaagggauaauaccaucaauguucgaaccagagagagaaaaaguagaugcaaucgacggagaauacaggcugagaggugaagccagaaaaaccuuuguagaccuaaugagacggggagaucuuccgguauggcuagcuuauaaaguugcagcggaagguauuaauuacgccgauagaaaaugguguuuugacgguaucaaaaauaaccaaauccuagaagaaaauauggagguggagauauggacuaaagagggagagaggaagaaacuaaaaccucgaugguuagacgcgcgaaucuauagugacccacuugcacuaaaagaauuuaaagaguuugcagcuggacggaaaucucucacauugaaccuuauaacagaaaugggacgauuaccaacguucaugacacaaaaagcucggaacgcauuagauaauuuggcagucuuacauacugccgaggcgggaggacgagcauacaaucaugcccuuucagaguuaccugagacuuuagaaacauugcucuuguugacacuguuggcaacgguuacaggaggaaucuuuuuauuucuaaugucaggcaaagggauugguaagaugaccuuaggaauguguuguaucauaaccgcgucaauucuuuuaugguaugcacaaauucaaccgcacuggauugcugcgucaauaauucuugaguucuuuuugauagucuuacugauuccagagccagaaaagcaacgaacgccgcaagauaaccaauugaccuauguggucauagcaauucuaacuguaguugcagcaacgauggcaaacgagaugggguucuuggagaaaaccaaaaaggacuuaggacuaggaucuauuaccacacaagaaucagaaaguaauauucuagauauagaccugagaccagcaagcgccuggacauuauacgcagucgcuacgacauuugugacaccaaugcuacgccacucaauagaaaauuccucuguaaacguaucucuaacagcaauagcaaaucaagcaacaguacuuaugggccuagguaaaggauggccacugucuaaaauggacauuggaguaccucuguuggcaauuggcuguuauucacaaguuaacccgaucacacuaacggcugcuuugcuauuauugguggcgcauuacgcaauaauagguccaggauugcaagcaaaagcuaccagggaggcacagaaaagagcagcagcaggcauaaugaagaacccaacuguugaugggauaaccguaauugaucuugaaccuaucccuuacgacccaaaauuugaaaagcaauuagggcaaguuauguugcucauauuaugcgugacacaaguuuuaaugaugcgaacgacgugggcuuugugcgaggcuuugacguuagcuacugggccaaucaguacuuuaugggaagguaaucccggacgauucuggaauaccaccauagcagucagcauggccaauauauucagggggucauaccuugccggagcagguuuguuguuuagcauaaugaaaaacacuacgaauacaagaagagguacuggcaacauaggcgaaacccuuggcgaaaaguggaaaagccgauuaaaugcgcuaggcaaaagugaauuucaaauuuauaagaaaucuggcauucaagaaguugauagaacccuagcaaaagaaggcauuaagagaggagaaacggaucaucaugcuguaucaagagguucugcgaaauuacgaugguuuguugagagaaacaugguuacaccugaggguaaagucguugaucuaggaugcgggcgaggagguuggucguauuauuguggaggcuuaaaagauguccgcgagguaaaaggcuuaaccaagggcgguccaggucaugaggagccaaucccuaugucuacguauggauggaaccuggugagguugcaaagcgggauagauguguucuuuacaccucccgagaaaugugacacacuauuaugcgauauaggggaaagcucaccgaauccaacaaucgaagcaggaagaacucuucgaguacucaauuuagucgaaaacuggcugaauaacaauacucaauuuuguaucaaaguucucaacccauauaugccaucagugauagagaaaauggaaacuuuacaaaggaaauacggaggagcgcuaguacggaacccauuaucaaggaacaguacccaugagauguauugggugagcaacgccacaggaaauauagugucgagcguuaacaugauaucgagaauguuaauaaaucgcuuuacgaugaagcauaagaaagcaacauaugaaccggaugucgaccucgguucagguacucggaauaucggaaucgaguccgaaauuccaaaccuggacauaauaggaaagagaauagagaaaaucaaacgagaacacgaaacaucauggcauuaugaucaggaucauccguacaagacuugggcauaucacgguucauacgaaaccaaacaaacaggaucagcgaguucaauggugaaugguguaguucgauuauuaacaaaaccgugggauguaguacccaugguaacacaaauggcuaugacggauacaacaccauuuggacaacagagaguuuucaaagaaaaaguggauaccaggacucaagaacccaaagaaggcaccaaaaagcuaaugaaaauaacagcggaauggcuauggaaagaguuggguaagaagaaaacaccacggauguguaccagagaagaauuuacccggaaagucagaucaaacgcugcccuaggggcaauauucacugaugaaaacaaauggaaaucagcccgagaagcaguagaagacggcagauucugggagcuuguagacagggaaagaaaccugcauuuggaagguaaaugugaaacgugcguguauaacaugauggguaagcgugagaagaaacuuggcgaauuugguaaagcaaaaggaagccgugcuauuugguauaugugguugggggcacgcuuucuagaguucgaagcucucggguucuuaaacgaagaucacugguuuagccguggaaacucccuguccgguguagaaggagaaggauugcaccgauuaggguauauacugcgagauguaggcaagaaagaagguggugccauguacgcagacgacacagccggaugggacacacguauaacauuggaggaucucaaaaaugaagaaauggugacuaaucauaugaaaggagaacacaagaaauuagccgaggcgauauucaaacuaacauaucaaaacaagguugucagaguacaaagaccaacuccccguggcacaguuauggauauuauuucucgaagagaucagagagguucuggucaaguuggcacuuacggauuaaauacuuucacaaauauggaggcgcaacugauaaggcaaauggagggcgaagguauuuuuaaaaguauacaacauuuaacggcaaccgaagaaaucgcgguucaaaacuggcuggcucgaguuggacgugaaagacucucuagaauggcaauauccggugaugauugugucgucaaaccuauagacgaccguuuugccucagcauuaacagcuuugaaugauauggguaagguucguaaagauauacaacaaugggaacccaguagaggcuggaaugauuggacucaaguuccuuuuugcagucaccauuuucaugaacuugucaugaaagacggaaggguccuaguuguuccgugucgcaaucaggacgaauuaauagguagggccagaauaucucaaggugcgggguggucacuaaaagagacagcuugccuuggaaaguccuacgcacaaauguggacucuuauguauuuccacagaagagauuuaagacuugcagcuaacgcgauuuguucagcugugccaucucauuggguuccuacaucccgaacaacguggagcauucacgcuaaacaugaauggaugacgacagaggauauguuggcuguauggaauagaguuuggauccaagaaaauccuuggauggaggacaaaacaccuguagaaucaugggaagaaguaccauauuuaggaaaaagagaagaccaguggugcgguagucuuauaggucuuacuagccgagcaacuugggcgaaaaauauccagacggcuauaaaccaaguaaggucucuaauaggcaaugaggaauacaccgauuauaugccgucgaugaaacgauuucguaaagaggaggaagaagccggaguucuaugguaa

SEQ ID NO: 22363 - RNA, 9876 nt, Artificial Sequence
  derived and/or modified CDS sequence (opt6) from DENV-2__GU131959__SS-prME
acagcugguguaauaguaauguuaaucccgacaguaauggcauuucaucuaacuaccagaaauggugaaccucacaugauaguaggacgucaggaaaaaggcaaaucgcuacucuuuaaaaccgaagacggaguaaacauguguacgcucauggcaauugaucucggugaacugugugaagauacaauaacauauaaaugcccccuacugaggcagaaugaaccggaagacauugauuguugguguaacucuacuagcacauggguuaccuauggcacguguaguacuacaggagagcauagacgugagaaaagaaguguggcgcuaguuccacacguaggaaugggacuugaaacacgaacugaaacuuggaugaguagugaaggcgccuggaaacacguacaacguauugagacguggauauuaagacauccgggauucacaaucauggcagccauacucgcuuauacaauugguacaacacacuuucaaagagcucucaucuuuauucuauuaaccgcaguagcuccauccaugacuaugcgauguauuggaauuucaaauagagacuuuguugaaggggucagugguggcucuuggguugauauugucuuggaacauggaucuugcguaacuacuauggcgaaaaauaaaccuacacuagauuuugaacuaauuaaaaccgaagcaaaacaaccagcaacacucagaaaauacugcauagaggcgaaauugaccaacacuacaacugaaucucgauguccuacucagggagaaccaucacuaaacgaagaacaagacaaacgauucauauguaaacauagcaugguagaccgaggaugggguaauggaugcgggcuauuugguaaagggggcauuguaacaugugcaauguuuacuuguaagaaaaauauggaaggaaaaguagugcagccugaaaacuuggaguacacaauaguuauuacaccucacucaggcgaagaacacgcuguaggcaaugacacggguaaacacgggaaagaaauaaaaauuacaccccaauccucaauaaccgaagcggaacuaacuggauaugguacaguuacuauggaaugcaguccaagaacaggguuagauuuuaaugaaaugguucuuuuacaaauggaggauaaggcuuggcucgugcauagacaaugguuucuagaucuuccccucccauggcuacccggagcugacacccaagguucgaacuggauucaaaaagagacucuagugacuuucaaaaacccacaugcuaagaaacaagacguaguaguauuaggaucgcaagaaggagcaaugcauacagcacuaacaggagcgacagaaauccaaaugucaaguggaaaucucuuauucacuggccauuuaaaaugucgauuaaggauggacaaauugcagcuuaaagguaugucauauagcaugugcaccgguaaauuuaaaauaguaaaagaaauagcggaaacacaacauggaacaauuguaauaaggguccaguacgaaggagauggaucaccaugcaagauaccauuugaaauaacagauuuggaaaaacgccacguacucgggcgccuaauaacgguaaacccuauaguaacagaaaaagacucucccgucaacauagaagcggaaccuccauuuggagauucauauauaaucauuggcguugaaccaggacaauugaaacuaaauugguuuaagaaagggaguuccaucggacaaauguucgaaaccacgaugagaggggcuaaaagaauggcaauuuugggugauaccgcaugggauuucgguucgcucgggggaguauuuacgucaauaggaaaagcauuacaccaagucuucggggcuauauauggcgcugccuucaguggugugagcuggacaaugaaaaucuugaucggugucaucaucacuuggauaggaaugaauacuagaaguacgagccucucaguaucgcucguuuugguagggguuguuacccuauauuuaggggccaugguacaagcagauagcgguugcguuguauccuggaaaaacaaagagcuaaaaugugguaguggaauauuuauaacagacaauguacauacauggacagaacaauauaaauuucaaccagagagucccagcaaauuagccagcgccauccagaaggcccacgaggagggaaucuguggaauccgaucugucacgagauuagagaacuuaauguggaagcaaaucacacccgaguuaaaucacauuuuaucagaaaacgaagucaaauuaacgauaaugaccggugacauaaaaggcauuaugcaagcuggaaagcggagucuuaggccgcagcccacagaacuaaaauacaguuggaagacauggggaaaagccaaaaugcuuucuaccgagucgcacaaucaaacguucuuaaucgauggaccggaaaccgcagagugcccuaauaccaacagggcauggaacucuuuagagguagaagacuacggauuugguguauuuacuacgaauauauggcuaaagcugcgcgaaaaacaagacguauuuugugacucgaaacuaaugagugccgcaaucaaagauaauagagcuguucacgccgacauggguuacuggauagaaucugcucugaacgaaacauggaagauggagaaggccucauuuauagagguaaaaagcuguuauuggccaaaaagccauacgcuaugguccaacggagugcuagaaagcgagaugauaauaccgaaaaacuucgcuggcccaguaucucaacauaauuauagaccuggauaccauacacaaacggcagggccauggcaccuagguaaauuagaaauggauuucgauuuaugcgaagguaccacaguaguaguaaccgaagauugcggaaauagagguccuaguuuaaggaccacaacagccagugggaaacuaauuaccgaaugguguugccguagcuguacauuaccgccacuucguuacagaggugaagauggaugcugguauggaauggaaauuagaccguuaaaggagaaagaggaaaaucucguaaauuccuugguaacggcaggacacggacagauugauaauuuuagcuuaggaguccuagggauggcacuauuccuugaggaaaugcugaggacgagaaucggaacaaaacacgcuauuuugcucgucgcagcaucauucguaaccuuaauaaccggaaacauguccuuucgagauuuaggaagaguaauggucaugguuggagcuacaaugacagacgacauugguauggguguaacauauuuagcucuacuagcagcguucaagguuagacccacauuugcagcaggauuguuguuaaggaaauuaacaagcaaagaacuaaugauggcaacuauagguauagcucuacuaucccaaucaacuauaccugaaacaauacuagaacuaacagacgcccuagcguuggguaugaugguucuuaaaaucguucggaauauggaaaaguaccagcucgcaguuacaaucauggcuauaucaugugugccuaacgcggugauauuacaaaacgccuggaaaguaaguugcacaauuuuagcagcuguaucgguaucuccuuuauuacuuaccaguucacaacaaaaggcugauuggauuccuuuggcccuaacuauaaagggccugaaccccacagcgauauuucuaaccacauuaagcagaaccuccaagaaaaggucuuggccacuuaacgaggcaguaauggcagugggaaugguuucaauacuugcaaguagucuacuaaagaaugacauacccaugacugggccauuaguugcgggaggguuguugaccguuuguuacgucuuaacaggucgcagugcugaccucgaacuugaaagagcagcugaugucaaaugggaagaccaggcagaaaucagcgggucaagccccauacuaucuauuacaauuucagaagacggaucaaugaguauuaaaaaugaagaggaagaacagacuuuaacuauacugaucagaacaggacuucugguaauaucaggaguuuucccaguaaguauacccauuaccgcagcagcuugguaucuaugggaagugaagaaacaaagagccggaguacuaugggaugucccaagcccaccgccggucgaaaaagcggaacuugaagauggcgcuuauagaaucaaacagcgcggaauacuaggauacucacaaauaggggcggguguguacaaagaaggaacuuuccauacuauguggcauguaacgcgaggugcaguacuaaugcauagaggaaagcgaauagaaccaagcugggcggacguaaagaaagaucucauaucguauggaggaggcuggaaacuagaaggagaguggaaagaaggggaagaaguacagguguuagcucuagagccuggcaaaaaccccagagcaguucaaaccaagccgggcauauucaaaacuaacaccggaacaaucggagccguaucgcuugacuucuccccgggaacuucuggaucucccauugucgaucguaagggcaaaguaguaggacuguauggcaacgguguagucacaaggagcggagcauauguguccgcgauugcccagacggagaaaucaaucgaagauaacccggaaauagaagaugauauuuuuagaaagaagcgccugacuauuauggaccuucacccaggcgcgggaaagacaaagagauacuugccggcuaucguucgcgaagcaauaaaaagaggguuaaggacacucauacuagccccaacgagaguaguugcugccgaaauggaagaggcacucagaggccuaccaauccguuaucagacgccugcaauaaaaacagagcacacaggacgcgaaaucguugaucuaaugugucacgcaacguucacgaugagguuacuaucaccaguaagggugccuaacuauaaccuaauuauuauggaugaagcacauuuuacagauccugcuucaaucgcggcacguggauauauuucaacgcgagucgaaaugggugaagcagcaggaauuuucaugacggcaaccccaccaggaagcagggacccauucccgcaaucuaacgcuccaauaauggaugaggagagggagauaccugaaaggucuuggaacucuggacacgaguggguuacggacuuuaaagggaagacaguaugguucguaccuuccauaaaagccggaaacgacauugcugcuugcuugcgcaaaaacggaaagaaggucauucaauuaucaaggaaaacauuugauucggaauacgucaaaacuagagcaaaugacugggauuuuguaguaacuaccgauauuucggaaaugggcgcaaauuuuaaagcagaacgagucauagauccacgacguuguaugaaaccuguaauacuaacagacggggaagagagagucauuuuagccgggccaaugcccgucacacauaguagcgcugcgcaaagacgagguaggauagguaggaaucccaagaacgaaaaugaucaauacauauacaugggcgagccgcuugagaacgaugaagacugcgcacacuggaaagaagcaaaaauguuacucgacaauauuaauacaccagaaggcaucaucccguccauguucgagccugaaagagaaaagguugaugcuauagauggggaauauagauuaagaggcgaagcaaggaaaacauucguugacuuaaugcgaagaggagauuuaccuguauggcuagcauacaagguggcagccgagggaauaaacuacgcagacagaaaauggugcuuugauggcaucaagaacaaucaaauacuagaagaaaacauggaaguagagauuuggacaaaggaaggcgaacggaagaaauuaaaaccaagguggcuggacgcuagaauuuauagcgacccacuagcuuuaaaagaauuuaaagaauuugccgcugggaggaaaucccuaacuuuaaacuugauaacagaaaugggccgccuaccuacauuuaugacucaaaaagccaggaacgcguuagauaacuuagcagugcuacauacggcagaagccgguggacgcgcauauaaucaugcgcucagugaacuaccggagacacucgagacacuuuuacuguugaccuuauuagcaacugucacuggugguauauuucuguuuuugauguccgguaaaggaauuggaaaaaugacccucggaaugugcugcauuauaacagcuucuauauuacucugguacgcacagauacagccucacuggauugccgccagcauaauuuuagaauuuuucuuaauuguccuacucauuccagaaccggaaaaacaacgaacuccacaggacaaucaauuaaccuauguagucauagcuauauuaacaguuguugcagcaacaauggccaacgaaaugggauuuuuagagaaaaccaagaaagacuuaggccugggaucaauaacgacacaagaaagugaaaguaauauacuagacaucgaucuaagaccagcgagugcuuggacacucuacgccguagcuacaacauucgucacuccgaugcugaggcacagcauagaaaauaguaguguuaaugugucacugacagcaauagcgaaccaagccacagugcucaugggacuagggaaaggauggccccuuucaaaaauggauauuggaguaccauuacuugcaauugguuguuauagucagguaaauccaauuacauuaacggcugcacuacuacuauuaguagcacauuacgcaauaauaggaccugguuugcaagcaaaagcgacaagggaggcccagaaacgagcugcugcagguauaaugaaaaauccuacuguugauggaauuaccguaaucgaucuggagccaauuccauacgacccuaaauuugagaaacaauuggggcaagucaugcuuuugaucuuaugcgucacacaaguacucaugaugaggaccacgugggcucuaugcgaagcauuaacccucgcaacugggccgauuucuacacuuugggagggaaaucccgguagguucuggaauacuacaauagcaguaucaauggcuaacauauuuaggggaucguacuuggccggagcggguuuauuauucucgaucaugaagaauacgacuaacacuaggcgagguacaggcaauauaggggaaacacugggugagaaauggaaaaguagauuaaaugcucucggaaaaagcgaguuccaaaucuauaagaaaagugggauacaagaaguagauagaacauuagcgaaagaagggauuaaacgaggggaaacugaucaucacgcgguuucuagagguuccgcaaaauuacgaugguucguagaaaggaacaugguaacuccagagggaaaaguuguggacuuagguugcgguagaggcggcugguccuauuacuguggagguuuaaaagacguuagagaagucaagggguuaacgaaagggggaccaggccaugaggagccaauuccuaugaguacauauggguggaaccugguacguuuacaaucaggaauagauguuuucuucacucccccagagaagugugauacauuacuaugugauauaggagaaaguuccccaaacccuacuaucgaagcaggaagaaccuuacgagugcuuaacuuaguagaaaauuggcugaacaauaauacccaguuuuguauuaagguuuuaaauccguauaugccguccguaauagaaaagauggaaacccuucaaagaaaauauggaggugcacugguaaggaacccacugagcagaaauucuacacacgaaauguacuggguuucaaaugcgacuggaaauauagugaguucugucaauaugauauccagaaugcugauaaaucgcuuuacgaugaaacauaaaaaggcuacuuacgagccagauguagaucuugggucgggaacacggaacauagguauugagucugagauucccaauuuggacaucauagggaagcguaucgaaaagauuaaacaggaacaugaaacaagcuggcacuacgaucaagaucacccguauaaaacuugggcauaucaugguuccuaugaaacgaagcaaacagggucagcgucuagcaugguuaacggaguagugagacuauugacuaaaccaugggaugucguacccaugguaacucaaauggcaaugacugauaccacgccauuuggacaacaacgaguauucaaagaaaagguagauacaaggacacaagaaccaaaagaggguacuaagaaacuuaugaagauuacugccgaauggcuauggaaagagcuuggaaagaaaaagacuccaaggaugugcacgcgcgaagaguuuaccagaaaaguccggaguaaugcugcccuaggagcaaucuuuacggacgagaauaaguggaaaagugcuagggaagcuguagaagacgggagguucugggaauuaguugaucgcgagcguaacuuacauuuggagggaaaaugugaaacaugcguauauaauaugauggguaaacgcgaaaagaagcuaggugaauuuggaaaagcaaaggggucaagggcaauaugguauaugugguuaggggcacgcuuuuuagaguucgaagccuuagguuuucuaaaugaggaucacugguuuagucggggaaauucacuaagcggaguggaaggcgaagguuugcauagacuugguuacauacuacgagauguagguaagaaagagggcggagcgauguacgccgaugacacagcaggaugggauacuaggauaacucuagaggaucuuaaaaaugaggaaaugguaacaaaucauaugaaaggugaacacaagaaacucgcagaagcaauauucaaacuaacuuaucaaaacaaaguuguacguguucaaaggcccacaccuagagguacgguaauggauauaauaucacgaagagaucaaagagguucaggucaaguggggacuuaugggcuaaauacauucacaaauauggaagcacaacuaauacgacaaauggaaggagaagguauauuuaaaagcauacagcacuuaaccgcaacagaagaaauagcuguucagaauuggcuggcaagaguagguagggaacgauuaagucgaauggcuauaucaggagaugacugcgugguaaaaccaauagaugaucgguucgcgagcgcccuaacagcacuaaaugacauggggaagguaaggaaagauauccaacagugggaaccuagucgagguuggaacgacuggacacaagucccauuuuguagccaccauuuucacgaguuaguaaugaaagacgguaggguccuuguagugccaugccgaaaucaagacgagcuuauaggaagggcgcgaaucucacaaggagcaggauggucguuaaaagaaacugcuugucugggcaaaucauacgcacaaauguggacguugauguacuuucauaggagagauuuacgucucgccgcgaaugccauauguucagcgguuccaucacacuggguacccaccucaagaacaaccuggucaauucaugcuaaacaugaauggaugacuacagaggauaugcuugcgguuuggaauagggucuggauacaggaaaauccguggauggaagacaagacgccaguggaaucaugggaagaggucccguacuuaggaaaaagagaagaucaauggugugggagccuuauaggucuaacgucaagggcuacgugggcuaaaaauauucaaacugcaauaaaucagguacguagucucauuggaaaugaggaguauaccgauuauaugcccucaaugaaaagauuuagaaaggaagaagaagaagcagggguucugugguag

SEQ ID NO: 22364 - RNA, 9876 nt, Artificial Sequence
  derived and/or modified CDS sequence (opt6) from DENV-2__GQ868515__SS-prME
acugcugguguaauuguaaugcuaauaccaacaguaauggcuuuccauuuaacuaccagaaacggagaaccacauaugauagugggacgucaagaaaaaggaaaaaguuuauuauuuaaaaccgaagacgguguaaauauguguacacuuauggcaauugauuuaggagaacuuugugaagauacaauuacauacaaauguccauuguuacgccaaaacgaaccggaagacauugauugcuggugcaacucuacuucaacauggaucacguauggaaccuguucaacuacuggagaacaucguagagagaaaagaagugucgcuuugguaccacacguagguaugggacuagaaacaagaacagaaacauggaugaguagugaaggggcuuggaaacauguccaacggauagaaacguggauucuucggcauccuggauuuacaauaauggcagcaauuuuggcguauacuauaggaacgacacauuuccaaagggcauuaauauucauuuuacuuacugcugucgcaccaaguaugaccaugcggugcaucgguauaagcaauagagauuuuguagaagggguaucagguggauccuggguagacaucgugcuggaacacggcaguugcguaaccacaauggcgaaaaacaaaccaacgcuagauuuugaguugauaaaaacugaagcuaaacaaccagcuaccuuacgaaaauacuguauagaagcgaaacuaacgaauacuacuaccgaaagccgaugucccacacaaggagagccaucacuaaaugaagaacaagauaaaagauuuauuugcaaacauucgaugguagaucgugguuggggaaacggcuguggauuauuugguaaaggaggcauaguaacaugugcaauguuuacuugcaagaaaaauauggaagggaaaguaguccaacccgaaaaccuagaauacacaauugucauuaccccacauuccggcgaggagcacgcagucggaaacgauacggguaaacaugguaaagaaauaaaaaucacgccacagaguaguauaacugaagcagaacuaacuggauauggaacagugacuauggaauguucgccacgaacuggauuagauuucaacgaaaugguauuauugcagauggaagauaaagcaugguuggugcauagacaaugguuuuuagaccuuccguuaccuugguuaccaggcgcagacacacaaggaucaaacuggauacaaaaagagacucuaguaacuuucaaaaauccacaugcaaagaaacaggauguagucguauugggaagucaagagggcgcgaugcacacugcauuaaccggggcaacagaaauacaaaugagcucgggcaauuuacuauucaccggucauuuaaaaugccgauugcgaauggauaaauuacaguuaaaagguaugaguuauucuaugugcacggguaaauucaaaaucguuaaagagaucgcggagacucaacauggaacaauaguaauaagagucagguaugaaggggacggcuccccauguaaaaucccuuuugaaauaacggacagugagaaaagacacguccuagguaggcuaauaacuguaaaccccauaguuacagagaaagauucccccgugaauauagaagcugaacccccuuuuggagacaguuauauaauaauagguguugaaccuggacaauugaaauugaauugguucaagaaaggcucaaguauaggacaaauguucgaaacuaccaugcgcggugcgaaaagaauggcaauucugggagauacggcuugggauuucgguagccuaggagguguguuuacuucaauugguaaagcauuacaucagguuuucggcgcaauauacggcgcagcuuuuucggguguuucuuggacuaugaaaauauugauuggaguuauaauaacauggauagguaugaacucucgaaguacaucucuaucaguaucgcuaguucuaguagggguagucaucuuguaucucggagcaaugguccaagcugacaguggaugcgucgucuccuggaaaaauaaagaguuaaaaugcggauccggaauauuuauaacagacaauguccauaccuggacagaacaguauaaauuccagccugaaucucccaguaaacuagcaagcgcaauacagaaagcgcaugaagaaggaauauguggaauacgaagcguaaccagacuagagaaucugauguggaaacaaauaacaccagagcuaaaucauaucuugucugagaacgaaguaaaauuaacaauuaugacaggugauauuaaaggaauuaugcaagcggguaaaagaucacuacguccacaaccaacugaacuuaaauauucguggaaaacuugggguaaagccaaaaugcuauccacugaaucccacaaucagacguuucugauagauggaccagaaacugccgagugcccaaauacuaaucgagcuuggaacagucuagaaguagaggacuacggauucggagucuuuacaacuaauauauggcugaaauuacgggagaaacaagacguguucugugacucaaaauuaaugagcgcagcuauuaaggauaauagagcaguccaugccgacaugggauauuggauagagagugcacuaaaugacaccuggaagauggagaaggcuucguuuauagaaguuaaaaguugucauuggccgaaaucgcauacgcuaugguccaacggagugcuagaaucugaaaugauaauuccaaagaauuucgccgguccagucucgcaacacaacuauaggccugguuaccauacacaaacugcuggaccuuggcaucuaggcaaauuggaaauggacuucgaucucugcgaaggaacgaccguuguaguaacugaagauugcgggaaccgagguccaagccuaagaacaacgacagcuagcgguaaacuaauaacggagugguguuguaggucgugcacucuaccaccgcuucgauauagaggggaagauggauguugguauggcauggaaauaagaccuuuaaaagaaaaagaggaaaauuuagucaauagccuaguaacagcaggucauggucaaauugauaauuuuaguuuaggaguucuugggauggcccucuucuuggaggaaauguuacgaacacgaauuggaacuaaacaugcaauucuauuaguagcagccagcuuuguaacccucaucacuggaaacaugaguuuucgagaucucggacgcguaauggugaugguaggugcgacaaugacagaugacauugggaugggugugacguauuuagcucuauuagcugcauucaaaguacgaccaacauuugccgcaggauugcuacuuagaaaauuaacaaguaaggaacuaaugauggcuacaauaggcaucgcuuuacuuucacaaucgacuaucccagaaucuaucuuagaauuaacagaugccuuagcacucggcaugauggucuuaaaaauaguaagaaauauggaaaaguaccaacuggcagugaccauaauggcaauaagcuguguuccuaacgcgguaauacuucaaaacgcguggaaaguaaguuguacuauuuuagcggcggucucgguuaguccucuauuauuaacgucaucacaacaaaaggcagacuggauccccuuagcacuuacuauuaagggccuaaacccaacggcaauauuuuugaccacucuaucaagaaccaguaagaagaggagcuggccacuuaaugaagccgugauggcuguaggaaugguuucaauacuggcaucgaguuuacuuaaaaaugauauaccgaugacaggaccucuaguagcaggaggucuacucacugugugcuacguacuuacuggucgaagcgcugaucuagaauuagagagggcagccgauguuaaaugggaggaccaagcugaaauuuccgggagcucccccauacugucuauuacaaucucugaagaugguucuaugagcaucaaaaacgaagaagaggagcaaacauuaacuauccuaauaaggacagggcuccuggugauaaguggaguauuccccgugagcauuccaauaacggcggcggcaugguaucuaugggaagucaagaaacaacgggcaggcguucuaugggacguacccaguccgcccccuguagaaaaggcagaacuagaagauggagcauaucggauuaaacagcgugggauccucggauacucgcaaaucggagccgggguauauaaagaagguacauuccauacgauguggcaugugacacgaggagcaguccuaaugcacagaggaaagcgcauugaacccagcugggcagauguaaagaaagaucuuauaucauauggaggcggauggaaacucgaaggagaauggaaagaaggagaagagguucaaguguuagcuuuagagccuggcaaaaauccaagagccguucaaacuaaaccgggaauuuuuaaaaccaauacgggcacaauaggugcgguuucacuugauuuuagcccagguacuuccggaucaccgauuguugacaggaaggggaaagucguaggguuauaugguaacggaguaguaacaagaaguggcgcguacguuucugccaucgcgcaaacugagaagucuauagaagauaauccagagauagaagacgauauauucaggaagaaaaggcuaaccauaauggauuugcacccgggagccggcaaaacaaaaagauauuuacccgcgaucgugagagaagcuauaaagagaggauuaaggacgcuaauucuagcaccuacgagagugguugcagcugaaauggaagaagcacuuagaggcuuaccaauccguuaucaaacaccagcaauuaagacugagcauacugggcgagaaauagucgacuuaaugugucacgccacuuucacaaugcgacuccucucuccaguucgcguaccaaauuacaauuugauaauaauggacgaggcccacuuuacagaccccgcaucaauagcggcucguggcuauauaucaacaagaguggaaaugggagaagccgccgguauauuuaugaccgccacaccacccgguagucgcgauccauuuccgcagucgaacgcuccaauuauggacgaagaacgagaaauccccgagagaaguuggaacaguggacaugaguggguaaccgauuuuaaaggaaagacuguaugguuugucccaucgauaaaagcagguaaugacaucgcggcuugcuuacgcaaaaauggcaagaaagucauccaacuuaguaggaagacuuuugauagcgaauacgugaagaccagagcaaaugauugggacuucguaguaacaacagauauaagugagaugggagcaaacuucaaagcagagagagugauugacccuagacguugcaugaaaccuguuauucuuacagacggugaagaaagaguaauacuagcuggaccgaugccgguaacucacagcucggcagcgcaacgcaggggaagaauagguagaaacccuaagaacgaaaaugaccaguacauauauaugggagaaccauuagaaaaugaugaagacugugcccauuggaaagaagccaaaauguuguuggauaacauaaacacaccggaaggaauaauucccucgauguucgaaccagaacgcgaaaagguggaugcuaucgauggagaauauagacuccguggggaagcaaggaaaacauucgucgacuugaugcguagaggagaccuaccgguguggcuugcuuacaaaguggcagcagaagggauaaacuaugccgacagaaaauggugcuucgauggcaucaaaaauaaccagauucuagaagaaaauauggaaguugaaauuuggacaaaggagggugaaaggaagaaauuaaaacccagauggcuagaugcaagaauuuauagcgauccacuggccuuaaaagaauuuaaagaauuugcugcaggaagaaaaucccuaacacugaauuuaauaacagaaaugggaaggcuacccacauuuaugacacaaaaggcuagaaacgcguuggacaaccuagcuguauuacacacugcugaagccgguggacgagccuacaaccaugcgcugucggaguugccagaaacacuugagacuuuacuucuauuaacguuacuagcaacgguaacgggaggaauauuucuauuuuugaugagcggaaaaggcauaggcaaaaugacacugggaauguguuguaucauaacugccucuauacugcuuugguacgcacagauacaaccacacuggauagcagcaaguauaauuuuagaauuuuucuugauugugcuacuaauaccagagcccgaaaaacaacgaacaccccaagauaaccaguuaacauacguaguaauugcuaucuuaacuguugucgcagcaaccauggcuaaugagaugggauuucuggagaaaacuaagaaggaucuuggucucggcaguauuacuacacaggaaagugaauccaacauauuagacauagacuugagaccagcgucagcguggacguuguacgccguagcgacaaccuuugugacuccuaugcuacgacauagcauugaaaacagcucuguuaacguuucauuaacagcaaucgcaaaucaggcaacaguacuaauggggcuaggaaagggauggccacuaagcaaaauggacauagguguaccuuuauuagcaaucggauguuacagccaaguaaauccaauuacuuuaacugcagcauuauuacuucuggucgcacacuaugcgauaauaggaccuggauuacaagcgaaagcgacaagggaggcucagaaaagagcugcugccggaauaaugaaaaauccaacuguagauggaauuacuguaauagaccucgagccuauaccauaugauccaaaguuugaaaaacaguuaggacaagucaugcuuuuaauuuuaugcgucacucaagucuuaaugaugagaacuacaugggcuuugugugaagcgcuaacacucgccaccggaccaaucaguacguuaugggaaggcaauccuggaagauuuuggaacacaacgauagcgguaucuauggcaaacauuuucagagguucauaucuugcaggagcaggauuauuguucucgauuaugaagaauacgacgaacacuagaaggggcaccggcaauauaggugagacauuaggcgaaaaauggaaaaguagacuuaacgcuuuaggcaaaagcgaauuucaaaucuauaagaaaaguggaauacaagaagucgacagaaccuuggcuaaagaagggauuaagagaggcgaaacagaccaccacgccgucaguagagguagugcgaaauuaagaugguuuguagaaaggaauaugguaacgccugaaggaaaagugguugaucuaggauguggaagaggcggauggaguuauuauugcggcggauuaaaagacguccgagagguaaaagggcuuaccaagggaggaccaggccacgaggagccaaucccgauguccacauacggauggaacuuaguacggcugcaaagcggaauagacguauucuuuacaccaccugagaagugcgacacauugcucugugacauaggugaaucgucuccuaauccaacuauagaggcugguagaacgcuaagaguacuaaauuuaguggaaaauuggcuaaauaauaauacgcaauucuguauuaaaguauuaaacccuuauaugccgucaguaauugaaaagauggagacucuccagcguaaauaugggggagcuuuaguacgaaacccucuaucccgcaauucuacacaugaaauguacuggguaaguaacgcaacugggaauauugucucgagcgucaauaugaucucaaggauguugauuaauagauuuacuaugaagcacaagaaagccacuuacgaaccugauguagacuuagggucagguacaagaaauauaggaauagaaucagaaaucccuaaucuggauaucauuggaaaaaggauagagaaaauaaagcaagagcaugaaaccucauggcauuacgaucaagaccauccguauaaaacgugggcauaucacggaucauacgaaaccaaacaaacagggagugcaaguucuaugguaaauggagugguucgacuauuaacgaagccaugggacgucguaccuauggugacacaaauggcuaugacugauaccaccccauuuggacaacaacguguauuuaaagaaaagguagauacaagaacacaagaaccaaaagaagggacaaagaaauugaugaagauaacagcugaguggcuguggaaagaauuaggcaagaagaaaaccccacgaaugugcacccgcgaagaguucacaagaaaaguucggagcaaugccgcccugggugcaauauuuacugacgaaaauaaauggaaaagcgcucgagaagcaguagaagauggacgauuuugggaacugguugacagggaaagaaauuugcauuuagaaggaaaaugcgagacaugcguauauaauaugauggggaaacgugaaaagaagcuaggcgaauuuggaaaagcgaagggaucaagggcuauuugguauauguggcuaggugcuagguuucuugaguucgaagcauuagguuuccuaaaugaagaucauugguucaguaggggcaauaguuuaucuggaguugagggggaagggcuucaccggcugggguauaucuugagagauguaggcaagaaagaggguggagcaauguaugcagaugauacugccgggugggacacaagaauaacucuagaagaucucaaaaacgaggaaaugguuacgaaccauaugaagggggaacacaagaaacuagcugaagcaaucuucaaacuaacuuaccaaaacaaaguaguuagaguacagagaccaacaccacguggaacaguaauggacauuauuucgaggagggaucaacgcggaucuggucaaguaggaaccuauggauuaaacacguuuacaaauauggaagcacaacuuauaagacagauggaaggagaagggauuuuuaaaaacauucaacauuugacugcaacagaagaaauagcugugcaaaauuggcuggcgagagucggacgcgaaagacuuucucguauggcgauaaguggagaugacuguguaguaaagccgauagaugaucgauucgcgucagcgcugaccgcauuaaacgauaugggaaaagugaggaaagauauucaacagugggagccaagccguggguggaaugauuggacucaaguaccuuucugcucacaucacuuucaugaacuugugaugaaagaugguagaguauuaguggucccaugcagaaaccaagaugaacuaaucgggcgugcuagaauuucccaaggggcuggauggucuuuaaaagagaccgcaugucucggaaaaucguaugcacaaauguggacguuaauguacuuucacagaagagacuuaagauuagcagcgaacgcgauauguagugcaguccccucacauuggguaccuacaaguagaacaacuuggagcauucaugcgaaacacgaauggaugaccacagaggauauguuggcgguuuggaaucgggucuggauccaagaaaauccuuggauggaggauaaaacgccgguagagaguugggaagaagucccauaccucgguaaacgugaagaccaauggugugggucacuaauagggcuuacuucgcgugcaacaugggccaagaauauacaaacugcaaucaaucaagugcggagucuaaucgguaaugaggaauauacugauuacaugccaucuaugaaaagauuuagaaaggaagaagaagaggcugguguccuaugguag

SEQ ID NO: 22365 - RNA, 9876 nt, Artificial Sequence
  derived and/or modified CDS sequence (opt6) from DENV-2__GQ868516__SS-prME
acugcuggaguaauaguaauguuaauuccgacaguuauggcauuucacuuaaccacucgaaacggggaaccgcacaugauugucgguagacaagaaaaaggcaaaucucuacuuuucaaaaccgaagauggcguuaacauguguacauuaauggcuauagauuuaggugaacuuugugaagauacaauaacguacaaauguccacuauuaagacaaaaugaaccagaagacaucgauuguugguguaacucuacaucgacauggauaacauacggcacauguuccacuacaggcgagcaccggcgugaaaaacgguccguugcuuuagugccgcaugucgguaugggauuggaaacuagaaccgaaaccuggauguccucagaaggcgcguggaaacacguacaaaggauugaaaccuggauuuugagacacccgggguuuacuauuauggcagccauccuagcuuacacuauaggaacaacgcauuuucaacgagccuuaauauuuaucuugcuaacugcgguagcaccuagcaugacaaugcgauguaucggaauaucuaaucgcgauuucguugaaggagucaguggcgguucuuggguggauauaguucuggaacaugggaguuguguaaccacaauggccaaaaauaaaccaacauuagauuuugaacugauaaaaaccgaagcaaaacaaccggcaacacuccguaaauauugcauagaagcaaaacucacaaauacuacaacggaaaguagguguccaacacaaggcgaaccaucucuaaacgaagaacaagauaaaagauuuauauguaaacauuccauggucgaccgcgggugggguaacggaugugguuuauucgggaaaggagggauaguaacaugugcaauguucacauguaagaaaaauauggaggguaaagucgugcaaccggaaaaucuggaauauacaauagucaucacaccgcauucgggagaggagcacgcuguuggaaacgauacaggaaaacacgggaaagaaauaaaaauaacuccucagucuucuauaacagaagcugaauuaacaggguauggaacuguuacaauggaauguucuccucguacuggauuagacuuuaaugaaaugguauuauuacaaauggaagacaaagcauggcuagugcaccgucaaugguuucucgaucugccuuuaccguggcuuccaggagcggauacacaggggucaaauuggauccaaaaggaaacuuuaguaaccuuuaaaaacccucacgcgaagaaacaagacguuguaguauuagguagccaagaaggagcaaugcacacagcccugacaggggccacagagauucaaaugagcaguggaaaucugcuuuuuacgggacauuuaaaaugucgauuaagaauggauaaguuacaacuaaaaggaauguccuauaguauguguacagggaaauuuaaaauuguaaaagaaauugcugaaacucaacaugguacaauaguaauacgcgugcaauaugaaggugauggaucgccuuguaagauaccauucgaaauaacugaucuagaaaagcgucauguuuugggcagauugauaacagucaauccuauaguuacagaaaaggacucaccuguaaacaucgaggccgaaccgcccuuuggggacaguuacauaauaauaggaguagagcccggccaguuaaaacuuaauugguuuaagaaagggucaucaauaggccaaauguuugagacaacuaugcggggcgcaaagcgaauggcaauacuaggagacacagcuugggacuucggaucuuuaggugguguauuuaccucgauaggaaaagcacuacaucaaguauucggagcaauauacggggccgcauuuucaggaguaucuuggacaaugaaaauuuuaauaggcgucauuauaacauggauuggaaugaacagcagaucgacaagucugagcgucucuuuagugcuaguugggguaguuauauuauacuugggggcuaugguacaggcugauagcggauguguaguuaguuggaagaauaaggaauuaaaauguggaucaggaauauucauaaccgauaauguacacacauggacagaacaauacaaguuccaaccggaaucacccaguaaguuagcaagugcgauccagaaagcacaugaggaaggcauauguggaaucagaagugugacacgucuggaaaacuuaauguggaaacaaauuaccccagaauuaaaucauauucuaagugagaacgaaguuaaacuaacaauaaugacaggcgacauaaaaggcauaaugcaagccggaaaacguagccuaagaccacagccgacagaacuaaaauauucguggaaaacaugggguaaggcgaaaaugcuaaguaccgaaucccauaaccaaacauuucugauugaugguccagaaacagcagaauguccaaacaccaaccgagcauggaauagucuugaaguagaagacuauggauucggaguuuucacuaccaacaucugguuaaaauuaagagaaaaacaagauguauuuugugacagcaaguuaaugucagcagcuaucaaagacaacagggcaguucaugcagacaugggauauuggauagagucagcacuaaaugacacauggaaaauggagaaagccucauucauagaaguuaagucaugucauuggccgaagagucacacacuauggucaaaugguguccucgaaagugaaaugauuauacccaaaaauuucgcuggaccggucucacaacacaauuacagaccuggauaucauacucaaacagcgggaccauggcaucuugggaaauuagaaauggauuuugaccuaugcgaagguaccacugucguaguaacagaagacugcgguaaucgcgguccaucauuaagaacuacaacagcaucagguaaacuuauuacagaaugguguugucgcucaugcacguuaccuccccuaagauacagaggagaagacggauguugguacggaauggagauacgacccuuaaaagagaaagaggaaaauuuagucaauucuuuagucacagcgggucacggacaaauagacaauuucuccuuggggguguuaggaauggcauuauuccuggaagaaaugcuacggacucgaauugguacaaagcaugcuauucuguugguagcagcaucauuuguaacauuaauaacggguaauauguccuuucgagacuuaggucgcguaaugguaauggucggagcuacgaugacugacgauauagguaugggugucacauaucuagcauuauuagcagcuuucaaaguaagaccaaccuucgccgcuggauuacuauugcgcaaauuaacuucaaaggaacuaaugauggccacuauaggcauagccuuauuaagucagaguaccauaccagagucuauccuugaacuaacggaugcguuagcauuaggaaugaugguauuaaaaauaguaagaaauauggaaaaauaccaacuagcaguaacuauaauggccauauccuguguuccaaacgcuguuauauugcagaaugcguggaaaguuucauguacaauauuagcggcagugucuguauccccuuugcuacuaacaagcucacaacaaaaagcagauuggauuccguuagcauugacgauuaaaggauugaauccaacugcaaucuuucucacaacccuaucuaggacgagcaaaaagagguccuggccacuaaacgaagcaguuauggcaguuggaauggugaguauacuagcaagcagucuacuuaaaaaugauauuccaaugacaggcccucuaguagccggagguuuacuuaccguauguuauguccuaacggggagaagugcagauuuggaauuagaaagggcagcugacguaaaaugggaagaucaagcggagauuucggguucuuccccuauuuuaaguauuacaauaucagaagaugguucuaugucuaucaaaaaugaggaggaagaacaaacguuaacuauucuuauacguacuggccuuuuaguaauaagugguguauuuccggucaguauuccgauuacagccgcagcuugguauuuaugggaagugaagaaacaacgagccgguguacuaugggacguaccaucaccuccuccaguagaaaaagcugaacuugaggauggugcguauagaauaaaacaaagagguauuuuggguuauucacaaauaggugcuggaguauauaaagaagggacuuuucauacaauguggcacguaaccagaggugcuguauuaaugcacaggggcaaacgcauagagccaucaugggcagauguaaagaaagauuuaauaucguauggaggcggcuggaaauuggaaggugaauggaaagaaggugaagagguccaggucuuggcauuagaaccaggcaagaauccuagagcgguacagacaaaaccaggaauuuuuaagaccaacacuggcacaauaggagcagucucccuugauuucucuccuggaacaagcggaucgccaauaguagaucgcaaagguaaaguggugggguuauaugggaacggaguaguaacaagaagcggagcauacgugucagcuauugcccaaacagagaaaagcaucgaagacaauccagagauagaggacgauauuuuccggaagaaacgccuaacgauuauggauuuacauccaggagccgggaaaacuaaaagauaccuaccugcaauuguuagagaagcaauuaaaagaggucugagaacccuaauucuggcaccgacccgcgugguagccgcagaaauggaagaggcacuuagaggguuaccaauacgcuaucaaacucccgcuauuaaaaccgaacauacagggagagaaaucgucgaucucaugugucaugcgacuuucacgaugagacuccuuaguccaguccguguuccaaacuauaauuuaauuauaauggaugaagcacauuuuaccgacccagcgagcauagcugcucgaggcuauaucagcaccagaguagaaaugggagaagcagcuggcauuuuuaugacagcgacuccaccaggcaguagagauccauucccgcaaaguaaugcuccaauaauggaugaagaaagggaaauuccggaacgcucauggaacuccggccaugaguggguaaccgacuuuaaaggcaaaaccguuugguuugucccuucaauaaaagcagggaacgacauagcagcuuguuugaggaagaacggaaagaaaguaauacaacuaucaagaaaaacauuugauucugaguaugugaaaacgcgagcaaacgauugggauuuugugguuacgaccgauauaucagaaaugggagcuaacuuuaaggcagaaagggucauagacccucgucgauguaugaaaccaguaauuuuaaccgacggagaagaaagagugauacuagcggguccgaugccuguaacacacagcagcgcggcacaaagacgagguagaauagggaggaauccgaaaaaugagaacgaucaguacauuuauaugggagaaccauuagaaaaugaugaagauugcgcccauuggaaagaggccaagaugcugcuugauaauauaaauacuccugaaggcaucauuccuucaauguuugaaccugaacgagagaagguugacgcuauugauggggaauaccggcuacggggugaagcgcguaaaacauuuguugauuuaaugagacguggggaucuacccgucugguuggcguauaaaguagcugccgagggcaucaacuacgcagaucguaaauggugcuuugaugguauuaaaaauaaucaaauacuagaggaaaauauggaagucgagauauggacaaaagaaggagaaaggaagaaauuaaagccccgaugguuagaugcgaggaucuauagcgacccccuagccuuaaaagaguuuaaggaauuugcagcaggaagaaagucccuaacauugaauuugauuacugaaaugggccggcuuccaaccuucaugacucagaaagcucgcaacgcauuagauaacuuagcagucuugcacacugcggaggccggcgggagagcuuacaaucaugcucucagcgaacuaccugaaacgcucgaaacgcucuuauuauuaacacuguuggccacggugacaggcggaauuuucuuauuccugauguccggaaaagggauugguaaaaugacacuuggcaugugcugcauaauuacagcuuccauacuauuaugguaugcacaaauacaaccacacuggauugcagcaaguaucauacucgaauuuuucuuaaucguuuuguuaauaccagaaccagaaaaacaacgaacaccucaagauaaucaauuaaccuaugucguaaucgccauacuuacaguaguagcugcgacaauggccaacgaaaugggcuuccuugagaaaacuaagaaagaucucggucucggaucaaucacaacgcaagaaucagaaucuaacaucuuagauaucgaccuacggccugcuagugcauggacucuauaugcggucgcgacaacauuugugaccccaauguuaagacauaguauugaaaauucgagcgugaaugucucgcuuacggcaauugcaaaucaagcgacuguacugauggggcuggggaaaggguggccacuaucaaaaauggauauaggcguaccuuuacuagccauaggauguuacucacaggucaauccaauuaccuuaacugccgcguugcuuuuauuaguggcucauuacgcuauaauugguccaggauuacaagcgaaggcgacccgugaagcucagaaaagggcugcagcaggaaucaugaaaaacccuacugucgacggcauaacggugauagaccucgaaccaauacccuaugauccaaaauucgagaaacaauugggucagguuauguuauuaauccugugcguuacgcaaguauugaugaugagaacaacaugggcccucugcgaggcguuaacuuuagccacaggaccaauuucuacuuuaugggaagguaaccccggaagguuuuggaauaccaccauagcaguuuccauggcaaacauauucagagguagcuaucuagcgggagccgguuuauuguuuaguauaaugaaaaacaccacgaauacccgacgugguacuggaaauauaggagagacccuaggugaaaaguggaaaagcagauuaaaugcccucggaaagucagaauuucaaaucuauaaaaagucuggaauacaagaagucgauaggacauuagcaaaagaaggaauuaaaaggggagagacagaucaucaugcagucagcagaggaagcgcuaaacugagaugguucguagaacguaauaugguuacaccagaaggaaaagugguagaccuuggauguggcagggguggauggucuuacuauugcggcggacuaaaagacguaagggaagucaaaggacugacaaaaggaggcccuggacaugaagaaccaauuccaaugucaacauaugguuggaaccugguucgauugcaaucagggauugauguauucuuuacuccaccugaaaaaugugacacccuauuaugugauauaggugaaaguaguccgaacccuacaauugaggcaggucggacacugagaguacuuaauuuaguggaaaacuggcuaaauaacaacacgcaauucuguaucaaaguacuuaacccauauaugcccagcguaaucgagaaaauggagacucuucagagaaaauacggaggggcgcuugugcguaauccguuaucaagaaauucaacacaugaaauguauugggucucaaaugcuaccgguaacauugucaguaguguaaacaugauaucgagaauguugauuaaucgguuuaccaugaagcacaaaaaggccacguaugaaccggauguagaucuaggaagugggacacgaaauauagggaucgaaagcgagauuccaaauuuggauauuaucggcaaaagaaucgagaagaucaaacaagaacacgaaaccagcuggcacuaugaccaagaccauccauacaaaacgugggcguaucaugguagcuaugaaacgaaacaaacaggcucugcaagcagcaugguaaacggaguaguuagacuguuaacuaaacccugggaugugguacccaugguaacucaaauggcuaugacugacacuacaccauuuggccagcagaggguauucaaggaaaagguagauacaagaacacaagaaccaaaagaaggaacgaagaaauuaaugaaaauaacagcagaguggcucuggaaagagcuugguaagaagaaaacacccaggaugugcacuagagaagaauuuacucgaaagguccggucaaacgcugcacuaggcgcgauauuuaccgaugagaacaaguggaaauccgcacgagaagcaguagaagauggccgauuuugggagcucguagaccgagaaagaaauuugcauuuagagggaaaaugugaaacaugcguauauaauaugaugggaaaacgugagaagaaacugggcgaguucgggaaagcaaaaggaucuagagcuauaugguauauguggcuaggcgcaagauuuuuagaauuugaagcguuagguuuucuaaaugaagaucauugguucagucguggaaacucgcuguccgguguggagggugaggggcuccaucgauuaggauauauucuaagagauguuggcaagaaagaaggcggggcuauguacgcagacgauacugccgguugggauacaaggaucacacuugaagauuuaaagaaugaggaaauggugacgaaucacaugaaaggcgaacauaaaaagcuagcagaggccauuuuuaaauugacuuaccaaaauaaaguagugcgugugcagcgaccgacaccucgagguacaguuauggacauaauaucaagacgugaucaacguggaucagggcaaguaggaacuuauggacuuaauaccuuuacaaacauggaagcacagcuaauccgccaaauggaaggcgaggguauauucaaaaacauacaacaucucacugcuacagaagagauagcugugcaaaauugguuagcgcgaguaggacgggaaagacugaguagaauggcgaucuccggcgacgacuguguaguaaaacccauagaugauagauuugccucagcauugacagccuuaaacgacauggguaaaguaagaaaggauauacaacagugggaaccuaguagggguuggaacgauuggacgcaaguacccuuuuguucucaccauuuucaugaacuugucaugaaagaugguagaguauuagugguuccgugucguaaccaggaugaacuuauugguagagcuaggauaucgcagggugcgggauggagccuaaaagaaacagcgugucugggaaaaagcuaugcacaaauguggacucuaauguacuuucauagacgugaucuucgacuugccgcaaacgcaauaugcucagcaguaccaagucacuggguucccaccaguaggacuacuuggucuauccacgccaagcacgaauggaugacaacggaagacaugcuagcaguuuggaaccgggucuggauacaagaaaauccuuggauggaagacaaaacuccaguggaaucaugggaagaagugcccuauuuaggcaaacgugaagaucaauggugcggaucacuaauaggucuuacaucccgugcaacaugggccaaaaacauacagacagccauaaaucaaguccguucuuuaauugggaaugaagaguacacagacuacaugccuaguaugaaaagauuuaggaaagaagaggaagaagcaggcguacuaugguaa

SEQ ID NO: 22366 - RNA, 9876 nt, Artificial Sequence
  derived and/or modified CDS sequence (opt6) from DENV-2__GU131975__SS-prME
acagcaggggugauaguaauguugauuccgacuguaauggcuuuccaucucaccacucgaaacggggaaccacauaugauuguuggacgccaagaaaaagggaaaucuuuguuauucaaaacagaagaugguguaaacaugugcacacuuauggcaauugacuuaggugaacugugugaagauacgauaacuuauaaaugcccacugcuucggcagaaugaaccagaagacauagauuguuggugcaauucgaccaguacuuggauaacauacgggacaugcucuacaacgggagaacacagaagggagaaaagaucaguagccuuaguaccacauguggguaugggucuagaaacaagaacggaaacauggauguccucugaaggugcauggaaacacguacaaagaauagaaacuuggauacuaaggcauccaggauuuacaauuauggcugcaaucuuggcauacacgauagggaccacacauuuucagagggcauugauuuuuauuuuacucacugcaguggcgcccaguaugacuaugagaugcauaggaauuuccaaccgagacuucguagaagguguuaguggagguucauggguagauauuguacuggaacacgggaguugugucaccacaauggccaaaaauaaaccuacacucgacuuugaauugauaaaaacugaagcuaaacaaccagcaacacucagaaaauauuguauagaagcaaaauugacuaauacuacaaccgaauccagauguccuacccaaggagaaccaagccuuaaugaagaacaagauaaaagguucauuuguaaacacucaaugguugauagaggauggggaaauggauguggacuuuuugguaaaggaggaaucguuacuugcgcgauguucacuuguaagaaaaauauggaggggaaaguuguucaaccugagaaccuagaauacacaauugugauuacgccucauagcggagaagaacacgccguagguaaugauacaggcaaacauggaaaagaaaucaagaucacaccucagucuucaauuacggaggcugaacuaacgggguacggaacuguaaccauggaauguucaccucgcacggguuuagacuuuaaugaaaugguauuacuacaaauggaagacaaagcguggcuuguucaucgacaaugguuucucgauuuaccauugcccuggcuaccaggagccgacacucaaggcaguaauuggauacaaaaagaaacguuagucacguuuaagaauccucacgcgaagaaacaggauguggugguacuaggaucacaggaaggagcaaugcacacagcguuaacuggagcaacggagauucagaugucuucgggaaaccuucuuuucaccggacaucugaaaugcagacucagaauggauaaacugcagcuuaaggguaugucguacucaauguguacugguaaauucaagaucguaaaagaaauagcugagacucaacauggaacuauugugauccgcguacaauaugaaggcgauggauccccgugcaaaauacccuuugaaauuacggaccuugagaaaagacauguccucggaagauuaaucacugucaauccaauuguaacugagaaagauucuccagucaacauagaagcggaaccaccauucggugacaguuauauaauaaucggcguagaaccaggucagcuuaaauuaaauugguuuaagaaaggaucaucuaucggccaaauguucgaaacgacaaugcgaggagcuaagagaauggcaauacugggagacacagcuugggacuucgggucccuaggagggguuuuuaccaguauagguaaggcacuccaucaaguauuuggagcgauuuauggagcggcauuuucaggaguuucuuggacaaugaaaauccuuauaggaguaauaaucaccuggauugguaugaacucaagaucgacuagcuuguccguaucauuaguuuugguggggguaguuauacuauaucuaggagccaugguucaagcagauagugguugcguaguaucauggaaaaauaaggaacuuaaaugcggaucuggcaucuuuauuacggauaacguucauaccuggacagaacaauacaaauuucaaccugaaagcccauccaagcuggcaucagcuauucaaaaagcccaugaagaggggauuugugguaucagaucgguaacaagauuggaaaacuuaauguggaaacaaauuacaccagagcuuaaccacauuuugucggagaaugaaguaaaauuaacuauaaugacaggagauauaaaaggaauaaugcaagcugggaaaagaucacuucgaccacaacccaccgaacuaaaauacucguggaaaacaugggggaaagccaagaugcuuucaacugagucacacaaucagacuuuucuaauugaugguccggaaacagcugaauguccuaacacaaauagagcguggaacucguuagaaguugaagauuacggauuugguguauuuacaacaaauauuuggcugaaauugcgcgagaagcaagaugucuuuugugacagcaaauugaugucagcagcuaucaaagauaauagagcuguacaugcugauaugggauauuggauagagagcgcauuaaacgacaccuggaagauggaaaaggcuucguuuauagaaguaaaaucaugucacuggccuaaaucacacacccuuuggaguaacggaguacuagaaucggagaugaucauacccaaaaacuuugcaggccccgugagucaacauaauuaucgaccaggguaccauacacagacagcuggaccuuggcaucuaggaaagcucgagauggacuucgacuugugcgagggcacgaccguugucgucaccgaagauugugggaauagaggaccuucuuuaagaacgacaacggccaguggaaaacuuauaacagaaugguguuguagaucuuguacacuuccaccucuuagauacaggggagaggauggguguugguauggaauggaaauccgcccauuaaaagaaaaagaagaaaacuuaguuaacucucuaguaacggcaggacauggacagauagauaauuuuagucucggcguacuaggcauggcuuuauuucuugaagaaauguuacggacaaggauagguacaaagcaugcaauuuugcuaguggcagcgucuuucguuacacucauuaccgggaauaugaguuucagagauuuaggcagagugauggucaugguuggcgcaacuaugaccgacgauauaggaaugggaguuaccuacuuagcauugcuggccgcauuuaaaguucgaccaacauuugcagcagggcuauuacuaagaaaacuaacuuccaaggaauuaaugauggcaacuauaggaauagcgcuacugagccaaaguacuauuccggaaucuauccuagaacuaacagaugcacuagcccucgggaugaugguuuugaaaaucgucagaaacauggaaaaauaccaacuggcaguuacaauaauggcaauaaguugcguaccaaaugcggugauccuacaaaaugccuggaaaguuagcugcacaauuuuagcugcgguuucuguaagcccacuauuauuaacgagcagucaacaaaaggcugauuggaucccauuagcguugacgauuaaaggacugaauccuacugcuauuuuucuuacaacguuaucaagaacgagcaagaaacguuccuggccccuaaaugaggcaguaauggcagucgguaugguaaguauuuuagcaagcagccugcuaaagaacgauauaccaaugacagguccguuaguggcugguggacuccuaacaguuuguuacguucuaacaggucgaagugcugacuuagaacuagaacgagccgcagacguuaaaugggaggaucaagcagaaauauccgggucuucuccaauuuuaucuaucacuauaagcgaggacggcagcaugucaaucaaaaaugaggaagaggaacagacauuaacaauauugauucggaccggacuacuuguuaucucugggguuuuuccgguuucgauaccaaucacagcggccgcgugguaccuuugggaagucaagaaacagagggccgguguccuaugggauguacccucgcccccaccaguggaaaaagcagagcuggaagacggcgcauaucggauuaaacaacgagguauacuaggauauagccagaucggggcgggggucuacaaagaggguacguuucauacuauguggcauguuaccaggggagccguauuaaugcaucggggcaaaagaauugaaccaucuugggcagacgugaagaaagaccugauaucauacggagguggauggaaacuugaaggcgaguggaaagaaggggaagagguacaaguucuugccuuagaaccagggaaaaauccacgcgcgguacaaacuaaaccaggaauauucaaaaccaacacaggcacaaucggggcuguaagccuugacuuuucgcccggaacgucuggaaguccuauaguagaucggaaagguaaaguuguagguuuauauggaaaugguguuguuaccagaucuggagccuacguaucggcaaucgcacaaacggaaaaaucuaucgaagacaauccggagaucgaggacgauauauucagaaagaaaagacucacgauaauggaccuacaccccggagccgguaaaacaaaacguuauuuacccgcuauaguacgcgaagcaauaaagaggggauuacgaacucuuauacuggcaccuacaagaguugucgcugcagaaauggaagaagcgcugagaggauuaccaauccguuaucaaacuccugcuauuaaaacggaacauacuggacgcgaaauagucgaucuaaugugccaugcaaccuuuacaaugcgguuauuaagccccguuagagugccgaacuauaaccuaaucaucauggaugaagcacauuucaccgauccagcaucgauugcugcacguggauauauaaguacacgugucgaaaugggagaagcagcaggaauuuucaugacggcuacaccuccgggauccagggaucccuuuccucaauccaaugcaccuauaauggaugaagaacgggaaaucccagaacgaucuuggaacuccggccacgagugggucacugauuucaaagguaaaacagucugguucgucccgucuauuaaagcaggaaaugauauugcagcuugucuaaggaaaaauggcaagaaaguuauacaauuaucaaggaaaacuuucgacagugaguauguaaaaacuagagcuaaugauugggauuuuguaguaacuacugauauaucagaaaugggagcuaauuuuaaagcggaaagagucauugacccucgacgauguaugaaacccgucauacucacggauggugaggaaagagugauauuagcagguccaaugccggugacucacagcucugcugcucaacgcagagguagaauagggaggaauccuaaaaaugaaaaugaccaauacaucuacaugggugaaccucuagaaaaugaugaagauugcgcgcauuggaaagaagccaaaaugcucuuggauaacauaaauacaccagaaggaauaauaccgucaauguuugagccagaaagggaaaaaguggaugcaaucgauggugaauaucgacuuagaggcgaagcgcggaaaaccuucguugaccuaaugcgucguggugaccucccaguuugguuggcguauaagguagccgcugagggcauaaauuacgcagauaggaaauggugcuuugacggaaucaaaaacaaucagauucuagaggagaacauggagguggaaauauggacuaaagaaggugagaggaagaaacuaaagccucguugguuagacgcgcguauauacucggauccauuagccuuaaaagaauuuaaggaguuugcggcuggucgcaagagcuuaacauuaaaccuaauuacagaaaugggaagacugccaacauuuaugacacaaaaagcacgaaaugccuuagacaacuuagcaguacuacauacugcagaagcuggcggucgagcauauaaccacgcucucagugagcuaccagaaacguuggagacucuuuuguuacuaacgcuauuagcuacaguuacgggcggcauauuuuuguuccuuaugaguggcaaagggaucggaaaaaugacauuaggaauguguugcauaauuacugcguccauacugcucugguacgcccaaauacaaccacacuggauagcagcaucuauuauacucgaguucuuuuuaauaguacuguuaauuccagaaccggaaaaacaaaggacaccacaagacaaccaacuaacauacgugguuauagccauacuuacaguuguugcagcgaccauggcaaacgagaugggguuuuuagagaaaacaaagaaagaccuugggcuagggucuaucacaacucaagaaucugaaaguaauauacuagauaucgacuugcguccagcaagugcauggacccuauacgcuguggccacuacguuugucacaccgauguuaagacauaguauugaaaauucuucaguaaacguuucguuaacagcgauagcaaaccaagcaacaguucuaaugggacuagguaaaggauggccucuaucuaagauggacauaggugucccauuauuagccaucggcuguuacucucaaguuaaccccauuacauuaaccgccgcauuguuauuacuugucgcacauuacgcgaucauugguccuggucuucaagcaaaagcaacaagagaagcgcaaaagagagcugcggccggcaucaugaaaaacccaaccguagacgguauuacuguaauagaccuagagccuauccccuaugacccgaaauuugaaaaacaacucggucaagucaugcuucuuauuuuaugugugacacaaguacugaugaugcguaccacaugggcgcugugugaagcauugacacucgcaacaggcccaauaagcacucugugggaagguaauccggggcgauucuggaauaccacgauugccguuucuauggcaaacauauuuagaggcaguuauuuagccggggccggucuacuuuucuccauaaugaaaaacacuacaaauacuaggagaggaacaggaaauauaggagaaacauuaggcgaaaaauggaaaucgagacuuaacgcauuggguaaauccgaguuucaaauauauaagaaaucuggaauacaagaaguagaccgaacacuggcuaaagaagggauaaagaggggagagaccgaccaucaugcagucucuaggggaucugcaaaguuaagaugguucguugagagaaauauggugacgccugaagguaaggugguagaccuagguuguggaagaggcggauggucuuauuauuguggcgggcuuaaagauguucgugaagugaaaggacuaacgaaaggugguccagggcaugaggaaccuauuccaaugaguacauauggauggaauuuaguacgacuacaaucgggcauugauguguuuuucacuccgccggaaaaaugcgauacucucuugugugauauaggagaaucaagcccaaauccuacaauugaagcuggacgcacacuaaggguuuuaaaucucguagaaaacugguuaaauaauaauacucaauuuuguauuaagguacuuaacccauacaugccaagcgugaucgaaaagauggaaacgcuacaacgaaaguauggaggagcauuaguucgaaauccucuuagccgcaacuccacacaugaaauguauuggguaagcaaugcaacagguaauauugugucaucaguaaacaugauaagcagaauguuaauuaaccguuucaccaugaagcacaaaaaggcgaccuaugaaccugacguagauuuaggaagugguacccguaacauagguauagaaucagaaauaccgaaucuagacauaauuggcaaacgcauugaaaagauaaagcaagaacacgaaacaaguuggcauuaugaccaagaucauccuuacaaaaccugggcauaucaugggucauaugaaacgaagcagacgggauccgcuucauccauggucaacggggucguucgacuacuuaccaaaccaugggauguaguccccauggucacacaaauggcaaugacagauacuaccccauuuggucagcagagaguuuuuaaggagaagguugacacaagaacucaggaaccaaaggaagggacuaaaaagcuaaugaaaauaacagcggaguggcucuggaaagagcuaggcaagaagaaaacgccacggauguguaccagagaagaauuuacccgaaaggucagaaguaacgcagcacucggagccauuuuuacugaugaaaacaaauggaaaagugcaagagaggcaguggaagaugguagauuuugggaauugguagauagggaaagaucccuucaccuagaagguaaaugugaaacuuguguguacaauaugauggggaaaagagaaaagaaacugggagaauuuggcaaagcaaaaggaucuagggcaauaugguauaugugguuaggggccagauucuuggaguucgaagcauuaggauucuuaaacgaagaucacugguuuuccagggggaauagccuauccggaguugagggggaaggacuccacagauuagguuacauauuaagggauguaggcaagaaagaaggaggcgcuauguacgcggacgauacagccgguugggauacaagaaucacuuuggaggauuuaaagaacgaagaaauggucacuaaccacaugaaaggugaacacaagaaacuagcagaagcaauauuuaaacucacuuaucagaauaaaguugugagagugcaacggccaaccccaaggggaacugucauggauauuauuuccagaagggaucaacgagguaguggacaaguuggaacuuauggacuaaauacauucaccaauauggaggcacaauuaaucagacaaauggagggagaagguauauucaagaacauacagcaucuaacugcaacagaggaaaucgcggugcaaaacuggcuagcaagaguaggcagggagaggcuuucgcgaauggccaucuccggugaugacugcguaguuaaaccuauugacgacagguuugcgagcgcccuuacagcccuaaaugauaugggaaaaguaaggaaagacauacaacagugggagccaagcagaggauggaacgauuggacucaagugccauuuuguucgcaucacuuucacgaacucgugaugaaagacggccgaguacuuguggucccauguagaaaucaagaugaguuaaucgguagggcucgaauaucucaaggugcaggauggucacuaaaagagaccgccugcuugggcaagucauaugcccaaauguggaccuugauguauuuucaucgacgagauuuaagacuggcagcgaacgcuauauguucagcuguaccuucacacuggguaccgacaagcagaaccacauggucaauacaugcaaaacacgaguggaugacgacugaggacaugcuggccguguggaaucgugucuggauucaggagaauccguggauggaagacaaaacaccggucgaaucaugggaagaaguacccuacuugggaaagcgagaggaucaguggugcgguucacuuauuggacuuacgaguagagcuacuugggccaaaaacauacaaaccgcuauuaaucaaguaaggaguuugauugggaacgaagaguauacugauuauaugcccagcaugaaacgauucagaaaagaagaagaagaagcuggaguauugugguag

SEQ ID NO: 22367 - RNA, 9876 nt, Artificial Sequence
  derived and/or modified CDS sequence (opt6) from DENV-2__JN819422__SS-prME
acggcuggagucauagucaugcuuauaccuacugcaauggcauuccaccuuacuacacguaauggggaaccacauaugauaguugggagacaggaaaaaggaaaaucauuacuauuuaaaacagaagacggggucaacaugugcacuuuaauggcgauugacuuaggagaacuuugugaagacaccauaaccuauaaauguccccuuuuaagacaaaaugaaccugaagauauagacuguugguguaauucuacaucuacguggguaacuuauggaacaugcacaacaacuggagaacaucggagagaaaaacgcagcguggcauuagucccccacguagggaugggacuagaaacuaggacggaaacauggaugucaagugaaggagcuuggaaacacguucaacguauugaaacauggauuuuacgccaccccggguuuaccaucauggcggcaauacuagcauauaccauagguacaacacauuuccaaaaagcacuaauauucauauuguuaacagcaguugcaccauccaugacgaugagaugcauaggcauaucaaaucgcgauuucguagaaggaguaagcgguggaucauggguugauauaguauuagaacacggaaguuguguuacaacaauggccaaaaacaaaccaacauuagacuucgaacugauuaaaaccgaagccaaacagccagcaacucuacgaaaauacuguauugaagccaaacucacuaacacaacuaccgaaucacggugcccgacucaaggagaaccgucauugaaugaagaacaagauaaaagauuuauuuguaaacacucuaugguagauagagggugggguaacgguugcggacuuuuugguaaaggagguauagugacaugugcaauguuuacaugcaagaaaaauauggaaggaaaaguugugcagccggaaaaucucgaauauacaauaguaauaacaccucauaguggugaagaacaugccgucggcaaugacacagggaaacacggaaaagagauaaaaauaacaccgcaaaguagcauaacagaagcagagcucacuggauauggaacaguaacuauggaauguucgccuagaaccggauuagacuucaacgaaaugguguuacuacaaauggaagauaaagcgugguuaguacauaggcagugguuccuugaucucccguuacccuggcuaccgggggcagauacucaagguaguaauuggauccagaaagaaacauuagucacauucaaaaauccacaugcaaagaaacaagaugucguaguauugggaucucaggagggcgccaugcauaccgcucuaacaggggcaacugagauccaaaugaguucaggaaauuuguuauuuacuggucacuuaaaaugcagauuaaggauggauaaacuacaacuaaaaggcaugaguuacucaaugugcacaggaaaauucaaaauaguaaaagagauagcagaaacacagcaugguacuauagucauucguguucaauacgaaggugaugggucacccugcaaaauuccauuugagaucacagaccucgagaaaagacacguauuaggacgccugauuacuguuaauccgauuguuaccgagaaagauucgccaguaaauauugaggccgagcccccguucggggacucuuacauuauuauagggguagaaccuggucaauugaaguuaaacugguucaagaaagguucaucgauugggcaaauguucgaaacaacgaugagaggugcaaaaaggauggcgauacuaggcgacacagcgugggacuucgggagccugggaggcgucuucacuagcauagggaaagcauugcaccaagucuucggcgcaaucuacggcgcagccuucagcggaguauccuggacaaugaagauuuuaauuggagugauuauaacauggauugggaugaacucccgaucgacaucauuaucuguuaguuuggucuuaguugguguaguuacccuauauuuaggugcaaugguacaagcggacuccggcuguguagugaguuggaaaaauaaagaguuaaaaugcggcuccgguauauuuauaacagauaauguacacacuuggacagaacaauauaaauuucagccagagucgcccaguaaguuagcuucagcuauucagaaagcucaugaagaagguaucugcgggauaagaagcguuacgagguuagaaaauuugauguggaaacagauaacuccugaacuaaaccauauacucagugaaaacgaaguaaaguuaacuauaaugacaggagauauaaaagggauaaugcaggcaggaaaaagaucucucagaccacaacccaccgaauuaaaguauucauggaagacaugggggaaagcuaagauguuaagcacagaaucacacaaccaaacauucuuaauugauggcccagaaaccgcggaauguccgaauacuaauagggccuggaacucccuugaaguugaagauuacggcuucgguguauuuacuacgaauauaugguuaaaacuaagagaaaaacaagauguguuuugugauucaaaacuaaugagugcagcaauaaaagacaacagagcgguacacgcugacaugggcuauuggauagaaagcgcacucaaugacacauggaaaauggaaaaagccaguuuuaucgaagucaaauccugucacuggccaaaaucacacacauuauggaguaacgguguacuggaaucugaaaugaucauacccaaaaauuucgcaggaccaguuagccaacauaacuauagacccggauaucauacacaaacugcaggaccauggcaccuugguaaauuagaaauggauuuugacuuaugcgaagguacgacaguagucguuacugaagauuguggaaaucgaggucccucgcuucguacgacaaccgcaucaggcaaacucauuacggaaugguguugucgaucuuguacguugccacccuuacgcuaccgaggcgaagacggcugcugguacgguauggaaauucgaccauuaaaagagaaagaagaaaacuuagugaauaguuuagugacugcaggacacggacaaaucgacaauuucucauugggagugcuaggaauggcucuauuuuuagaagaaaugcugaggacaagaauaggaacaaagcacgcuauucuccugguagcugugaguuucgucacucuaauaacuggaaacauguccuuuagagaccucggaagagucaugguaaugguaggggcuacgaugacugacgacaucggaaugggcguaacauaucuugcccuauuagcggcauuuaagguccgaccaacguuugcugcgggacucuuauuacgcaaacuuacaucaaaagaacuaaugauggcaaccauuggaauagcacuauuaucccaaaguacaauuccagaaaccauacuagaauuaaccgaugcguuagcuuuaggaaugaugguguuaaaaauuguaaggaauauggaaaaauaccaacuugcagugacaauaauggcuauuaguuguguaccgaacgcaguaauacugcaaaaugccuggaaagucaguugcaccauccucgcagcagucucagugucacccuugcugcucacaaguagucagcaaaaggccgauuggaucccgcuugcacugaccaucaagggacucaaucccacugcuauuuuucuuacaacacuuucgcgaaccagcaagaaacguaguuggccgcuaaaugaagcuauuauggcgguuggaaugguuucuauacuugcgucgagucuacuaaagaaugauauuccaaugacugguccccugguugcugguggcuuguuaacuguuuguuauguuuuaaccggcagauccgcagaccuagaacucgagcgagcagcugacgucaaaugggaagaucaagcagagaucagugggucuucacccauccuguccauuacaauuucggaggauggaaguaugucuaucaaaaaugaagaggaagaacagacucuuaccauacuaauacggacuggcuuauuagugauauccgggguauuuccagucagcaucccaauaacugcagcggcaugguacuugugggaagugaagaaacagagagccggagucuuaugggacguacccaguccacccccaguggaaaaagcagaacuugaagacggagcauaucguaucaaacagagaggcaucuuggguuauagccaaauuggagcugggguuuauaaagaaggaacguuucauacaauguggcaugucacaaggggagcaguacuaaugcaccgagguaagagaaucgaaccaucuugggcagauguuaaaaaggacuuaauuucguacggugguggguggaaguuagagggagaguggaaggaaggggaagagguacaaguacuagcauuagaaccaggcaaaaauccacgagcuguccagacaaaaccuggaaucuuuaagacaaauacaggaacgaucggggcugugucucucgacuucucgccaggaacaagugguuccccuauagucgacagaaaggggaaagucguuggucuauacgguaauggagucguaacucgaaguggagcauacguaucggcaauagcgcagacggaaaaaucaauagaagacaauccggaaauugaggacgacauauuuaggaagaaacgacugacuauaauggaucuucacccuggcgcagguaaaacaaaaagguaccugccagcaaucgucagagaggcaauaaaaagaggacuuaggacacugauccuugcuccaacaaggguuguugcggcagagauggaagaagcucugcgaggucuaccaauacgauaucaaacgccagccauuaaaacccaacauacagguagagaaauuguugaucuaaugugccacgcaacguucacaaugagauuauuauccccagugcgagucccuaacuauaacuugauuaucauggacgaagcacacuuuaccgacccagcaucaauugcugcgcggggguacauuucaacgaggguagaaaugggagaagcugcaggaaucuuuaugacugccaccccuccagggucucgcgacccguuuccucagucuaaugcuccaauuauggaugaggaacgagagauccccgaacgcucauggaacucuggccaugaguggguuacggauuuuaaaggaaaaaccguaugguucgugcccaguauaaaagcaggaaacgacauugcggccuguuugaggaaaaacgggaagaaagugauacagcugaguagaaaaacauuugacucggaauaugucaaaacaagagcaaacgauugggacuuuguggugaccacugacauuagcgaaaugggagcaaacuuuaaagcagagcgcgucaucgaucccaggcgguguaugaaaccuguaaucuuaacugauggagaagaacguguaauacuugcgggaccaaugccaguuacacauagcagugccgcucaacggcguggccguauaggaagaaaccccaaaaaugaaaaugaccaauauauauauaugggagaaccauuagaaaacgacgaagacugcgcccauuggaaagaagcuaaaauguuauuagauaacauuaacacuccggagggaauaauucccucaauguuugaaccggaaagagaaaagguggaugcaauugacggagaauauagacugagaggggaagccagaaaaaccuuuguagauuuaaugagacguggcgaucugccuguauggcuggcauacaaaguagcagcagagggaaucaauuacgcugauagaaaaugguguuucgacggaauuaaaaauaaucagauacuugaagaaaauauagaaguugagauuuggaccaaagaaggugaaagaaagaaacuuaaacccaggugguuagacgcccguauauauuccgauccacuagcguuaaaagaguucaaagaguucgcagcuggucguaaaagccugacgcuaaaucucauaacagaaauggggagacuuccaaccuuuaugacacaaaaagcuagaaacgcauuagacaaucuggccguauuacauacugcggaagcaggcgggagagcuuacaaucacgcacuaucugagcuaccugaaacacuugaaacauuguugcuacucacuuuacuagccaccguaacagggggaauauuucuauuuuugaugucagggaaaggaguaggaaaaaugacauuggguauguguuguauuauaacugcgaguauacuauuaugguaugcccaaauacagccgcauuggauagcagcaucuaucauucuggaguucuuuuuaaucguccuauuaauacccgagccagaaaaacaacgaacuccacaagauaaucaacuaacauacguaguaauugcaauacucaccguuguagcggcgacaauggcuaaugaaaugggauuucuagagaaaacuaagaaagauuugggacuuggauccaucacaacccaagaaucugagucaaauauacucgauauagaucuaagaccagcuucugcguggacauuguaugcaguagcaacaacauuuguaacgccaaugcuuagacauucaauagaaaacucaucgguaaaugucucguuaaccgcaauugcaaaucaagcaacgguuuugaugggguuggguaaagguuggccacuuucuaaaauggauauuggagucccguuauuagcuaucggcuguuauucacaggucaaccccauaacgcucacagcagcauugcuucuguuagucgcacauuaugccauaauaggaccgggacuacaagccaaagcgacaagggaagcccaaaaacgggcugcagcuggcauaaugaagaaucccaccguagacggaauaacggugaucgacuuggaaccuauuccuuaugacccuaaauuugaaaagcaacuaggacagguaauguugcuaauucucuguguaacccaaguucuaaugaugaggacaacaugggcauuaugugaggcuuuaacguuagcaacagguccaaucucgaccuuaugggaagggaaccccggacguuuuuggaauacaacaauagcgguguccauggcgaauaucuuucgcggauccuauuuagcaggagcuggauuacucuuuucuauuaugaaaaauacaacuaauacacguagagguacggguaacauaggagagacguugggggaaaaauggaaaucuagacuaaacgcauuagggaaaagcgaguuccaaguguauaagaaauccggaauacaagaaguugaccggacauuagcaaaagaaggcauaaaaagaggagaaacagaccaucaugccguaucuagaggauccgcaaaacuucggugguuugucgaacgaaacaugguaacgccagagggaaagguaguagaucuuggcugcgggcgaggcgguuggaguuauuacugcggcgggcuaaagaacguaagggaaguuaaagguuuaacaaaagggggaccuggucaugaagaaccgauacccaugaguacguauggguggaaccuagugcgccuacaaucagguguggauguauuuuucacuccaccggaaaaaugugauacucuacuuugugacauuggugaaucaagcccaaacccgacaaucgaggccggaagaacacuaagagugcuaaaccuuguugaaaacugguuaaauaacaauacucaauucugcauuaagguauugaacccuuacaugccuaguguuauugagaaaauggaagcauuacaaagaaaguacgguggugcauuaguuagaaauccccugagucgaaauucuacacaugaaauguacugggucucaaacgcgacuggaaauauugucaguucugucaauaugaucagucgaaugcugauuaaccgcuucacaaugaaacauaagaaagcuacauaugaacccgauguugauuugggcaguggaacacguaacauaggcaucgagucagagauacccaaucucgacauuauuggaaaaagaaucgaaaagauuaaacaggagcaugagacauccuggcauuaugaucaagaucacccauauaagacuugggccuaccacgguucguacgagacgaaacaaacaggaucagcaucuagcauggucaauggaguuguuagauuauuaacaaaaccuugggacguuguaccaauggugacucaaauggccaugacagacaccacaccuuucggucaacagaggguauucaaagaaaaaguugacacaaggacacaagagccaaaagaagguacuaaaaagcugaugaaaauaacugcugaguggcuauggaaagaacuagguaaaaagaaaacaccacggaugugcacucgagaagaauuuaccagaaaaguuagauccaacgcagccuuaggagccauauucacagacgaaaacaaguggaaaucagcgagagaagcaguggaagauggcagauucugggaauuaguagauagagaaagaaaccuccaccuagagggaaagugcgaaacguguguauacaauaugaugggaaagcgagagaagaaauugggagaauuuggaaaagcuaaaggaaguagagcaauaugguacaugugguuaggagcaagguuccucgaauuugaggcuuuaggauuuuuaaacgaagaucauugguuuagccgggggaacucucucucagguguagaaggugaaggucugcaucgguuaggauacauccuuagggacguuggcaagaaagagggcggugcaauguacgcagacgauacagcaggaugggauacacgaauuacauuagaagaucucaaaaacgaagaaaugguaacaaaccauaugaagggugaacauaagaaauuagcugaagcuaucuuuaaacuaacauaucagaacaagguugucagaguucaacggccaacgccacgcgguacaguaauggauauaaucucaagacgcgaucaaagagggucaggacaaguaggcacuuaugggcuuaauaccuuuacgaacauggaggcacaguuaauacgucaaauggaaggugaaggaauuuucaaaagcauucaacauuuaaccgcuacggaagagauugcgguacaaaacuggcuagcgagaguaggccgugaaagacuaucccgaauggcuauaagcggggaugacugcgugguaaaaccuauagaugaccgauuugccagcgccuugacggcccugaaugauaugggcaaaguacgaaaagacauccagcaaugggaaccaucacguggauggaaugauuggacccaagugccuuucugcagccaucacuuccacgagcuaguaaugaaagacggacgaguucuagugguuccauguagaaaucaggaugaacuaauuggccgcgcucgaauuucccaaggcgcagguuggaguuuaaaagaaacugccugcuuggguaaaucguacgcccaaauguggacccuaauguacuuucaccggagagacuugcgauuggcugcgaaugcaauauguuccgcuguaccaccacauuggguuccaacaucacguacaacguggucgauacaugcaaaacaugaauggaugacuacagaagacauguuagcugucuggaaccgaguauggauacaagagaacccuuggauggaagauaaaacuccuguugagaguugggaggaggugcccuaucuggguaagcgggaggaucaaugguguggcagucugauuggacugacaucaagagcaacaugggccaaaaauauucaaaccgcuauaaaccaagucaggagccugauugggaaugaggaauauacagauuauaugcccaguaugaagcgguuccgcagagaggaggaagaagccgguguauugugguga

SEQ ID NO: 22368 - RNA, 9876 nt, Artificial Sequence
  derived and/or modified CDS sequence (opt6) from DENV-2__GU131955__SS-prME
acagcggggguaauaguaauguuaauaccaacugugauggcuuuucauuugacaacacggaauggagaaccacacaugauaguugguaggcaggaaaaaggaaaaucucuacuguuuaaaacugaagaugguguaaauaugugcacccuuauggccauagacuuaggcgaacuuugcgaagauaccauaacauacaaaugcccacugcuaaggcaaaacgaaccggaagacauagauuguugguguaauucaacaaguacuugggugacauacgggacaugcaguacuacuggagaacacagacgugaaaaacguagcguugcauuaguuccacauguugggauggggcuugaaacgagaacagaaacauggaugagcagcgaaggcgcuuggaaacacguucaacgaauagagacauggauucuacgacauccuggauuuacaaucauggcagcaauacuagcauauaccauuggcaccacucauuuucaaagagcuuugauauuuauucucuuaacagcgguggcaccaagcaugaccaugcgauguauuggaauauccaauagggauuuugucgaaggaguaucuggugggagcuggguagacauaguacuugaacauggaagcuguguaacuacuauggcgaaaaauaaaccaacacuugacuuugagcuuaucaaaaccgaagcaaaacaaccagcuacucuuagaaaauauugcaucgaagcgaaauuaacuaacacaacaaccgagucuagauguccaacucagggagagccuagucucaaugaagaacaagauaaacgcuucauauguaaacauagcaugguugaucgaggcuggggaaacggguguggacuauucggaaaaggcgguauugugaccugcgcgauguuuacguguaagaaaaacauggaagguaaaguagugcaaccggaaaaccuagaauacaccaucgugauaaccccgcauucuggagaagaacacgcuguugguaaugauacaggaaaacaugguaaagaaaucaaaauaacaccucaaaguucaauaacagaagcagaacugacagguuacggaaccguuaccauggaaugcagcccucguacaggacuugacuucaacgagaugguccuguugcaaauggaagauaaagcguggcucgugcauagacagugguuucuggaucuaccauugccaugguuaccaggagcagacacacaagguucuaauuggauacaaaaagaaacacuuguuaccuuuaaaaauccacaugcaaagaaacaagauguuguuguguugggcucacaggaaggagcaaugcacacagcauuaacaggagcaacagagauacaaaugagcuccggaaaucuguuauuuaccggucacuuaaaaugcagacucaggauggauaaacuccagcugaaagguaugaguuauucuaugugcaccggaaaauuuaaaauaguaaaagaaauagcugaaacucagcaugguacaauaguuauccggguucaauacgaaggagaugguucgcccuguaaaauuccuuuugaaauuacugaccuugaaaagcgacacguauugggacgacuaauuacaguaaauccuauuguaaccgaaaaagacucuccaguuaauauugaggcagaacccccuuuuggugauucauacaucauaauugggguagaaccaggacaauuaaaacugaauugguuuaaaaagggaucgagcauuggacaaauguuugagaccacaaugagaggagcaaaaaggauggcuaucuuaggggacacagcaugggacuuuggaagucuaggggguguauuuacauccauuggaaaggcuuuacaucaagucuuuggugcaauauauggagcggcauuuucaggaguuucauggaccaugaaaauauuaauaggcguuauaauaacauggaucgguaugaacucacgaucgaccaguuuaucugugagccuaguauuaguaggaguagucaccuuguauuuaggagcaaugguucaggcagacagcgguuguguaguaagcuggaaaaauaaggaacuaaaguguggaucuggaaucuuuauuacugauaaugugcauacauggacagaacaguacaaguuccaaccagagaguccuuccaaacuugcaucugcuauucaaaaagcccaugaagagggaauauguggaaucagaagugugacuagacucgaaaauuuaauguggaaacaaauuacaccugagcuaaaccauauauuaucagaaaaugaagucaagcugacgauaaugacaggcgauauaaaggguauaaugcaggccggaaagcguucguuaagaccacagccaacugaacugaaauacaguuggaaaacaugggguaaagcaaaaaugcucagcacagagagccacaaucaaacauuucuaauugauggcccugagacagcggaauguccuaacacuaauagggccuggaauagucuagaaguagaagauuauggguucgguguuuuuacaacuaauauauggcuuaaauuaagggaaaaacaagacguguucugcgauucuaaguuaaugagugcagcgauaaaagacaauagagcagugcacgcggauaugggauauuggauugaaucagcacuaaacgacaccuggaaaauggaaaaagcaaguuuuauugagguaaagucaugccauuggccuaagucgcacacucuuuggucgaacggaguauuagaaucggaaaugauaauucccaaaaauuuugccggaccgguuucccagcauaacuaucguccaggcuaccauacacaaacagccggaccauggcacuuaggaaaauuagagauggauuuugaccuuugugaggguacgacuguugugguaacagaggauuguggaaacagagggccuagcuuaaggacuacaacggcuucaggaaaacugauaaccgagugguguuguaggagcuguacuuugccacccuuaagauaccgaggugaggauggguguugguauggaauggagauaagaccacuaaaagaaaaagaagagaacuugguuaauaguuuggugaccgcgggacauggacagauagauaacuucucccuaggaguuuuaggcauggcgcuuuuccucgaggagaugcuuagaacaagaauaggaacaaaacacgcuauucuucuaguagcagccucuuuuguaacccuuaucacagggaacaugaguuuccgugaucugggccgaguaaugguuaugguuggugcuaccaugacugaugauauagggaugggcguaacuuaucucgcguuacuugcagccuuuaaaguucguccuacauuugcugcaggccuucuacuccguaaacucacauccaaagagcuaaugauggcaacaauagguauagcguugcuaagucaaucuacgauacccgagaccauauuggaauuaacagacgcucuagcucuuggcaugauggugcucaagauuguuaggaauauggaaaaauaccaguuagcuguaacaauuauggcaaucuccugcguuccuaaugcuguuauauuacagaaugcguggaaggucucuugcacuauuuuagcggcuguuagcguaucaccccuuuuacuaacaaguucccaacagaaagcugauuggauaccucuggcacuuacaauaaaagguuugaacccgacagcaauauucuugacaacacuuucaaggacauccaaaaagagaaguuggccauugaacgaggccguuauggcggucggaaugguaaguauuuuggcgagcucgcugcucaaaaaugauauaccaaugacugguccuuugguagcuggaggacuccucacaguauguuacguauuaaccggccgcucagccgacuuagaacuagaaagggcugcggauguaaaaugggaggaucaagcggagaucucaggaucaaguccuauacuauccauaacaauaucggaggauggaucaaugucaaucaaaaaugaagaagaggaacaaacauuaacuauacuuauaagaacuggacuauuaguaaucagcggcguauuucccguaucgauacccauaacagcagcagcuugguaccuaugggaggucaagaaacaaagagcgggaguacuaugggauguuccaucaccgccuccaguugaaaaagcggaauuagaagauggugcuuauagaauuaaacaaagagguauacuaggauauagccaaauuggagcgggcguauauaaagaggguacauuucauacgauguggcacgucacaaggggagcaguccuaaugcauaggggaaaaaggaucgagccuaguugggccgaugugaagaaagacuugauaagcuauggugguggcuggaaacucgaaggcgaauggaaagaaggagaagaaguacaaguacuagcucucgaaccagguaaaaauccacgggcaguacaaaccaaaccgggaauauucaaaaccaauacuggaaccauuggcgcaguaucacuggauuuuucaccggguacaucgggaucucccauagucgaucggaaaggaaaagucguuggguuauaugguaaugguguggugacaagaucuggggcguacgucagcgcaauagcgcaaacagaaaagaguaucgaagauaauccagaaauugaagaugauauauucaggaagaaaagacuaacaauaauggauuugcacccaggagcagggaagaccaagagauaucuaccugcgauagugcgagaggcgauuaaacgagguuuaagaacauuaauauuagcaccaacccgaguuguagcugcagaaauggaagaagcguuaagaggauuaccuauucgguaccaaacgccagccauaaaaaccgaacacacaggaagagaaauaguggaucuuaugugucaugccacuuucacaaugagauugcucucaccugucagaguuccaaauuauaacuuaauaauuauggaugaagcucacuuuacagauccagcaucuauugccgcucguggguacauaagcacacguguugaaaugggugaagcagcaggaauauucaugacugccacaccuccagguucccgagacccguuuccucaauccaacgcuccgauaauggaugaagaacgagaaauaccugaaagaaguuggaacucagggcacgagugggucacagacuuuaaaggaaaaacuguuugguucgucccauccauaaaggccggaaaugauauagcugcuugcuuaaggaaaaacgguaagaaaguaauucaacuuucccgcaaaacuuucgauagcgaauaugugaaaacaagagcaaacgauugggacuuuguuguuaccaccgauauaagugaaaugggggcaaacuuuaaagcugaaagggugauugauccgcguagguguaugaaaccaguaauucuuacugauggugaggagcguguaauccuugcuggcccaaugcccgucacccacaguagcgcugcacaaagacggggacgaaucggacggaauccgaaaaaugaaaacgaucaauacauauauaugggagaaccauuggagaacgaugaagauugcgcucacuggaaagaagcuaaaaugcuacuagauaauauuaacacucccgagggaauaauaccuucaauguucgaaccagaacgagaaaaagucgacgcaauugacggagaguauagauuacgaggggaggcaagaaagacuuuuguagauuugaugagaagaggggauuuaccaguauggcuggcauacaaaguggcggccgaaggcauaaauuacgccgauagaaaaugguguuuugacgguauuaaaaauaaccaaauucuagaagagaauauggaaguggagauauggacaaaagaaggagaacgcaagaaacuaaagcccagauggcuagacgcgcgcauauauucggauccucuagcuuuaaaagaauuuaaagaauuugcugccgguaggaagagucuaacauuaaauuuaauaacggaaaugggcaggcuaccaacauuuaugacacagaaagcuagaaaugcacuagacaaccuugcaguacuacauacugcugaagcaggaggacgugcauauaaucacgcuuuauccgaauugcccgagacauuggaaacccuuuuauuauuaacuuuacuugcaacggugacgggaggaauauuucucuuuuuaaugaguggcaaaggaauuggaaagaugacacuagguauguguuguaucaucacagcuagcauuuuguuaugguacgcccaaauacaaccgcacuggauagcugcaaguauuauauuagaguucuuucuaaucguacuccuaauaccagaaccggaaaagcaaaggacaccacaagauaaucaauuaacauauguaguaaucgcgauacucacagucgucgcagccacaauggcaaaugaaaugggauuuuuagaaaagaccaaaaaggaccuagguuugggaucuauaacaacgcaagaaucagaaagcaacauauuggauauagaccuaaggccggccagugcuuggacacucuacgcagucgcaacuaccuuugugacucccaugcucaggcacaguauugagaacucaucuguaaauguaaguuugacugcaauugcuaaucaagcuacgguuuuaaugggacugggcaagggauggccccuuuccaaaauggauauaggcgucccacugcucgcuauagguuguuauucacaaguaaacccaaucacuuugacugcugcuuuauuauuauuagucgcucauuacgcaauaaucggacccggccuucaggcaaaagcaacacgugaagcccagaaacgugcugcagcaggaauuaugaaaaaccccacgguugauggcauaaccgugaucgaucucgagccgauuccauaugauccuaaauucgaaaaacaacuaggucaaguaaugcuacuaauacuuugcgucacucaagugcuaaugaugcgcacuacaugggcacuuugugaagccuuaacacuagcgacugggccuauuagcacccucugggaggggaacccaggaagauucuggaacacgacgauugcaguaaguauggcaaauauauucagaggaucuuaccuagcuggugcgggccugcuauucagcauuaugaaaaauaccacaaacacgcguagaggcacaggaaauauaggcgagacccuuggcgaaaaauggaaaagcagauuaaacgcauugggaaaauccgaguuucaaauauacaaaaagagcgguauacaagaggucgauaggacgcuagcgaaagagggaauaaagagaggagagacggaccaccaugcagucuccaggggaucagcaaaguuaagaugguuuguagaaaggaauauggucacuccagaaggcaagguaguugaucucgguuguggccgaggcgguuggaguuauuacugcgguggacucaaggauguaagagaggugaaaggcuuaacuaaaggagguccagggcacgaggaaccgauaccgaugucuacguauggguggaauuuggucagacuucaaucggggauagauguauucuucacuccuccagaaaaaugcgacacacucuuaugugacauaggagaaucgucaccaaauccaacuauugaagcgggccgaacucucagaguacucaaccuagucgaaaacuggcugaauaauaauacacaauuuuguaucaagguacuuaacccuuacaugccuagugucauagaaaagauggagacauugcaacguaaguaugguggagcacuggugaggaaccccuuaucacguaacucaacccacgaaauguauugggucucuaaugcgacuggcaauauaguaucuucaguaaauaugaucuccaggauguuaauaaauagauucacaaugaaacacaagaaagcgacauacgagccugauguagaccuaggaagugguaccagaaauauagggauagaaagcgaaaucccaaacuuggauauaauuggcaagagaauugaaaagauuaaacaagaacaugaaacgucuuggcacuaugaucaagaucauccauacaaaacaugggccuaccauggcaguuacgagacuaaacagacuggaucugcaagcucgauggucaaugguguuguacgauuacuaacaaaaccaugggacguuguaccuaugguaacucaaauggcgaugaccgacacgacuccauucggacagcaacggguauucaaagaaaagguugauacccgaacacaagaaccgaaggaggggacuaaaaaguugaugaaaaucacagcggagugguuauggaaagagcucggcaagaagaaaacaccucgaauguguacccgcgaagaauuuacaagaaaagugagguccaaugcagcauugggugcuauuuucacagacgaaaauaaauggaagagugcaagggaagccguugaagacggaagauucugggagcuaguggaucgagaacgaaauuuacacuuagaagguaaaugugagacuugcguuuauaauaugaugggcaagagagagaagaaacuuggagaauuuggaaaagcaaagggaagcagagccauaugguauauguggcugggagcgagguucuuagaguucgaggcuuuagguuuucugaacgaggaucacugguucucaaggggaaauucuuuaaguggaguagaaggugaaggacugcacaggcuuggauauauacuccgagauguugggaagaaagaggguggcgcaauguacgcggacgauacagcuggaugggacaccagaauuacccuugaagauuuaaagaacgaggaaauggucacaaaucauaugaaaggagaacauaagaaacuagcugaggcuauauuuaaacuaacguaccaaaacaaaguaguacgaguacaacggccuacuccaagaggaacagugauggacaucauuucuagacgcgaucagagaggaucuggacaagucggcacuuacggcuuaaauacguucacgaauauggaagcucaauugauaagacaaauggaaggggaaggaauuuuuaaaagcauccagcauuuaacagccacagaagaaauagcaguacagaacuggcuugcucggguuggucgagaacgccucaguaggauggcaauauccggagaugacuguguaguaaaacccauagaugaccgguuugcgagugcauuaacggcacuaaacgauaugggaaagguacgaaaagacauacaacaaugggaacccagccgggguuggaaugacuggacacaagugccuuuuuguucucaucauuuucacgaguuaguaaugaaagauggacgagucuuaguaguaccuugucgaaaucaggaugaacuuauaggucgagcucguauuagucaaggggcagguuggagucuaaaagaaacagcuugucuagggaagucauaugcccaaauguggacauugauguacuuccaccgaagagacuuacgauuagcagccaacgcgauuugcagcgcaguaccgucucacuggguucccacuagccgaacaacauggucgauucacgcgaagcacgaauggaugacuacagaagacauguuagcgguguggaauagagucuggauccaagaaaacccuuggauggaggauaaaacaccaguagagucaugggaggaaguuccuuacuugggaaaaagagaagaucaauggugcgguucgcuaauuggucuuaccucaagagcuacuugggcaaagaauauacaaacagcuauaaaccaaguuaggucuuugauagguaaugaggaauauacagauuauaugccuaguaugaaaagguuuaggaaagaggaggaagaggcugggguacuaugguaa

SEQ ID NO: 22369 - RNA, 9876 nt, Artificial Sequence
  derived and/or modified CDS sequence (opt6) from DENV-2__KJ189311__SS-prME
accgcugggguaauaguuauguuaauuccaaccguuauggcauuccacuugacaacacgcaacggagaaccacacaugauugucggacgacaagaaaaaggaaaaucgcuguuauuuaaaacagaagaugguguuaauaugugcacccugauggcaauugacuuaggagaauugugugaagacacaauuacguacaaaugcccacuguuaagacaaaaugaaccagaagacauagauugcuggugcaacucuacguccacguggauuacauacggaaccuguucaacaacaggagaacauagaagagagaaacgaaguguugcuuuagugccgcaugugggaaugggacuagaaacucggacagaaaccuggaugucaucggaaggagcuuggaaacauguucaaaggaucgaaacauggauacuaagacacccuggguuuacaauaauggccgcuauacuagcauauacgauuggaacaacacauuuucaacgagcacuuauuuucauucuuuuaacggcugucgccccaaguaugaccaugcggugcauugggauauccaacagggauuuuguagaagguguaaguggaggaagcuggguagauauaguacuagaacaugguuccuguguuacaaccauggccaaaaauaaacccacauuggacuucgaacuaauaaaaacagaagcaaaacaaccagcaacuuuacgcaaauauugcaucgaagcgaaacuuacaaacacaacuacugaaucgcgcugucccacccaaggagaacccagcuuaaacgaagaacaagauaaacgguucaucuguaaacauucaaugguagauagaggauggggcaacggguguggacuuuuuggcaaaggaggaauaguaaccugcgcaauguuuacauguaagaaaaauauggaagguaaaguuguucaaccagagaauuuagaauauacgaucguaauaacuccacacaguggcgaagaacacgcaguugguaaugauacaggcaaacacggaaaagaaaucaaaaucacaccacaaagcucaauaaccgaagcagaacuuacagguuauggaacaguaacgauggaguguagcccacguacggguuuagauuuuaaugaaaugguauuguuacagauggaagauaaagcaugguugguacacagacagugguuccuugacuuaccccuccccuggcuaccuggugcagauacacaaggcucgaauuggauccaaaaagagacucuugucacauuuaaaaauccucaugcgaagaaacaggacgucgugguacuugggagucaagaaggagcaaugcacacagcacucacaggcgcuacugagauacaaaugaguucagggaacuugcucuuuacuggucacuuaaaaugucgccugagaauggacaaacugcaauugaaaggaaugucauauucuauguguaccgguaaauucaaaauagugaaagagauagcugaaacccaacaugguacaauagucauaaggguccaauacgaaggagaugggaguccauguaaaauuccguuugagauaacagauuuagagaaaagacauguguuaggacguuuaaucacgguaaauccgauaguaacugaaaaagacucgccgguuaauauagaagcugaaccgccuuucggagacucguauauaauaauaggaguagaacccggccaacuaaaacugaauugguuuaagaaaggaagcucaauaggacaaauguuugagacuaccaugagaggggcuaaaagaauggcuauccuaggcgacacagcaugggacuuugguagucuaggaggaguauucacaagcauaggaaaagcacuccaucagguauuuggagcaauuuauggcgcagcuuuuucgggaguauccuggaccaugaaaauucucauaggagucauaauaacauggauugguaugaacucacguaguaccagcuuaaguguaucucuggugcuaguuggcguugugauucuuuaucucggagccaugguccaagccgauucaggaugcguagugucuuggaagaauaaagaauuaaagugcgguucagggauauucauuacggauaacgugcauacauggacagaacaauacaaauuucaacccgaaucuccuucaaaauuggcuagugccauucagaaagcccacgaagaggggauuugcggaauacgaagcguaaccagauuagaaaaucugauguggaaacaaauaacuccagagcugaaccauauauuaagugagaacgaagucaaauuaaccaucaugaccggugacauaaaaggaauaaugcaagcggguaaaagaucucuccgaccacagccuacagaacuaaaguauagcuggaaaacuugggguaaggcaaaaauguuaaguaccgaaucucauaaccaaacauuucuuauugauggacccgaaaccgcugaguguccaaauaccaacagagcauggaacucauuagaaguugaagacuaugguuuuggaguuuucacuacaaacauaugguuaaaauuaagagagaaacaggacguauuuugcgauagcaaauuaaugagcgcagcaaucaaggauaauagagcaguacaugcagacaugggcuacuggauagagucugcauugaaugacacauggaaaauggaaaaagcguccuuuauugaaguaaaaaguugucauuggcccaaaagucauacucucuggucgaacgguguuuuagaaucagaaaugauaaucccuaagaauuuugcuggaccuguaucccaacacaacuauagaccaggauaucacacacaaacagccggacccuggcaucuagggaaauuagaaauggauuucgauuuaugugaaggaacaacagugguuguaacugaagauuguggaaauagagggccgucguugagaacgacuaccgccucggguaaauuaauuacugaaugguguugucguuccuguacuuuaccgccucuaagguauagaggagaagaugggugcugguauggaauggaaauucgaccauuaaaggaaaaagaagagaauuuagucaacucacucgucacagcgggacaugggcagauagacaauuuuucauugggaguuuuggggauggcgcuguuucucgaagagauguugcguacaagaauaggcaccaaacacgcaauuuuauuaguggcugcuuccuucguaacauuaauaacagguaacaugucauucagggacuugggaagagucaugguaauggucggugcuaccaugaccgaugauaucgggaugggaguaacuuaucuugcccuguuagcggcauucaagguacgaccuacauucgccgcuggccuuuuacugcgaaaauuaacuucgaaagagcugaugauggcuacuauuggcauugccuuacugucccaaaguacuauaccggaaagcauauuagaauuaaccgaugcacuagcacucggaaugaugguacucaaaaucgugcgaaacauggaaaaguaucaguuagcaguuacuauaauggcaauaaguugugugccuaacgcgguaauucuacaaaacgcauggaaagugucuugcacaauauuggcagcaguuaguguuagucccuuacugcugacuucuucgcaacaaaaggcggauuggauaccacuagccuuaacaauaaaagggcucaacccgacagcaaucuuucuaacaacauuaaguagaaccaguaagaaacggucauggccccuaaacgaggcggugauggcaguaggaaugguaucaauacuagcuucaagccuucugaagaacgacaucccaaugaccgggccucucguggcaggcggauugcuaacgguauguuauguuuuaacugguagguccgccgaucuugaguuagaaagagcagccgacguuaagugggaagaucaagcggaaaucucggguucaucgccaauuuuaucuaucacuauaagcgaagacggcucaaugucaauaaagaaugaagaagaggagcaaaccuuaaccauucugauacgcacuggauugcuaguaauuagugggguauuuccagugucuauacccauaacagcagcagcaugguauuuaugggaaguaaagaaacaaagagcuggcguccuaugggacguuccaaguccaccaccagucgaaaaagcggaauuagaagauggcgcauaccgaauuaaacaacgagguauccuuggauacucucaaauaggagcgggcguuuauaaagaggguacauuucauacaauguggcacguaacuagaggcgcugucuugaugcaccgaggaaaacgaauugaaccgucgugggcugaugucaagaaagaucuaauauccuacggagggggcuggaaauuagagggcgaauggaaagaaggggaggaaguucaagucuuggcauuagaaccggggaaaaacccaagagcaguccaaacuaagccaggaauauucaagacuaacaccggcaccauaggcgccguuucauuggauuucagcccaggcaccagugguucuccuauugucgauagaaaaggcaaaguaguggguuuguauggaaacggaguaguuacucguucaggugccuauguaucugcuaucgcccaaacagaaaagucuaucgaagauaaccuagagauugaagaugauaucuuuagaaagaaacgauuaacaauuauggaccuacauccaggagcuggcaaaacgaaaagguauuuaccugcaauaguaagagaagcgauuaagagaggacuacguacguugauccuugcuccaacccgagucguagccgccgaaauggaggaggcguuaagaggucuaccaaucagguaccaaacaccagcaauuaaaacagaacauacuggcagggaaauaguagaccuaaugugucaugcaacauuuacaaugagacuucuuagccccguuagaguuccgaacuauaaucuaauaauuauggaugaagcucauuuuacagauccggcaucuauugcggcuagggguuacaucaguacaagggucgaaaugggugaagcugcaggaaucuucaugacugcgacuccgccugggucucgggauccauucccccaaucaaaugcgccuauaauggaugaagaacgggaaauuccagaaagaaguuggaacucaggacacgaauggguuacagacuuuaaagggaaaacagugugguucguuccgagcauaaaagcgggaaaugacauagcagccugucugaggaaaaauggcaagaaagugauacaauuaagcagaaaaaccuuugacagcgaguauguaaaaacucgagcuaacgauugggauuuugucgucacgacggacauaucagaaaugggagcuaacuucaaagcagaaagaguaaucgauccuagacguuguaugaaaccagucauucucacagauggcgaggagcgugugauacucgcaggacccaugccaguaacacauagcagcgcugcccaaagaagaggccgaauaggucggaauccaaagaaugagaaugaccaauauauuuacaugggagaaccuuuggagaacgaugaggacugugcccauuggaaggaagccaagaugcuccucgacaacauaaauacaccugaaggcauaauacccagcauguuugaaccugaacgagaaaaaguggacgcuauugauggagaauauagacuuagaggggaagccagaaaaacuuucguggaucuaaugagaagaggagaucucccggucuggcuagccuauaaagucgccgcagaaggaauaaacuacgcagacagaaaaugguguuucgauggaaucaaaaacaaucaaauacuugaggagaacauggaaguugaaaucuggacuaaagaaggggagagaaagaaacuaaaaccuagaugguuggacgcgcguaucuacagugacccgcuggcauuaaaagaauuuaaggaguuugcggcuggucgcaagaguuuaacauuaaaucuuauuacagaaaugggucgccuaccgacguuuaugacccaaaaagcuagaaaugcccuugauaaucuagcagugcuccauacagcugaggcuggcggucgugcauacaaucacgcuuuaucagaauugcccgaaacacucgagacgcuacuauuauuaacccuauuagcgacgguaaccggaggcauauuuuuauuucuaaugaguggcaagggaauuggcaaaaugacguuagggauguguugcaucauaacagcaagcauauuacugugguacgcacaaauacaaccacauuggaucgcugcaaguauuauacucgaguucuuccuaauaguuuugcuaaucccagaaccugaaaaacaaaggacgccacaagauaaucagcugacauacguagugauugcuauuuuaacuguaguggcagcaaccauggcaaaugagaugggcuuuuuagagaaaacaaagaaagauuuaggccuuggaucaauuacgacccaagaaucagaauccaacauauuggauaucgacuuacgaccagcaagcgccuggacauuauaugccguggcaacaacauuugucacuccuauguuacgucauucaauugaaaacaguagugucaauguaagccuaacagcaaucgcaaaucaagcaaccguccuaaugggauuagguaaagguuggccucuguccaaaauggauauaggagugccguuguuagcuauuggcugcuauucgcaagucaauccgauuacucuuacagcggcguuauugcugcuuguagcgcacuaugcuauaauugguccuggucuacaagcgaaagcaacgagagaggcacagaaaagagccgccgcggggauuaugaaaaacccuacgguugauggaauuacuguaaucgaucuagaacccauaccuuaugauccgaaauuugaaaaacagcucggucagguuaugcucuuaauauugugcguuacucaaguacuaaugaugaggacuacaugggcuuugugcgaagcauugacccuagcaacaggcccuauuucuacguugugggaagggaacccgggucgauuuuggaauaccacuaucgcaguaaguauggcgaauauauuccgaggcucauaucuagcaggcgcagguuuacuauuuucaauuaugaaaaauacuacuaacacaagaagagguacaggaaauauaggugaaacuuuaggagaaaaauggaaaaguagacugaaugcacucgguaaaucugaauuucaaauuuauaagaaauccgggauacaagagguugaccggacucuagcgaaagaagguauaaaaagaggugagacagaucaccaugcaguaaguagaggaucagcgaaauugagaugguucguagaaagaaauauggugacaccagaagguaaagucgucgacuuaggaugugguagagguggaugguccuauuacugcgguggauuaaaagacguacgagaaguaaaagguuugacgaaagggggaccuggccaugaagaaccuauuccaaugucuacauaugguuggaaucuuguucgacuacaaucaggaauagacgucuucuuuacaccgccagaaaagugcgacaccuuacugugcgauauaggagaaucuucgcccaauccuaccauugaagcuggacgcacguugagaguccuaaaccucgucgaaaauugguuaaacaacaacacucaauucugcauuaaagugcuaaauccuuacaugccaagugugauugagaaaauggagacacuucagcgaaaguacgguggagcauugguacgcaacccauugaguaggaauaguacacacgaaauguacuggguuagcaacgccacaggaaacauaguaaguucaguaaauaugauuagccgcauguuaauuaacagauuuacaaugaagcauaagaaagccacguaugaaccugauguggacuuagguucaggaacaagaaauauugguaucgagucagaaauaccaaaucuagacaucauaggaaaacguauugagaaaauaaaacaagaacaugaaacuucauggcauuacgaccaggaccauccguacaaaacaugggcauaucacggaucauaugaaacuaagcagacagguucagcgucuagcauggugaauggcguaguucgacugcuuacaaaaccgugggaugugguuccgaugguaacacaaauggcgaugacugauacaacuccauuuggacagcaaaggguguuuaaagaaaaagucgacacaagaacucaagaaccaaaagaagguacuaagaaacuuaugaagaucaccgcggaaugguuauggaaggaacuaggcaagaagaaaacaccgcgaauguguacuagagaagaguucacacgaaaaguacgauccaacgcagcacucggagccauauucacggaugagaacaaguggaaaucagcgagagaagcaguugaagauggcagauuuugggaacuuguugaccgagaacguucacuucaucucgaaggaaagugugaaacgugcguuuacaacaugaugggaaagagagagaagaaguuaggggaguucggcaaagcuaaagggagcagggcaaucugguauaugugguuaggugcgagauucuuagaguucgaagcucucgguuuccuaaacgaggaucauugguuuucucguggaaauucauugucugguguugagggugaaggucuacacagauuaggauauauccucagagacguaggcaagaaagaggguggugcaauguaugcagaugacacugcaggcugggauacgcgaaucaccuuggaagaccucaaaaaugaagaaaugguaacaaaccacaugaagggggaacauaagaaacuagcugaggcgaucuuuaaauuaacauaucaaaauaaggugguuagaguacaaaggccaacuccgagaggaacaguuauggauauaauaucccgucgcgaccagagaggaagcggccaaguuggaacuuauggucucaauacauuuacaaauauggaggcacaacuuaucaggcaaauggaaggugaaggcaucuucaaaaacauucaacaccugaccgcuacggaagaaauugccguccaaaauuggcuugcacguguugggagagaaagacuuucacgcauggcuauaagcggugacgacuguguuguaaaaccaaucgaugauagguuugcaucagcucuaacagcacuuaacgauauggguaaagugcgcaaagauauacaacaaugggaaccuagucguggauggaaugauuggacacaaguuccauucuguucgcaccacuuccacgaauuaguaaugaaagauggaagaguucugguaguaccaugccgaaaucaggaugaacuuauaggaagggcccgaauuagccagggugccggcuggagccuaaaggaaacagcaugucugggaaagucuuacgcgcaaauguggacguuaauguacuuucacaggcgcgaucugagacuggcugcgaacgccaucugcagugcuguaccuucacauuggguuccgacuagccgcacuacuuggaguauacaugcuaaacaugaguggaugacuacagaagauaugcuugcaguauggaaccgcguuuggauucaagaaaauccauggauggaagauaagacuccgguugaaucaugggaggaggucccauauuugggcaaacgcgaggaucaauggugugggagcuuaauuggacuaaccucacgagcgacuugggcuaaaaauauacagacggcgauaaaucaggucagaagucucauugggaaugaggaauauacagauuauaugccguccaugaaacgguuuaggaaagaagaggaagaagcaggaguuuugugguaa

SEQ ID NO: 22370 - RNA, 9876 nt, Artificial Sequence
  derived and/or modified CDS sequence (opt6) from DENV-2__KJ189370__SS-prME
acggcugguguaaucgucaugcugauuccuaccgcaauggcauuucauuuaacaacgcggaauggugaaccgcauaugauuguaucccgccaagaaaaagggaaauccuuacuauucaaaaccgaggaugggguuaauaugugcacacuaauggcaauugaucugggggaguuaugcgaagacacaauuacuuauaaauguccacuacuccgacaaaacgaaccagaagacauugacugcuggugcaauucuaccucaacauggguuacguacgggaccugcacuaccacuggggaacaucgaagggaaaaacggagcgucgcauuaguuccacacgugggaaugggacuagagacucgaacagaaaccuggaugucaucagaaggagcuuggaaacauguccagagaauugaaacguggauacuaagacauccaggauuuacgauaauggcagcaauucucgccuauacaauaggaacuacacacuuccaaagagcccucauauuuauacuccuaacggcaguagcaccaucuaugacaaugagguguauagguauaucuaacagggauuucgucgaggguguaagcgggggaaguuggguagacauuguauuagaacacgggagcugugucacaacgauggcuaaaaacaaaccaacacuagacuuugaguuaauaaaaacugaagcuaaacagccugcaacacuuaggaaauauuguauugaagcaaaauuaacaaauacaacaacagaaaguagaugcccgacucagggggaaccaagucuuaacgaagaacaggacaaaagguucauaugcaaacacucuaugguagacagggguuggggaaauggaugcgguuuauucgggaaaggaggaaucgucacuugugccauguuuacuuguaagaaaaauauggaagguaaaguaguccaaccagagaaccuagaauauacaauaguaauaacaccacacaguggagaagaacacgcaguuggaaaugacacgggcaaacaugggaaagagauuaaaauaacuccucaaucaagcauaacagaagcagaacuaacuggcuauggcacggugacgauggaguguaguccgagaacaggacuugauuuuaaugaaaugguacuguuacaaauggaagacaaagcguggcucguacaucgccaaugguuccuagauuugccauugccgugguuaccaggggccgauacccaaggaagcaacuggauucaaaaagagacguuaguaacauucaaaaauccacacgcuaaaaagcaagauguuguaguauuagggucccaagagggugcgaugcauacugcauugacuggugcaaccgagauacaaaugaguucugguaaccuucuauucacuggacaucuaaaguguagauugcguauggauaaacuucagcucaaagguaugucauauucgaugugcacgggaaaguuuaaaaucguaaaagaaauagccgaaacucaacacggaacgauuguaauaagaguacaguacgagggagaugggucuccauguaaaauccccuuugaaauuacggaucuggaaaagagacauguucuagguaggcugaucacuguaaauccaauagucacugaaaaagauaguccagucaauauugaggcagaaccuccauuuggugacucuuauauuauuauaggaguagaaccgggacaauuaaagcucaacugguuuaagaaaggaucaucaauaggacaaauguuugaaacaacaaugaggggagcaaagagaauggcgauauuaggugauaccgcgugggacuuuggaagucuaggcggcguauucacaucuauagggaaagcacuacaccaagucuuuggcgcaauuuacggggcggccuucucuggagugucguggacuaugaagauccuuauaggaguuauuauaacuuggaucgguaugaacucgcgaagcaccucucuaucaguaucacucguccuaguaggugucguaacauuauaucugggagcaaugguccaggcugauucagguuguguggucucuuggaagaacaaagaguugaaaugcgguaguggcauauuuauaaccgacaacguacauaccuggaccgaacaauacaaauuccaaccugaaucucccuccaaauuggcaagcgccauucaaaaggcucaugaagaaggaauuugcgggauaaggaguguaaccagauuagaaaaucuaauguggaagcagauaacaccagaauugaaccauauauuaucagaaaaugaaguuaaauugacaauaaugacuggcgauaucaaaggaauaaugcaggcuggaaaaagaucuuuacgaccacaaccaacugaacuuaaguauagcuggaaaacuuggggcaaagcuaaaaugcuaagcacagaaucgcacaaucagacauuuuuaauugacgguccagaaacggccgaaugucccaauacaaauagagcguggaacucacucgaggucgaggauuacggcuucggcgucuuuaccacuaacauaugguuaaaauuaaaagaaaaacaggacguauucugcgauagcaaauuaaugagugcagcuauaaaagacaacagggcaguacaugcagauaugggguacuggauugaguccgcacuuaaugacacauggaaaauggaaaaagcuaguuucauagaaguuaagagcugucauuggccaaaaagucauacuuuguggagcaacggcguguuggagagcgaaaugauaauacccaaaaauuuugccgguccugucagccaacacaacuauaggccaggauaucauacacagacagcuggcccauggcauuugggcaaguuagaaauggacuuugaucugugugaggguacuaccguuguaguuacagaggauuguggaaaucgcggaccuagccuucgaacuaccacugcuagugggaaacuaauaacggaaugguguugcaggucauguacgcuaccaccuuuaagauauaggggugaggacgggugcugguaugguauggagauaaggccguuaaaggagaaggaagaaaaccuuguuaauagucucguuacugcaggacauggacaaauagauaacuucaguuuaggaguccuaggaauggcguuguuucuugaagaaauguuaagaacuagaaucggaacaaaacaugcgauauuauuagucgccguaucguuuguuacucuaaucacugguaauaugagcuuucgcgaccuggggcgcgugaugguaaugguuggcgcuacuaugacagacgacaucgguauggguguaacuuaccuggcucuacuagcugccuucaaagugcgaccaacguucgcagcugguuuguuauugcguaaacuuaccaguaaagagcucaugauggcaacuaucggaauagcauuauuaucacagagcacaauaccagaaacgauacucgaguugacggacgcccuagcuuuaggaaugaugguacucaaaguaguaagaaacauggaaaaguaucaacuugcaguaacaauuauggcaauuucaugcguaccgaaugccguuauauugcaaaaugcuuggaaagucucgugcacaauccucgcggcggucuccguuucaccacuauuauuaacuucgucacaacagaaggcugacuggauaccuuuagcguugaccauuaaagguuuaaacccuacugccauauuuuuaaccacauuaagucgaacgagcaagaaaaggaguuggccauuaaaugaagcgauaauggccguuggaaugguaagcauuuuagcauccagccuacuuaagaacgacauuccgaugacggguccgcuaguggcaggaggacuacuaacuguauguuauguuuuaacuggcaggagcgcagaccuggaauuagaaagagcggcugacgucaaaugggaggaccaagcagagaucagcggcucaucaccuauucucuccauuacuauuagugaagaugguuccaugucuaucaaaaaugaagaagaagaacaaaccuuaacaaucuuaauucgaacaggacuccuuguaauaaguggcguauucccaguaaguauaccaaucacagcugcagcgugguaccugugggaagugaagaaacaaagggcgggcguacugugggauguuccaucaccgccaccaguugagaaggcggaacuagaagacggagcuuacaggauaaagcaaagaggcauucucggguauucacaaaucggagccggugucuacaaagaggggacauuccauacaauguggcacguaacacgaggugccguuuuaaugcaucguggaaagcgaauagaaccguccugggcugacgugaagaaagaucuaauuuccuauggagguggauggaagcucgaaggggaauggaaagaaggagaggagguacaaguacuagcucuagaacccgguaaaaaccccagagcaguccagacgaaaccagguauuuucaaaacuaacaccggaacaauuggagccguaucauuagauuucagcccagguacauccgggagucccauagucgaccggaaggggaaaguaguaggucuuuacggcaacggugugguaacgaggaguggcgccuacguuuccgcaauugcccaaacagaaaagucuauugaagacaauccugagauagaagacgauauauucagaaagaaacggcuuacaauaauggauuuacacccaggagccggaaagacaaaaagguaccuuccugcaauaguaagagaagcuauaaagagaggauuaagaacuuuaauauuagcuccaacgagaguaguugcggcagagauggaagaggcacuucgagguuuaccuauacguuaccagaccccagcaauuaaggcagaauauacaggacgugaaauagucgaccugaugugucacgcuacuuuuacaaugagacuccucucacccguuagggugccaaauuauaacuuaauuauaauggaugaagcacauuuuacggaccccgcaaguauagcagcaagaggcuacauuaguacaaggguagagaugggugaagcagcagggaucuuuaugacugcaacgccaccagguagcagagauccauucccccaaagcaaugcuccgauuauggaugaggaacgagagauaccagaaaggaguuggaacuccggucaugaauggguuacugauuuuaaaggaaaaaccguuugguucgucccaaguauuaaagcugggaacgauauagcagcuugucugcguaaaaacgggaagaaaguaauacaguuaagcagaaaaaccuuugauagugaauacgucaaaacucgagcaaacgacugggauuuuguaguaacaacagacauuagugaaaugggugcuaacuuuaaagcagaaagaguaauagacccucgaaggugcaugaaacccguaauucuuacagauggugaagaacguguaauccuggcuggacccaugcccguuacgcauagcagugcugcgcaaagaagaggccgaauugggcggaacccuaagaacgaaaaugaucaauacauuuacaugggugaaccgcucgagaaugaugaagacugugcgcacuggaaagaagcaaaaauguugcuagauaacauuaauacaccugaagguauuauacccaguauguuugaacccgaacgggagaaaguugaugcuauugacggugaauauagacuccgcggagaagcuaggaagacuuucguggaccugaugagacgaggagauuuacccguauggcuagccuacaagguagccgccgaaggcauaaacuaugcagacaggaaaugguguuuugaugggauuaaaaacaaccagauuuuggaagaaaacauggaaguggagauauggaccaaagaaggugaacguaagaaacuuaagccuagguggcuagacgccaggaucuauucagacccucuagcacuaaaagaguucaaggaauuugcugcagggcguaaaucucuuaccuuaaauuugauaacagaaaugggacgguuaccaacauuuaugacacaaaaagcacgaaacgcgcuugauaauuuggcagugcuccauacggcugaggcuggagggagagcauacaaccaugcacuaagugaauuaccagaaacauuagaaacacuucugcuauuaacauugcuugcaacuguuacgggcgguauauuccuguuccucaugucagguaaggggauugggaaaaugacccuggguaugugcuguauuauaacggcaaguauauuauuaugguacgcucaaauucagccacacuggauagcagcuucuauaauucuagaguucuuucuaauuguuuuacugauuccugaaccugaaaaacagagaaccccgcaagauaaucaacucacauaugugguaauugccauucugacaguaguggccgccacaauggcuaaugaaauggguuuucuagagaaaaccaagaaagaucugggauuaggcucaauuacaacacaagaaucagaaaguaacauauuagacauugauuugagaccggcauccgcauggaccuuauaugcuguggcaacaacguuucucacuccuauguuacgucacucaauagaaaacucaucagugaauguuagcuuaacagcaauagcaaaucaagcuacuguauuaaugggauuaggcaaaggauggccucuuucaaaaauggacauaggaguuccauuauuggccaucggcuguuauagccaggugaacccuauaacacuaacugcggcauuauuacuauuaguagcacacuacgccauuaucggcccgggucuucaagcaaaagcgacgagggaagcacaaaaacgggcagcggcggguauuaugaaaaauccaacuguagaugguauaacagugaucgaucuagauccuauaccuuacgauccgaaauuugaaaaacaacuugggcaggucauguugcuuauccuuuguguaacucaaguucucaugaugcguacaacgugggcccugugugaagcauuaacacuggcaaccggacccaucagcacccuaugggaaggaaacccgggcagauucuggaacacgaccauugcaguuaguauggccaauauauuuagaggaucauaucuagcuggugcaggucuucuauuuaguauuaugaagaauaccacaucaacuaggcgcggaacgggaaacauaggugagacauugggugaaaaguggaaaagucgacuaaacgcccuaggaaaaagugaguuccaaauuuauaaaaagaguggcauucaggaaguagacagaacccuggcuaaagaggguaucaaaagaggugaaacugaccaccaugcuguuucacgugguucagcaaaacuacgcugguuuguagaaagaaauauggucacucccgaagguaagguaguggacuuaggguguggcagggguggauggucauacuacuguggcgggcugaaaaauguuagagaaguaaaagggcuuacaaaagggggacccgggcacgaggaaccuauuccuaugaguaccuacggcuggaauuugguccgauuacaaaguggaguggacguauuuuucacgccucccgagaagugcgauacgcuacuaugugacauaggugagucuaguccaaacccaacuauagaagccggucguacguuaagaguuuuaaaccuaguggagaauuggcucaacaacaacacucaauuuugcauuaaaguacuaaacccguacaugcccucuguuauugagaaaauggaagccuuacaaagaaaauauggaggagccuuaguacggaacccacuuagcagaaauucuacucaugagauguacuggguuucuaacgccacuggcaacauaguuaguagugucaacaugaucucgcguauguugauuaaucgcuucacaaugaaacacaagaaagcaacauaugaaccggauguugaucucgggagugguacuaggaauauagguauugaguccgaggugccaaaccuugacauuaucgggaaaagaauagagaaaauuaaacaagagcaugaaacguccuggcauuacgaccaagaucacccuuacaaaacaugggcauaucauggaucuuaugaaacaaaacaaaccgguagcgcaucaagcaugguaaacggaguagucagacugcuaacuaaaccgugggacguaguaccuauggugacgcagauggcaaugacagauacuacccccuuuggccaacaaagggucuucaaggaaaaaguagauacacguacgcaagaaccaaaagaaggcacaaagaaauuaaugaaaauaacggcugaauggcuauggaaagaauuagggaagaagaaaacgccacguauguguacacgagaagaauuuacacguaaagugcgauccaacgcagcuuuaggagcaauuuuuacagacgaaaauaaauggaaaucagcgcgugaagcgguagaagacggcagguucugggaauuaguggacagagaacgaaauuuacaucuggaagguaaaugugaaacauguguauauaacaugaugggaaaaagggaaaagaaacuaggggaguuugggaaagcaaaaggaucacgagccauuugguacaugugguuaggugcacgguuuuuagaauuugaagcacuaggauuuuuaaacgaagaucauugguuuagcaggggcaacaguuuaagcggcguugaaggcgaaggacuacauagauuggguuacauacuacgagaaguaggcaagaaagaaggcggggcgauguacgcggacgacacggccgguugggacacacguauaacgcuagaagaucucaaaaacgaagaaaugguaaccaaccauaugaaaggagaacauaagaaacuagcggaagcgaucuuuaaacuaacguaucaaaacaaggucgugaggguucaacgacccacaccucgugggacagucauggacaucauaaguagaagggaucaaagggguuccggacagguggggacguacggguuaaacacauucacuaacauggaagcacagcuuauuaggcagauggaaggagaagguauauuuaaaucaauacaacaccuaacugcaacagaagagauagcaguucaaaauuggcuuguacgagucgguagagagcgcuuaucucgcauggcgauaagcggagaugacugcgugguaaaacccauagacgacagauuugccuccgcucuaaccgcguuaaaugacaugggcaagguacguaaagacauacagcagugggagccuucaagagguuggaaugacuggacccaagugccguuuuguucacaucauuuucaugaacuuguuaugaaggauggcagaguacugguaguaccuugccguaaccaggaugaguuaauaggccgcgcaagaauuagucaaggggcggguuggucacuaaaagaaacagccugccugggaaaaucauaugcacaaauguggacucugauguauuuccaucgaagagaucuacgcuuagcggcuaaugcuauauguucagccgugccuucacacuggguaccuacaagcagaaccacauggucuauacaugccaaacaugaauggaugaccacagaggauauguuggcaguauggaacagagucuggauacaggaaaacccauggauggaagauaagacucccgucgaaaguugggaggaaguuccuuauuuagggaaaagagaagaucaguggugcggaucacucaucggguuaacaucaagggcuacuugggccaaaaauauucagacagcgauuaaucaaguaagaucauugauugguaaugaagaguauacugauuauaugccgagcaugaaacguuuuagaagagaagaagaggaagccggugucuuaugguag

SEQ ID NO: 22371 - RNA, 9876 nt, Artificial Sequence
  derived and/or modified CDS sequence (opt6) from DENV-2__EU482620__SS-prME
acugcagggguuauaguaaugcuaauuccaacugcaauggcuuuucaccuaacuacuaggaauggugaaccacacaugauugugggacgccaagaaaaaggaaaaucuuugcuuuuuaaaacagaagauggagucaauaugugcacacuuauggcaauugaucuaggagaacuaugugaagauacgauuaccuacaaauguccacuacuacgucagaacgaaccggaagacauugacugcugguguaauaguacaaguacuuggguaaccuauggaacaugcaccaccacaggugaacaucgaagagagaaaagauccguagcccuagugccccauguagggaugggucuggaaacuagaacggaaacauggaugucaagcgaaggagcauggaaacacguacaacgaauagaaacauggauauuaaggcauccagguuuuacaauaauggcggcaauuuuagcauacacgauaggaacaacucauuuucaacgagcauuaauauuuauuuuauugaccgcgguagcaccaucaaugaccaugcgauguauugguaucucaaaucgugauuucgucgaagguguaaguggagggaguuggguagauaucguauuggaacauggaucauguguaacaaccauggcuaaaaauaaaccgacacucgauuucgaauuaauaaaaacugaagcgaaacaaccagcaacacuucgaaaauauugcauugaagcgaaacugaccaauacaacaacggaaucacgcuguccuacgcaaggcgaaccaucauuaaaugaagaacaagacaaaagauuuauuuguaaacacucaauggucgacaggggguggggaaaugguugugguuuauuuggaaaaggugguauugucacaugugcuauguuuacaugcaaaaagaacauggaaggaaagguuguacaacccgagaaccucgaauacaccauaguaauaacaccccacagcggagaagaacaugccguuggaaacgauacggguaaacacgguaaagaaauuaaaauaaccccucaaucuagcauuacagaggcagaguuaacuggcuacggaacaguaaccauggaauguucaccaaggacaggccucgauuucaaugaaaugguucuccugcaaauggaagauaaagcauggcuaguccauagacagugguuuuuggaucucccccuaccaugguuacccggagcagacacucaaggcucaaacuggauacagaaagaaacccuaguaacuuuuaagaauccucaugccaagaaacaagauguuguaguauuggggucucaagaaggagcuaugcacacugcauuaacuggagcgacugagauucaaaugucuagcggaaaucuauuauucacaggucaucuaaaguguagauugagaauggauaaguugcaacuuaagggaaugucguauuccaugugcaccgguaaauuuaaaauaguaaaagaaaucgcagaaacccaacauggaacgauagugauaagaguacaauacgaaggcgaugguucuccauguaaaauaccuuuugaaauaacggauuuagaaaagagacauguauugggucgacuuaucacagucaauccaauagucacagaaaaagacucaccagugaauaucgaggcagaaccaccguucggggauucauacaucaucauugguguggaaccagggcaacuuaaacugaauugguucaagaaaggaucuucgauaggccagauguuugaaacuacuaugagaggcgcaaagcgaauggcaauucucggugauacagccugggacuuugggucauuaggagguguauuuaccucaaucgguaaagcauuacaccaaguuuuuggagcgauauauggggcagcguuuucagguguuagcuggacaaugaaaauauuaaucggcgucaucaucacauggauaggcaugaacucuagaucaacaagccuuagcguaaguuuaguauuggugggcgucguaacuuuauaucuaggggcuguagugcaggccgacucgggaugcguugugucauggaaaaauaaagagcucaaaugugggucgggaauauuuauaacugacaauguucauacauggacagaacaauacaaauuccagcccgagucaccgucgaagcuagcuucagcuauucagaaggcucaugaagaaggcauaugugguaucagaucaguaacaagacuagagaaccuuauguggaaacaaaucacaccugaauugaaucauauuuuaagugagaacgaaguaaaauugaccauaaugacgggugauaucaaaggaauuaugcaagcaggaaaacgcucgcuucguccucaaccgacagaauuaaaauauagcuggaaaacauggggaaaagcuaagauguuaucaacugagucccacaaucagaccuuccugaucgauggaccagaaacggccgaaugcccaaauacaaaccgggcguggaacucauuggaaguugaagacuacggauucggaguauuuaccacaaauauuugguugaaacuaagggaaaaacaagauguauucugugauaguaaauuaauguccgcagcaauuaaagauaaucgugcuguacaugccgauaugggguacuggauagaaagugccuugaaugacaccuggaaaauggaaaaggccucuuucauugagguaaaguccugucauuggccaaaaagccauacucuauggucaaacggagugcuagaaucggagaugauuauacccaaaaauuucgcaggaccaguaagucaacauaauuauagaccagguuaucauacacaaacggcgggucccuggcacuuagguaagcuagaaauggauuucgacuuuugugaagggaccaccguuguggugacugaagauugcgguaaucgaggcccgagcuuaaggacaacuacggcaucaggaaaauuaauaacagaaugguguugccgcucauguacguuaccuccucugcguuaccguggggaagauggguguugguaugguauggaaauacgaccucugaaggagaaagaagaaaacuugguuaacucacuuguuaccgcuggccacggucaaauagauaauuuuucacuuggaguauuagguauggcacucuuccuggaggaaaugcucaggacaaggauaggaacuaagcacgcgauacuuuugguugcagucagcuuuguaacccucauuacaggcaauaugucauucagggaccuuggucgcgugauggucaugguaggggccacaaugacagacgauaucggaauggguguaaccuaucuugccuugcucgccgcauuuaaaguaagacccacguucgcagcuggacuucucuugaggaaauuaaccuccaaagaauuaaugauggcaacaauagggauagcuuuauuaagccaaaguaccauaccugagacuauucuagagcuaacagaugcacuugcauuagguaugaugguucuaaagauuguucggaauauggaaaaauaccaacuagcugucacaauuauggcuaucaguuguguaccaaaugccguaauucuacaaaaugcguggaaaguaucaugcacuauacuugcugcaguaaguguaucaccguuauugcuaacaagcucacaacagaaagccgauuggauaccauuagcccuaacuaucaaaggucucaauccuacugcgauauuccuuacaacgcuuagucguacaagcaagaaaagaagcuggccauuaaacgaagcaauaauggcuguagggaugguaucaauauuagccuccucguuacuuaagaacgauaucccaaugacaggaccguuaguagccggcggccuguugacuguaugcuauguuuuaacggguagaucagcagaccuagagcucgaacgagcggcggacguaaagugggaagaccaagcggagaucucaggaaguucuccaauauugucaauaacuauaagcgaagacgggucaaugucuaucaaaaaugaagaagaagaacaaacuuuaacuaucuuaauacguacaggucuucuaguaauuucagguguauuuccaguaaguauuccaauuaccgcagccgcuugguaucuaugggaagucaagaaacagagagccgguguuuuaugggacgugccaagcccaccuccgguagaaaaagcggaacuggaagauggugcguacaggauaaagcaaagaggaauacuuggcuauucgcaaauuggugcuggaguauacaaagaggggacauuccacacuauguggcacguuacgcgaggagcuguccucaugcauagaggcaagcgaaucgaacccuccugggcugauguuaagaaagaucuuauuagcuacgguggaggguggaaauuagaaggcgaauggaaggaaggcgaagaaguccaaguauuagcacuagaaccaggcaaaaauccgcgugcaguacaaacaaaaccaggaaucuucaagaccaauaccggaaccaucggugccguaucucuggacuuuagccccggaacaagcggaagcccgauaguugaccgcaaaggcaaaguagucgggcuuuacggaaauggcguagugacgagaucaggggcauacguuucggcaauagcccagacagaaaaaucuauagaggacaacccggaaauagaagaugauauauuuagaaagaaaagacuuacuauaauggaucuucauccgggugcaggaaaaacgaagcgauaucucccagccauaguuagggaagcgauuaagagaggcuugcgaacguuaauuuuagcaccaacccguguggucgcagcagaaauggaagaagcauugaggggguuaccuaucagguaucaaacaccagcaauuaaaacagaacacacaggacgagaaauaguugaccuuaugugucaugcgacauucacaaugcggcuucucagcccuguuaggguucccaacuauaacuuaauaauaauggacgaagcucauuuuaccgacccagcuagcaucgcugcucgaggauauauuucaacgcgagucgagaugggggaggcugcuggcauauucaugacagcaacacccccgggcaguagagaucccuuuccgcagaguaacgcaccaauuauggaugaagaacgugagauacccgaaagauccuggaacagcggacaugaaugggugacugauuucaaagggaaaacagucugguuuguaccaagcauaaaagcgggaaacgacauagccgcgugccucagaaagaacgguaagaaaguuauucaacuaagccggaaaacguucgauagugaauaugugaagacgagggcgaaugacugggauuuuguuguaacaacagauauuuccgagaugggugcgaauuuuaaagcagaacgggucaucgauccaaggcgaugcaugaagccaguaauacugacugauggugaagaaagagugauauuagcaggaccuaugccgguuacccacaguucagcugcacagagaagagguaggaucggacgaaauccaaagaaugaaaacgaccaauauauuuauaugggggaaccuuuagaaaaugaugaagauugcgcacauuggaaagaagcaaagaugcuacuagauaacauaaacacuccagaaggaauaaucccguccauguuugaaccagaacgcgaaaaaguggaugccaucgauggagaguauagauuaaggggugaagccagaaagacauuuguagaucuaaugcgaaggggugacuuaccagucuggcuagcguauaaaguugcagcagaaggaauaaacuauacggauagaaaguggugcuuugauggaauaaagaacaaccagauauuagaagaaaauauggaaguagaaauuuggaccaaagaaggggaacggaagaaacuaaaaccacgaugguuagaugcaagaauuuauagcgauccacucgcucuaaaagaauuuaaggaauuugccgcaggacgaaaaucacuuacccuaaauuugauaacagaaauggggagacugccgacuuuuaugacacagaaagcacgcaacgcauuagacaaucuagccguauuacacaccgcugaagcuggagggagagcguacaaccacgcguuaagcgaacuaccagaaacuuuagaaacgcuuuuacuucugacucuauuggcuacaguaacgggaggcauuuucuuauuuuugaugagcggaaaaggcaucggcaaaaugacauuaggcauguguugcauuauaacggcuaguauccuacuaugguacgcacaaauacaaccacauuggaucgcagcaagcaucauacuagaguucuuucuuaucguuuuguugaucccagaaccagaaaagcagcgaacuccacaagauaaucaauuaaccuacgucguaaucgcaauauugacuguuguggcggcuacaauggccaacgaaaugggguuucuagagaaaacuaagaaagauuuaggcuuaggcucaauaacuacccaagaaucggagaguaacauauuagauauagaucuacgacccgcgagugcguggacccuuuaugcagucgccacaacauuugucacccccaugcugcggcacucaauagaaaauucauccguaaauguaucguugacagcaauugcaaaucaagcuacgguccuuaugggcuugggaaaaggauggcccuuauccaaaauggauaucggaguaccucuucucgcuauugggugcuauagccaaguaaaccccauuacguuaacggcggcacugcugcuccuaguagcacauuaugcaaucauuggccccgguuuacaagcaaaagcaacacgagaagcacaaaaacgagcggccgcuggcauaaugaagaauccaacuguagacgguaucacugugauugaucuugaaccaauacccuaugacccaaaguucgaaaaacaauuggggcaaguuauguuauuaauauugugcgugacgcaaguccuuaugaugaggacgacaugggcacuuugcgaagcacuaacauuagcuaccgguccuauaucuacauuaugggaaggaaacccgggacgauuuuggaauacgaccaucgcuguauccauggcaaauauuuucagaggaucauauuuagcuggagcaggcuuauuauuuucgaucaugaaaaauacgacaaguacacgaagagguacugguaauauuggcgaaacuuugggagagaaguggaaaagucgacuaaaugcauuaggaaaauccgaauuucaaauauauaagaaaagcggcauucaagaaguugauaggacacuggcgaaagaaggcaucaagaggggagaaacugaucaccacgcaguaucuagggguagugcaaaacuuaggugguuuguagaacgaaauaugguaaccccugaaggcaagguugucgaucugggaugcggaagagggggcuggucguauuacugugggggcuugaaaaaugucagggaaguaaaaggauuaacuaaaggcgguccaggacaugaggagccuauucccaugucgacauauggauggaaucuagugcgacuucaaucugguguugacguauucuuuacuccaccagagaaaugcgacacguuacuuugugauaucggcgaauccucgcccaauccaacaauagaggcaggucguacgcuuagaguucuaaaccucguagaaaauugguuaaauaauaacacccaauuuugcauuaaaguauuaaaccccuauaugccaucaguaauagagaaaauggaggcucuacaaagacaauaugguggggcgcuagucagaaauccucuuagccgcaauucuacgcacgaaauguacugggugucgaacgcaacagguaauauagucucaagcguaaauaugauaucacgaauguuaauuaacagauucacaaugaagcauaagaaagcaaccuaugaaccggacguagauuuagguagcgggacaaggaauauaggcauagaauccgagauaccaaauuuagauaucauuggaaagagaauugagaaaauaaaacaagagcaugagauuucuuggcauuaugaucaggaucauccauauaaaacgugggcguaucauggguccuaugaaacaaagcaaacagguucggcauccucgaugguaaauggaguggugagauuauuaaccaaaccaugggacguaguuccaaugguuacacaaauggcuaugacagacacaacaccauucggucaacagcguguuuuuaaagaaaaaguugauacgcgaacacaggagccuaaagaaggcacaaagaaguuaaugaaaauaacugcugaaugguuguggaaagaguuaggcaagaagaaaacacccaggaugugcacaagagaggaauuuacacgaaaaguucgaucuaacgcagcguuaggagcaauauuuacugacgagaauaaauggaagucugcucgugaagcaguugaggaugggagauucugggaguuaguagauagggaacguaauuuacaucuagaaggcaagugcgaaaccuguguauacaacaugauggguaaacgagaaaagaaacucggagaguuuggcaaagcuaaggggagccgugccauaugguauaugugguuaggugcccgcuuuuuagaauuugaggcgcugggcuuccuuaacgaggaucauugguucaguagagguaauucucuaucuggaguagaaggugaaggccugcacagguuaggauacauauuacgugauguuggcaagaaagagggcggagcuauguacgcugaugauacugcuggaugggacacgagaauaacacuggaagaucuuaaaaaugaagaaaugguaacgaaccacaugaagggugaacacaaaaaguuagcagaagcgaucuuuaaacuaacauaccaaaacaaaguaguaagaguacaaagaccuacuccacgcggaacgguuauggacauuauaucgcgccgagaucaaagggggaguggacaaguaggaacauauggacuaaauaccuuuacaaauauggaagcgcaguuaauacgacaaauggaaggugagggaauauucaaaucaauucaacaucuuacagcaacugaagagauugcaguacaaaauugguuagcuagagucggaagagaaagauuaucucgaauggcuauuagcggugacgacugugucguaaaaccgauagaugauagauucgcauccgccuuaacagcauugaaugauauggggaaagugcgaaaagacauacaacagugggaaccgucgcgaggauggaacgauuggacccaagucccuuucuguucacaucauuuucacgagcuaguuaugaaagacgguaggguauuaguaguaccaugucguaaucaagacgaacuaauugggagagcacgaauaagucagggagcgggauggucauuaaaagaaacggcaugccuaggaaaaagcuaugcacaaauguggaccuugauguauuuucaucggagagacuuacgucuugcagcaaaugcgauauguucagcaguaccuagucacuggguuccaaccucccguacuacauggucuauacaugcaaagcaugaguggaugaccacggaagauauguuggcaguauggaacaggguguggauucaagagaacccuuggauggaagauaaaacccccguagaaucaugggaagaaguuccuuaucuugguaaaagagaagaucaaugguguggcagcuugauuggacucacuucaagggcgacaugggcuaaaaauauacagacagcgauuaaccagguaagaucacucauagggaacgaagaauauacagauuacaugccaucuaugaaacguuuccgaagggaggaagaagaagcaggaguuuuaugguaa

SEQ ID NO: 22372 - RNA, 9876 nt, Artificial Sequence
  derived and/or modified CDS sequence (opt6) from DENV-2__FJ373300__SS-prME
acggccggggucauagucaugcuaauuccuacagcaauggcguuucauuuaacgaccaggaauggugaaccucacaugauuguuggacgacaagaaaaagguaaaucacuauuauucaaaacagaagacggaguaaauauguguacacucauggcaaucgaucugggugaauuaugugaagacaccaucacauacaaaugcccauuguuaagacaaaaugaaccagaagauauugauuguugguguaauagcaccagcaccugggucacauauggaacauguacuacgacaggugaacaccguagggagaaaagguccguugcuuuaguuccacaugucgggaugggauuagaaacaaggacagaaacauggaugucuagcgaaggagcuuggaaacacguucaaaggauagaaacuuggauacucagacacccuggauucacaauaauggcugcaauauuggcuuacaccauagguacuacgcauuuucaaagggcucuaauuuucauccugcuaacugcuguugcuccaagcaugacuaugcguuguaucggaauaagcaacagggauuucguggaaggggucaguggaggaaguugggucgacaucguauuggaacauggaaguugcguaacgaccauggcuaaaaauaaaccgacuuuggauuuugaauugauaaaaacugaagcaaaacaaccggccacacuucggaaauacuguaucgaagccaaacuuaccaacacaacuacagaaucucgauguccaacacaaggggaaccuucauuaaacgaagaacaagacaaacgauucauauguaaacacagcaugguugauagaggauggggaaauggaugcgggcuauuugggaaaggugguaucguaacaugcgcaauguuuacauguaagaaaaacauggaaggcaaaguaguucagccggaaaaccuagaauauaccauaguuauaaccccacauagcggagaagaacaugcgguugguaaugauacagguaaacauggaaaagaaauaaaaauuacaccccagucuucaaucacugaagcagaauuaacuggcuauggaacuguaacuauggaaugcagcccaagaacuggacuggacuuuaaugagaugguccuucugcagauggaagauaaagcaugguuaguccauaggcaaugguuucuagauuuaccccuaccaugguuaccuggggcugacacacaaggcagcaauuggauucaaaaagaaacacucguaacuuuuaaaaauccacacgcuaagaaacaagauguuguagugcuggguucacaggaaggagcuaugcacacggcguuaacgggugcaacagaaauacagaugaguucagggaauuuauuauuuaccggacauuuaaaauguaggcuacguauggacaaacuacaguuaaaaggcaugaguuauagcaugugcacagggaaguuuaagauagugaaagaaaucgcugagacucaacaugggacuauugucauaagagugcaauaugagggcgauggaucaccauguaagauaccguuugaaauuacagaucuagagaaacggcauguacugggaagauuaauuacaguaaauccuauugugacugagaaggauucgcccguuaacauugaagccgagccuccauucggugacaguuacauuauaauuggagucgaaccaggacaauuaaaacuaaauugguuuaagaaagguaguucaauaggacaaauguucgaaacaacaaugcguggagcaaagcguauggccauacuaggggacacugcaugggauuuuggcucgcuagguggaguuuucaccucaauugguaaggcacuacaucaaguauucggcgcgauuuauggggcugcguucagcgggguuuccuggacgaugaagauauuaauaggaguuaucauaacauggauugguaugaacucaagaaguacguccuuaucagucagccuagugcuaguuggaguaguaacacuuuauuuaggcgcuguaguacaagcagauagcggcugcguaguaucuuggaagaauaaagagcuaaaaugcggaagcggaauuuuuauaacagauaacguccacaccuggacagaacaauacaaguuucagcccgaaaguccauccaaauuggcuuccgcgauucaaaaagcgcaugaggaagguaucugugguauaagaagcgucacgcgacuggagaauuuaauguggaagcaaauuacgccugaauuaaaccacauccucuccgaaaacgaaguuaaauuaacaauuaugaccggggauauuaaaggaacuaugcaagcagggaaaagaucccucagaccacaaccgacagaacuaaaauauucuuggaaaacuugggggaaagcuaaaauguugucuacugaaagccauaaucaaacauuuuugauagaugggcccgaaacugcugaaugcccaaauacuaaucgagcauggaauagcuuagagguugaagauuacggauuuggaguuuuuacaaccaauauauggcuuaaauuaagagaaaaacaagauguuuucugcgauucuaaauuaaugucugcggcaauaaaggacaaccgagcaguacaugccgauaugggguacuggauugaauccgcguuaaaugacacauggaaaauggaaaaagccucuuuuauugaaguaaagaguugucauuggccaaagucucacacccuuuggucuaauggagucuuagaaagcgagaugauuauacccaaaaacuucgcaggaccaguaucucaacacaauuaucgaccaggauaucacacacaaacagcugguccauggcacuuaggaaaacuggagauggacuuugacuuuugcgaaggcacuacuguuguuguaacugaagacugcgguaaucgaggaccuucacuucgaacgacgacagcgucgggaaaauuaauaacugaauggugcugccggagcuguaccuuaccgccccugcgauauagaggcgaagaugguuguugguacgggauggaaauacgaccuuuaaaagaaaaagaagaaaaccuugucaauucauuaguuaccgcaggucauggucaaaucgacaauuuuucuuuaggcguauuaggcauggcauuauuuuuagaggagauguuacggacacguauuggaacuaaacacgcaauuuuacugguagcagucucuuuugugacauuaauuaccgguaauaugagcuucagagauuuaggcagaguaaugguaaugguaggugcuaccaugacugaugacauuggaaugggagucacauacuuggcauuauuagcugcuuucaaggucagaccaacuuuugcagcuggguuauugcuacggaaguuaacauccaaagaacucaugauggcaacuauugggaucgcgcuuuuaagccagucaacuauccccgaaacuauccuagaacuaacagaugcacuagcuuuggguaugaugguucucaaaauaguacgcaauauggaaaaauaucagcuggcagugacaaucauggcaauuaguuguguaccuaacgcaguuauucuucaaaacgcauggaaaguuucauguacaguauuagcagcgguuucaguaucaccauuauuacuaacgagcagucaacaaaaagcagauuggauaccauuggcacuaacaauuaaaggucuuaauccaacugcaauauuuuuaacgacucucucuaggacaucgaagaagagaaguuggccucuaaacgaggccauuauggcaguaggaaugguuucaauuuuagcaucuucacuauugaaaaacgacauuccuaugacuggaccauuaguagcgggcggacuucuaaccguaugcuacgugcuuacgggucgaucagcagaucuggaauuagaaagagcagccgauguaaaaugggaagaccaagcugaaauuagcggaucuaguccuaucuuaucaauuacuauaucugaagauggaucgaugucaaucaaaaaugaagaagaagaacaaacucuaacaauucuaauuagaacaggacuauuaguuauuagcggugucuuucccguaaguauccccauaacggcagcugcuugguaccucugggagguuaagaaacaacgagcggguguccucugggacguaccaagcccaccaccaguagaaaaagccgaguuagaagacggagcguauagaaucaaacaacgaggaauccuagguuauucccagauaggggccggcguauauaaagaaggaacuuuucauacgauguggcauguuacacguggcgcaguacugaugcauaggggaaaacgaauugaaccaaguugggcggacgugaagaaagaccucaucucauauggcgguggguggaaauuagaaggugaguggaaagagggagaggagguucagguccucgcacuagagccgggcaaaaauccacgagcaguacaaacuaaacccggaauuuuuaaaacaaauacagguacaauaggcgcggucucuuuagacuuuaguccuggaacaagugggucuccaauaguagauagaaaagguaaaguaguuggucuauacggaaacggcgucguuacuagaucuggggccuaugugagcgccauagcacaaacggagaagucuauugaagacaacccagagauagaagacgauauauuuaggaaaaagagauuaacgaucauggaucuacacccuggcgcuggaaaaacgaaaagauaccugccggcaauaguccgagaggcaauuaaacgggggcuuagaacuuugauacuggcuccaacuagggucguagccgcagagauggaagaagcacuacgaggucuuccaauaagguaucaaacuccagcuauaaagacagaacauacaggacgggaaaucguugaucuuaugugccaugcaacuuucacuaugagguuacuaagcccuguacgaguuccgaauuauaaccugauuauuauggacgaagcucauuuuacagauccagcaaguaucgcugccagaggcuauauuucgacaagagucgagaugggcgaagccgcugguauuuuuaugacagccacuccgccagguucaagagauccauuuccucaauccaaugcgccuauaauggaugaggaacgagaaaucccagagagauccuggaacuccgggcacgaguggguuacagacuucaaaggaaaaacaguaugguuuguaccaaguauaaaagcggggaaugacaucgcggccugucugaggaaaaaugguaaaaagguaauacaauugucaagaaagacguuugauagcgaguaugugaaaacucgagcaaaugauugggauuucgucguaacaacagacauuucagagaugggggcaaauuuuaaagcagaacgcguaaucgauccaagaagauguaugaaaccugucauauuaaccgacggagaagaacggguaauucuggcugggccuaugccuguuacgcauuccucugcagcucaaagaagggguaggaucggcaggaauccuaaaaaugaaaaugaccaauauauuuauaugggggaaccacuagaaaacgaugaagauugugcacacuggaaagaagcgaaaaugcuuuuagacaauauaaauacaccagaaggaauaauaccaaguauguuugagccugaacgagaaaaaguugaugcaauugauggagaauauagguuacguggagaagcaagaaaaacauuuguugaucucaugcgaagaggggauuuaccaguaugguuagcuuacaaaguagccgcugaagguauaaauuaugcagaucgaaaaugguguuucgauggcauuaaaaacaaccaaauccuagaagagaauauggaaguugaaauuuggacuaaagagggagaacguaagaaacuaaaaccaagauggcuagaugcacgaauauacuccgacccccuugcucuaaaagaguuuaaagaguucgccgcagguagaaaaaguuuaacucuaaaucuaauaacagaaaugggcagguugccaacuuuuaugacacaaaaagcaagaaacgcgcucgauaauuuggcggucuuacauacugccgaagcuggcgguagggcuuauaaucaugcgcuaucugaauuacccgaaacccucgaaaccuuacuguuauugacucuuuuggcgacagugacaggugguaucuuucuauucuuaaugucugguaagggaaucggcaaaaugacacuugggaugugcuguauuauuacagcgucaauauuacuaugguaugcccaaauucaaccucacuggauagcagcuuccauaaucuuagaguucuuuuuaaucguuuuacugauuccagaaccugaaaagcaaagaaccccacaggauaaccaauuaacauaugucguaauugccauccuaacgguuguugcugccacgauggcaaaugaaauggguuucuuagagaagacgaaaaaggaucucggauuagggucaauuacaacucaagagagcgaaucuaauauuuuagauauugaucuacguccugcaucugccuggacauuauaugcgguugcuaccacuuuugucacaccgaugcuacggcauucaauagaaaauucaagcguuaaugugucuuuaacggcgauugcaaaucaggcaacuguucucaugggucuagggaaaggauggccgcuuagcaagauggacauugguguaccccuauuagcuauuggcugcuauucacaaguaaacccgauaacauuaacagcugcacuacuacuuuuagucgcacacuaugccauuauaggcccaggacuccaggcuaaggcuacccgugaggcccagaaaagagcggcagccggaauaaugaaaaauccaaccguagaugguauuacaguuauugaucuagaaccaauuccauaugauccaaaauuugaaaaacaauuaggucaaguuaugcucuuaauucuaugcgucacacagguauugaugaugcgaacuacuugggcacuuugcgaagccuuaacguuagcaacgggaccgaucucuacucucugggaagggaaccccggaagauucuggaauacgacuauagcaguuaguauggcuaauauauucagaggaucguaucuugcaggagcaggccuauuguuuucaauuaugaaaaacacaacuucuacaagacgaggcacugguaacaucggagaaaccuuaggagaaaaauggaaaucgcguuugaaugcacucgguaaguccgaguuucaaauauacaagaaguccgggauacaagaaguugaucggacauuagcaaaagaaggcauaaaacguggugaaacagaccaucaugccguaucgagagguucugcaaaauuaagaugguuuguggaacgaaauaugguuacaccggaaggaaaaguaguugacuuagggugcggucguggaggguggucuuauuauuguggaggucuaaagaauguccgugaaguaaaaggcuugaccaaaggagggccaggacaugaagaacccauaccaaugucuacauauggauggaaccuaguaagguuacaaaguggaguggauguauucuuuacuccaccagaaaaaugcgacacucuauugugcgacauaggagaaucgucaccaaaucccacgauagaagcggggcgaacauuaagaguauuaaaccuaguagagaacuggcugaacaacaauacacaauuuugcauuaagguacuaaauccuuauaugccgucugugaucgagaaaauggaggcuuuacagagacaauacggaggagcuuuagucaggaauccacuuucuagaaacuccacucaugagauguauugggucucaaacgcaacuggcaacauaguguccuccguuaauaugaucucaagaaugcuaauuaaccgauuuacaaugaaacauaagaaagcaaccuaugaacccgauguugaccuuggcagugguacgagaaauauugggauagagucagaaauuccaaaccuggauauaauugggaaacgaauagagaaaauaaagcaggaacaugaaauaucguggcacuacgaccaagaccauccguauaagacaugggcuuaccacggaagcuacgagaccaaacaaacuggauccgcauccaguauggucaauggcguagugcguuuauuaacuaaaccgugggaugucgugcccaugguaacucagauggccaugacugacacuacuccauuugggcagcaaagaguauucaaagaaaagguugauacacgaacacaagaaccgaaagaagggacuaagaaauugaugaaaaucaccgccgaaugguuguggaaagaacuugguaagaagaaaaccccacgcaugugcacucgugaagaguucaccaaaaagguuagaaguaaugcagcccugggagcaauuuucacagaugaaaauaaauggaaaagcgcaagagaagcaguagaagacgggagauucugggaauuaguagaucgcgaaagaaauuuacaccucgaggggaagugugagacuuguguauacaauaugauggggaagagagagaagaaauuaggggaauuugguaaggcaaaggguucuagagcuauaugguauauguggcuuggggcucguuucuuagaguucgaggcauugggcuuccugaacgaagaccauugguuuagcagagggaacagucugagcggagucgaaggugaaggacuacacagacuaggauacauacuuagagacguaggcaagaaagaaggaggagcuauguaugcugacgauacugcugggugggauacacgaauaacacuagaagaccucaaaaacgaagagaugguuacgaaucacaugaaaggagaacauaagaaauuagccgaagcuauauucaaacuuacuuaccaaaauaagguaguccguguacaacguccaaccccgcgaggaacugugauggacauaaucucaagaagagaccaacggggaagcggacaaguuggaacuuauggccuuaauacauuuacgaauauggaggcccaacuaauaagacaaauggaaggugaaggaauauucaaaaguauccaacauuugacagcuaccgaggaaauagcugugcaaaacuggcuagcacgcguaggaagagaaagguuaucucgaauggccauuucuggagacgauuguguggucaaaccuauagaugauagauuugcgagcgcucuuacugcuuuaaacgauauggguaaagugagaaaagauauccaacaaugggaaccgagccguggguggaacgacuggacacaaguucccuuuugcagucaccacuuucaugaauugguuaugaaagauggacguguucucguagugccguguaggaaccaagacgaacucauuggacgagcccgaauaucacaaggugccggcuggucacuaaaggaaacagcguguuuggguaaaucguacgcucaaauguggacucugauguauuuucaucgacgagaucuuaggcuagcugcaaaugcaauaugcagugcuguccccagucacugggucccaacauccaggacuaccuggucgauccacgcuaagcaugaauggaugacuacugaagauaugcuagccgucuggaacagggucuggauccaggagaauccguggauggaagacaagacacccguagagucgugggaagaaguuccauaucuugggaaacgagaggaucaaugguguggcucacuaaucggauugacuucaagggccacaugggccaagaauauacagacagcuauaaaucaagugagaucacuaauaggcaaugaagaauacacagacuacaugcccucaaugaaacguuuccgcagagaggaagaagaggcaggaguccuuugguaa

SEQ ID NO: 22373 - RNA, 9876 nt, Artificial Sequence
  derived and/or modified CDS sequence (opt6) from DENV-2__EU596495__SS-prME
accgcugggguaauugugaugcuuauuccgaccgcuauggcuuuccauuuaacaacuagaaauggggaaccucauaugauuguaggacgucaagagaaagguaaaucguuauuauucaaaacagaagauggaguuaauaugugcacgcuaauggcuauagaccuaggagaauuaugcgaagauacaauaacuuauaaauguccauuacuuaggcagaacgaaccagaagauaucgauuguuggugcaacucaaccucaacauggguuaccuauggaaccugcacaacaacgggagaacaccgcagagaaaaaagaucaguugcgcuaguaccacacgucggaaugggacuagaaacccguacagaaacuuggaugucaucggagggagcuuggaagcacguacaaaggauagaaaccuggauccuuagacacccgggguuuaccauuauggccgcaauuuuggccuauacaauugguacaacacacuuucaacgagcucuaauuuucauccuuuuaaccgcuguugcaccgucuaugaccaugcguuguauaggaauuaguaaccgggacuucguagagggaguaaguggugguucaugggucgauauaguacuagagcacggaucaugugugacaacgauggcaaaaaacaaaccaacauuagauuuugaacuaaucaaaacagaggcgaaacaacccgcuacccuuagaaaauauuguauagaagcuaaacugacaaacacgaccacagagaguagguguccaacccaaggagaacccaguuugaacgaagagcaagauaagagguuuauuugcaaacacucaaugguagauagaggaugggguaauggguguggacuauucggaaagggaggaauaguaacaugcgcuauguucacguguaaaaaaaacauggaagguaaaguuguucagccagaaaacuuagaauauacgauaguaauaacuccccauaguggggaagaacaugcaguaggaaacgauaccggaaaacacggaaaagagauuaagauuacgccucaaaguagcauaacagaggcggaguuaacgggcuauggaacugucacuauggaaugcaguccucgaacuggacuagauuucaaugaaaugguacuacuacagauggaagacaaagccugguugguacaucgacaaugguuucuugauuuaccgcucccauggcuaccaggagcugacacucagggaucaaacuggauacaaaaagagacuuugguaacuuuuaagaauccucacgcgaaaaaacaagacguaguaguacucggaucccaagaaggagcgaugcauacagcauuaacaggugcaaccgaaauccaaaugucgagcgguaauuugcuauuuacgggucaucugaaaugccgguuaagaauggacaaacuacaacuaaaagguauguccuacuccauguguacagguaaauuuaaaauaguaaaagagauugcagagacccaacauggaacaauaguaauuagaguucaauaugaaggggacgggagcccauguaaaaucccauucgagauuacagaccuggaaaaacgacacgucuuaggaagguugauuacugugaauccuauaguuacuggaaaggacucuccagucaauaucgaagcagagccuccauuuggggauaguuacauuauaauagguguagaaccagggcaauuaaaguugaauugguucaaaaaagguucaaguauuggacaaauguuugaaacaacuaugcgaggugcaaaacggauggccauacucggagauaccgcuugggacuuugguucucuuggcggaguauucaccaguauaggaaaggcacuacaccaggucuuuggagcaauuuacggcgcagccuuuagugguguuucauggacuaugaaaauucuuauaggaguuauuauaacuuggauaggaaugaacucgcgaucaacaucauuaucaguaucauuaguacuaguaggaguaguaacuuuauauuuaggagcaguaguacaggccgacucaggauguguagucucuuggaaaaauaaagaauugaaauguggaucagguauauuuaucacagacaaugugcauacuuggacagaacaguauaaauuucagcccgaauccccgucaaaacuagcaucagcuauacagaaagcucacgaagaaggaauuugugguauaaggagugucaccagacuagagaacuugauguggaaacagaucaccccggaauuaaaucauauucugagugaaaacgaaguaaaacuaacgauuaugaccggggacauuaaagguaucaugcaagcuggaaaaagaucccuacgaccacaaccaacagaguuaaaauacucauggaaaacauggggaaaagcuaaaaugcuaagcacugaaucacauaaccaaacauuucucauagacggucccgaaacagcggaaugcccuaauacaaaccgugcuuggaauagucucgaaguggaagauuauggcuuuggaguauuuacuacaaacauuugguuaaaacuucgagaaaaacaagacguauucugugacucaaaauugaugagugccgccauaaaagacaacagagccguucaugcagauaugggauauuggauugagagcgcauugaacgauaccuggaaaauggaaaaggccucuuucauagaaguuaaaucaugccauuggccuaaaucacauacacucuggucaaauggggucuuagagagcgaaaugauuauaccgaaaaacuuugcgggcccaguaucacaacauaacuaccgacccggauaucauacacaaacggcagggcccuggcacuuaggcaaauuagaaauggacuucgauuuuugcgagggaacaacggucguugucacagaagauugcgggaauagaggacccagcuugagaacuacaaccgcaagcgggaaguuaauaacagaauggugcuguagauccuguacgcucccgccacuaagauaucguggagaagaugggugcugguacgguauggagauccgcccccuuaaagaaaaagaagagaaccuuguaaacagucuugugaccgcagggcacggucagauagauaauuucagccucgggguucuaggcauggcacuuuuuuuagaagaaaugcuccggacaagaauugguacaaagcaugcaauccuauuagucgccgugucauucguaacucuuauuacgggcaacaugucauucagagauuuagguagaguaaugguaaugguaggagcuacuaugacagaugauaucgggauggggguuacguacuuggcucuucuggccgcauucaaagucagaccuacauucgcggcaggcuuacuauuacgaaaacuuacguccaaagaauuaaugauggcaacuauagguauugcguugcuaagucagagcacaauacccgaaaccauauuagaauuaacagacgcauuggcauuggguaugauggucuuaaaaauagucaggaauauggagaaauaucaauuagcuguaacaauuauggcuauaagcugcguaccaaacgcugugauauuacaaaaugccuggaaaguuaguugcacuauucuggcugcgguuagcguaucuccgcuauuauugacauccucccaacagaaagcggauuggauuccauuagcacuaacgauaaaaggucugaaucccacugcaauuuuucugaccacucuauccagaacuaguaagaaaagauccuggccacuaaaugaagccauuauggcggucggaaugguuucaauuuuggcguccucacuauuaaaaaacgauaucccuaugacggggccauugguugcugguggccuccuaacggugugcuauguuuugaccggaagaagcgccgacuuagaauuagagcgagcggcagaugugaagugggaagaucaagcggaaauaucagggucaucgccuauccuaucaauuacaauaucugaagaugggucaaugagcauuaaaaacgaagaagaggaacaaacuuugacaauauuaaucagaaccgggcuccuaguaaucaguggcguguucccaguuucgauaccaauaacggcagccgcaugguaccuaugggaaguuaaaaaacaaagagcagggguccucugggaugucccgagcccaccuccaguagagaaggcagaauuagaagacggagcauaucguauaaagcaacggggcauauugggcuacucgcagauuggagccggaguauacaaagagggaacuuuccacacgauguggcauguaacacgcggagcaguguuaaugcauagagguaaaagaauagaaccuuccugggcagauguaaaaaaagaucucauauccuauggugggggcuggaaauuggaaggugaauggaaggagggugaagagguccaaguauuggcuuuagaaccuggcaagaacccgagagcgguccaaacaaagccaggaauauucaaaacaaauacgggcacuauaggcgccgugucucuagauuuuaguccagggacaagugguucgcccauaguagaccggaagggcaaggucguagggcuuuacggaaaugguguugucacgaggagcggagccuacguaagugcuauugcgcaaaccgaaaaaucgauugaggacaacccagaaauugaagacgacauauuuagaaaaaaaagacuaacuauuauggaucugcauccaggugcagggaagacaaaaagauacuuacccgcaauagugagagaagcaauaaaacguggguuacggacguuaauacucgcgccgacgagaguaguagcagccgaaauggaggaagcacuacggggucuaccgauccguuaucaaacuccagcaauaaaaacagaacauacaggaagagaaauaguagaccuuaugugucacgccacuuuuacgaugcgacuucuguccccaguuagaguaccaaauuacaaucuuauaauuauggaugaagcucauuucacugaucccgcaagcaucgcagcgagagguuauauuucgacgaggguugaaaugggagaagccgcaggcauuuuuaugacagcuacuccuccugguagcagagauccauucccucaaucuaacgcuccaauaauggaugaagagagagagauaccagagaggucuuggaauucaggacacgagugggugacugacuuuaaagggaagaccguaugguucguaccuucuauaaaggcggguaaugauaucgcagcauguuuacgaaaaaacggaaagaaggucauacaauuaucgagaaaaaccuuugacuccgaguauguaaaaaccagggcaaacgacugggacuucgucguaacgacugacauaagcgagaugggugcaaacuuuaaggcugaaagagugauagacccaaggagaugcaugaaaccugugauacugacagacggagaggaaaggguaauacucgcaggacccaugcccguuacacauucaucagcagcucaaagaagaggcaggauuggacggaauccuaaaaacgaaaacgaucaauacauauacaugggcgaaccgcuggaaaaugacgaagacugcgcccauuggaaagaagcuaagaugcuucuagacaacauaaauaccccagaagggauuauaccaaguauguucgagccagagcgugaaaaaguugacgcaauugacggugaauaccgucuaagaggugaagcacggaaaacuuuugucgaccucaugagaaggggcgacuuacccguaugguuagcauacaaaguagcggcagaagggauaaauuacgcugaucguaaaugguguuuugacggcauaaaaaauaaucaaauccucgaagaaaacauggaagucgaaauauggacuaaagaaggugaaagaaaaaaacuaaagccuaggugguuagacgcuaggauauauucagacccacuagcuuuaaaagaauucaaagaauuugcagcgggacgcaaaaguuugacucucaacuuaauaaccgaaauggggcguuuacccacauuuaugacacaaaaagcaagaaacgcucuggauaauuuggcagugcugcauacggcugaagcaggggguagagcauauaaucacgcucuaagcgaauuaccugaaacucuagaaacacuacugcuucuaacacuauuagcgaccguuacagguggaauauuuuuguuucuaaugucugggaaagggaucggcaaaaugacauuagguauguguugcauaauaacagcaucgaucuuacuuugguaugcucaaauacagccacauuggaucgcugccucgauaauccuagaauucuuccucauaguacuacucauuccugagccagaaaaacaacgaacaccacaggauaaucaacuaacguauguuguaauagcaauucuaacuguuguugccgcaacaauggccaaugaaaugggauucuuggagaaaacaaaaaaggauuuaggauugggcucgauaacuacucaggagucagaaucaaauauacuggauauagauuuacgaccagcaucagcuuggacacuuuaugcagucgcgacuaccuuuguaacaccaaugcuuagacauucaauugaaaacucuucgguaaaugugagccuuacggcgauugcaaaccaagcuacuguucuaauggggcucgguaagggauggcccuuaucaaaaauggauauaggaguaccuuuacuagcaauaggauguuauagccaagugaauccaauaacccuaacugcagccuuacuacugcuaguggcucacuaugcaauaauaggaccggguuugcaggcuaaagcaacccgcgaggcacaaaagagagccgcugcuggaauuaugaaaaauccgacaguggaugggaucacaguuauugaucuagaaccaaucccauacgauccuaaauucgaaaagcaauuagggcaaguuaugcuccuuauuuugugcguaacacaaguccucaugaugagaacuaccugggcauuaugugaagcgcuaacguuagcuacagguccuauaagcacuuuaugggaaggaaacccgggccgauuuuggaacacuaccauagccgucucuauggcaaauauuuuccgaggaucuuauuuagcuggagcagggcuauuguucaguauaaugaaaaauacaacaucaacgagaaggggcacgggaaacauaggcgaaacauuaggggaaaaauggaaaucaagauuaaacgcauuggggaaaagugaguuccagauauauaagaaaagcggaauccaagaaguagacaggacacuagcgaaagaaggcauuaaacguggggaaacagaccaucaugcugucucgcguggaagcgccaagcuacguugguucguagaaaggaauauggucacgccagagggaaaaguaguugaucucggguguggaagagguggauggucuuacuauuguggaggauugaaaaauguaagagaagugaaagguuuaacuaaaggugguccuggccaugaagaaccuauaccaaugucaacauauggcuggaaccucguacgacuacaaucaggugucgauguauuuuucacgcccccugaaaaaugcgauacacuacuaugugacauuggcgaaaguucaccuaacccuacaauagaagcuggaagaacauuaaggguuuugaaccuaguugagaauugguuaaacaacaauacacaauuuuguauuaaggugcuaaaucccuacaugccaaguguaaucgaaaagauggaggcauuacaaaggcaguacgguggugcccucgucagaaacccuuuaucucggaacaguacccacgaaauguauuggguaagcaaugcaaccgguaauauaguuaguaguguuaacaugaucagucgcauguuaauaaacagauuuacgaugaaacacaaaaaggcaacauaugaacccgacguugaccucggcuccggcacaagaaacaucgguauagaaucggaaauaccgaacuuagacauuauugguaagcggauugaaaaaauaaaacaagaacaugaaaucucauggcauuacgaccaagaucauccauauaagacaugggccuaucauggaucuuaugaaacaaagcaaacuggaucagcguccucuaugguuaacggaguaguaagauuguugacaaaaccaugggacguugugccaaugguaacccagauggcaaugaccgauacaacacccuuuggccaacaaaggguguucaaagaaaaaguagacacucgaacacaagaaccaaaagaagguacaaaaaagcuuaugaaaaucacugcagagugguuauggaaggaauuagguaaaaaaaaaacgccuagaaugugcacucgggaagaauuuacaaaaaaagugcgcaguaaugcagcgcuuggcgcaauauuuacugaugaaaauaaguggaaaagugcgagagaagcgguggaggauggaagguuuugggaauuaguagaucgggagagaaacuuacaccuggaagggaagugugaaacaugugucuauaauaugauggggaagagagaaaaaaaacugggagaauuugguaaggccaaaggaucaagagcaauuugguacaugugguuaggcgcucgguuucucgaauucgaagcuuuaggcuuuuuaaaugaagaccacugguucagccgcgguaauagucuauccggaguagaaggugaaggccugcaccgacuagguuauauacuuagggauguggggaagaaagaggguggugcuauguacgcugacgauacugcgggaugggauacaagaaucacccuggaggacuuaaaaaacgaagagaugguaacaaaccacaugaaaggagaacauaaaaaacuagcagaagcuauuuuuaagcuaacuuaucaaaauaaaguugugagaguucaacgaccaacacccagagguacugugauggacaucauuucgaggagggaucagaggggauccgggcagguaggaaccuaugguuuaaauacauucacaaauauggaggcgcaauuaauaaggcaaauggaaggugaaggcaucuucaaaucaauucaacacuugaccgcaaccgaagagauugcaguccaaaauuggcuagcacgaguagggcgggaaagauuaucgagaauggcaauuaguggggaugauugcguaguaaagcccauagacgauagauucgcaucugcauugaccgcacuaaacgauauggguaaagucagaaaagacauucaacaaugggaaccuagcagaggcuggaacgacuggacgcaagucccuuuuugcucacaucauuuucacgagcuugucaugaaagauggacguguucucgugguaccauguagaaaucaagacgaacucauaggccgagcaagaauaucucaaggagcuggcuggucguugaaggaaacugccugcuuagggaaguccuaugcacaaauguggaccuuaauguacuuucacaggagggacuugagauuggcggcaaaugcuauuugcagcgcaguaccgucucauugggugccaacaucacgcaccacauggucaauacaugccaagcacgaauggaugacaacggaagauauguuagcuguauggaauagaguauggauucaagagaauccguggauggaagauaaaacaccugucgagucgugggaagaggucccauaucucgguaagcgugaggaccaaugguguggcucacuaaucggucuaacgucgagggcgacaugggcuaagaauauacagacggcgauaaaucaaguucgaucucuuauuggcaaugaagaguauacugauuauaugccuaguaugaagagguuccgaagagaagaagaagaggcagguguauuaugguaa

SEQ ID NO: 22374 - RNA, 9876 nt, Artificial Sequence
  derived and/or modified CDS sequence (opt6) from DENV-2__EU596497__SS-prME
acugcuggaguuauaguuaugcugauaccgaccgcaauggccuuucauuuaacaacaaggaacggagaaccacacaugauuguugguagacaggagaaaggaaagucuuugcuauucaaaacagaagauggagucaacauguguacguugauggcaaucgacuuaggagagcugugugaagacacaauaacuuauaaaugcccacuauuaagacaaaacgaaccggaagacaucgacuguugguguaacucaacuucaacaugggugacuuacggaacuugcacaacuacgggcgagcauaggagagaaaaacguagugucgcucuggucccgcaugugggaauggggcuagaaacgcggacugaaacauggauguccuccgagggugcauggaagcauguacaacgaauugaaacauggauccuccgucauccaggguuuaccauuauggcugcaauucuugcauacaccauaggaacaacacauuuucaacgcgcacucauauuuauccuacuaaccgcagucgcuccaaguaugacaaugagauguauuggcaucucuaaucgcgauuucguagagggugugagcggaggaucuuggguagacaucguacuugaacacggcucaugcgucacaacaauggcuaaaaauaaaccgacgcuggacuucgaauugauaaaaacugaagcaaagcaacccgcuacacucaggaaauauuguauugaagcaaaguugacaaauacaauuaccgaaagccgauguccuacacaaggagagccuagcuuaaacgaagaacaagauaagcgcuucauaugcaaacauucaauggucgaucggggaugggguaacggauguggccucuucggcaaagggggcaucguaacaugugcgauguuuaccugcaaaaaaaacauggaaggcaagguaguccagccagaaaaucuagaguauaccauagucauaacaccacauagcggugaagaacacgcagucggcaaugacaccggaaaacaugggaaagaaauaaaaaucacuccacagagcucuauaacugaagcugaacuaaccggauauggaacugucacaauggaguguagcccaagaacaggacuugacuuuaaugagaugguccuccuucaaauggaagauaaagcuuggcuaguucaccggcaaugguucuuggaccuuccucuccccugguuacccggugcagacacgcagggcuccaauuggauccagaaggaaacauuagugacguucaaaaauccccaugcgaaaaagcaagacguggucguacuaggcagccaagaaggagcaaugcacaccgcacucacaggggcaacggaaauacaaaugucaucuggaaaucuacucuucaccggucaucuaaaaugucgacuacggauggacaaacuacaguuaaaaggcaugaguuacagcaugugcacgggcaaauucaaaauuguaaaagaaaucgcagagacacaacacggaaccauuguaauacgaguacaauaugaaggagaugguucuccaugcaaaauaccauucgaaauaacagaucucgagaagcggcauguauugggucgacuaauaaccguaaacccaauuguuacagaaaaagauucgccuguuaacauagaagcugagccuccguucggggauaguuacauaauaauaggugucgaaccaggucaauuaaaauugaauugguucaaaaaggguucgucgauaggucagauguucgaaacuacaaugaggggagcaaagagaauggccaucuuaggggacacggcaugggauuuuggcucacuuggugguguauuuacaaguauuggcaaagcgcuacaucaaguguuuggugcuauauauggcgcggcauuuucugguguuucuuggacgaugaagaucuuaaucgguguaauaaucacauggaucggaaugaacucgaggaguacaucccuaucagucaguuugguccuuguuggagucguaacgcuauaucuaggugcaguaguacaagccgauucaggcugcguaguaaguuggaagaauaaagaacucaagugcggcucaggcauuuuuauaaccgauaauguacauaccuggacagaacaguauaaauuccaaccugaaucaccaucaaagcuagcaagugcaauccaaaaagcgcacgaagaaggaaucugcggaauacgcagcguuaccagauuagagaauuuaauguggaaacaaaucacuccggaauuaaaucacauauuaucggaaaacgagguaaaacuaacuaucaugacuggcgauauuaaggggauuaugcaagcggguaaaagaucccuucgaccacagccgacagaacucaaguacucuuggaaaacaugggggaaggcgaaaaugcugagcaccgaaucucauaaucagacauuuuuaauugacggaccagaaaccgcagaaugcccaaacacgaauagggcuuggaacucacuugaaguggaagauuaugguuucgguguuuuuacgaccaauauuuggcuaaaguuacgagaaaaacaagauguauucugcgauucgaaauugauguccgcagcuauaaaggacaauagagcuguacaugccgacaugggauauuggauugaaagugccuuaaacgauacauggaagauggaaaaagcaucuuucaucgagguaaaguccugucauuggccaaaaaguuacacauuauggagcaauggcguauuagaaucagaaaugauaauccccaaaaacuuugcuggaccaguaagucaacacaauuacagacccggcuaucauacgcaaaccgcgggacccuggcauuuaggaaaacuggagauggauuucgacuucugugaaggcaccacagugguagucacagaagauuguggcaacagaggcccaagucuacgaacuacaacugcaaguggcaaauugauaacagaaugguguugucguagcuguacccucccucccuugagguacagaggugaagauggauguugguauggaauggaaaucaggccucuaaaagaaaaagaagaaaauuuaguaaauucguuaguuacagccgggcaugggcaaauugauaacuuuucccucggcguacucgguauggcucuuuuccuugaagaaaugcuaagaacaagaauaggaacaaagcacgccauauuguuaguugcugucuccuuugucacgcuaaucacagguaacaugucguuucgugaucuugguagggucaugguuaugguaggggcaacaaugacagacgauaucggcaugggcguaacuuauuuggcauuauuggcugccuucaaaguaagaccuacuuucgcugcaggucuacucuuacgaaaacuaacaaguaaggaacucaugauggccaccauuggcauagcccuuuuaucucaaucuacaauaccagagacaauuuuagaacuuacugaugcccuagcacuugggaugaugguucuuaaaaucguaagaaauauggaaaaauaccaauuagcagucacaauuauggcgauaagcugugugccaaacgcgguuaucuuacagaacgcauggaaagugucauguacaauacucgcagcgguaucagucucaccguuguuacuuaccucaucgcagcaaaaagcagacuggaucccauuagcgcuaacuauuaaagguuuaaauccuacggccauuuucuugaccaccuuaaguagaacaucaaaaaagcgaucauggccuuuaaaugaagcuauaauggcgguuggaauggucaguauccuagccaguagucucuugaaaaacgacaucccaaugaccggaccgcugguagcuggcggauuacuuacagugugcuacguauuaacagguagaucagcugauuuggagcuagaaagagcagcagacguaaaaugggaagaucaagcagaaaucaguggcaguucacccauacuuagcauuaccauaucggaagacgguaguaugucgauaaaaaaugaagaagaggaacaaacacuaacgauacuaauacgcacaggguugcuuguaauaucggggguauuucccguuagcauuccaauaacggcugcggccugguauuugugggagguaaaaaaacaaagggcgggaguacuuugggaugugcccaguccaccgccaguugagaaagcggaguuggaagauggagcguaucgcauaaagcaacgaggaauacugggauauucacaaauaggcgcaggaguauauaaggaagggacuuuccauacuauguggcaugugaccagaggugcuguccuuaugcacagaggaaaacggauagaaccaaguugggcagacguaaaaaaagacuuaauauccuacgguggaggcuggaaauuggaaggcgaauggaaagagggugaggagguucaaguccuagccuuagaaccugggaagaacccuagagccguccaaacuaagccuggaauauuuaaaacaaacacuggaacaauaggggcgguaucacuagauuuuagccccggcacuagcggaaguccaaucguagauagaaaagggaaagucguagggcuauacgggaacggaguggucaccagaucuggugcuuacguaucggccaucgcacaaacugaaaaaucgauugaagauaacccugagauagaggaugauaucuuucgaaaaaaacgcuuaacaauuauggaucuucaucccggggcaggaaaaacaaaacgcuaccuccccgcuauaguaagggaagcuaucaagcguggacucagaacuuuaauacuagcucccacuaggguggucgcugcugaaauggaagaggcuuuacguggccuuccaaucagauaucaaacacccgcuauuaaaacggaacacaccggccgugaaauuguagacuuaaugugccaugcuacauucacuaugagauuauugagcccagugcgcguuccaaacuacaauuugauaaucauggacgaggcacacuuuaccgauccagcuagcauugccgcgagaggauauauaucgacaaggguggaaaugggggaagcggcaggaauauuuaugacggcuacaccaccugguaguagagacccuuucccacaaucaaaugcuccgauaauggaugaagaaagggaaaucccagaacggaguuggaacaguggacaugaaugggucacagacuuuaaggggaagaccgugugguuuguaccgucaauuaaggcgggaaacgauauagcagcaugucucaggaagaacggaaaaaaaguuauacaauugagccggaaaacauuugauucggaguaugucaagacuagggcgaacgacugggacuuuguagugacaacugauaucagugaaaugggagcuaauuuuaaagcagaacguguuauagaccccaggaggugcaugaagccugucauacugacugauggcgaggaacgggugauacuagcaggaccgaugccugugacacauucaucugcagcacaaagacgaggacgcauaggaagaaacccgaagaaugaaaaugaccaauauauuuacaugggagaaccucuugaaaacgaugaagauugcgcacauuggaaagaggcaaaaauguugcuugacaauauaaauaccccagaggguauuaucccgaguauguucgagccagaaagagagaagguugacgcuaucgauggagaauauagacuacguggugaagccagaaaaacauucguagauuuaaugaggaggggagaucuaccaguaugguuagcauacaaaguagcagcagaagguauaaacuaugcagauagaaaaugguguuuugauggaauuaaaaacaaucagauauuagaagaaaacauggaaguagaaauauggaccaaagaaggcgagagaaaaaaacuaaaaccacguuggcucgaugcucgaauuuacucagaucccuuagccuuaaaagaguuuaaagaguucgcagcaggccguaaaagucuaacacugaaucuaauaacugagauggguagauugccuacuuucaugacucaaaaagcucgcaacgcucuugauaaccuagccgugcuacacacagcagaagcgggaggucgugcauauaaucaugcacuaucagaacuaccugaaacauuggagacccuccuacuguugacacuccuugcgacagucacuggaggaauauuucuuuucuuaaugucaggaaaaggaaucgguaagaugacguuagggaugugcugcauaauaacagcaucaauacuccuaugguacgcucaaauacagccgcacuggauugcugcgaguauuauuuuagaauuuuuccuaauuguccuucuaauaccugaaccagagaagcagcguacgccucaagacaaucagcuaacauacguaguuaucgcaauuuugacaguaguugcugcuacaauggcgaacgagaugggauuccuagaaaaaacaaaaaaggaucuaggauuaggcucuaucacaacacaagaauccgaaagcaauauauuagauaucgaucuuagacccgcgucagcuuggacacuauacgcgguagcuacaaccuucguaacgccuauguuaagacacaguauagaaaauucgucgguaaacguuaguuuaaccgccauagcaaaucaggccacaguauugaugggauuaggaaaaggguggccauuaucaaaaauggauauuggggugccacuguuagcaauaggcugcuauucacaagugaacccgauaacucuuacugcagcuuuacuucuauuaguugcucacuaugcaauaauuggucccggacuacaagcaaaagcgacucgggaagcgcaaaaaagggccgcugcaggcauuaugaagaauccaacgguggacggcauaacggugauagaccuagaaccaauaccauacgaucccaaguuugagaagcaauuaggucaaguaauguuauuaauauuauguguaacgcaagugcuaaugaugcgaacgacaugggcauuaugcgaggcccucacacuagccacgggaccaauuuccacucuuugggaaggaaauccaggcagguucuggaauacaacuauagcggugucaauggcaaauauuuuuagggguaguuauuuagcaggugcuggacuacuguucucaauaaugaaaaacacaacuucaacaagaagggguacuggcaauaucggagaaacacuaggugaaaaauggaagucuagacuaaaugcgcucggcaaaucagaauuucaaauauauaagaagucaggaauucaagagguggacaggacacuugccaaagaaggaauaaagcguggagaaacagaucaucacgcuguaucgcgaggcagugcaaaacucagaugguuuguugaaagaaauauggugacaccagaaggcaaggucguggaucugggaugcggaagaggugguuggaguuacuauugcggcggucucaagaauguacgcgaggucaaaggguuaacuaaaggcggacccggucacgaagagccaaucccgaugucaacuuauggcuggaaucuaguccgucuucaguccggcgucgauguauuuuuuacuccuccagaaaaaugugacacccucuuaugugacauuggugaaagcagcccgaacccaacgauagaagcuggucguacucuuaggguauuaaaucugguggagaacugguugaauaauaacacacaauuuuguauuaagguacuaaauccauauaugcccucagucauagaaaagauggaagcguuacaaagacaauacggaggcgcccuaguacgaaauccacuaucuagaaauaguacacaugagauguacugggugucuaacgcuacgggaaacauaguaucaagcguaaauaugauaucgcgcaugcuuauaaauagauuuacuaugaaacauaaaaaagcaacauaugaaccagacguagaccuaggaagcggcacuagaaauauagggauagaaagugaaauucccaauuuagauauuaucgggaaacgaauagaaaaaauuaaacaagagcacgaaauaucuuggcauuacgaccaagaccaccccuauaaaacgugggcauaucaugguucguacgagacaaaacaaacagguagcgccaguaguauggugaauggugucgucagacugcuuacuaagccaugggacguagucccgauggucacucagauggcuaugacagacacgacccccuuuggacaacaacguguauuuaaagagaaaguagacacacgcacgcaagaacccaaagaaggaacuaaaaagcuaaugaaaauaacagcagaauggcuauggaaagaauuggggaaaaaaaagacaccaagaaugugcacaagagaggaauuuacaaaaaaaguuaggagcaaugcagcauuaggagcgauuuucacggacgagaacaaauggaagucagcuagagaagcgguugaagacggcagauuuugggaacucguggaucgcgaaagaaaccuacaccucgaagguaaaugugaaaccugcguguauaacaugaugggaaagcgggaaaagaaauuaggcgaguuugguaaagccaaaggauccagagcgauaugguacauguggcucggggcuagguuuuuagaauucgaagcucugggguucuuaaaugaagaccauugguucucaagaggaaacagucuaucagguguagaaggagaaggauuacaccggcugggcuauauauugcgagauguaggcaagaaagaagguggcgcgauguacgcugacgacacagcgggcugggauaccaggauuacccuagaagacuuaaaaaacgaagaaauggucaccaaucauaugaaaggagaacacaaaaaauuagccgaagcgauauuuaaguuaacuuaccagaacaagguagugaggguacaacgaccuacaccaagagguacgguuauggacaucaucucgaggagagaccagagagggaguggacaagucgguacguauggacucaacacauucacuaacauggaagcgcaguuaauaagacaaauggaaggagaagggaucuucaaaaguauucagcauuuaacagcaaccgaagaaauugcagugcaaaauuggcuagcaagaguaggaagagaacgacuuucacguauggcgauuaguggagaugauugugugguuaaacccauugaugacagauuugcaagcgcauuaacugcgcucaaugacaugggaaaaguaagaaaggacauucaacaaugggaaccaagucggggguggaacgauuggacacaaguccccuuuuguagucaucacuuucaugaauuagucaugaaagaugguagaguucucguaguaccgugucgaaaucaggacgaacuuauuggaagagcaaggauaagucagggugcaggguggaguuugaaagaaacagcaugucuagguaaaagcuaugcgcaaauguggacauuaauguacuuucaucggagagaucugcgauuggccgccaacgcaauauguuccgccguuccuucgcauuggguaccuacgucacguacaaccuggagcauccaugcaaaacacgaauggaugacgacagaggauaugcuggcaguauggaauagagucuggauucaggaaaacccuuggauggaagauaagaccccaguagaaaguugggaagaggugcccuaucuaggaaagagggaagaccaauggugcggaagucuaaucggacugacuaguagagcaacaugggcaaaaaacauacaaacagcuauaaaccaagugcgaucucucauagggaaugaagaauacacggacuauaugcccucgaugaaaagauuucgcagagaagaggaggaagcaggggugcucugguag

SEQ ID NO: 22375 - RNA, 9876 nt, Artificial Sequence
  derived and/or modified CDS sequence (opt6) from DENV-2__EU569695__SS-prME
acagcaggaguaauaguuauguuaauacccacagcuauggcauuucacuuaacaacacguaauggagaaccucauaugauagugggaagacaagaaaaagguaaauccuuacuauucaaaacagaagacggaguuaauauguguacccuuauggccaucgaucugggugaacuaugugaagauaccauuacuuacaaauguccauuauuacgucagaaugaaccagaagauauagauuguugguguaacagcacgucaacguggguuaccuaugguacguguacuaccacgggagaacaccgucgugagaaaagaaguguagcauuggucccacauguuggaaugggauuagaaacacgcacggaaacauggaugucgagcgaaggagcuuggaaacacgugcaacguauagaaacuuggaucuuacgucauccaggauucacgauaauggcggcaauucuagcauauacgaucgguacaacgcauuuucagcgugcauuaaucuuuauacuacugacagcaguugcuccaaguaugacuaugcguugcauagguauaaguaauagagacuucguagaaggugucucagggggaucauggguggacauaguccuugaacauggaucaugugucacaacaauggcuaaaaacaaaccgacacuagauuucgaacuuauaaaaacagaggccaaacaaccagcaaccuuacgaaaauacuguaucgaggcuaaauuaacuaacacaacaacggaaucuagauguccaacucaaggagagcccucgcuaaaugaagaacaagacaaaagauuuauauguaaacacaguaugguagauagagggugggguaauggauguggucuuuucgggaaaggaggaauugucacaugugccauguucacguguaagaagaacauggaggguaaaguugugcaaccugaaaaucuagaauacacuauaguaauaacaccccacuccggggaagaacaugcugucggaaaugacacagggaaacacggaaaagaaauaaaaauuacaccacaguccagcauuacagaagcagaacuaacaggauauggaacagugaccauggaauguagucccagaacagggcucgauuuuaacgaaaugguucuucuacaaauggaagacaaagccuggcuuguacaucgccaaugguucuuggaccuuccacuccccuggcuaccaggugcagauacacaaggaagcaauuggauacagaaagaaacccuagugacuuucaaaaacccacaugcaaagaagcaggauguagugguacuaggaucucaagagggugcaaugcauacggcucucacgggugcuacggaaauccaaaugaguuccggaaauuuguuauuuacuggacaucugaaauguagauugcguauggacaagcuacaacuuaagggaaugagcuauaguauguguacgggaaaauucaaaauuguaaaggaaauagcugaaacgcagcaugguacaauaguaauaagaguccaguaugaaggagauggaucuccauguaaaauaccauuugaaaucacagaccuagagaaacgacauguauuagggagauuaauaacgguaaacccaaucguuaccgaaaaagauagcccaguuaauauugaagccgaaccaccauuuggggacucauacaucauaaucggugucgaaccaggacaacucaaauuaaacugguuuaagaaagguucaucuauuggacagauguuugaaaccacuaugcgaggcgcaaaacgcauggcaauacucggggauaccgcaugggauuuugguucguuaggugguguauucacaucuauaggcaaggcacuccaucagguuuuuggcgcaauauacggcgcugcauuuaguggaguaucauggacaaugaagauauuaauagggguaauaauaacuuggauagggaugaauagcagaagcacgucacuuucaguaucccuuguccuaguaggaguaguaacacuauaucucggagcaguuguacaagcagacucaggcuguguaguuaguuggaaaaauaaggaauugaagugugguagcgggauauucauuacagacaauguccacacuuggacugaacaauauaaguuucaaccugaaagcccaucaaaauuagccucagcaauucaaaaagcacaugaggaaggaauuugugguaucagaaguguaacgagauuagaaaaccuuauguggaaacaaaucacgccugaacuaaaucacauuuugucagaaaacgaaguuaaacuaacuauuaugacgggugacauaaaaggaauaaugcaagcgggaaaaaggaguuuacggccccaaccuaccgaacuuaaguauucguggaagacauggggcaaagcuaaaauguugaguacugagucccauaaccaaacauuccuaauagauggaccggaaaccgccgaauguccaaauacaaaccgagccuggaacucauuagagguugaagacuacggauucggaguuuuuacaacaaacauauggcuaaagcuaagagaaaaacaagacguauuuugugacucaaaacugaugucugcagcuaucaaagacaauagagcuguucaugcugauaugggauacuggauugaauccgcuuuaaaugauacauggaaaauggaaaaggcuucuuucauugaaguaaaaucuugucacuggccuaaaagucacacauuauggucgaauggagugcuugagucagaaaugauaauacccaaaaacuucgcaggccccguaagucaacacaauuauagaccuggauaucauacgcaaacggcaggaccauggcaccucgguaaacuggagauggauuuugauuucugugagggaaccacuguagucguuacugaagauugcggaaaucggggaccuucuuuacggacaacaacagccucagguaaacuaauaacagaauggugcuguagauccuguacccuaccuccacuuagauauagaggggaagacgguugcugguaugguauggaaauaagaccauuaaaagaaaaggaagagaaucuuguaaacagucugguaacagcaggacacggucagauugauaauuuuucucuaggaguuuuaggcauggcccuauuucuggaagaaaugcuuagaaccagaaucggaaccaaacaugccauauuauuaguagcagugucauucgucacccuaauaaccggcaacaugucauucagggaucuaggcagaguuauggucaugguuggagccacuaugacugacgacauaggaaugggagugacauacuuagcacuuuuggcagccuuuaaaguacgcccuacguucgcagcagguuuauuauugcguaaauuaacaucaaaagaauuaaugauggccacuauagggauugcccuacuaagucaaucgaccauaccagaaaccauccucgagcuuacugacgcacucgcucuagguaugauggugcuaaaaauugugagaaacauggaaaaauaucaacuagcuguaacuauuauggcgauaagcugugugccgaaugcugucauacuacaaaacgcauggaagguuagcuguacuaucuuggcugccguauccguaaguccguuguuauuaacaaguucgcaacaaaaagcggauuggauuccauuggcauugaccauuaaaggccuaaauccaacggcuaucuuuuuaacuacucuuucgcgaacauccaagaagcguagcuggccccugaacgaagcaauuauggccgucgggauggucagcaucuuagcgaguucauuauuaaagaaugauauuccuaugacgggaccuuugguagcuggagguuuacuaacagucuguuauguucuaacaggaaggagcgcugauuuagaacuugagagagcagcagauguuaaaugggaagaucaagcagaaaucucuggaagcagucccauauugucuauuacaaucucagaagaugggucgauguccauuaagaacgaagaagaagaacaaacgcuaacuauuuugaucagaacggggcuuuuaguaauaagcggcgucuuccccguaaguauuccuauuacugcggccgcaugguaucugugggagguaaagaaacagcgggcaggggucuuaugggacguuccgucuccucccccgguggaaaaggcagagcuggaggauggagcauaccgaaucaaacaaagagggauacuggguuauagucaaauuggagcgggaguauacaaggaaggaacguuucacaccauguggcauguuacacgaggcgcuguacuaaugcaucgagggaaaagaauagaaccuucuugggcggaugucaagaaagaucuuauaagcuaugggggaggguggaaacuggaaggggaauggaaagaaggggaggaaguacaagucuuggcauuggagccuggcaaaaauccaagggcaguccaaaccaagccagguauauucaaaacgaacacugggacuauaggagccgugucacuugacuucagcccggguacuucggggucaccgauaguagaccgcaaggggaaaguaguaggacuguacggcaacgggguaguuacacgaaguggggcauaugugucugccaucgcucaaacugaaaaaucgauugaggauaauccggagauugaggacgacauauuccggaaaaagcgacuaacgauaauggaccuucauccaggagcagggaaaacaaaaagauaccuacccgcaauuguacgagaagcaauuaaacguggauuaagaaccuugauauuggcgcccaccaggguaguggcagcagaaauggaagaggcauuaaggggucucccaauuagauaucaaacuccugcuauaaaaaccgaacauacgggaagggagaucguggauuuaaugugucaugccacauuuacaaugagacuucuaucgccaguuagagugccgaacuauaauuuaaucauuauggaugaagcacacuuuaccgauccugcaucuaucgccgcuaggggauauauaucgacucgaguagaaaugggagaggccgcaggaauauuuaugacagcaacaccuccuggcucucgugacccguuuccucaaucgaacgcuccgauuauggaugaagagagggaaauuccugaaagaucauggaacuccggucacgaauggguaacggacuucaaagguaaaacugucugguucguuccuucuauaaaagcggguaaugacauagccgccugucuucgcaaaaaugggaagaaaguuauucaauuaaguagaaaaacguucgauagugaauauguaaaaacacgggccaacgacugggacuucguuguaacaacugauauuuccgaaaugggagcaaauuuuaaagcagaaagaguaauugauccacggagaugcaugaaaccgguuauacuaaccgauggugaagaacgagugauauuagcugggccaaugccuguuacacacuccucugcugcgcaacgucgaggacgaauaggaagaaauccuaaaaaugaaaacgaucaauauauauauaugggugaaccacucgaaaaugacgaggauugcgcacauuggaaggaggcaaaaaugcuauuggacaauauuaacacgcccgaaggcauaauucccucuauguucgaaccagagcgugaaaaaguagacgcaauagacggcgaauacagacuacguggcgaggcgagaaagacauucguagaucucaugagaaggggagauuuaccgguaugguuggcuuacaaaguagcagcagagggaauaaacuaugcugauagaaaaugguguuucgauggcauuaaaaauaaucaaauacuagaagagaacauggaaguagaaaucuggacgaaagaaggugaacgaaagaaacuuaaaccaagaugguuggaugcgcgaauauacagcgacccacuagcacucaaagaauuuaaagaguucgccgcaggaagaaaaagucucacucucaaccuaauuacugaaaugggacgacucccaacauucaugacacagaaggcuaggaaugcacuagacaacuuagcaguacuacacaccgcagaagcugguggcagagcauauaaucaugcuuuauccgaauuaccagaaacucuggaaacauuauuacuucuuacauuacuugcuaccgucaccggugggauauuuuuauuccugaugucgggaaaaggaauugguaagaugacccuagguauguguuguaucaucacagcuucuauucuuuuaugguacgcacaaauucaaccacacuggauagcggcaucaauaauacuggaauuuuucuuaaucguucuuuuaaucccggagccagaaaagcaaagaaccccacaggacaaucaacuuaccuauguaguaauagcgauacuaacggugguagcagcuacaauggccaaugaaaugggauuucuugagaaaaccaagaaagaccuagggcuaggaucaaucacaacccaagaaucggaaucuaauauauuagauauagauuugcguccugcuucugcauggacgcucuaugcugucgcaacaacguuuguaacaccuauguugcgccacucuauagaaaacuccaguguuaacgucucucugacagcugucgcuaaccaggcgacgguacucauggguuuggguaaaggauggccauuaaguaaaauggauauaggaguaccucuacuugcaauaggaugcuacucucaagucaaucccauaaccuugacggcggcuuuguuacuguuaguugcccacuaugcaauaaucggacccgggcugcaggcaaaagcgacgagagaagcacagaaaagagcggcggccgguauuaugaaaaaucccacaguagaugguaucacagugauagacuuagagccuauaccuuaugaucccaaauucgagaagcaacuagggcagguuaugcugcuuauacuguguguuacccaaguauuaaugaugagaacaacaugggcucugugcgaagcgcuaacauuggcuacagggccaauaucaacgcuaugggaagggaauccgggccguuuuuggaacacgacaaucgcagugaguauggcuaauauauuccgaggaucguaucuagcaggcgcagguuuguuauuuaguauuaugaaaaacacaaccucaaccaggcgaggaacaggaaauauuggcgagacccuaggagaaaaguggaaauccagacuaaacgcguuagguaaaagugaguuccaaauauauaagaaaaguggcauacaagagguggaucguacucuagccaaggaagggaucaagcgcggagaaaccgaucaucacgcaguaagccgggguucagcaaaacucagaugguucguugagagaaauauggucacaccagaaggaaaagucguagaccuaggguguggccguggaggaugguccuacuacuguggagggcugaaaaacguccgugaaguuaaaggauuaaccaaagguggaccaggacacgaagaaccuauaccuaugagcacuuauggauggaauuuagucagacugcaaucaggaguugacguauucuuuacuccuccagagaaaugugauaccuuacuuugcgauauuggcgagucaaguccaaacccgacuauagaagcuggcagaacauugcgcgucuuaaaucugguggaaaauuggcucaauaauaauacgcaguuuugcauaaaaguauuaaacccuuauaugccuaguguaauagaaaagauggaggcuuuacaacgucaguaugguggggcucuagucagaaauccucugucaagaaacuccacucaugagauguacugggucucaaaugccacugguaauauaguuagcucuguaaauaugauaucacguauguuaauuaauagauuuacaaugaagcauaagaaagccaccuaugaaccugauguagaucucggaagcgggacacguaacauuggaauagaaagcgaaauaccuaaucuagauauaauaggaaaacgaauagagaaaauuaaacaagaacaugagauuagcuggcacuacgaccaagaccauccguauaaaacgugggcuuaccauggcaguuaugaaacuaaacaaaccgggagcgccucuucuauggucaauggaguaguacgacuacugacaaagcccugggauguuguaccaaugguaacccagauggcuaugacggauacaacuccuuuuggccaacaaagaguauucaaagaaaaaguugacaccaggacucaagaacccaaggaagguaccaagaaacugaugaaaaucacugcugaaugguuauggaaagaguuaggcaaaaagaaaaccccacguauguguacccgagaagaguuuacuaaaaaggugcguucaaaugcugcccuuggagcgauauuuacugacgaaaacaaauggaaaagcgcaagagaagcggucgaagaugguagguucugggaacugguagaccgagaaagaaaccuacaucucgaaggcaaaugugaaacuuguguauauaauaugauggguaagagagagaagaaauugggcgaguucggcaaagcaaaagguagcagagcgauaugguauaugugguuaggcgcacgauuucuggaauuugaggcccucggauuucuaaaugaagaccauugguuuaguagaggcaauaguuuaucugggguugaaggagaaggucuacaccgacuugguuauauacuuagggaugugggcaagaaagaaggaggagcaauguaugccgaugacacugcaggaugggauacaagaauuacacuggaggaccucaaaaaugaagaaauggucacaaaccauaugaaaggcgaacacaagaaauuagcugaagcuauauuuaaguuaacauaccagaacaaaguaguacgaguacaaaggccuaccccacgggguacaguaauggacauaauuaguagacgcgaucagagaggaucuggccaaguuggaacuuacggccucaauacauucaccaacauggaagcucaacuuauaaggcaaauggaaggggaaggaaucuuuaaaaguauccaacauuuaacagcuacagaagaaaucgccguacaaaacuggcucgcaagaguuggcagagagagauuaucucgcauggcuauuucaggagaugacugcguuguuaaaccaaucgacgauagguuugcaucggcucuaacagcauuaaacgacauggggaagguuagaaaagacauccaacaaugggagccgucccggggguggaaugacuggacacaaguaccauuuuguucgcaucauuuucacgaacucguaaugaaagaugguagaguacuugugguuccauguagaaaccaagaugaacuaaucggucgagcaagaauuucacagggugcaggauggucucuaaaagaaacagccugcuuagggaaaucguacgcccagauguggaccuuaauguacuuccauagaagggacuuacgauuagcagccaaugcuaucuguucggcaguaccaucgcauuggguaccaacuagcaggacaacauggagcauccacgcaaaacacgaauggaugacaaccgaagacaugcuagcaguauggaauaggguuuggauccaagaaaauccuuggauggaagauaaaacuccuguugaaagcugggaagaaguaccauacuuggguaaaagggaagaucaaugguguggcagucuuauaggacuaacuucuagagcaacuugggccaaaaauauacaaaccgcaauaaaccagguaagaucacugauaggaaacgaagaguauacugacuacaugccuucaaugaagcguuuccgaagagaggaagaagaggcaggaguccuuugguga

SEQ ID NO: 22376 - RNA, 9876 nt, Artificial Sequence
  derived and/or modified CDS sequence (opt6) from DENV-2__EU482623__SS-prME
acagcaggcguuauaguaaugcuaauaccgacagcgauggcauuucaucuaacaacacgaaacggagaaccccauaugauuguggguaggcaagaaaaaggaaaaucucuauuauucaaaacagaagaugggguaaacauguguacgcuaauggcuauagaucuaggugaauugugcgaagauaccauaacuuacaaauguccccuacuacgacaaaaugaaccugaagauauagauugcuggugcaacuccacauccacuuggguaacguauggcacuugcacaacuaccggagaacauagacgcgaaaaacgcucaguagcgcuagugccucaugucgguauggguuuagaaacucgaacagaaacauggaugaguagcgaaggagcauggaaacacguacaaagaauugaaacguggauacucagacauccagguuucacgauaauggcagccauacuggccuauacuauugggacgacacauuuucaacgagccuuaaucuucauccuuuugacagcaguagcaccaucaaugacaaugcguuguaucggaauaagcaauagagauuuuguugaagggguaaguggaggaucuuggguagacauaguacuagaacacggaucuugcguaacaacaauggcuaaaaacaaaccgacacuugauuucgaguuaauaaaaacugaggcuaaacaaccugcaacuuuaagaaaauacuguaucgaagccaaacuaacgaauaccacuacggaaagucgaugcccaacacaaggugaaccaagucuaaacgaggaacaagauaaaagguuuauuuguaagcacucaauggucgacagggggugggggaacggcuguggauuauuuggaaagggaggaaucguuacaugcgcuauguuuacguguaaaaagaauauggaaggaaaaguagugcaaccugaaaaucuggaauacacaaucguaauuacuccacacagcggugaggagcacgcagugggaaacgacacaggcaaacacggaaaggagaucaaaauuacgccgcaaucaagcauuacagaagcagaacucacaggcuaugggacaguaacuauggaaugcagcccgagaacgggauuagauuuuaaugaaaugguacuacuacagauggaagacaaggcgugguugguacacaggcaaugguuuuuagaccuuccucuaccaugguuaccaggcgccgauacucaagaaucaaacuggauucaaaaagaaacccuaguaacauuuaaaaauccccaugccaagaaacaagacguaguuguacuagguucucaagaaggugcaaugcauacugcuuuaacgggcgcaacugaaauccaaaugagcucuggcaaccuacuauucacaggacaccuaaaaugcagacuccgaauggacaaacuacaauuaaaagggaugucauauuccaugugcacaggaaaauuuaaaauaguaaaagagauagcugagacacaacacgguacaauugugaucagaguucaauaugagggagacggcaguccuuguaaaauaccuuuugaaauaaccgaccuugaaaaacgccauguauuaggucgacucauuaccguuaacccgaucgugacagaaaaagauucaccuguuaauauugaagcagagccaccguuuggagacuccuauauuauaaucgggguggaaccuggacaacucaaacugaauugguucaagaaagguuccuccaucggucaaauguuugaaacaacaaugcgaggcgcgaagagaauggccauacuuggagacacagcgugggauuucggaagucugggugguguauucacgaguauuggcaaagcacuacaucagguuuuuggggcgauauauggcgccgcuuucuccggcgucucauggacuaugaagauuuuaauaggcguuauuaucacauggauaggaaugaacagucgcuccacuucccuaucaguuagcuugguacugguaggaguaguaacacuuuauuuaggcgcgguuguacaagccgauucagguugugucguaucauggaagaacaaagaacuaaaauguggauccggaauuuucaucacggauaauguucacacguggacagagcaauacaaguuucaaccagagagcccaucaaaacuagcaucugccauccaaaaagcucaugaagaagggauaugcgggauaagaaguguaacucgauuggaaaauuuaauguggaagcaaauuacgcccgaguuaaaccacauauugucggagaaugagguaaaacucacaauuaugacgggugacauaaaggggauaaugcaagccgggaaaagaucacuacgcccacagccuacugaacuaaaauauaguuggaaaacuuggggaaaagcgaaaauguuaucaacugaaucacauaaucaaacguuucuaauagauggacccgagacagcagagugcccaaauacaaaucgugcguggaauagucuugaaguugaggauuacgguuucgggguauuuacaacgaacauauggcuaaaacuacgggaaaagcaggacgucuucugcgauucaaaauuaaugucggcugccauuaaggacaaucgcgccguacacgcugacaugggauauuggauagaaagcgcucuaaacgauacuuggaagauggagaaagcaucauucaucgaagugaagucuugucacuggccaaaaucacacacgcucuggucgaacggaguacucgagagugaaaugauaaucccaaagaacuucgcggggccgguuucacaacauaacuaccggccuggguaucauacacaaacugccggaccauggcaucucggaaaauuagaaauggacuuugauuuuugcgaaggaacuaccgugguaguaacggaagauugcggcaaccggggaccuagucuacgaacaaccaccgcuagugguaaacuuauaacugaaugguguugucgauccugcaccuugccucccuuaagguauagaggggaagauggcuguugguaugggauggaaauccguccacuuaaagaaaaagaagaaaaucuagugaauagccucguuaccgcagggcauggacagauagauaauuucaguuuaggagugcucggcauggccuuguuacuugaagaaauguuacgaacgagaauugguaccaagcacgcgauacuccuaguggcugugagcuuugucacgcucauaacuggcaauaugucauucagggauuugggaagagugaugguuauggugggagccacuaugacagacgacauaggaaugggagucacauauuuagcacuuuuggcugccuuuaaaguaagaccaacuuuugcggcaggacuuuugcuccgaaaacuuacaucuaaagaauuaaugauggcuacaauaggaauugcauuguugucacaaucaacgauaccagagacgauccuugaauugacugaugcacuagcuuuaggcaugaugguucuuaagauaguucgaaauauggaaaaauaucaacuagcggugacuauaauggcaauuagcugugugccaaaugcuguuauacuacaaaacgcuuggaaaguaucauguaccauauuagcggcuguaagcguaagcccacuacuuuugacgucaucacaacaaaaggcugauuggaucccucuagcgcuaacuauaaaaggacuaaauccaaccgcaauauuucuaaccacacuaucacguacaaguaagaaaagauccuggcccuuaaaugaagcaauuauggcagucggcaugguuuccauauuggcuaguucacuacuuaaaaaugauauacccaugacuggaccuuuaguagcugggggauuacuaacaguauguuauguucuaaccggaaggucugcagaucucgaauuagaacgagccgcugaugugaaaugggaggaccaagcugagaucagugggaguagcccaauacuuucaauuacuauuucagaagacggcaguaugucaaucaaaaaugaagaggaagaacaaacacuaaccauccucauccguaccggcuugcuaguuaucagcggaguauucccuguuucaauaccgauaaccgcggcagccugguauuugugggagguuaagaaacaacgggcuggaguccuaugggauguuccaagucccccuccuguugaaaaagcagaacuagaggauggcgcuuauagaaucaagcaaagaggcauucucggauacagccaaauaggagcagggguuuacaaagaagguacuuuccauacuauguggcauguaacucgaggagcuguacuaaugcaccgagggaaaagaaucgagccgucaugggccgauguuaagaaagaccuaaucucauacggaggaggcuggaaauuagaaggagaauggaaagaaggggaagaaguacaaguacucgcucuagaaccugguaaaaauccuagggcaguccagacgaaaccuggaauauucaaaacaaacucuggcacuauaggagccguuucucuugauuucucaccuggaaccucgggaucaccaauaguagaccggaaaggaaaggugguggguuuauacggcaauggagucguaacgagaucaggcgcauauguaucagcgauagcacaaacugaaaaguccauugaggacaacccagagaucgaagacgauauuuuuaggaagaaacgguuaacuauaauggaucuacauccaggagccggcaaaacgaaacgauaucuaccggcaaucguccgagaagccaucaaaagaggacuaagaacgcuuauauuagccccaaccagaguaguugcugcagaaauggaagaagcauuaagagguuuaccgauccgauaucaaacuccugcaauaaagacagaacacacuggaagagaaauaguugaucuaaugugccacgcgacauuuacaaugaggcucuuaucacccgugcgaguaccgaacuauaaucugauaauaauggaugaagcgcacuuuacagaucccgcaucaauugcagcacggggauacaucaguacccgaguugaaaugggggaagcggcaggaaucuuuaugaccgcaacaccaccgggaucgagagauccuuuuccacaaagcaaugcuccgauaauggacgaggaaagggaaauuccagaacgaagcuggaacucaggccacgaguggguuacagauuuuaaaggaaaaaccguaugguuuguuccuucaaucaaagcuggaaacgauaucgccgcauguuuaaggaaaaauggaaagaaaguaauacagcuaucgagaaaaacguuugauucagaauaugucaaaacuagagcuauugauugggauuuugucguuacuacugacaucucggaaaugggagcaaauuucaaagcggaacgugucauugaccccagacguuguaugaaaccuguuauuuuaacagacggcgaagaaaggguaauccuagcaggcccaaugccagucacgcacaguagugcagcacagagaagggguagaauugguaggaacccuaaaaacgaaaaugaucaguauaucuauaugggugaaccacuagaaaaugaugaagacugcgcacacuggaaagaagccaaaaugcuacuugacaauauaaauacaccagaggguaucauaccuaguauguucgaaccugaaagagaaaaaguugaugcaauugauggggaauacagauuacgcggcgaagcucguaaaaccuucguagacuuaaugaggagaggcgaucuacccguauggcuugcauauaaaguggcagccgagggaauuaauuaugcggacaggaaaugguguuuugacgggaucaaaaauaaccaaauucuugaggaaaacauggagguugaaauuuggacgaaagagggugaaagaaagaaauuaaaaccaagaugguuagacgcuagaauauacucugacccacuugcacuaaaagaauuuaaagaauuugcagcagggagaaaaucauuaacacuaaaucucauuacggaaaugggucguuugccaaccuuuaugacacaaaaagcaagaaaugcauuagauaauuuggcuguguuacauaccgcggaggcaggaggucgcgccuauaaccacgcucuaagugaguuacccgaaacguuagaaacccuccuccugcuuacgcuauuggccacgguaacaggagggauauuccuuuuucuuauguccgguaaagguauugguaaaaugacauuggguauguguuguauuauuacggcaucgauuuuacucugguaugcucaaauacagccccauuggauagcugcaaguauuauacuugaguucuuuuugauaguauugcugauacccgagccagagaagcaacgaaccccacaagauaaucagcuaacguacguaguuauagcuauuuuaacaguagucgccgccacuauggcaaaugaaaugggcuuucuagagaaaaccaagaaagaucucggccucgguucaauaacaacucaagaaagcgagagcaacauccuagacauugaccuacgaccagcaucugcauggacacuauacgcugucgcaaccacguuugucacuccaauguugagacauuccauagaaaacaguagcgucaacguuucuuugaccgcaauagccaaucaagccacaguacucaugggacuagguaaagguuggccccuuaguaagauggacauagggguaccgcuacuggccauagguugcuauagccaagucaaccccauuacuuuaacugcagcgcuauuacuauugguagcccauuaugcuauuauagguccuggguuacaagcgaaagcgacgcgugaggcacagaaaagggcugcggcgggcauaaugaagaauccuaccguagauggaauaacagucaucgaucuagagccaauaccauacgauccgaaauuugaaaaacaacuaggacaaguaaugcuccucauucugugcguuacgcaaguacuaaugaugaggacaacaugggcguugugugaggcuuuaacuuuagcgacuggccccauaaguacucugugggaaggaaacccagguagauuuuggaacacuacgauagcugugagcauggccaauauauuuagaggcucuuaucuugcaggagcaggcuuacuguucaguauaaugaaaaauacuacaucuacgcguagaggaacggguaacaucggagaaacccucggggaaaaauggaaaagcagguugaacgcauuaggaaaaucugaauuucagaucuauaagaaauccgggauacaagaaguagacagaacuuuagcaaaagaaggaauaaagcguggagaaaccgaccaccaugccguaucacgaggaucugcuaaacuaagaugguuugucgaacgaaauauggucacaccagaaggaaagguaguggauuuaggaugcggaaggggaggauggucguacuauugcggaggacucaaaaauguaagggagguaaaagggcuaacaaaaggcgguccaggacaugaagaaccaauuccuaugaguacuuaugguuggaaucuuguacgacuacagucgggcguagacgucuucuuuaccccuccugaaaaaugugauaccuuauuaugugauaucggugaaucgucucccaauccgacaauugaagccggcaggacuuuacguguuuuaaaucuaguagagaauuggcuuaauaauaacacgcaauuuuguauaaagguacuaaauccuuauaugccuaguguaauagagaagauggaagcacuccaaagacaauauggcggcgcgcuugucaggaauccauuaucgcguaacucgacucacgagauguauuggguaucaaacgcgacaggaaauauugugucguccguaaacaugauaucccguauguuaauaaaccgauucacuaugaaacacaaaaaggcaacauacgaaccugauguugauuuaggcucaggcacaagaaauauaggcauagagagugaaauuccuaauuuagauauaaucgguaaaaggauagagaagauuaaacaagaacaugaaauuuccuggcacuaugaccaagaccauccauacaaaacgugggccuaucacggaucauaugaaacaaaacaaacugguucugcgagcaguaugguaaacgggguggugagacuauuaacuaagccaugggacgucguaccaaugguaacacaaauggcuaugacagauacaacaccauuuggacaacagcguguauuuaaagaaaaaguggauaccagaacacaagaaccgaaggaagguaccaagaaacuaaugaaaauaacugccgaauggcuauggaaggagcucggcaagaagaaaacuccgaggaugugcacgagagaagaauuuaccaagaaaguccggagcaacgcagccuuaggagcgaucuuuaccgaugaaaauaaauggaaaucagcacgagaagcagucgaagauggccgcuuuugggagcuaguagaccgagagcgaaaucuccaucuagaagggaaaugugaaacauguguuuauaauaugaugggcaaaagagagaagaaauuaggcgaauuugguaaagccaaagguucucgcgcuauaugguauauguggcuuggugcaagguuuuuagaguuugaggcauuaggcuuccugaaugaagaccacugguuuagccgagguaacucauuaucuggugucgaaggagaagggcugcauaggcuaggauauauucugagagauguggguaaaaaggaaggcggggcaauguaugcagaugacaccgccgguugggacacacguauaacauuggaggauuuaaagaacgaggaaaugguuacaaaccacaugaaaggagaacauaagaaacuugcagaagcuauauuuaaguugacauaccaaaacaaagugguuagaguacagagaccaaccccaagaggaaccgucauggacauaauaucccgaagagaucaaagagguucaggacaggugggaacguacgguuuaaacacuuucacaaacauggaagcacaacucauuagacagauggaaggagagggaauuuuuaagucaauacaacacuuaacugcaacagaagaaauagcaguucagaauuggcucgccagaguuggaagggagcgcuuguccaggauggcaauaucaggugacgauugcguuguuaagccuaucgacgauagauuugccagugcacuaacggcuuugaaugacaugggcaaaguuagaaaagauauacaacaaugggagccuaguagaggcuggaaugacuggacccaagugccuuucuguucacaccacuuccacgagcuagugaugaaggaugguaggguccuagugguuccguguagaaaucaggaugaacuaauugggcgugcuagaauaucucagggugccggauggucccugaaagaaacagcgugucuaggaaaaucauaugcgcagauguggacucuaauguacuuccacagaagagauuuacgucuagcugcuaaugcaauaugcagcgcaguaccaucacauuggguaccaaccagccguacuacauggaguauacaugcaaaacaugaauggaugacuaccgaagauaugcucgcaguguggaacaggguguggauacaggaaaauccguggauggaagacaaaacccccgucgaauccugggaagaaguaccguaccuaggaaaacgugaggaucaauggugcgguagucuaauuggguugacaagucgugccacuugggcaaagaauauacaaacggccauaaaucaaguucgaucucucauuggaaaugaagaauacacagauuauaugccuagcaugaaaagguucagacgagaagaggaagaagccgguguccuuugguaa

SEQ ID NO: 22377 - RNA, 9876 nt, Artificial Sequence
  derived and/or modified CDS sequence (opt6) from DENV-2__EU569698__SS-prME
acugcuggugucauaguaaugcuuauaccaaccgcaauggcauuucaccuuacuacgcgaaacggugaaccacacaugauuguuggaaggcaagaaaaaggaaagagcuuauuguucaaaacggaagacggaguaaacauguguacgcuaauggcaauugaccuaggagaauuaugugaagauacuauaacuuacaaauguccuuuacugaggcaaaaugaaccagaagauauugauuguugguguaauaguacgucaaccuggguuaccuacggaacauguacgacaacgggagaacaucgucgcgaaaagcgaaguguggcgcuaguuccccacgugggaaugggacuggaaacuagaacagaaaccuggaugucgucggaaggugcauggaaacacguacaaagaauugaaacguggauucugagacauccaggauuuacaaucauggcagccauucuagcauacacuauaggaacgacccauuuccaaagagcgcuaauauuuauucuauuaacugcuguagcuccaucuaugacaaugcgauguauugguaucucaaaucgcgacuuuguagaaggagucagugguggaucuuggguagauauaguauuagaacacggaucauguguaacaacuauggcuaaaaauaaaccgacacuagacuuugaauuaauuaaaaccgaagcuaaacaaccagcaacucugagaaaauacugcaucgaagcuaaauuaacaaacacaaccacagaaagccguuguccuacccaaggagagcccucguuaaacgaggaacaggacaaaagauuuauuuguaaacauagcaugguagacagaggauggggcaauggauguggccuguuuggaaaagguggaauaguaacuugcgccauguucacauguaagaaaaauauggaagguaaagugguucaaccagaaaacuuagaauauaccauaguuauaacaccccauucuggagaagaacaugcaguuggcaaugauacaggaaaacauggaaaagaaauuaaaauaaccccgcaaagcucuauaacagaagcugaguuaacggguuacggcacgguaacuauggaguguaguccgagaaccgggcuagacuuuaacgagaugguccuauuacaaauggaagacaaagcgugguuaguacauagacaaugguuuuuagauuuaccacugcccuggcucccaggagcugauacucaagguucaaacuggauacaaaaagaaaccuuaguuaccuucaaaaacccacacgcaaagaaacaagauguuguggugcugggaucgcaagaaggagccaugcauacagcucugaccggugcaacugagauacaaaugagcagugguaaccucuuauuuacaggacaucuaaaaugucgacucagaauggacaaauugcaguuaaaaggaaugucguauaguaugugcacugguaaauuuaaaauugucaaagagauugcagaaacacaacauggaacaauaguaauucgaguacaguaugagggggacggaaguccuugcaaaauaccuuucgaaaucacagaucuagagaaacgacacguuuugggucgccucauaacggucaaucccauugugacugaaaaagacucaccugucaauauagaagccgagccaccuuuuggcgauuccuacauuaucauagguguggagccugggcaguugaaauuaaauugguucaagaaagggagcucuauagggcagauguuugagacaacaaugagaggagcaaaaaggauggccauucuaggagauacagcuugggauuuugggucuuuaggaggaguauucaccagcauaggcaaagcauugcaucaaguguucggcgcaauauauggugcagccuucucgggcguuucuuggacaaugaaaauacuuauagguguaauuauaacguggauaggcaugaacucuagauccacaaguuugagcguaagccuaguauuagucggugucgucacuuuguauuuaggcgccguuguacaagcggauucaggaugcguagugaguuggaaaaauaaagaauuaaaguguggaaguggcauauucaucacagacaauguucauacguggacagagcaauauaaauuucaaccagaaagccccucgaagcuggccagcgcuauacaaaaagcacaugaagaagguauaugugggauucgaucaguuacgcgacuagaaaauuuaauguggaaacaaauaacucccgaacuuaaucacauucuaagcgaaaaugaaguuaaacuaacuaucaugacuggagauauuaaagguauuaugcaggcgggaaagaggaguuuacguccccaaccaacggaguuaaaauacagcuggaaaacgugggguaaagcaaaaaugcuaucgacagaaucucauaaccaaacuuucuuaauagauggacccgaaacugccgaguguccaaacacuaauagggcauggaacucacuagaaguagaggauuacggauuuggaguauucacgacuaacauaugguuaaaacuccgagaaaaacaagacguauuuugugauagcaaacuuaugagcgcagcgauuaaagacaaucgcgcuguucaugccgacaugggguauuggauugaaucggccuugaacgauaccuggaaaauggagaaggccagcuucauugaaguaaaaucuugucauuggccaaaaucacacacguuguggaguaauggcguacuugaaucagagaugauaauacccaaaaauuucgcuggcccaguuagccaacauaacuauagaccuggauaucauacacagacagcaggaccuuggcaucuagggaaauuagaaauggacuuugacuucugcgaaggaacgacagucgugguaacagaagauuguggcaacagaggaccaucgcugcgaaccacaacugcuaguggaaaacuuaucacugaauggugcuguagauccuguacucuaccgccucuaagguauagaggagaagauggaugcugguacgggauggagauaagaccgcuuaaagaaaaggaagaaaauuuaguuaauucauugguaacggcgggacauggacaaauagauaacuuuagccucggaguccugggaauggcacuauuucuagaagaaaugcuccguacuaggauugguacaaagcacgcaaucuuauugguggccgucaguuucgugacacucaucacuggaaacaugagcuuucgagaucuggggagaguuauggugauggugggagcuacaaugacagacgauaucgggauggguguuacuuauuuagcccuccuugcagcauucaaagucagaccaacguuugcggcuggacuauuacuacgaaaacucacaucaaaagaauuaaugauggcaacaauaggcaucgcccuccugucccaaucuacaauaccagaaacaauauuagaauuaacagacgccuuagcacugggaaugaugguuuuaaaaaucguccggaacauggagaaguaccaacuagccguaacuauaauggcuaucagcugugugcccaaugcugugauauuacaaaaugcuuggaagguuagcugcacaauccuugcagcggucagcgucucuccucuccuucuuacaagcucucaacaaaaggcugauuggauuccucucgccuugacuauaaagggacucaauccaacggcuauauuucucacaacacuguccagaacaucgaaaaagagaucauggccucuaaacgaagcaauaauggcaguagguaugguuuccauacuugcaagcucacuacucaaaaacgauauaccuaugacaggaccccuaguagcugguggguuguuaaccguaugcuacgugcuaacuggacguucagcagacuuagaacuugaacgagcagcagaugucaaaugggaggaucaagcugaaauaaguggguccagucccauucugucgauaacuaucucagaagauggaaguauguccauuaagaaugaggaagaggaacagacauuaaccaucuuaaucagaacaggacuccuaguuauaaguggcguuuucccugugucaauuccaauaacggcagcagcuugguaucuuugggaagugaagaaacaaagagcaggcgucuugugggacguuccaagcccaccuccggucgaaaaagcagaauuggaagauggcgccuaucguauaaaacagagagguauauuaggauauagucaaauaggagcaggcguauacaaagaaggaaccuuucacaccauguggcacguuacaaggggagcaguuuuaaugcauagaggcaagcggauagaaccgucaugggccgacguuaagaaagacuuaauaucauacggaggaggauggaaacuugaaggggaguggaaggaaggagaagaagugcagguuuuagcucuagaaccuggcaaaaaucccagagcaguacaaacaaaaccaggaauauuuaaaaccaauacagggacgaucggggcagugucauuagacuucucgccagguacauccgguuccccaauagucgaucggaaagguaaaguagugggcuuauacggaaauggaguagucaccagaaguggggcuuaugucucagcaauugcucagacagaaaaaucaaucgaagauaauccugaaauugaggaugauauuuucaggaagaaaagauugacuaucauggaucuucacccgggugcaggaaagacuaaaagauaccuacccgcgauaguacgugaagcgauaaagcgagggcugcgcacacuaaucuuggcaccuacuagaguaguggcagcggaaauggaggaggcauuaagaggcuuaccgauaagauaccaaaccccugcuaucaaaacagaacacacaggccgagagauagucgaucuuaugugucaugcgacauuuacgaugagacuuuuaaguccuguucgaguaccuaauuauaaccucauaauuauggaugaagcacauuuuacggacccugccuccauagcugcaagagguuauaucucaacacguguagaaaugggugaagcugccggaauauuuaugacagcaacaccgcccggaucgcgagauagcuucccacagagcaaugcacccauaauggaugaagaaagagaaauaccggaaaggucuuggaacagcggacaugaguggguaacagauuuuaaaggaaagaccguaugguuuguaccgucaauaaaagcgggaaacgacauugcugcuuguuuaaggaaaaauggcaagaaaguaauucaauuaagccggaagacauucgauagugaauaugugaagacuagagcgaaugacugggacuuuguagugaccacugacauuagugagaugggagcaaacuucaaagcagaacggguaauagauccaagacgaugcaugaaaccaguaauauugacggacggugaagaaagagucauauuagccgguccuaugccgguaacacauuccucagcagcucaacgacgagggcgaauagguagaaaucccaaaaaugaaaacgaccaguauaucuauaugggagaaccacuagaaaaugacgaggauugugcccauuggaaagaagcaaaaaugcuguuggauaauauaaauacccccgaagguauuauucccucaauguuugagccugaaagggaaaaaguggacgcaaucgauggugaguacaggcugaggggcgaagcaaggaaaacauucguugaccugaugcgaagaggggaucuuccagucugguuagcauauaagguggcggcugaaggaauaaacuaugcggaucgaaaaugguguuucgacggcaucaagaauaaccaaauauuagaggaaaauauggaaguggaaauuuggacuaaagaaggagaaagaaagaaauuaaaaccuagauggcucgacgcaagaaucuacagugauccacuggcauuaaaagaauuuaaggaguucgcugccggucgaaaaucucucacuuuaaacuuaauaacagagauggguagacuaccaacguuuaugacgcaaaaagcucgaaacgcacuagauaaucuugcuguacuacauacagcagaggcugguggacgagcuuauaaucaugcauuaagcgaacuuccugagaccuuagagacgcuguuauuacuaacacuacucgcaacagugacaggaggaaucuuccucuuuuuaaugucggggaagggaauaggaaaaaugacccucggaaugugcuguauuauaacagcuagcauacuccucugguaugcgcaaauacaaccacacuggauagcagcaaguauaauuuuagaguucuuuuuaauuguauuacuaauaccagaaccggagaaacaaagaacuccucaagauaaccaacuaacuuauguagugauagcgauccuuacugugguagcagcaacgauggcgaaugagaugggguuucuagagaaaacuaaaaaggauuugggcuuagggucaauaacaacacaagaaucugaguccaauauacuugauaucgacuuacguccagccucugcauggacccuauaugccguggccacuacauucguuacuccgaugcuccgucacaguaucgaaaacucuagcguaaacguaagucuuacugccauagcgaaccaagcaacuguauuaaugggauuaggaaaagguuggcccuugucaaaaauggauauuggaguaccccucuuagcuauuggcuguuauucacaaguuaauccaauuacccugacugcagcccuucuacugcucguagcacauuacgccauuauagggccuggucugcaagcaaaggcuacaagagaagcucaaaagagagcagccgcuggaauaaugaaaaacccaaccgucgauggaauaacugucauagauuuggaaccuauuccuuaugacccaaaauucgaaaaacagcuuggacaaguuauguuauuaauacugugugugacucagguacuaaugaugagaacuacuugggcauugugugaagcauuaaccuuagcaacaggaccaaucaguacacuuugggaagguaauccaggcagauucuggaauacaacuauagcagugagcauggcuaacauauuucgugggagcuaccucgcgggagcuggcuuguuauuuucaauaaugaagaauacuacgucuacaagaagagggacaggaaauaucggggagacacuuggcgaaaaauggaaaaguaggcuaaaugcacuaggcaagucugaguuccaaaucuauaagaaaaguggcauccaagaaguggauagaacauuagcgaaagaaggaauaaaaaggggugaaacggaccaccaugcgguaucaagaggcagugcaaaacuccgaugguucguagaacgaaauaugguaacaccagagggcaaaguuguagauuuggguugcggcagaggaggguggaguuauuauuguggagggcucaaaaauguccgugaaguaaagggacuaacgaaagguggcccuggacaugaggagccaauaccuaugucaacauacgguuggaaucuaguuagacuacaaagcgguguagacguauuuuucacuccgccagaaaaaugcgacacccucuuaugugauauaggugaaucaaguccaaacccaacuaucgaggcaggcagaacuuuacgcguccuuaaucuaguugagaacugguuaaauaacaauacacaguuuuguauaaaagugcuuaaccccuacaugccuuccguuauagagaaaauggaggcccuucagcgccaauacggaggugcacucguaaggaacccauuaucaagaaauucgacccaugaaauguacuggguaucaaacgcgacuggaaauauugucagcuccgucaacaugauuagcagaaugcuaauuaaucgauuuacgaugaaacacaagaaagcaacguacgagccggauguggaucuggggagcgggacucguaauaucggaaucgagucugagauuccaaauuuagacaucauaggaaaacgaauagagaaaauaaaacaagaacacgagauuagcuggcacuaugaucaggaccacccguacaaaacuugggcauaucaugggagcuaugaaacaaaacaaacuggaucagcuucuagcaugguuaacggaguaguacggcuuuuaacaaaaccuugggacguaguuccuaugguaacucaaauggccaugacggacaccaccccuuuuggacaacagagaguauuuaaagaaaaaguagacacaaggacucaagagccgaaagaagggacuaagaaacucaugaaaauaacagcagaauggcuuuggaaagaacuaggcaagaagaaaacgccacggaugugcacaagggaggaauuuacgaagaaaguacgaaguaaugcugcguuaggggcaauuuuuacagaugaaaauaaauggaaauccgcccgugaagcaguagaagacggaagauuuugggaacucguggacagagaaagaaauuuacauuuagagggaaagugcgaaaccugcguauacaauaugaugggcaaaagagaaaagaaacuuggcgaguucgguaaagcgaaagggucaagagcuaucugguauaugugguuaggggcuagguuucuugaauuugaggcauuaggguucuuaaaugaagaucauugguuuagcaggggaaacagccuuucuggcgucgaaggggaaggacuucauaggcucggauacauucugagggacgucggcaagaaagaggguggcgcgauguaugcggacgauacggccgggugggacacuaggauaacauuagaagaucucaaaaacgaagaaauggucacaaaccacaugaagggggaacauaagaaacuagcagaagcgauauucaaacugacuuaccaaaacaaagugguaagggugcagagaccaacaccacgagguacagucauggacaucaucucgcgacgggaccagagaggaagugggcaaguagguacuuacggauugaauacguuuacaaauauggaagcgcaacucauaaggcaaauggaaggagagggcauuuuuaagucaauccagcaucugacagcgacugaagaaaucgcaguccaaaacuggcuggccagaguuggaagagaaaggcucagcaggauggcaauauccggagaugauugcgucguuaaaccuauugaugaucguuucgcaucagcacugacagcucugaaugacaugggaaaaguaaggaaggauauccaacagugggaacccagucgugguuggaaugauuggacacaaguaccguuuuguucacaccacuuucaugaauuaguuaugaaagacggucggguccuaguugucccaugccgaaaucaagaugaacugauaggccgagcacgaauaucgcaaggugcuggaugguccuugaaagaaacggcuuguuugggaaaauccuaugcacaaauguggacauugauguauuuccaucguagagauuuacgacuagcagcuaaugcuauaugcuccgcaguaccaucccauuggguaccgaccaguaggacuacguggucuauacacgcaaaacaugaauggaugaccaccgaagacaugcuggccguauggaauagggucuggauucaagagaauccauggauggaggacaaaaccccaguugagucgugggaagaaguacccuaucuaggaaaacgggaagaucaauggugugguucacuuauaggccuaaccaguagagcaacuugggccaaaaauauucagacagcuaucaaccaaguaagaaguuuaauaggcaaugaggaguacaccgacuauaugcccaguaugaagagauucaggagggaagaagaggaagcaggaguauuaugguaa

SEQ ID NO: 22378 - RNA, 9876 nt, Artificial Sequence
  derived and/or modified CDS sequence (opt6) from DENV-2__EU569699__SS-prME
acugcaggagugauuguuaugcuaauaccuaccgcaauggcuuuucauuuaacaaccaggaauggagaaccccauaugauagugggaagacaagaaaaagggaaaucauuacuguuuaaaacagaggauggugugaauaugugcacacuaauggcgauagacuugggugagcuaugugaagauacaauuacauauaaaugcccuuugcugcggcagaaugaaccagaagauauagauuguugguguaauagcaccucuacauggguuacguauggaacuuguaccacaacaggggaacauagaagggagaaaagaagcguugcacuuguuccacacguaggaaugggacuagaaacacguacagaaacauggaugucuagugaaggagcauggaaacacguacagagaaucgaaacauggaucuuacgacauccaggauucacuauaauggcggcaauauuagcauauacgauugguaccacccauuuccaacgcgcacuaauauuuaucuugcucacggccguggcaccauccaugacaaugagauguauagguauaucuaauagagauuucguagaaggaguaucuggaggaaguuggguggacauuguacucgaacauggaagcuguguaacaacgauggccaaaaauaaaccaacauuagauuucgagcuaauuaaaacugaagcaaaacaaccagcuacguugagaaaauacugcauugaagcaaaauuaaccaauacuaccacugaaucacgauguccuacucaaggggaaccgucauugaaugaagaacaagauaaaagauuuauauguaaacauaguauggucgaccggggcuggggcaacggaugugggcucuuuggcaagggcggcauaguuacaugugcaaaauuuaccugcaaaaagaacauggaagguaaggugguacaaccagaaaauuuagaauauaccauuguuauuacuccacauaguggagaagaacaugcaguagggaaugauacaggcaaacauggcaaagagauaaaaaucacgccucaauccaguauaaccgaagcggaauugacagguuauggcacaguaacaauggaguguucuccgcggacaggauuagauuucaaugaaaugguuuuacuucaaauggaagauaaagcaugguuaguacauaggcaaugguucuuggaccuaccuuugccauggcucccuggcgcggacacucaagguucgaauuggauucaaaaagagacauuaguaacuuucaaaaacccgcacgccaagaaacaagauguagugguucuagggagccaggaaggagccaugcauacagcuuugaccggggcgacugagauacaaaugucaagugguaauuuauuauucacgggacaucuaaaaugcaggcuaagaauggauaagcuccagcuaaaaggaaugucuuauucgaugugcacaggcaaauuuaagauagugaaagaaauagcagaaacccaacacggcacaauuguaauuagaguccaguacgaaggcgauggaaguccauguaaaauaccuuucgagauaacagaccuggaaaaacgucauguucuagggagauuaaucacagugaauccuauaguaaccgagaaagacucuccaguaaacauagaagcagagccgccauuuggcgauagcuacauuauaauugggguugaaccgggucaacuuaaacuaaauugguucaagaaaggcagcucgauaggucaaauguucgagacaaccaugagaggcgccaaacggauggcaauucuaggagauacugcaugggauuucgggagucuaggaggaguauucaccucuauuggaaaggcacuccaccaaguauuuggugcgauuuauggggcagccuuuucugguguaucuuggacuaugaaaauacuuaucggagugauaauuacauggauugggaugaacucccggagcacaagucugucaguaucauuaguacuugugggcgucguuaccuuauauuuaggcgccaugguacaagcagacucggguuguguaguuagcuggaaaaauaaggaguugaaaugcggaucugguauuuucauuaccgauaauguucacacuuggaccgagcaauacaaguuccaaccugaaucgccuuccaaauuggcuucggcaauacaaaaagcucacgaagaagguauauguggaauccgaaguguuacaagguuagagaaccuaauguggaaacaaauaacaccggaauugaaucacauacugagcgaaaaugaagucaaacuaacuaucaugaccggagauauacgagggauuaugcaagcugguaaacguagucuaaggccacaaccuacugaauuaaaguacaguuggaaaaccuggggaaaagcuaagaugcuaagcacggagucgcacaaucaaacauuucuaauagaugggccugaaaccgcugaauguccaaacacaaaccgugccuggaacagucuagaaguugaagacuauggauuuggcgucuucaccacuaauauuugguuaaaauuacgggacaagcaagauguguuuugugauucgaaacuuaugucugcagccauaaaagauaauagggcgguacacgccgauaugggguauuggauagaaucagcacugaaugauacauggaagauggaaaaagcgagcuucauugaagugaaauccugucauuggccgaagucgcauacucuauggagcaacggaguacuagaaagcgaaaugauuauaccgaaaaacuuugcaggaccaguaucacaacacaauuauagaccugguuaccauacacaaaccgcagguccguggcacuuaggcaaacuagaaauggacuuugauuuaugugaagguaccacagucguuguuacugaagauugugggaacagaggaccaucacuucgcacaacuacagcauccgggaaauuaauaacagaauggugcugccgauccugcacacuaccaccacuucgguaccguggagaagauggguguugguaugguauggagauaagaccuuuaaaggagaaagaggaaaaccuagucaauagccuuguuacugcaggacauggccaaauagacaacuuuucacuaggaguccucgguauggcacugcuacuagaagagaugcuucguacccgaaucggaacuaaacacgcaauauuguuaguggccgugagcuucguaacgcugauaacagguaacaugagcuuccgagaccuuggacgugucauggucaugguaggugcaacaaugacugaugacauaggcaugggagucacauaucuugcuuuguuagccgcuuucaaaguucgaccaacauucgcggccggcuuguugcuccguaaauuaaccaguaaagaguuaaugauggccaccauugguauagcauugcuuucgcagucgacaauuccggaaacaauacuugaauuaaccgaugccuuagcccuagggaugaugguacucaaaauaguaagaaauauggaaaaauaucaacuugccgugacagugauggcgauuaguugcguuccuaacgcaguaauacuacaaaaugcuuggaaagugaguugcacuauccucgcugcggucuccguuuccccacuucuauuaaccucaagccaacaaaaagcagauuggauuccucucgcauugaccauaaaaggauuaaauccaacagccauuuuucuuacaacguuaucgaggacuucaaagaaacgaucauggcccuuaaacgaggcgaucauggcaguaggaaugguuucaauacuagccucaucacuauuaaagaaugacauaccaaugacaggcccccuaguggcgggugguuuauuaacaguaugcuaugucuuaacaggccgauccgcagaucucgaguuagagcgcgcagcugacguuaaaugggaggaucaagcagagauaaguggaaguucaccuauauuaagcauuacaaucucagaagaugguaguaugagcauuaaaaaugaagaagaggaacaaacccucacgauauugauaagaacugguuuacucgugauaucagguguguuuccugucucaauacccauuacggccgcggcaugguaucugugggaagucaagaaacaacgugcuggaguccugugggauguaccaucuccuccuccgguagagaaagcagaacuggaagauggggcguaucgaauaaaacaaagagggaucuugggcuauucacagauaggggccgguguauacaaagaggguaccuuucacacgauguggcacguuacaagaggggcuguauuaaugcaccgaggcaaacgcauagagccgucgugggcagaugucaagaaagaccuuauaaguuaugggggaggcuggaaguuagaaggugaguggaaggaaggagaagaaguacaaguacuugcauuagaaccugggaaaaauccacgagcgguccagacaaaaccggguauauucaagacaaacacagguaccauaggagccguaagucuugauuucucuccuggaacuucuggaucacccauagucgacagaaaaggaaagguuguagggcuuuacggaaacggcguaguuacacggaguggagcauacguaucagcuauagcacagacugagaaaaguauagaagacaaccccgaaauagaggaugauauuuuuagaaagaaacgacuaaccaucauggaucuucacccaggggcaggcaagacaaaacgguauuuaccagcuauagucagagaggcgauaaaacgcggucugcgcacauugauauuagcuccaacgaggguagucgccgcagagauggaagaagcacuuagagguuugccuauacgauaucagacaacggcuauaaaaacagaacauacagguagggaaaucgucgaucuuaugugucaugcaacauucacaaugcguuuacuauccccaguaagagugccaaauuacaauuuaaucauuauggaugaagcacacuuuacagauccggcaaguauagcagcccguggauauauaucgacaagaguagaaaugggggaagcagcgggcauauuuaugacagcuacaccaccaggcuccagagaucccuuuccacagagcaacgcgccuauaauggacgaagaaagggaaauaccugaacggucuuggaacucaggccaugaaugggugacggauuuuaaaggaaagacaguaugguuugugcccucaauuaaggcaggaaaugauauagccgcauguuuaaggaaaaaugguaagaaagugauucaauuaucacgcaaaacuuuugauagcgaauacgugaaaacuagggccaaugauugggacuuuguggucacaacagacauuagugaaaugggagcuaauuuuaaggcagaacgcguuaucgacccccgcagaugcaugaaaccaguaauacucacagacggagaagaacgcguuauauuagccggaccaaugcccguaacgcauucaucagcagcgcaacgacgaggaagaauagguaggaauccuaagaacgaaaaugaccaauauauauauaugggagagccgcuagaaaaugaugaagacugcgcacauuggaaggaagcgaaaauguuacuggacaacauaaauacaccagaagguauaauaccaagcauguucgaacccgaaagagaaaaaguugaugcgaucgacggugaauaucggcuccguggagaggcacguaaaacauuuguggaucuaaugcgcagaggggaucuaccuguuuggcuugcuuauaagguagcugcugaagggaucaacuaugccgauaggaaaugguguuuugacggaaucaagaauaaucagauacuagaggaaaauauggaaguugaaauauggacaaaagaaggagaacguaagaaacuaaagccaagaugguuagacgccagaauauacagcgauccauuggcuuuaaaagaguuuaaggaguucgcggcgggcaggaaauccuugacacuuaauuuaauuacugaaauggggagguugccuacauucaugacccaaaaagcacgaaacgcacuggacaaucuugcaguuuuacauaccgcagaagcaggcgguagagcauauaaccaugcccuaagugaauuacccgaaacacuagaaacgcuacuauuauugacccuauuagccaccguaacugggggcauauuucucuuccuaaugagugggaaaggaauaggaaaaaugacccuugggauguguuguauaauaacugccuccauacugcucugguaugcccagauacaaccacauuggaucgcggcaaguauuauucuggaguucuuucucauagugcuguugaucccugaaccugaaaaacagagaacaccgcaggauaaucaacugaccuacguaguuauagcaauauuaacaguaguagcagcaaccauggcaaacgaaauggguuuucuagagaagacgaagaaagaucuaggauuaggauccauaacaacucaagaaucugaaaguaauauacucgacauagacuuaagaccagcaucggccuggacacucuaugcaguagcuacaacauuuguaacaccaaugcuaaggcacagcauugaaaauucgagugugaauguaucccucacugcgauugcaaaucaagcaaccguccuuauggguuuggguaagggauggccucucucaaaaauggauauagggguacccuugcuugcuauugguuguuauucacagguuaauccaauaacccuuacugccgcucuuuuacuacucguagcucacuaugcgauaauagguccgggucuacaagcgaaagccacucgugaggcccagaaaagggcagcggcuggcauuaugaaaaaucccaccguagacgggauaacgguuauagacuuagagccaauaccauaugaccccaaauuugaaaaacaguuaggucaggugaugcuuuugauucucugcgugacacagguccucaugaugcgcacgacaugggcguugugcgaggcuuugacccuggcaacggggccaauuaguacauugugggaaggaaaucccgguagauuuuggaauacaacaauagcuguaaguauggcgaauaucuuccgagguaguuaccuagcuggcgcaggccugcuauuuucaaucaugaaaaacacaacaaauacccggagaggaacuggcaacauaggagaaacguugggagaaaaauggaagagucggcuaaaugcauugggaaaauccgaguuccaaaucuacaagaaaucaggcauucaggaaguugauagaacauuggcaaaagaaggaaucaagcgcggcgagacagaccaucaugcaguaucacgagguucugcgaaauuaagaugguuuguagaaaggaauaugguaacaccagaaggcaaaguaguagauuuaggcugcggccguggggguuggagcuacuacuguggaggacucaaaaacgugagagaaguuaaaggacuaacgaaaggggguccgggacacgaagaaccaauaccuaugucuacauauggguggaacuuggucagauuacaaucagggguugauguauucuucacaccuccagaaaaaugugauacguuauuaugugauaucggugaaagcucaccuaacccaacaauagaagcuggaaggacccuaagaguguugaacuuaguagagaauugguuaaacaauaauacacaauucugcauuaaaguauuaaacccauauaugcccagugugauagagaaaauggaagcacuccaaaggaaguauggaggagcacuuguacgaaauccauuaagcagaaauaguacacaugagauguacuggguaaguaaugcgacuggaaacauaguuucgucaguuaacaugauuucgaggaugcuaaucaauagguucaccaugaaacacaaaaaggcuacauacgaaccagauguagauuuggguucugguaccagaaacauagggauugaaucggaaauaccuaauuuagauauaauaggcaaaagaauagaaaagauaaaacaagaacaugaaacauccuggcauuacgaccaggaucacccauauaagacaugggcauaucaugguaguuaugaaacgaaacagacaggaagcgcaaguucaaugguaaaugguguuguuagauuacuaacuaaaccaugggauguugugccaauggucacacaaauggcaaugacggauacaacaccuuucggucaacaaagaguauucaaagaaaaaguggauacaagaacacaagagcccaaagaaggaacaaagaaacuaaugaaaauaacugcugagugguuguggaaagagcuaggcaagaagaaaacaccaagaauguguacucgcgaagaauuuacaagaaaaguacgauccaacgcagcacuaggugcaauauuuacggaugaaaauaaauggaaaagugcccgugaagcuguggaggaugguagauuuugggaacuggucgaucgggagaggaacuuacaucuugaaggaaagugugaaacguguguauacaacaugauggguaaaagagaaaagaaauuaggggaauuuggaaaagcgaaagggaguagagcaaucugguauauguggcuaggagcuagauuccuagaguucgaagcauuagguuuucuaaaugaggaucacugguucuccagaggcaauucacugaguggggucgagggggaaggucuacauagguuagguuacauucuacgcgacguagguaagaaagaaggaggugcaauguaugcugaugacaccgcagggugggacacacggauuacccuagaagaucuuaagaacgaagaaauggucacaaaucauaugaaaggugaacauaaaaagcuagcagaagcaauuuuuaagcucacuuaucagaacaaagucguacgaguucaaagaccgacaccacgaggaacgguaauggacauaauuucaaggcgcgaucagagagguuccggacaaguaggaacauauggguuaaacacguucaccaauauggaggcgcaacuaauucgacagauggaaggggaaggaaucuucaagucaauacaacaccucacggccauagaagaaauagcugugcaaaacugguuagcccgcguaggcagagaacgcuuaucaagaauggcuauaucaggcgaugauugcgucauuaaaccgauagaugacagauuugccucagcacuuacggcauuaaaugauaugggaaaaguaagaaaggauauacaacaaugggagccuagcagagguuggaacgacuggacacaagucccauucuguucgcaucauuuucaugaacuuguaaugaaagauggcaggguuuuaguaguaccaugcagaaaccaagaugaacuaaucgggcgagcaagaaucagccaaggagcagguuggucgcuaaaagagacugcuugucucggaaaauccuaugcccaaauguggacacuuauguacuuucauaggagagaccuaaggcuagcagccaacgcaaucugcagugcagugccaagucacuggguaccuaccagcagaacaacauggagcauucacgcuaaacaugaguggaugacuacugaagauauguuagcaguguggaauagaguguggauacaagagaacccuuggauggaagacaaaacaccuguagagucgugggaggaaguucccuaucuaggaaaaagggaagaucaauggugugguaguuugauaggacugacgagccgagcaacaugggcgaaaaauauucaaacugcuauaaaucagguaaggagccuaauagggaacgaagaauauacugacuauaugcccagcaugaagagauucagaagggaagaagaagaagcaggaguacuaugguaa

SEQ ID NO: 22379 - RNA, 9876 nt, Artificial Sequence
  derived and/or modified CDS sequence (opt6) from DENV-2__KF955366__SS-prME
acagcaggagucauaguaaugcuaauuccuacagcgauggcauuucacuuaacaacucgaaacggagaaccacacaugauaguaggucgucaagagaaaggaaagucucuacuguucaaaacagaagauggaguaaauaugugcaccuugauggcuauugauuuaggggaauugugugaggauacuauaacuuauaaaugcccguuauuaagacagaaugaacccgaggauauagauugcuggugcaacucaacuuccacuugggucacauacggaacgugcacgacaaccggagagcaccgaagagaaaagagaucagucgcauuaguuccucauguuggcaugggacucgaaacuagaacagaaacauggaugagcucugaaggcgcauggaaacauguacaaagaaucgaaacguggauccuuagacaccccgguuucaccauuauggcggccauauuggcguacacaauaggaacaacccacuuccaacgugcguuaaucuuuauucugcuaacggcaguagcacccaguaugacgaugcguuguaucggaauuucuaauagagauuuuguggaaggagucagcggcggcucuuggguagauauuguauuggaacaugguucuuguguaacaacaauggccaaaaauaagccaacauuggacuuugaacuaauaaaaacugaagcuaaacagcccgcgacacuaagaaaauauuguauagaggcuaaguuaacuaauacaacaacggaaucucguugccccacccaaggagaaccaucauuaaacgaggaacaggauaagagauuuauauguaaacacucaaugguugacagagguuggggaaacgguuguggauuauucggcaagggggggauugugacgugcgcaauguuuacuuguaaaaaaaauauggaaggcaaaguuguucagccagaaaaccucgaguauacaauugucauuacaccacauaguggagaagaacacgcgguugggaacgacacugggaaacacggaaaggaaauuaaaauaaccccgcagaguucaaucacagaagcagaauuaaccggguaugguacugucacaauggaauguucgccacgaacaggccuagacuucaaugaaaugguuuuacuacaaauggaagauaaagcuugguuaguacauaggcaaugguuuuuggauuugcccuugccauggcuuccuggagccgauacgcagggaucgaauuggauucaaaaagaaacuuuaguaacuuucaaaaacccucaugcaaagaaacaggaugucgugguccuagggagucaggaaggugcuaugcauaccgcguuaacuggugcgacugaaauccaaaugagcagcgggaacuuacucuucacaggacaucucaaaugccgacuaagaauggacaaauuacaacugaaagguauguccuauucuauguguaccgguaaauuuaaaauaguaaaggaaauagcggaaacacaacacgggacgauaguuaucagaguacaguacgagggagacggaaguccuuguaagauaccguuugaaauaacugaucuagaaaaacgacauguauuaggaagauuaauaacuguaaauccuauagugacggagaaagacaguccaguaaacauagaagcagaaccaccuuuuggagauucauacauaauaauaggggucgaaccgggucaacuuaaacugaauugguucaaaaaggguucgucuauaggacaaauguuugaaacuacaaugcggggagcuaagagaauggcuauuuuaggagacacggccugggacuucggcagcuugggaggaguauucacuucaauaggaaaagcacuacaucaaguauuuggugcaauauacggugcugcauucucgggaguuaguuggaccaugaagauuuuaaucggaguaauaauaacuuggauugguaugaauucaagaucaacuucucuaucuguaaguuuaguucuuguugguguggucacacuauaucuaggcgcggugguccaagcggauagcgguugcguagugucguggaagaacaaggaacugaaauguggaucaggaauuuuuauuacagauaauguacauacuuggacugagcaguauaaauuucaaccugaaaguccuagcaaacuagcuagugcgauacagaaggcccaugaggaaggcaucuguggaauuaggaguguaacaaggcuagaaaauuugauguggaagcaaauaacacccgaacuaaaucacauacugagcgaaaaugaaguaaaacuaacuauuaugacaggugacauaaaaggaauaaugcaggcggggaagagaagcuuaagaccucaaccaacugaacuaaaauauucauggaagacuuggggaaaagcaaaaaugcuuagcaccgaaucccacaaucaaacauuccucaucgauggcccagagacagcagaaugcccaaacacaaaucgcgcguggaauuccuuggaaguugaagauuauggguuuggugucuuuacaacgaauauuuggcuuaaacuucgugagaaacaagauguuuuuugcgauucaaaauuaaugucagccgccauaaaagacaauagagcaguacaugcugauaugggguauuggauagaaagugcacuaaaugauacguggaaaauggaaaaagcaucauucaucgagguaaagucuugccacuggccuaaaucucauacauuauggaguaacggugugcucgaaucagaaaugauaauaccaaagaauuuugcaggucccguaagucaacacaauuauaggccaggguaucauacacaaacggcaggaccauggcaucuaggcaaguuagagauggauuuugacuucugcgagggaacaacggucguaguaacugaagauugcgggaaccgcggcccuucgcuacgcaccaccacagcauccggaaaacuuauaacagaaugguguugcagguccugcacguuaccuccuuugcgguaccggggugaagauggaugcugguauggaauggaaauuagaccauuaaaagaaaaggaagagaacuuaguuaacucccuaguaacggcgggacauggacaaauagauaacuucucgcuagguguuuuagguauggccuuauuuuuggaagaaaugcuucggaccagaauagguacaaaacacgcaauauuacuaguggcggucucauuuguaacuuuaauuacaggcaauaugucguuccgagaucuuggacgagucaugguuaugguuggagcaacgaugacggaugacauagggauggggguuacuuaucuagcguuauuagcugccuuuaaaguccgcccaacuuuugcagcuggccuacuucucagaaagcugacuucaaaagaauuaaugauggcaacaauagggauagcccuuuuaucccaauccaccauuccagaaaccauccuagaguuaacagaugcauuagcguuaggaaugaugguauuaaaaauugugaggaauauggaaaaauaucaauuagccguuacaauuauggcgauaucgugugugccgaaugcuguuauacugcagaaugcauggaaagucucaugcacaauucucgccgcugucaguguaaguccauuauugcuaacuaguagccaacaaaaagcagauuggauaccauuagcuuuaacaaucaaaggucuaaauccaacugcuauauuuuuaacgacgcugucacgaacaucuaaaaaaaggucuuggccacuuaacgaagcaaucauggcaguugggaugguguccauacuugccaguaguuuacucaaaaaugauauccccaugacaggaccccuaguagcugguggccuccuaacagucuguuauguucugacaggcaggagcgccgaucuugaauuagaacgagcagcggaugucaaaugggaagaucaggcagagauaaguggaucaucccccauucucucaaucacaaucagcgaggacggaagcaugaguauaaaaaacgaggaagaagaacagacacuaaccaucuuaauaaggacuggauuauuaguuauaagcggaguauuuccugugaguauaccaauaaccgcagcagcuugguaucuaugggaagugaagaaacaaagggccgggguauuaugggacgucccaucuccaccucccguugaaaaagcagaauuagaggauggggcuuaucgaauaaaacaacgggguauauuaggguauucacaaauaggggcagguguguacaaggaaggcacauuccacacuauguggcacguaacaagaggagcgguacuuaugcaucggggaaagaggauugagccaucaugggcugaugucaaaaaagauuuaaucaguuacggugguggauggaaacucgaaggagaauggaaagagggugaagaaguacaaguauuagcucuugaaccuggaaaaaauccuagagccgugcaaacuaaacccggaauuuuuaaaaccaacacagggacgauaggcgcagugucucuugauuucucgccaggaacaaguggcucaccuauaguagaucggaaaggaaaaguagugggacuguaugguaauggaguggugacucggucgggugccuacgugagugcuauugcucaaacugagaagucaauugaagauaacccugaaauugaggaugacaucuuucgaaaaaagagauuaacaauaauggauuugcacccaggcgccgguaaaaccaaaagguaccuaccugcgauaguucgagaagcaauaaaacgaggacugaggacucuaauacuagcucccacucgaguuguugcagcggaaauggaggaagcacuaaggggguugcccauaagauaucaaacacccgcaaucaaaaccgagcauaccggacgggaaauaguagauuuaaugugccacgcaacuuuuacuaugagacuauuaucacccguaaggguacccaacuacaaucuaauaauuauggaugaggcacauuucacugauccugcuagcaucgccgcuagaggcuauauuagcacuagaguugaaaugggagaggcagccggcauauucaugacugcaacauccccgggcuccagggauccauucccccaaaguaaugcgccaauuauggaugaagaaagagaaauuccagaacgcucguggaacagcggccacgaauggguuacugacuuuaaaggaaaaaccguaugguucgugccguccauuaaagcgggaaaugacauagcggcaugcuuacgaaagaacggaaaaaaaguaauacaauuaaguagaaaaacuuucgauucagaauauguuaaaacaagggcuaaugacugggacuucguuguaacaacggauauaagugaaaugggggcuaacuucaaagcagagcgagucauagauccgcgucgguguaugaaacccguaauucuaaccgauggagaggaaagagucauuuuagcggggccgaugccuguaacacauagcucagccgcucaacgucgagggcggauaggcaggaauccaaaaaaugaaaaugaccaguauauauauaugggugaaccacuagagaaugacgaagauugcgcacauuggaaagaagcaaaaauguugcuagauaauauaaacaccccagagggcauuauuccaaguauguuugaaccugaacgcgagaaaguagaugcaauagacggugaguaucggcugaggggagaagcaagaaaaaccuuugucgacuuaaugcgaagaggggaccuaccuguaugguuggccuauaaagucgcagcggaaggaauaaacuacgcagaccgaaaauggugcuucgaugggaucaaaaauaaccagauuuuggaagaaaauauggagguagaaaucuggacuaaggaaggcgaaagaaagaaacuaaagccuagaugguuggacgcgcgaauuuacagcgauccacucgcacuaaaggaguuuaaagaauuugcagccggaaggaaaucgcuuacucuaaaucuuauaacugaaaugggcagacuacccacguucaugacacaaaaggcaagaaaugccuuagacaaucuagccguuuuacauacugcagaagcugguggaagggccuauaaucaugcauuaucugaauuaccggagacuuuagaaacgcugcuucuauuaaccuuacuagcaacaguaacgggcggaauauuuuuauucuuaaugucuggaaaggggauaggcaaaaugacacuuggaauguguuguauuauaacagcaaguauacuacuaugguacgcacaaauacaaccgcacuggaucgcugcgaguauaauauuggaguuuuuuuugauaguauuauuaaucccagaaccagagaagcaaagaaccccgcaagacaaucaacuuacguaugucguaauugccauucuuacagucguagcggccaccauggccaaugaaaugggguuccuggaaaaaacaaaaaaagacuugggcuugggauccaucacaacacaagaaucagagaguaacauauuggauauugacuuaagaccagcgagugcuuggacuuuauaugccguagccacgacuuuuguaacuccaaugcuucgucacaguauagaaaauuccagugucaacguaucuuugacggcuauugcgaaucaagcaaccguauuaaugggauuaggcaaaggguggccuuuaaguaaaauggacauuggcguaccauuacuugccauaggcugcuauucucagguuaacccaauuacuuuaaccgcggcacuccugcuauuagucgcccacuacgccauuauuggcccaggucuccaggcgaaggcaacacgcgaggcccagaaacgagcggccgcuggaaucaugaagaacccaacaguggauggaauaacgguaaucgacuuagaacccauuccauaugacccuaaauucgaaaagcaauuaggccaaguaaugcuccuaauauugugcguaacccaaguacuaaugaugaggacaacaugggcccugugcgaagcgcugacguuagcgacugguccaauauccacauuaugggagggcaauccggggcgauuuuggaauacaacuauagcaguuagcauggcuaacauauucaggggaucauaccuagcgggggcuggauuacuauuuuccauuaugaaaaacacaacaucaacaagaagagguacugguaacauaggagaaacacuuggcgaaaaauggaagaguagauugaaugcucuagggaagagcgaauuucaaauauacaagaaaagcggaauucaagaagucgauagaacauuagcgaaagaagggauuaaaagaggggagacagaccaucaugcaguaucuagaggcuccgcgaaauuaagaugguuuguagaaagaaacauggugacaccagaagggaagguaguggauuuaggaugcggucguggaggauggucguauuauugcggagguuuaaaaaacguccgcgaggucaaagggcuuacuaagggugguccaggccaugaggaaccgauacccaugagcacauauggauggaaccucgugcgguuacaaagugguguggacgucuuuuuuaccccuccugagaaaugcgacacgcuguuaugugacauaggagaaucuagcccgaacccuacaauugaagcagggcgcacacuucguguucuuaaucuaguagaaaauugguuaaauaauaacacacaauuuuguaucaaaguauugaacccuuacaugccuagcgucauugaaaaaauggaagcuuuacaacgacaguacgguggagcacuuguacgcaauccacucuccagaaauucuacacacgagauguauuggguaaguaacgccacaggaaauauaguauccucgguuaacaugauuucaagaaugcuaaucaaccgcuucacgaugaaacacaaaaaagcaaccuaugaaccagauguugaucuagguucggguaccagaaauauugguaucgaauccgagauuccuaaucucgacaucauuggaaagcgaauagaaaaaaucaaacaagaacacgaaauuucguggcauuacgaccaagaucauccauauaaaacgugggccuaucauggcucauacgaaacaaaacaaaccgguucagcuagcaguauggugaauggaguugugaggcugcuuacaaaaccaugggauguaguuccuaugguuacucagauggcuaugacugacacaacaccuuuuggucagcagagaguauuuaaagaaaaagucgauaccagaacacaggagccuaaagaaggcacuaagaaacuaaugaaaauaacagcugaauggcuuuggaaggagcuaggcaaaaaaaaaacccccagaauguguacaagagaggaguuuacgaaaaaaguacguucgaaugcugcguuaggugcuauauuuacugaugaaaauaaauggaagucggcucgugaggcaguagaagauggacguuuuugggaacuaguagaccgugaacggaauuuacaucuagaagggaaaugugagacaugcguuuauaauaugaugggaaaaagagaaaaaaagcuaggugaauuuggaaaagcaaaaggaagucgcgcaauaugguauaugugguuaggcgcaagauuucuggaauuugaagcgcuagguuuuuuaaaugaagaccauugguuuucaagaggaaacagucuuagcgguguugaaggcgaaggcuuacaccgcuuagguuauaucuugcgagacguaggcaaaaaagaagggggugcgauguaugcugaugauacugcugggugggacacaagaauuacgcuagaagaccugaaaaacgaagaaauggucacaaaucacaugaaaggagaacauaaaaagcuugcagaagcaauuuucaaacugacauaucaaaauaagguggucaggguccaacggccaacucccaggggcacuguuauggacauaauaucgcgcagagaccaacgagguucaggacaagucgggacuuauggguuaaauacguucacuaacauggaagcacaauuaauaaggcaaauggaaggcgagggcauauuuaaauccauucaacacuugacugcaacagaagaaaucgcagugcaaaacuggcuugcccgcguaggacgggaacgauuaagcagaauggccauaucaggugacgauugcgucguaaaaccuauagaugaucguuucgcuucagcucucacugcuuuaaacgauauggggaaggucagaaaagauauccaacagugggaaccaucucgagguuggaacgauuggacucaaguuccauucuguagucaucauuuucaugaauuaguuaugaaagauggucggguucuaguuguuccauguagaaaccaggacgaauuaaucgguagagcuagaauaucacagggagcagguuggagccuaaaggaaacagccugucuaggaaaaaguuaugcacaaauguggacacugauguauuuucacaggagagaucuaagauuagcugcaaaugcaaucugcagcgcaguuccaucacacuggguuccaacgucgcgaacaacauggucuauacaugcuaagcacgaauggaugaccacugaggauauguuagcaguguggaauagaguuuggauacaggaaaauccguggauggaagacaagacaccuguagaaaguugggaggaaguaccauaccuaggaaagagagaagaucaguggugcgguagccuaauuggauuaacaaguagagcaacaugggcaaaaaauauacaaacugcuauaaaucagguacguagucugaucggaaacgaagaguauacugacuauaugccaucaaugaaaagguuuagaagagaagaagaggaagcuggcguacuuugguga

SEQ ID NO: 22380 - RNA, 9876 nt, Artificial Sequence
  derived and/or modified CDS sequence (opt6) from DENV-2__EU569700__SS-prME
acagcagggguaauagugaugcuaauucccaccgccauggcauuucaucuaacgaccagaaauggagaaccccacaugauaguaggaagacaagaaaaaggcaaaucacugcuguucaaaaccgaagauggaguuaacaugugcacacuaauggcgauagaucuuggagaauuaugcgaagacaccaucacauacaaauguccguugcuacgccagaacgaaccagaagauaucgauugcugguguaauucaacuuccacguggguaacuuauggaacauguaccaccacaggggaacaucgacgcgagaaaagaucaguugcuuugguaccacacguagggaugggacuagaaacacguacagaaacguggaugucgucagaaggagccuggaaacacgugcaacgaaucgaaacauggauucuccgacauccgggguuuaccaucauggccgcgaucuuagcuuauaccauugggaccacucauuuucaacgagcauugaucuucauauuacuaacggccguagcuccaucgaugacuaugagguguauagggauauccaauagagauuucguggaaggcguaagugguggaucuuggguggauaucguacuagaacauggcucaugcguuacaacgauggccaaaaacaaacccacucucgacuucgaacuuauaaaaacugaagcgaaacaaccggcuacgcucagaaaauauugcauagaagcgaaauuaacaaauacgacaacagaaagcagauguccuacucaaggagaacccagucuuaacgaagaacaggacaaaagauuuauauguaaacauuccaugguugaucgaggauggggcaaugggugcgguuuauucgguaaaggggguauagugacaugugcaauguuuacauguaagaaaaacauggagggcaaaguuguccagccagaaaauuuagaauacacaauuguaaucacaccucauucuggagaagaacacgcagugggcaacgacaccgggaaacacggaaaagaaauaaaaauaacgccccaaucuaguaucacugaagcugaacuaacgggauacggaacaguaacaauggaaugcucaccgcggacaggacuagauuuuaacgaaaugguacuacuacagauggaagauaaagcauggcuagugcauagacaaugguuccuugauuuaccgcugcccugguuaccuggugcagacacacaagguagcaacuggauccaaaaagaaacacucguuacauucaaaaauccacacgcuaagaagcaagacgugguaguucuggggucacaggaaggcgcaaugcauacugcguuaacuggagcaacggagauucaaaugucuucuggaaauuuguuauucacuggucauuuaaaaugccggcuucggauggacaaauuacaguuaaaaggaaugucauauucuauguguaccgguaaauucaaaauaguaaaagagauagcagaaacgcaacaugggacuaucguuauucgaguacaguaugaaggugacggaaguccauguaagauaccuuuugagauuacggacuuagagaaacgacauguauuaggccgccuuaucacgguaaauccaaucguaacugaaaaggauaguccagugaauauagaagcggagccuccauuuggcgauaguuacauaaucauaggaguagaaccaggacaacucaaguuaaacugguuuaagaaagguagcaguauaggacaaauguuugaaacuacaaugaggggugcuaaacgaauggcaauacuuggugacacagcaugggacuucggcagccuagggggcguuuuuacaaguauuggcaaggcgcuucaucaaguauucggcgcuaucuauggagcugcauuuucuggaguuagcuggaccaugaaaauucuaauugguguuaucauaacauggauaggaaugaauagcagaagcacgucauuaagcguuuccuuaguucucguagggguuguuacuuuauaucuuggcgccgucgugcaagcagauagcggcuguguagucucauggaaaaauaaggaauugaagugugguucagggauauucauaacugacaacguacauacuuggacugaacaauacaaauuucaaccagaaucaccuucgaaauuagcuucagcgauccaaaaggcucaugaagaaggaauaugugggauaagaagcguaacacgguuagaaaaucuaauguggaaacagauaaccccugaauuaaaucauauacugucagaaaaugaaguaaaacuuaccauuaugacuggagauauaaaagguauuaugcaagcagguaaaagaucuuuaagaccccagcccacggagcucaaauacaguuggaaaacaugggguaaagcaaaaauguugucuacggaaagccacaaucaaaccuuuuuaaucgaugguccagaaacagcggagugccccaacacuaauagagccuggaauagucuugaaguugaggacuacggauucgguguuuuuacaacgaacauuugguuaaaacuaagagaaaaacaggauguauuuugcgacucaaaauugaugagcgccgcaauuaaagacaacagagcuguucaugcugauaugggauauuggauagagucagcacuuaacgauacuuggaaaauggagaaggcuaguuucauugaaguaaagagcugucacuggccgaaaucacauacacuuuggagcaauggaguguuagaaagugaaaugauaauuccuaaaaauuuugcaggaccaguaucacaacauaauuaucggccuggauaccauacucagacggcagggccuuggcaccuuggaaaacuugagauggauuuugacuuuugugaaggaacaaccgucguaguuacggaagacugcggaaauagaggcccgucauuaagaacuacaacagcaagcggcaaguuaaucacugaauggugcugcagaucuuguacacuuccacccuugagauacaggggugaagauggaugcugguauggaauggaaauacgaccauuaaaagaaaaagaagaaaaucuuguaaauagcuuaguaacagcaggacauggacaaauagacaacuucucauuaggaguucuaggaauggcacuguucuuagaagaaaugcuccggaccagaauaggaacaaaacaugcuaucuuacucguagccguaaguuucgugacucuaauaacaggaaacaugaguuucagagauuuaggucguguaaugguaaugguuggugccacaaugaccgacgauauagguaugggaguaacuuaccuagcacucuuagcagcuuucaagguuaggccaacauucgcagcgggacuacuauuaaggaaauuaacgucuaaagaauugaugauggcaacaauugguauagcccuauuaucacaaucgacaauuccagaaacaaucuuagaacuaacugacgcccucgccuuagguaugauggugcuuaaaauuguacggaauauggaaaaauaucagcuagcaguuacuauaauggcuauaaguuguguaccaaaugcagugauacuacaaaaugcguggaaaguuagcugcaccauauuggcagcuguuucugucagcccauuacuacucaccuccucgcaacaaaaggcagauuggauuccguuggcccuuaccauuaaaggacuuaauccgacugcaauauuucuaacgaccuugagccggacguccaaaaagagaagcuggccacuuaacgaagcaauaauggcugucggaaugguaaguauauuggcaaguagccuuuugaaaaaugacauccccaugaccggaccucuaguggcgggcggcuuacuaacagucuguuauguccucacagggcgaagcgccgauuuggaacuagaacgagcagcagacguuaaaugggaggaucaggcugaaauaucuggaaguaguccaauacuuagcaucacgauuagugaagauggaucuaugucaaucaaaaaugaggaagaggaacaaacguuaacuauuuuaauccgcacuggcuugcucgucauuucagguguuuuucccgucucaauaccuauaacggcggcggccugguaucuuugggaggucaagaaacagagggcagggguucugugggauguaccaucgccaccgccaguagaaaaagcagaauuggaagauggggcauauaggauaaagcaaaggggaauacuaggcuauucucaaauuggagccgguguguacaaagaaggaacuuuccauacaauguggcaugucacuagaggcgcagucuugaugcaucgcggaaagcgaauagaacccucuugggcggauguuaagaaagaccuuaucaguuauggaggggguuggaaacuagaaggagaauggaaggaaggagaagaaguucaaguucuugcacuagaaccaggcaaaaauccacgggcaguccaaacuaagccgggaauuuucaagacaaacaccggaaccauaggagcaguauccuuagauuucucaccagguacaucagguaguccaauuguagauagaaaagggaaaguaguagguuuauaugggaacggcgugguaacacggucgggugcuuauguaucagcaauagcacagacugaaaaaucuauagaggauaacccagaaauugaagacgacaucuuucguaagaaacgguugacuauuauggacuuacaucccggagcggguaaaacaaagagauauuugccugccauuguuagagaggccauuaagagaggauuacgaacccuaauuuuagcccccacuagagucguugccgcagaaauggaagaagcgcugcggggcuugccgauuagguaccaaacacccgcaauaaagaccgaacauacaggaagagaaauaguugauuuaaugugccacgcgacguuuacaaugcgccuacucuccccaguuagaguaccaaacuacaaucuaauaaucauggaugaggcacacuuuacagaucccgccucgauagcagcaagagguuacaucucaaccagaguggaaaugggugaagcagcagguauuuuuaugaccgcaacuccacccggcucccgagacccuuuuccacagagcaaugcgcccauuauggaugaggaacgugagauuccagagcgaucuuggaauaguggacacgaguggguaacagauuucaaggguaaaacuguuugguuuguaccaucaaucaaggcgggaaacgacauagccgcuugccuacguaaaaacggaaagaaagugauucaacucagcagaaaaaccuucgacagugaguacguaaagacacgcgcuaaugauugggacuucguaguuacaaccgauauuuccgaaaugggagcgaacuucaaagcggaacgcgucaucgacccacguagaugcaugaaacccguuaucuuaaccgauggcgaagaacgaguaauauuagcugguccaaugccugugacucauucgucagcugcucagaggcgagggcggauaggaagaaaccccaaaaacgaaaaugaucaauauauauauaugggugagccauuagaaaaugacgaggauugugcucacuggaaagaagcuaaaaugcuauuagacaauauuaacaccccagaaggcauuauaccaagcauguucgaaccagaaagagaaaaaguagaugcaauagacggggaauacagacuccgaggagaagccagaaagacauucguugaucuuaugcgcaggggagaucuuccaguaugguuggccuacaaagucgcggcugaagguauaaacuacgcggacaggaaguggugcuuugauggaaucaaaaauaaucagauccuugaggagaauauggaagucgaaauuuggaccaaagagggagaacgaaagaaacuuaaaccucgauggcuagacgcaagaauauauuccgauccccuagcguugaaagaguucaaagaauuugcagcgggcagaaaaagccuuaccuuaaaccucauuaccgaaauggggagauuaccgacauucaugacgcaaaaagcuagaaaugcccuagacaaucuagccguuuugcauacagcggaagccggugggagagcauauaaucacgcuuugagcgaauuaccugaaacacuagagacuuuauuauuguuaacguuacucgcuacuguuacaggcgguauauuucucuucuuaaugagcggcaagggaauagggaaaaugacucugggaauguguuguauaauuacagcgucaauucuacuaugguaugcccagauucagccacacuggauugcagcguccauaauacucgaguucuuccuaauaguuuugcugaucccagagccugagaaacaaaggacaccccaagacaaccaacuaacuuaugugguuaucgccaucuuaacaguaguugcugccaccauggccaacgaaaugggcuuucucgagaaaacgaagaaagaucuaggccuuggaucaaucacuacgcaagaaagugaaucuaauauauuagauauagacuuacguccugccucagcauggacacucuaugcaguggcgacaaccuuuguuacaccuaugcuucgccacucaauugaaaauucuucuguaaacguaagucuuaccgccauagcuaaucaggcaacaguguugaugggcuuagggaagggauggccccuaaguaaaauggauauagguguaccacugcuugccauuggguguuauucacagguuaacccaauaacacuaacagcugcguugcuacuuuugguugcucauuaugccauuauuggaccaggguuacaagcaaaagcuacaagggaagcgcaaaaacgcgcggcagcgggcauaaugaagaauccgacaguagauggaauuacaguaauugauuuagaaccgauaccguaugauccuaaguucgagaaacaacuggggcaaguaaugcuacuuauucuuugcguaacgcagguucuaaugaugagaacaacuugggcuuuaugcgaggcuuugacgcucgcgacgggaccaauuucuacauuaugggaaggaaauccaggaagauucuggaauaccacgauagcugucucaauggcaaauauuuuccgcggcucauacuuggcuggagcuggauuauuauuuagcauaaugaaaaauacgacaucaaccagaagagggacgggcaauauaggagaaacauuaggagaaaaauggaagaguagacuaaaugccuuaggaaaaagugaauuucaaauauacaagaaaucgggaauacaagagguugauagaacucuugccaaagagggcaucaaacgaggugagacugaucaucacgcuguaucacgagguagcgcaaaguuaaggugguuuguugaaagaaauaugguuaccccugaggggaaagugguugaucucggguguggaagaggaggguggucuuacuauuguggcggacucaaaaacgugagagaggugaaagguuugacgaaaggaggacccggucaugaagaaccaauuccaaugaguacauacggauggaauuugguacguuuacaaaguggugucgauguauucuuuacaccuccagaaaaaugugauacacuauugugugauauaggagaaucaagcccgaauccaacuauugaggcagggcguacauuacgagugcuaaaucuagucgaaaacugguuaaacaauaauacucaauucugcaucaaaguucuaaacccauacaugccaagcguuauagaaaagauggaagcacuacagcgacaauacggcggagcacuuguuaggaacccauuaaguagaaauaguacacaugagauguacugggucagcaaugccacagggaauauaguaucaucaguuaauaugaucucaaggaugcuaauuaacagauucacgaugaagcauaagaaagcaacuuacgagccagacguugacuuagguagugggacaagaaauauaggaauugagucagagaucccaaaccucgacauaauaggaaaacgaaucgagaaaauaaaacaagaacaugaaaucaguuggcauuacgaccaggaucaucccuacaaaaccugggccuaucacgguucuuacgagacaaagcaaacagguagcgcgagcucaauggucaauggcguuguucgguugcucacuaaaccuugggauguaguaccuauggucacucagauggcuaugacagauacgaccccuuuugggcaacaacgaguauucaaagagaaagucgauacgcgaacacaagaaccaaaagaggguacuaagaaacuaaugaaaauaacugcagaauggcucuggaaagaacucggcaaaaagaaaacacccagaauguguacuagagaggaguuuacuaagaaaguacguuccaaugcagcuuuaggagcuauuuuuacagaugagaauaaauggaaaagugcaagagaagcaguugaagacggacgcuucugggagcuagucgacagagagagaaauuuacaccuggaaggcaaaugugaaacgugcguguauaauaugaugggaaaaagggagaagaaacuaggagaguuugguaaagccaaaggcucaagagcuauuugguauaugugguuaggagcucgauuccuagaguuugaagcacuaggauuucuaaacgaagaucacugguuuagcaggggaaauaguuuaucaggcguagaaggugaaggccuucauagauugggcuacauuuuacgggauguugggaagaaagaaggaggagcuauguaugccgaugauacagcaggcugggacacgcgaauaacucuagaagaccuaaagaacgaagagauggucaccaaucacaugaaaggugaacauaaaaagcuagcagaagcuauauuuaaauuaacauaccaaaauaaagucguucgcguucaaagaccgacaccacgcggaacggucauggacauuauaucaagaagagaucagcgaggaagcggucaaguugggacuuacggucucaacacauuuacaaacauggaagcacaauuaauuaggcagauggaaggggaaggcauuuucaaaaguauucagcaucuuacagccaccgaagagauugcggugcagaauuggcuggcacggguaggaagggaacgacuuaguagaauggcaauaaguggugaugacuguguaguaaaaccuauugacgacagauuugcuucagcacuaacagcuuuaaaugauauggguaaaguccgaaaagauauccaacagugggaaccaucgcguggguggaacgacuggacacagguuccguuuuguagucaccauuuccacgagcuagugaugaaagauggacgugucuuaguaguacccugccggaaucaagaugaauugauuggaagggcccggaucucacaaggagcgggauggagucuaaaggagaccgcuuguuuagggaaaagcuacgcacaaauguggacuuugauguauuuucaccgcagagauuugagguuagcugcgaaugcgaucugcucagcaguaccgucacauuggguaccaacaucacgaacgacauggaguauucaugcgaaacacgaauggaugacuacugaggauaugcuagccguuuggaauagaguauggauacaagaaaauccauggauggaagauaagaccccuguugagucgugggaggaaguccccuacuugggaaaaagagaagaccaauggugcggcagucuuauuggauuaacuucgagagcuacaugggccaaaaauauccagaccgcaauuaaucaggugcguucuuuaauagguaacgaagaauauacagacuauaugcccucaaugaagcgauuuagacgugaggaagaggaagcuggcguauuaugguga

SEQ ID NO: 22381 - RNA, 9876 nt, Artificial Sequence
  derived and/or modified CDS sequence (opt6) from DENV-2__KF955369__SS-prME
acugcaggaguuaucguaauguuaauaccaacagcaauggccuuccauuuaacuacaaggaacggcgagccgcacaugauuguaggaagacaagagaaaggaaaaagucuguuauuuaaaacagaggacggcguaaauaugugcacucuuauggcaauagaccugggugaacuuugcgaggauacuaucacauauaaguguccacuauuaagacaaaacgaaccagaagauauagauuguugguguaauucaacaaguacguggguaacauacggcacaugcacaacuacaggggaacaccgucgagaaaaacgaagcgucgccuuggugccucacguugguauggggcuggaaacccguacggaaacguggaugucaagcgaaggggcguggaaacauguucaaaggauagagacauggauucuaagacacccggguuucacuauaauggcagcaauacuagcuuacaccauagggaccacucacuuucaaagagcacuaauauucauuuuauuaacaacaguagcuccaucuaugaccaugcgauguauugggauuagcaacagagauuucguugaaggagugucaggcgggucaugggucgauauuguacuggaacauggaucaugugugacaacuauggccaaaaauaagccaacauuagacuuugagcuaauuaaaacugaggcuaaacaaccagcuacgcuaagaaaauauuguauugaagcaaaacuaacuaacacaacaacggaaagucggugcccaacacaaggagagcccucccuaaaugaagagcaggauaaacgcuucaucugcaaacauucuaugguagaucgugguuggggaaauggaugugggcuuuuuggcaaagguggcauaguaaccugugcuauguucacaugcaagaaaaauauggaagguaaagucguucagccagaaaacuuagaguauacaauuguaauuaccccucacucaggugaagaacacgcugucggaaaugauacgggaaaacauggaaaagaaauaaaaauaacaccucaauccucgauuacagaggcugaauuaaccggauaugguacaguaacuauggaauguaguccacgcacagguuuagauuucaaugaaaugguauuauuacaaauggaagauaaagcguggcuuguacauaggcaaugguuucuagauuuaccacucccauggcuuccaggagcugacacgcaaggaucgaauuggauccagaaagaaacucuugucacguuuaaaaacccacaugcuaagaaacaggacguuguaguauugggaucccaagaaggggcuaugcauaccgcacuaacaggcgcgacagaaauccaaaugagcucagggaauuuauuauuuacaggacauuuaaagugccggcuaagaauggauaaacugcaacuuaaaggaaugucuuacagcaugugcacagggaaguucaaaauuguuaaggaaauugcagaaacacaacacgguacaaucguaauuagaguucaauaugaaggagauggaaguccauguaaaauccccuuugaaaucacugaucucgaaaagcggcauguacuuggccgauuaauuaccgugaaucccauagugacugaaaaagauucaccaguaaauaucgaggcagaaccaccauucggcgacagcuauaucauaauaggaguagaaccuggccaacuaaagcuuaauugguucaaaaagggcucuucuauuggccaaauguucgaaacuacaaugcggggugcuaaaaggauggcaauacucggggauacugcuugggacuuugggucauugggggguguguuuacaaguaucggaaaagcguuacaucaaguauucggggcaauuuauggggcugcguucucuggcguuucauggacaaugaaaauacugauuggaguuauuauuacuuggaucggaaugaauucgcguucaaccaguuugucuguuagucuaguauugguaggugucguaacuuuauauuuaggagcagucguacaagcugacucgggcuguguaguuucauggaaaaacaaagaauugaaauguggcaguggaauauuuauaaccgauaacguacacaccuggaccgaacaguauaaauuucaaccagagaguccaagcaaacucgcaucggcuauacaaaaagcucaugaagaagggauaugcgggauacgaaguguaacgagguuagaaaauuuaauguggaaacaaaucacgccagaauuaaaucauauauuaagcgaaaaugaaguaaagcuuaccauuaugacaggagauauuaagggcauuaugcaggcuggaaaaagaucccuaagaccgcaaccaacagaauugaaauauuccuggaagaccuggggcaaagccaaaauguuaucuacagaaucucauaaucaaacauuuuuaauagacgguccagaaacugccgaauguccaaauacgaacagagcguggaauucacuugagguagaagacuauggcuucgggguauucacaacaaacauauggcuuaaacucagagaaaagcaagacguguucugugauaguaaacuuaugucugcagccauuaaggacaaccgggcaguucaugcugauaugggcuauuggauugaaucagcacuaaacgauacauggaaaauggagaaagcgucguucauugaagucaaaagcugucacuggccaaagucacauacguuguggucaaacgguguacucgaauccgagaugaucauaccaaagaacuuugcggggccagucucacaacacaauuaucggcccggauaucacacccaaacggcgggcccguggcaucuuggaaaacucgaaauggauuuugacuuuugugaagguacuacagucguaguuacugaagauuguggaaaucguggaccaucguuaagaacgaccacugcgaguggcaaguuaauuacggaauggugcugucguagcugcacucuaccuccauuacguuacagaggagaagacgguugcugguaugguauggagauacgcccauugaaagaaaaggaagaaaaucuuguuaacagccucguaacagcaggucacggacaaauugauaauuucaguuuaggugugcuaggaauggcgcucuuucuagaggagaugcuucgaacucgaauagggacgaaacacgcaauauuacuaguagcuguaaguuuuguaacuuuaauuacaggaaauaugucguuucgcgacuuagggagaguaaugguaaugguaggagcgacuaugacugaugacauugggauggggguaacuuaccuagcauugcuagccgcuuucaaggugagacccacguucgcugccggauugcuuuuacgaaaauugaccucaaaagaacuuaugauggcuacaauuggcauagcgcuauuaucacaaucaaccaucccagaaacaauucuagaacuaacugaugcucuugcgcuugguaugaugguacuaaaaaucguaaggaacauggaaaaguaccaacuugcaguuacaauuauggcuauaucaugugugccaaaugcagucauucugcaaaaugcuuggaagguaucuugcacuauacucgcugcugugagugugucuccacuacuuuuaacaucaucacaacaaaaagcugauuggauuccacuagcguuaacaauuaaagguuuaaaccccaccgcgauauuuuuaacaacguuaucaagaaccucaaagaagcggucauggccccucaaugaagcaauaauggccguagggauggugaguauacucgcgagcagcuuguuaaagaacgauauaccgaugaccgguccucuggucgccggaggacuucucacugugugcuacguuuuaacagggagauccgcagaccuggaacucgaaagggcagcagauguuaagugggaggaucaagccgaaauaucugguucauccccaauccuaucuauaacaauauccgaagacgggagcaugagcauaaagaacgaagaagaagaacaaacgcuuacuauacuaauaagaacagggcuauuagugauuucugguguauucccgguuaguauuccuauaaccgccgcagcgugguacuugugggaaguaaaaaaacaacgugcaggggugcuaugggacguaccauccccgccaccaguagaaaaagcagaauuagaagauggcgcauauagaauaaagcaacggggaauuuuaggcuacucacaaauaggagcagguguauacaaagaagguaccuuucacacaauguggcacgugacaagaggagcaguucuaaugcacagggguaaacguauagaaccuucuugggcggacgucaaaaaagauuugaucucuuacggaggugguuggaaacuagaaggcgaauggaaagaaggggaagaaguccaggucuuagcucuggagcccggcaaaaauccaagggcaguacaaacaaaaccaggcauauuuaaaacuaauacagguaccauaggcgcaguaagccuagauuuuuccccaggaacuaguggaucuccuaucguggauaggaaggguaagguuguaggacuuuacggcaaugguguagucacgagaaguggcgcguacgugucagcuauugcgcaaacugaaaaaucaaucgaagauaauccagaaauugaagaugacaucuuuagaaaaaaacgauuaacuauaauggaucugcacccgggugcaggaaagaccaaacgauauuugccggcuauaguacgugaggcuauaaaaaggggcuugagaacauugauacuugcaccaacccgugucgucgcagcggagauggaagaagcacuacguggccuaccuauccgauaucagacacccgcaauaaagacugaacauacuggcagagaaaucguagaucuaaugugucaugcuacauuuacgaugagacucuugucgccgguacgaguuccaaauuacaaccugauuauaauggaugaggcccauuuuacagacccagccucuauagcagcacggggguacauuucaacaagaguugagaugggagaggcggcugggauauuuaugacagcaaccccaccuggauccagggauccuuuuccacaaagcaaugcuccaauaauggaugaagaaagggagaucccugaaagguccuggaauagcggacaugaaugggugacagauuuuaaagguaaaacagucugguucguuccuaguauaaaagcaggcaaugacauagcugcaugccuacgaaaaaaugguaaaaaagugauccagcuuagccgaaaaacguucgacagcgaauacguuaagacaagagcaaacgauugggacuucguaguuacaacagauauuagugaaaugggugcuaacuuuaaagcagaaagagucauagacccccguagguguaugaaaccuguaauacuuacagauggugaagaacgcgucauacuagcuggcccgaugccuguuacacauucuucugcagcacagcguagagguaggauuggucgaaaucccaagaacgaaaaugaccaguacaucuacaugggugaacccuuagaaaaugaugaagacugcgcccauuggaaagaggccaagauguuguuagauaacauaaacaccccagaagguauaauaccgucuauguuugagccagaacgugaaaaaguagaugccauugauggugaauaucguuuaaggggagaggcccgaaaaacuuucguagaccuaaugaggagaggugaucuaccgguaugguuagcguacaaagucgcagcagaagggaucaauuaugcggacaggaaauggugcuucgacgguauuaaaaacaaccaaauuuuagaagaaaacauggagguggaaauauggacaaaagaaggugaaagaaaaaaacucaaaccccgaugguuagacgcaagaaucuacuccgaucccuuagcuuuaaaagaauuuaaagaauuugcugccggaagaaaaagccuaaccuuaaaucugauaacagaaaugggccgauuaccgacauucaugacccaaaaagcuagaaacgccuuagauaaccucgcagugcuccauacagcagaagcggguggccgagcauacaaucacgcgcuuuccgaauuacccgagacauuagaaacucuuuuacuacuaacauuacuagcaacuguaacuggaggaauauuuuuauuccugaugucuggaaaagguauuggcaaaaugacccuaggcaugugcugcauaauaacggcaucaauucuguugugguaugcucagauacaaccacacuggaucgccgcgucgauaauacuugaauucuucuuaauaguuuuacugauaccagaacccgaaaaacagcgcacuccacaagauaaucaacuaaccuacguugugauagcuauacuaacgguaguggccgcgaccauggcgaaugaaaugggauucuuggaaaagacaaaaaaggaccuugggcuugggucuauaacgacccaggaaucagaaucaaacauacuagacauugaucuccgcccagcauccgcguggacucuauaugcaguagcuacaacauucguuaccccaauguuaaggcauucgauagagaauucgagugugaacgugaguuuaacggcuauagcuaaucaggcaacaguacuaaugggacuaggaaaagguuggccacuaaguaagauggacauuggagugccucuauuagcaauaggcugcuauagccaaguaaauccaauaacgcucacugcagcauuacuguuauuggucgcacauuaugcaauaaucggaccuggauugcaggcaaaggcgacucgcgaagcacaaaaacgugccgcagcaggaauaaugaagaauccaacgguagacggaaucaccgucauagauuuagaaccgauuccauaugaucccaaguucgaaaagcaacugggacagguuaugcuuuuaauacucugcguuacacagguacuaaugaugcggacuaccugggcuuuaugugaagcauuaacuuuagcuacaggccccauaucaacuuugugggaagggaacccagggagguucuggaauaccacaauagcagugucgauggccaauauuuuuagaggaucuuauuuagccggcgcuggauuacuguuuagcauaaugaaaaacacaacuucgacacgcagaggcacaggaaauauuggagagacauuaggagaaaaauggaagucccguuuaaaugcacucggcaagagugaauuucaaauauauaaaaaaaguggaauucaagaaguugauagaacauuggcaaaagaagguauuaaacguggggagacugaccaccaugcuguuucgcguggaagugcuaaacuuagaugguucguagaacggaacaugguuacuccagaaggaaaaguaguagaccuaggaugugguagaggagguuggucuuauuauuguggaggccucaaaaaugugcgugaaguuaaaggacuaacgaagggggggccugggcacgaggagcccauaccgaugucaacauacggcuggaaucuaguuaggcuccaauccgguguagacguauuuuuuaccccgccagaaaagugugauacccuucucugcgacauuggcgaaucuucaccaaacccaacaauugaagcugggcgaacauuacgaguauuaaaccuuguagaaaacuggcuaaacaacaacacccaguucugcauaaaaguacuuaaucccuacaugccauccguaauugaaaaaauggaagcauuacaacgccaguaugguggagcccuaguacgcaauccccuuagcaggaauucaacucacgagauguacuggguaucaaacgcuacagguaauauaguaucaagugucaacaugauaagccgcaugcuaauaaaucgguuuacaaugaaacauaagaaagcuaccuaugaaccugacguugacuuagguucagggacgcggaacauugguaucgaaagcgaaauaccuaaucuagauaucauugggaaacgaauagaaaaaauaaagcaagagcaugagauuucuuggcacuacgaucaggaccauccuuauaagacaugggccuaucauggaaguuaugaaacuaaacaaacagggagugcuagcagcaugguaaauggcgugguccgacuucucacaaaaccuugggaugucgucccgaugguuacccaaauggcgaugacagauacaacuccuuuuggacaacaacgaguauucaaggaaaaaguagacacacgaacacaagaaccuaaggaaggaaccaaaaaauuaaugaaaauaacugcagagugguuauggaaggaauuggguaaaaaaaaaacgccgcgaauguguacuagggaggaguuuaccaaaaaagucagaagcaacgcagccuuaggugcaauauucacugaugaaaacaaguggaaaucugcaagagaagcuguugaagauggucguuuuugggaacuaguugaucgagaacggaaucuacaucucgaaggcaaaugcgagacaugugucuacaauaugaugggaaaaagggaaaagaaauuaggagaauucggaaaagcuaaagguucuagagccauaugguauauguggcuuggcgcccgauuucucgaauucgaagcauuaggcuuccuaaaugaagaucauugguucagucgaggaaacucauugagcggcguagagggugaaggauuacaucgucuuggcuauauacuaagagacguagguaaaaaggaaggaggcgcaauguaugcagaugauaccgcaggcugggauacuaggauaaccuuagaagauuugaaaaaugaagaaaugguaaccaaccauaugaaaggcgaacauaaaaaauuggcagaagccauauuuaaguugacauaccaaaacaaaguaguucgcguccagagacccacaccuagagguaccguaauggacauaauuucacgaagagaucaacgcgguucgggccaggucggaacauacggucuaaauacuuucaccaauauggaagcacaacuaauaagacaaauggaaggagagggcauuuuuaaaucuauacagcaccuuacugcaacagaagagaucgcaguacaaaauuggcuggcccgagucgguagggaaagacuuucacgcauggcgauauccggggaugauugcgucguaaaaccaauugaugauagauuugcuucggcuuuaacagcacuaaacgauaugggaaaaguacgaaaagauauccagcaaugggagccaucacgaggauggaacgauuggacgcaagugcccuucuguucacaucacuuccaugaacuuguaaugaaagacggccgugugcuagucguuccgugucguaaccaagaugaauuaauagggagagcgcgcaucucacaaggcgcagguuggucgcugaaagaaacagcgugccuagguaaaucauaugcucaaauguggacacugauguauuuccaucgaagagaucuucgguuagcugcaaacgccauauguucagcaguuccuagccacuggguacccaccucuagaacaacauggaguauucaugcgaaacaugaauggaugacuacagaagacauguuagcaguuuggaaucgaguauggauacaggaaaauccauggauggaagacaaaacaccuguugaaucuugggaagaaguaccauaucucgguaaaagggaggaucaaugguguggcucgcuuauuggcuuaacaucuagagcuacuugggcaaaaaauauucaaacagcuauaaaucaaguucguaguuugauaggaaacgaagaauauacggauuauaugccuucgaugaaaagauuuagaagggaagaagaagaagcgggcguccuaugguag

SEQ ID NO: 22382 - RNA, 9876 nt, Artificial Sequence
  derived and/or modified CDS sequence (opt6) from DENV-2__EU569702__SS-prME
accgcaggcguaauaguuaugcuaauaccaacggcuauggcauuucauuugacaacacgaaacggugaaccgcacaugauaguaggacgacaagaaaaaggcaagagcuuguuauucaaaacggaagauggcgucaauauguguacccuuauggcaaucgaccuaggagaacuaugugaagauacuaucacuuauaaaugcccauuacugaggcaaaaugaaccggaagacauagauuguugguguaauucuacaaguacauggguuacuuauggaacguguacaaccaccggggaacaccgacgggaaaaacgcagcgucgcuuuagugccacacguagggaugggauuggaaacucguacagaaacguggaugucaucagaaggagcauggaaacauguacaacgaaucgaaacuuggauuuuacgucaccccggguuuacuauuauggcggcaauacuugcauacacaauagguacaacacauuuccagcgagcgcuuauauucauauugcuuacggcaguggcgccgucuaugacgaugagguguauugguauuucaaaccgggacuuugucgaaggggucuccggagguagcugggucgacauaguauuggaacacggaucaugcgugacuacaauggccaaaaacaaaccaacgcuagauuuugagcuuauaaaaacagaggccaaacaaccagcaacuuuaagaaaauauuguauagaggcaaaacuaacgaacaccaccacggaaucccgcuguccaacacaaggagaaccuucgcuaaaugaggaacaggauaaaagguuuauuuguaaacacucgaugguggacagaggaugggggaacggcugcggucuuuuuggcaaaggaggaauagugaccugugcaauguucacguguaagaaaaauauggaaggaaaaguagugcagccagaaaacuuggaauauacaauagugauuacgccucauucaggggaagaacacgccguaggcaaugacacuggaaaacauggaaaagaaauuaaaauaacaccucaaucguccauuacugaagcugaauuaacagguuauggaaccguaacaauggaauguucuccccgcacgggauuggacuuuaaugaaaugguacuacugcaaauggaagacaaagcaugguuaguacaccgucagugguuccucgauuuacccuuaccuugguuaccgggagcugacacacaggguagcaacuggauacaaaaagagacacuggugacguuuaaaaacccacaugccaagaaacaagacgucguuguacuaggaucccaggaaggcgcaaugcacacagcauuaacuggggcgacugaaauucagaugaguagugggaacuuacucuuuacaggccaucuaaaaugcagauuacgaauggauaaacugcaacuaaaagguaugucauauagcauguguacuggaaaauuuaaaauaguuaaagaaauugcugaaacgcaacaugguaccauagugaucagagugcaauaugaaggugauggaaguccaugcaaaauaccauucgaaauaacagaccuugagaaaagacauguucuaggaagauuaaucacgguuaauccaauaguaacagaaaaagacagcccagucaacaucgaagcugagccaccguuuggugauucguauauaauaauagguguugaaccagggcaauuaaaacugaauugguucaagaaaggaucgagcauuggacagauguucgagacaacuaugcgcggagcgaaaagaauggcgauacuuggggacaccgcgugggauuucggaucacugggagguguauuuacaagcauaggaaaagcacuucaccaaguguucggagccauuuauggugcggccuuuagugguguaucauggacaaugaaaauacuaaucgguguaauaauaaccuggauagguaugaacucgagaaguacaagucugucaguuucacuugucuugguuggcguuguaacuuuauaucuaggagccguaguucaggcagauaguggcuguguuguguccuggaaaaauaaagaacucaagugcggaucagguaucuucauaacagacaauguucacacguggacagagcaauacaaauuccaaccagaaucuccuucaaaguuggccagcgcuauacagaaggcccaugaagaaggcaucugcggaauccguaguguaacgagacuggaaaauuuaauguggaaacagauaacaccggaauugaaucauauacuaucagaaaaugaaguaaaauuaacgauaaugacgggcgauaucaaagggaucaugcaagcuggaaaacguucgcugcgaccucaaccuacugaacuuaaauacaguuggaagacauggggaaaggccaaaaugcuuucaaccgaaagucacaaucagacauuccuuaucgaugguccugaaacagcagaaugccccaauacgaauagggccuggaacucauuagaaguugaggacuacggauuuggaguuuuuacaaccaauauuuggcuuaaacuaagagaaaaacaagauguuuucugugauaguaaacugaugucugcggcuauaaaagacaaccgagcaguucacgcagauaugggcuauuggauagaaagugcacuaaaugauacuuggaaaauggaacgagcuagcuuuauagagguaaaaucaugucacuggccaaaaagucacacucuauggucaaacggaguguuggagucagaaaugauaauucccaagaauuucgcaggaccaguaucccagcacaacuaucgaccaggauaccacacacagacagcaggaccguggcacuugggcaaacuagagauggacuuugacuucugugagggaaccacaguuguaguuaccgaagauuguggaaauagggguccaucauuacgaacaacaacagccucaggaaaacuuauuacagaaugguguugcagaaguuguacacuaccuccccuuagauauaggggagaagauggcuguugguacgguauggaaauaaggccuuuaaaggaaaaagaagaaaacuuaguaaauucgcuaguuacggcaggacauggacagaucgacaauuuuagcuuaggaguacucggaauggcucuauuuuuagaagaaauguuacgaacacgaauugggaccaaacaugcaauccuauuaguagcaguuaguuuuguuacacuuauuacaggaaauaugucauuuagagaccuagggaggguuauggugauggucggagcaacaaugacagaugacauuggcauggguguuacguaucuagcauuacucgcagcauucaaaguacgcccaaccuuugcagcagguuuguuacugcggaaacugacgagcaaagaacuaaugauggcaacaauaggaauagcgcuauuaucacaaagcacgauacccgaaacuauucuagaauuaacagacgcuuuagcguuggguaugaugguccuuaaaauugugcgaaacauggaaaaguaucaacuagcgguuacaaucauggcuauuagcugugugccgaacgcggugauacugcaaaaugcuuggaaaguuucgugcacaauacuggcugcgguaucggugagcccgcuauuguuaacgucuucacaacaaaaagccgauuggauaccauuagccuuaacuauaaagggacugaacccuacagcuaucuuuuuaacaacgcuaaguagaacgucaaagaaaagaagcuggccauuaaacgaagcuauaauggcugucgggauggucagcauucuagcauccucauuacucaaaaaugauauaccuaugacagguccacucgucgcgggaggacuucuaacaguaugcuauguuuuaacggguagaucagcggauuuagaacuagaacgagccgcggacguaaaaugggaagaucaagcagagauaaguggauccucaccuauacuaucaauuaccauuagugaggaugggucaaugaguaucaagaacgaagaagaggagcaaacgcuuacuaucuuaauaagaacugggcuacuuguaaucagugggguauucccggucucaauaccuauaacggccgcagcuugguaucucugggaagugaagaaacaaagggcuggugucuuaugggacguuccgaguccaccuccuguagaaaaggcagaguuagaagauggcgccuacagaauaaagcaaagaggaauacuaggguauucgcaaauuggggcugguguauacaaagagggcacauuucauacaauguggcauguuacaagaggagcaguccuuaugcacaggggaaaacgcauugagcccucaugggcagauguuaagaaagauuugauuaguuauggugguggauggaaauuagaaggagaguggaaagagggcgaagagguacaaguauuagcauuagaaccagggaaaaauccaagagcggugcaaacaaagccagguaucuuuaaaacaaacacaggaacuaucggagcuguaaguuuggauuucaguccaggaacaucgggaagcccuauuguugacagaaaagguaaaguuguaggguuauacgguaauggaguuguaacaagauccggagcguacgucucagcgauagcucagacggaaaaaucgauugaagauaaccccgagauagaagaugauauuuuccggaagaaacggcuaacaauaauggacuuacacccuggagcuggcaaaacaaaaagguacuuaccugcgaucguaagagaagcaauaaaacggggacuccggacccucauacuagcucccacuaggguuguagccgcagaaauggaggaggcauugcgaggacuuccaaucagauaucaaacaccagcgauaaaaacugaacacacaggucgagaaaucgucgaccuaaugugucaugccacuuucacaaugagacuauugucaccgguucgaguacccaacuacaauuuaauaaucauggacgaggcgcacuucacagaucccgcuagcauagccgcacgagguuauauaucaacucgagucgagaugggugaagcagcuggaauauuuaugacugcgacaccaccuggaagcagagauccauuuccacaaaguaacgcacccauaauggacgaggaaagagaaauuccugaaagaaguuggaacuccggucaugaauggguaaccgacuucaaaggaaagacagucugguuuguuccuucaaucaaagcugggaaugacauugccgcaugccuaaggaaaaauggcaagaaagucauacaacuuuccagaaagaccuuugacagugaguacguaaaaacaagggcgaacgacugggauuuugugguaaccacagacauauccgagaugggagcuaauuuuaaagcagaacguguaauagauccaagacgcugcaugaaaccaguuauucugacggacuccgaagaaagagugauucuugcuggcccaaugccuguaacccauucaucagccgcgcaaagacgagggagaauaggaagaaacccaaagaacgaaaacgaccaguauauauauaugggagaaccuuuggagaacgacgaggacugugcgcauuggaaagaagcuaagaugcuacucgauaauauaaauacaccugaagggauaaucccgucaauguuugagccugaacgagagaaaguagaugcgauugacggcgaauauagacuaaggggagaggcuaggaaaaccuucgucgacuuaaugaggaggggagaccuaccagucugguuggcauacaagguagcugcggaaggcaucaacuacgcugaccguaaaugguguuuugacggaauuaagaauaaccagauacuagaggaaaauauggaaguagaaauuuggacaaaagaaggcgagagaaagaaacuaaaaccacgaugguuagacgcaagaauauacucggauccuuuagcacuaaaggaauuuaaggaauuugcugcaggacgaaaaucgcuaacacuaaaucucaucacagaaaugggaagguuaccaacauucaugacacagaaagcgaggaaugcccucgauaacuuagcaguucuacauacagcggaagccggaggucgcgcuuacaaccaugcccugucggaauugcccgagaccuuagaaacucuguuacuacucaccuuacuagcgacaguuaccgggggaaucuuucuauucuuaaugucaggaaaggguaucgggaaaaugacauuagguauguguugcauuaucacugcauccauacuuuuaugguaugcacaaauacaaccccacuggaucgcagcuagcauuauacucgaauuuuuccugaucguacuccuaauaccagaaccagaaaagcaaagaacaccacaagauaaccagcuuacauauguugugauugcaauuuuaacgguuguggccgcaacuauggcaaaugaaaugggcuuucuugagaaaaccaagaaagaccugggacuuggaagcauaacaacccaagaaagugaaucaaauauccucgauauagauuuacgaccugcaucggccuggaccuuauaugcgguugcuacaacuuucguuaccccuaugcucagacacaguaucgagaacagcagcgugaaugugucccuuacagcgauagccaaucaggcaacaguacugauggguuugggcaaagguuggccguuaagcaaaauggacauugguguaccuuugcuagcaauugguuguuacagccaaguuaauccuauaacuuugacagcagcgcuuuugcuauuaguagcacauuacgcuauuauugggccaggcuuacaagcaaaagcgacaagggaggcacagaaaagagccgcugcagguauaaugaagaaucccacuguugaugggauuacgguaauugacuuagaaccuauuccauacgauccaaaauucgaaaaacaacuggggcaaguuauguuauuaauacuauguguaacccaaguauuaaugaugagaacuacgugggcgcucugugaagcguugacuuuagcaacggggccaauuucaacauugugggaaggaaacccugguagauucuggaauacuacuauagcagucucuauggcuaacauuuuucgagguucauaccuagccggugcuggauuauuguuuucaaucaugaaaaauacgaccagcacaaggagaggcacaggaaauauaggagagacacuaggagaaaaguggaaaucaagguuaaaugcauuagggaaaucagaguuccaaauuuauaagaaauccggaauacaagaaguugaccgcacccuagcaaaagagggaaucaagagaggagaaacggaccaucacgcaguaucacgaggaagcgcaaaacuacguugguucguggaaaggaacauggucacaccggaagguaaaguuguggacuuaggguguggaagagggggauggucauacuauugugggggacucaaaaaugugagggaggucaaaggguuaacaaaaggaggaccaggucacgaagaaccuauaccaaugucaacauauggcuggaaucuaguccgcuuacagaguggagucgaugucuucuuuaccccaccagaaaaaugugauacacuuuuaugcgauaucggggaaucaagcccaaacccaacaauagaggcaggccggacacuaagaguauugaaucuaguagaaaauugguuaaacaauaauacacaguucugcauaaaaguauuaaauccguacaugcccaguguaauagagaaaauggaagcauuacagagacaauacggaggugcauuaguuagaaacccauuaagccgaaauucuacacaugaaauguauugggucucuaacgcaaccggcaauauuguaucuagugucaacaugauaagcagaaugcugauaaaucguuucacuaugaaacauaagaaagcaaccuaugaacccgacguugaccucgguucgggaacaaggaauauaggcauagaaucagagauaccgaaucuugauauuauaggaaagagaaucgagaaaauuaaacaagaacaugaaauaucauggcauuacgaccaggaucauccauacaaaacaugggcguaccacgguagcuaugaaacaaagcaaacuggcucugcuaguucaauggucaacggaguugucagauuauugacaaaacccugggaugugguaccaauggugacacaaauggcaaugacggauacaacaccguuuggacagcaacguguuuucaaagaaaagguugauacuaggacacaagaaccgaaagagggaacuaagaaauuaaugaagaucacugcugaauggcuguggaaagagcuaggaaagaagaagacuccccgaaugugcaccagagaagaauuuacuaagaaaguucgaucgaaugcggcacuaggcgcaaucuucacggaugagaauaaauggaaguccgcccgugaagcgguugaagacgggagguucugggaauugguagaccgagaacgaaauuuacaccuugaagggaagugcgaaacuugcguauauaauaugaugggaaagagagagaagaaacucggcgaguucgggaaggccaaagguagcagggcuauaugguacaugugguuaggagcaagguuccucgaguucgaagcucuuggauucuuaaacgaggaucacugguuuagucgcggcaauagccugagcggaguagaaggagaaggucuccauagacuaggauauauacuacgggauguuggcaagaaagagggaggcgcaauguaugcugaugauacugcgggaugggauacccgaauuacucuagaagacuuaaagaacgaagaaauggucacaaaucacaugaaaggagagcauaagaaacucgcugaagcuauuuucaaacugacauaucaaaacaaaguuguaagagugcaaaggccaacaccaagaggcacuguaauggacaucauuucaagaagagaccagcgcggaucuggacagguagggacauacggacuuaauacauuuacaaauauggaggcacaguuaauaagacaaauggaaggagaagguauuuucaagaguauccaacauuuaaccgccacugaagaaauugcaguacaaaacuggcuagcacggguuggucgcgaaagacucucaagaauggcgauaucaggugacgacugcguagucaaacccauagaugacagauuugcgucagcauuaacggcgcugaaugauaugggaaaaguaagaaaagauauucagcaaugggaaccuagucggggcuggaacgauuggacacaaguaccauuuugcagccaccauuuucacgagcuagucaugaaagauggucggguucuuguagugccaugucguaaucaagaugaauuaauaggaagggcacgcaucucacaaggugcuggauggucguuaaaggaaacagcuuguuuaggaaaaucuuacgcgcaaauguggacacucauguacuuccauagacgagacuuacguuuggcagcaaaugcgauaugcucagcaguacccucccauuggguacccacgucgagaacaaccuggaguauacaugcaaaacaugaauggaugacaacugaggacauguuagcaguuuggaaucgaguguggauacaggaaaacccauggauggaggauaaaacaccaguugaaaguugggaagaaguaccauaccugggaaaaagagaagaucaauggugcggaagccuuauaggucuaaccuccagagcaacgugggccaaaaauauacagacagcaauaaaccaagugagaucacuaauugggaacgaagaauauacugauuacaugccaucaaugaaaagauuuaggagagaagaagaagaagccggcguccugugguag

SEQ ID NO: 22383 - RNA, 9876 nt, Artificial Sequence
  derived and/or modified CDS sequence (opt6) from DENV-2__EU482624__SS-prME
acagcggguguaauaguaaugcugauaccaacagcuauggcuuuucaucuaaccacacgaaauggcgagccccauaugauaguaggccggcaggagaaagggaaaucauuacucuuuaaaaccgaagauggaguaaauaugugcacucuaauggcgaucgauuuaggagaauuaugugaggacacgauaacuuauaaaugucccuuauugagacaaaaugagcccgaagacaucgacuguuggugcaauucgacaagcacauggguaacguauggaaccugcacgacaacuggagaacaucggcgcgaaaaacgaucaguugcgcucguaccccacguaggcaugggacuugagacgagaacagaaacuuggaugucuagugaaggcgcauggaaacaugugcaacggaucgagacauggauauugagacaccccggguucacuauuauggcagcaauucuugcaaauacaauaggaaccacucauuuccagagagcucuaauuuucauacugcucacagcuguagcaccguccaugacuaugcgauguauaggcauaucuaauagagauuucguagaaggugugagcggcggaaguuggguagauauagucuuagaacacggaucauguguaacaacuauggcuaaaaauaaaccgacacuugauuucgaauuaauuaaaacagaagcuaaacaaccugcgacacucagaaaauacugcauugaagcaaaauuaaccaacacaacaacggagucgcgguguccuacacaaggagaaccaaguuuaaaugaagaacaggauaaacguuuuauauguaaacauagcauggucgacagaggauggggcaacggcuguggauuauucgguaaaggugggauaguaacaugcgcaauguucacaugcaagaaaaauauggaaggaaaaguggugcaaccugaaaaucuagaauauacaauaguaauuacuccacauuccggcgaagaacacgcuguugguaaugacacagguaaacauggcaaagaaaucaaaauuaccccacagaguuccauuacagaagcugaacucaccggauacggaacaguuacuauggaauguucucccagaaccggacuugacuucaaugaaaugguucuccugcaaauggaagacaaagcaugguuagugcaccgacaaugguuuuuggaccuucccuugccauggcuaccaggugccgauauacagggaaguaacuggauacaaaaagagacuuuaguaacguuuaaaaauccgcaugcuaaaaagcaggauguagugguauuagggagccaagagggcgcaaugcacacagcacuaaccggcgccacagaaauucagaugagcaguggaaaucuucuuuuuacaggucaucugaaauguagacuaagaauggauaaguugcaacuaaagggcaugucguauucaauguguacgggaaaguuuaaaauaguuaaagaaauagcggaaacacagcauggcacgauuguaauuagaguccaguacgaaggagacgguucccccuguaagauaccauuugagaucacagaucuagagaaacgacauguacuaggucgacuuauuacggucaacccuauaguaacggagaaagauaguccgguaaauauugaagcugaaccgccauuuggcgauagcuacaucaucauaggagucgaaccaggacaauuaaaacuaaacugguuuaagaaaggaucaucaauaggacaaauguucgaaacaacuaugcgcggagcuaaaagaauggcaauacuuggagauaccgcaugggauuucgguagccucggaggaguauucacaucuauugggaaagcucuacaccaaguuuuuggugcuauauacggcgcagcauucagcggugucagcuggaccaugaaaauauuaaucggagucauuauuacuuggaucgguaugaacucgagaucuaccagcuuaucagucucgcugguauuaguaggaguuguuaccuuguaccucggagcaguuguacaagcagauucuggcugcgugguaucuuggaaaaauaaagaauuaaaaugcggaagugguauauuuauuacugacaauguucauacguggacggaacaauauaaguuucaaccagaaaguccuaguaaguuggcgucagcaauacagaaggcgcacgaagaaggaaucuguggaauuagaaguguaacaagacuagaaaaucuuauguggaagcagauaacuccugaguuaaaucauauccucucugaaaacgaaguaaaauugaccaucaugacaggagauaucaaagguaucaugcaagcgggaaaaaggucauuacgaccgcaaccaacggaauuaaaauauagcuggaaaacauggggaaaagcuaagauguugaguacagaaagucacaaucaaacauuccugauagaugggccagaaacggccgaaugcccaaauaccaacagagcauggaacucccuagagguugaagacuacggcuucggagucuucaccacaaacauaugguuaaaacuuagagaaaaacaagacguauucugugacucgaaacugauguccgccgccaucaaagacaacagggcugugcacgccgauaugggguauuggauugaaagcgcucugaaugauacauggaagauggaaaaagccucuuuuauugaaguuaagaguugccauuggccgaaaucacauacacugugguccaaugguguauuagaaagugagaugauuauuccaaagaacuuugccggccccguaagccagcauaacuacagaccugguuaucacacacaaacagcagguccuuggcaucuagguaaauuagagauggauuuugauuuuugugagggaacgacaguugugguaaccgaagacuguggaaauagaggaccaagucuucguaccacaacagcaucagguaagcuaauuacugagugguguugucgcaguuguaccuugccaccccuuagauaccguggagaagacgggugcugguacggaauggagauaagaccacuuaaagaaaaggaagaaaauuuaguaaauucucuugugaccgcuggucauggacagaucgauaauuucucauuggguguacuaggaauggcucuguuucuagaggaaauguuaagaaccaggauagguacgaaacaugcuaucuugcuaguugcugucagcuuuguuacacuuauuacugguaacaugucguuuagagacuuggguagaguaaugguuaugguuggagcaaccaugacagacgauauaggaaugggagugaccuaucuagcccuacuagccgccuuuaaaguaagaccaacguuugcagcagguuuguuacugcgcaaacuaacaagcaaagagcugaugauggcuacaauugguaucgccuuacucagucagucuacgauaccugaaacgaucuuagaacuaacagaugcuuuagcacucggaaugaugguuuuaaagauaguaagaaauauggaaaaauaucaacuagcagucacaaucauggcaauaucaugcgucccuaacgcgguaauacuacagaaugccuggaaaguaaguugcacaaucuuagcagccguuagcgucucgccguugcuucuaacgaguucacaacaaaaggcugauuggauuccacuggcacuaacaauaaagggccucaacccuacggccauauuuuugacaacacucagccggacuucaaagaaacguagcuggccuuuaaacgaggccauaauggccguugggauggucaguauacuggcauccucucuacucaaaaacgauauccccaugacaggccccuuaguggcagggggauugcucacaguguguuauguacucacagguaggagcgcagaccuagaauuagagagggcggcugacgucaaaugggaagaucaagcugaaauaucaggaucuucuccaauauuaucaauuacgauaucggaagacgguuccaugaguauuaaaaaugaagaggaagaacaaacacugaccauuuuaauaagaacgggucuauuaguaaucuccgggguuuucccggugucaauaccuaucacagcggccgcaugguaccuaugggaaguaaagaaacagagagccgguguauugugggauguuccuaguccaccgccaguagaaaaagcagagcucgaagauggagcguauaggaucaaacagagaggaauuuuaggauauucucaaauaggcgcugguguauacaaagaaggcacuuuucacaccauguggcauguuacccguggagcuguucuaaugcauagagguaaacgaaucgaaccuucaugggcagaugucaagaaagaucuaauuucguaugguggcggauggaaauuagaaggggaauggaaagagggugaagaaguacaaguauuagcucuagaaccagggaaaaauccgcgagccguacagacaaaacccgggauauuuaaaacaaacaccgguacuauuggagcgguuucucuagauuuuuccccugguacgucaggaucaccaauaguggacaggaaaggaaaaguaguuggacuauacggaaaugggguuguaaccaggucaggcgccuacguuucggccaucgcccaaacugagaaaucuauagaagauaauccagaaauugaagaugauauuuucaggaagaaaagacugacaauaauggauuugcacccaggcgcaggcaagacgaaaagguacuuaccagcgauaguucgagaagccauaaaacgaggacuuagaacgcuaauacuagcaccgacaagagugguugcggcagagauggaagaggcauuaagaggacuuccaauacgauaucaaacuccggcaauuaaaacugaacacacuggaagagaaauuguagacuugaugugucaugccacauuuaccaugcgccuauuaaguccaguaaggguuccaaauuacaaucuuauaauaauggaugaagcacacuuuacugauccagcaucuauagccgcgcgaggauauaucagcaccagaguagaaaugggggaagcggcugguauuuuuaugacagccacacccccgggaagucgagauccauuuccgcagucgaaugcaccaauuauggaugaggaacgugaaauuccugagcguagcuggaauaguggacaugaauggguaacagauuucaagggcaaaacuguaugguucgugccaaguauaaaagcagguaaugauauugcggccugccuaaggaaaaaugguaagaaaguaauccagcuaagcagaaaaacguuugacucggaauacgucaagaccagggcgaacgacugggauuuuguagucacuaccgauauaagugaaaugggagcaaauuucaaggcagaacgaguaauagauccucgacgcugcaugaagccaguaauauugaccgacggggaagagagggugauacuugcagguccgaugcccguaacacacucuagugcugcacaaagaaggggaagaaucgguagaaacccuaaaaaugaaaaugaucaauauauuuauaugggugagccacuagagaaugacgaagauugugcccauuggaaagaggcaaagauguuacuugauaacauaaauacuccagaaggcauuauuccgucuauguuugaaccggaaagagagaaaguagaugcgauagacggugaauaccgucucagaggugaggcucgaaaaacguuuguugaccuaaugcgcaggggagaucuaccaguguggcuugcuuauaaaguagcagcggaggguauuaacuaugcggauaggaaauggugcuucgaugguauuaaaaacaaccaaauacuugaggaaaacauggagguagagaucuggacaaaagagggcgaaaggaagaaacuuaaaccacgauggcuggaugccagaaucuacucugacccucuagcucuaaaggaauuuaaagaauuugcagcaggcagaaaaucccucacguugaauuuaaucacggaaaugggaaggcuaccuaccuuuaugacacaaaaagcacguaaugcgcuagauaacuuggcagugcuucauacagcagaagcagggggcagagccuauaaucacgcccuaucugaauuaccugagacccuagagacacuacuuuuacugacucuauuagcaaccguaacuggugguauauuucuuuucuugaugucaggaaaagguaucggaaaaaugacgcuuggaauguguugcauaauaacagcaucaauucugcuaugguaugcacagauacaaccucacuggaucgcugcaucuauaaucuuagaguucuuucuaauuguacuuuuaauaccugaaccagaaaaacaacgcacaccacaagauaaucaacugacuuacgucguuauagcgauucuuaccguuguagcggcuacaauggcgaacgaaaugggauuuuuagaaaagacuaagaaggauuugggcuuaggaaguaucacuacacaagaaucagaaucaaacauauuagauauugacuuacgaccugcgucagcauggacauuauaugcgguagcgacuacauucguaacaccgauguugcggcacaguauugaaaauucuagugugaaugucucucuaacugcuauagcuaaucaagccaccguccucaugggacuuggaaaaggauggccucuuucaaagauggauauaggugugccguuacucgccauuggauguuacagucaaguaaauccgauuaccuuaacggcagcguuacucuuacuggucgcgcauuaugcaauuauaggaccaggacuccaagcgaaagccacccgcgaagcucagaaaagagcggcagccggaauaaugaagaacccaacuguggaugggauuacugugauugaucucgaacccauuccguaugauccaaaauuugaaaaacaguuaggacagguuauguuauugauccuaugugugacacagguccuaaugaugaggacuacaugggcgcuuugcgaagcgcuuacucuagcaacaggcccaaucucaacucugugggaaggaaacccuggcagauuuuggaacacgacuaucgcaguaucgauggcgaauauuuuuagggggaguuaucuugccggggcaggacuacuauuuagcauuaugaaaaauacaacgaguacaagaaggggcacagggaauauaggggaaacacuaggagagaaauggaagaguagacuuaaugcauuaggaaagagcgaauuucagauuuacaagaaauccgguauccaagaaguagauagaacacucgcaaaagaggggauaaaacgcggagaaacagaucaucaugcaguuaguagagguagugccaagcuacguugguucguugaaaggaacaugguuacaccagaagguaaaguaguagauuuggguuguggucgcggcgguugguccuacuacuguggaggacugaaaaauguuagagaaguuaaaggacucacgaaagggggucccggacacgaagaaccuaucccaaugagcacguauggcuggaauuuaguaagauugcaaaguggaguagacguauucuucacaccuccugaaaaaugcgacacacucuugugcgauaucggggaaucaaguccaaaccccacaauugaagcaggacggacacuacguguuuugaaucuaguggaaaauugguugaauaacaauacacaauucuguaucaagguguuaaacccauacaugcccucaguaauugagaagauggaagcauuacagagacaguauggcggcgcauugguuagaaacccucuaagucgcaauaguacgcacgaaauguacugggucagcaaugccacagguaauaucgucucaucagugaauaugauaaguagaaugcugauuaacagauucacaaugaaacauaagaaagcaacguaugaaccagauguggaucuaggaucaggaaccagaaacauugggauugaaucggaaauaccuaauuuagauaucauagggaagagaauugagaaaauuaagcaagagcaugaaauaagcuggcacuacgaccaagaccaucccuauaaaacuugggcauaucacggcagcuaugaaaccaaacaaaccggaucugcuuccuccaugguuaauggaguugugcgacuacuuacaaagccuugggacguaguccccaugguaacacagauggcaaugaccgacacaacgccauucgggcaacaaagggucuucaaagagaagguugacacacgaacgcaagaaccuaaagaggguacuaagaagcuaaugaaaauaacggccgaauggcuuuggaaagaauuagguaagaagaaaacaccuagaauguguaccagggaagaguucacaaagaaaguaagaagcaacgccgccuuaggagcaauuuucacugacgaaaacaaguggaagucugcaagagaagcaguagaagacgggagauuuugggaguuaguagauagagaacggaauuugcauuuagaagguaaaugugagaccuguguauauaauaugauggguaaaagggagaaaaaguuaggagaguuugguaaggcaaaaggaucacgcgccauaugguauaugugguugggagcuagguuucucgaguuugaagcauuaggcuuuuuaaacgaagaucauugguucagcagaggaaauucucuuaguggcguagaaggcgaaggacuacauagauuagguuauauacugagagacguagguaagaaagaaggaggugcuauguacgccgaugacacagcugguugggauacuagaauuacacuggaagaccuuaaaaaugaggaaauggucacgaaccacaugaaaggcgaacacaagaaacuagcagaagcaauauuuaaguuaacguaccaaaauaaaguugucagaguucaaagaccuacaccucgaggcacgguuauggacauaaucucaagaagagaccaacgugguucaggacaggucggaacguacggccuuaacacauuuacaaauauggaggcccaacuaaucaggcaaauggaaggagagggaauuuucaaaucuauucaacaucucacagcgacugaggaaauugcagugcagaacuggcuagcacguguaggcagggaacgucucucaagaauggcuauuucaggugacgauuguguagucaaaccaauagacgaccgauuugcuucugcacuaacagcccuuaaugacauggguaaagugcgaaaagauauucaacaaugggagccaucuagaggauggaaugauuggacacaaguaccauuuuguucucaccacuuccacgagcuagucaugaaggauggcaggguccucguaguccccugcagaaaccaagacgagcucauagggagagcccguauuagucaaggugccggguggagucuaaaagaaacggcaugucuuggcaaaucuuacgcacaaauguggacccuuauguauuuccaccggagggaucuaagauuggcagcaaacgcuauaugcucagcggucccuagccauuggguaccuacuagcagaacaaccuggaguauucaugcuaagcaugaauggaugaccacagaagauaugcuagcaguauggaaccgcguauggauacaagaaaaucccuggauggaagauaagacaccuguagagaguugggaagaaguuccauaucucgguaaacgggaagaucaguggugcgguucauuaauaggauuaacuuccagagcuacaugggcgaaaaacauccaaacagcaauaaaccaaguacgcaguuuaauuggcaaugaagaauacacagauuauaugccgucaaugaaaagauucagaagggaagaagaggaagcuggaguucuaugguag

SEQ ID NO: 22384 - RNA, 9876 nt, Artificial Sequence
  derived and/or modified CDS sequence (opt6) from DENV-2__EU596500__SS-prME
acagcuggugucaucgugauguuaauacccacagcuauggcauuucaccuuacaaccagaaauggagaaccacauaugauaguuggccgccaagaaaaaggcaaaucacucuuauucaaaaccgaagauggugugaauauguguaccuuaauggcaauagacuuaggagaacucugugaagauaccauuacauacaaaugcccacuauuaagacagaaugaacccgaagauauugacuguugguguaacuccacaaguacuugggucacauacgguacauguacgacaacaggugaacaucgaagagaaaaacguuccgucgcauuaguaccgcauguaggaaugggauuagaaacgagaaccgaaacuuggaugagcuccgaaggcgcauggaagcacguacaaaggaucgaaacuuggauccuccggcaccccggguucacgauaauggcggcaauucuagcauauaccauaggaacgacucacuuucaacgugcuuuaauauuuauauuguuaacggccguugccccuaguaugacaaugagauguauuggcaucagcaaccgagauuucguugaagguguuucugguggauccuggguggacauuguuuuagagcauggaucuuguguuacuacaauggcuaaaaacaaacccacguuggacuuugaauugauaaaaacagaagcaaaacaaccagccacguugagaaaauauugcauugaggcgaaacuaacgaauacgacaacagaaagucgcugcccaacgcagggggagccuaguuuaaacgaggaacaagauaaacgcuuuauauguaaacacucaaugguagacaggggaugggguaauggauguggacuauuugguaaaggagggauugucacuugcgcuauguucacguguaagaaaaauauggaaggcaaaguuguacaacccgagaaucuggaguacacaauaguaauaaccccucauagcggugaagaacaugccgugggaaaugauacggguaagcacggcaaagaaauuaagauaacaccccaaucuuccauaacagaagcugagcugacgggauacggaacuguaacaauggaaugcagcccaagaacgggacuggacuucaacgaaaugguccuauuacaaauggaagacaaagccugguuaguucacagacagugguuucuugaccuaccguugccgugguuaccuggagccgauacucaagguucaaacuggauucaaaaagaaacgcuaguaacauuuaaaaacccucaugcaaagaaacaggauguaguaguccuagggucacaagagggagcaaugcacacagccuugacaggagcaacagaaauucagaugaguagcggaaaucuacuuuuuacugggcaucuaaaaugcaggcugcguauggauaaacuucaauugaaaggaaugucauacucuauguguacugguaaguuuaaaauagugaaagaaauugcagaaacacagcacggaacaaucguaauacgcguacaauacgagggagacggaagcccauguaaaauuccuuuugaaaucacagacuuggagaaaagacacguauuaggcagguugauaacagugaacccuauaguaacagaaaaagacagcccaguaaauauagaagcggaaccacccuuuggagauucauauauaauuauagggguugaaccaggucaacuaaaacuuaacugguucaagaaagguucgucuauaggacaaauguucgagacgacaaugcgaggggcuaaaagaauggcaauacugggggauacagcaugggauuucgggucuuugggaggugucuucacuucaauagggaaagcgcuacaucaaguauucggagcaauuuauggggcugcauuuuccggaguuucauggacaaugaaaauacuaauuggaguuauuaucaccuggaucgggaugaacucccgaucgacaucccuaagcguaucacuggugcuuguaggcguugugacauuauauuuaggggcagucguucaggcagauucuggauguguaguuuccuggaaaaauaaggaacucaaguguggcagugguauauuuauaacagacaauguacacaccuggacagaacaauacaaguuccaaccagaaucaccaucuaagcuagcuucagccauccaaaaggcccaugaagaagguauauguggcauaagaucugugacgagguuggagaaccuuauguggaaacaaauuacuccagaacuuaaucacauacuuagugaaaaugaaguaaaacuuacaauaaugacaggcgacauaaaaggaaucaugcaggcagguaaacgcucacuucggccacaaccgacagaacuaaaauauucguggaaaacguggggcaaggcaaaaauguuguccacugagucacacaaucaaacauuuuugaucgacggaccugagaccgcagaauguccuaacacuaacagagcuuggaacucccuggagguagaagauuacggcuuuggcgucuucacaacaaacaucugguuaaaacuaagagaaaaacaggauguauucugcgauagcaaacuaaugucagcugccauaaaggacaacagagcuguucacgcagauauggguuacuggauagaaucugcccugaaugacacauggaaaauggaaaaggcaaguuuuauagaagugaagucgugccauuggccaaagucgcauacacuuuggagcaacgggguuuuagagagugagaugguaauuccuaaaaauuuugcaggccccguuagucaacacaauuacagacccgguuaccacacacaaacggcaggaccauggcauuugggaaaacuugaaauggacuucgacuucugugaagggacgacuguaguaguaacagaggacuguggaaacaggggacccucacuuagaacgacuacugcaaguggaaaauuaauaacugaguggugcugcagaaguuguacucuaccaccccucagauacagaggugaagauggguguugguaugguauggaaauacgaccuuuaaaagaaaaagaagaaaaucuaguaaacagcuuggugacugcgggacauggucaaaucgacaacuuuagucugggaguccucggcauggcucucuuuuuagaggaaauguuaagaacaagaauaggcacaaaacaugcuauccugcuaguagcagucaguuucgucacauuaaucaccgggaacaugucguuccgagaucucggacguguaaugguaauggugggugcaaccaugacggaugacauaggcauggguguaacguauuuagcccuuuuggcagccuuuaaaguucgaccuacauuugcggcaggauuacuccuaaggaaacuuacuagcaaggagcuaaugauggccaccauagguauugccuuauuaucacaaaguaccauccccgaaacgauuuuagaacuuacggacgcuuuagcucucgggaugaugguauugaaaaucguaaggaacauggaaaaauaucagcucgcugugacaauuauggcaauaucaugugugccgaacgcaguuauacuacaaaaugccuggaaaguaucuugcacgauacuagccgcagugucaguuucgccauuauuguuaacuucuagccaacaaaaagcagacuggauaccacuugcauuaacaauaaaaggucucaauccaacugccauuuuucuuacgacucuaucucguacaaguaagaaacgaucuuggccccugaaugaggcaaucauggccgugggcaugguaucuauauuagcaucuagucugcuuaaaaacgacauuccaaugacuggacccuuaguggcaggaggacuacuaacagucugcuacguucugaccggacggucagcagaucuagagcuggagcgagccgcagauguaaaaugggaagaccaagccgagauuucuggaucaucgccaauccugaguauaacaauuucugaagacggauccauguccaucaaaaacgaagaagaagaacagacccuaaccauacuaauaagaacaggccuucugguaauaucgggaguauuuccaguaaguauucccaucaccgcagcagccugguauuuaugggaaguaaagaaacaaagagcaggaguccuaugggauguuccuaguccaccuccaguggaaaaagcugaguuagaagacggugcuuacagaauaaaacaacggggaauccuagguuauucccagauaggggccggagucuacaaagagggaaccuuccacacaauguggcaugucacaagaggagcuguccuaaugcauagggguaaaagaauagaaccuucgugggcagaugucaaaaaggaccuuauuucauaugguggaggauggaagcuagaaggagaauggaaagaaggcgaagaaguucaagucuuagcacucgaaccagguaaaaacccuagagcgguucaaacaaagccggguauauuuaagacgaauaccggaacaauaggcgcaguaucgcuagacuuuucuccaggcacuucaggaaguccuauaguugaccguaaaggaaaaguagucggccuguaugguaacgggguaguaacaagaucaggugcauacgugucugccaucgcucagacagaaaagucaauagaagauaacccagagauagaagaugauaucuuuagaaagaaacguuugacaauuauggaucuucauccuggggcaggcaaaacgaaacgauacuuaccggcaauaguaagagaagccauuaaaaggggucuuagaacuuuaauacuagcuccaacaagaguaguagcugcagaaauggaagaggcauuaagaggccuaccaauccguuaccaaacacccgcaaucaaaacugagcauacgggaagagaaaucguugaucucaugugucaugcaacguuuacaaugagguuacuaagcccugucaggguaccaaacuacaaccucaucauaauggaugaggcccauuucacagauccugccuccauugcggcaagggguuauauaucaacuagaguggaaaugggagaggcagccgguauauucaugacggccacuccaccaggaaguagagacccguucccucaaucaaacgcaccgauaauggacgaagaaagggaaaucccagaacgauccuggaacaguggacaugagugggucacugauuucaaagggaagacaguaugguucgugcccaguauuaaagcaggaaacgauauagcagcaugucuaaggaagaacggaaagaaggucauacagcuaagcagaaaaacauuugauagugaauauguaaaaacgagagccaaugauugggauuuuguaguaacaaccgacauaucagagaugggagcaaacuuuaaagcggaacgaguaauagacccccgucguugcaugaaacccguaauucuaacagauggagaagaaagaguaauucuagcugguccaaugcccguaacgcacagcucagcagcccaaagacgcggacgaauugggagaaacccuaagaacgaaaaugaucaauauauauauaugggagaaccucuagaaaaugaugaagauugcgcgcauuggaaggaagcgaagauguuguuagauaacaucaauacacccgaaggaauaauuccaucaauguuugaaccugaacgugaaaaagucgaugcuauugacggagaguauaggcugcggggugaagcuagaaagacauucguugauuuaaugagaagaggagaucugccagucugguuagccuauaaagucgccgcggaaggaaucaacuacgcugacagaaagugguguuuugacggcaucaaaaauaaucagaucuuagaagaaaauauggaaguugagauauggacuaaggagggcgagcgaaagaaacuuaagccgcgcuggcuugaugccagaauauauucggauccuuuggcucuaaaagaauuuaaagaguucgcggccgggcggaaaucacugacccuaaauuuaauaacggaaauggggcggcucccuacuuucaugacucaaaaagcccgcaacgcacucgacaauuuagcaguacuacacaccgcggaagcugggggacgagcuuauaaucaugcccuaucugagcugccggaaacguuagagacucuauuguuacuaacuuuacuggcaacugucacaggcgggauuuuccuauuucuaaugagugggaaaaguauagggaaaaugacccugggaauguguuguauaauuacagcgucgauccuacuuuggcaugcacaaauucaaccucauuggauugcagccucgauaauauuagaguucuuuuugauaguacuucuaauaccugaaccggaaaagcaaagaaccccucaagacaaucaauuaacauacguaguuaucgcuauccuaacaguaguagcagcaacaauggcaaaugaaauggguuuucuggagaaaaccaagaaagauuuaggacuuggaucuauaacgacgcaagaaucugaaagcaacauacucgacauagauuuaagaccagcuucagcguggacuuuauaugcaguggcuacuacguuuguaaccccgaugcuucgucauagcauagaaaauuccucuguaaauguuucacuuaccgccaucgccaaucaagcgacaguauuaaugggauuaggaaaagguuggccauuaagcaagauggauauuggcgucccuuuauuugccauaggauguuauuaucaaguaaacccuauaacacucacagcggcgcuucuacuacugguugcgcauaacgccauaauaggucaaggccugcaagcaaaggcaacaagggaagcccaaaaacgagcagcagcagguaucaugaaaaauccuacgguagaugguauaacaguaauagaucuagaaccaauuccauacgaucccaaauuugagaaacagcugggccaagugauguuacucauauuaugcguaacacaaguucugaugaugcguacuacgugggccuuaugcgaagcguuaacacuugcgacugggcccauauccacucuuugggaggggaacccgggcagauuuuggaauaccacaauagcuguuagcauggcaaauauauuucgagguucauaucuagcuggagcugggcuacuauucaguaucaugaaaaacacaaccucaacaagaagaggcaccgggaauauaggcgagacuuuaggagaaaaguggaaaucaagacugaaugcccuagguaaaucagaguuccaaauauacaagaaaucuggcauacaggaaguagaccgcacacuagccaaagagggaauuaaacgaggagaaacagaucaucacgcagugaguagagguuccgcgaaacuuagaugguucguugagcggaauaugguaacaccagaaggaaagguagucgauuuaggauguggacgcgggggauggaguuauuacuguggggguuugaaaaauguaagagaaguaaaaggccuaacuaagggugggccaggacacgaagaaccuauuccuaugucaacuuacggauggaauuuggugaggcugcagucuggaguugauguuuucuucacuccaccggaaaaaugugauacccuauugugcgacauaggagaaucauccccaaauccaacuauagaagcaggcagaaccuuaagaguacucaauuuaguugaaaauuggcuaaauaauaauacccaguuuuguauuaaaguacuaaacccauauaugccuaguguaaucgagaaaauggaggcuuuacaacgacaauauggaggugcuuuaguucguaacccauugucgagaaacagcacgcacgagauguauugggucucaaacgcaaccggaaacaucguaucaucagugaauaugauuagucgcaugcuaaucaaccgauuuaccaugaaacauaagaaagcgacauaugagccagacguugaucucgguucagguacgcgcaauauaggaauagagaaugagaucccgaauuuggacaucauaggcaagagaauugagaaaauaaaacaagaacacgaaauauccuggcauuacgaccaagaucacccauacaaaacaugggcauaucauggcucauacgaaacgaaacagacuggaagugcaagcaguaugguaaauggaguaguaagacuacucaccaaaccuugggauguaguacccauggucacacagauggcaaugacagauacaacaccuuucggacaacaacgagucuucaaagagaaaguggauacaaggacacaggaaccuaaagaaggcaccaagaaauuaaugaagauaaccgcggaauggcucuggaaagaacuggguaagaagaaaacucccagaaugugcacaagagaagaguucacaagaaaaguaagaaguaaugcagcauugggggcaauauuuacagacgagaauaaauggaaaagcgccagagaagcuguugaagacggaagauuuugggaacuugucgacagggagcgaaaccuucaucuagaagguaaaugugaaacguguguauauaacaugauggguaaacgugagaagaagcucggggaauuuggaaaggcgaaagguagucgagcaaucugguauauguggcucggcgcacgguuucuggaguucgaagcacuaggguuccuaaacgaggaucacugguuuucaagaggaaauucccuuaguggaguugaaggugaaggacuacaucgccuuggauacauuuugagagauguaggaaagaaagaggguggggcgauguacgccgacgauacugcgggaugggacacgcggauaacuuuggaagaccuuaaaaacgaagaaaugguuaccaaccauaugaaaggcgaacacaagaaauuagcagaagcaauauuuaaauuaaccuaccaaaauaaaguugucagaguacaacgucccacgccgagaggaacaguaauggauauaauaaguagaagggaccagaggggaucaggacaagucggcacuuacgggcuaaauacauuuacaaauauggaagcccaauuaauucggcagauggaaggcgaaggaauauuuaaaagcauacaacauuuaacggcuacagaagagauagcuguacagaacugguuggcucgagugggacgagaaaggcuaagucgaauggcaauuaguggagaugacugugugguuaaacccauugaugauagguucgcuucagcacuaacagcacuaaacgacauggguaaaguuaggaaggauauucaacaaugggagccgaguagaggauggaacgacuggacucaaguuccguuuuguagucaucauuuucacgaauugguaaugaaagacggcaggguucuuguuguaccauguaggaaccaggacgaauuaaucggucgagcacguaucucucaaggugcuggauggagcuuaaaagagaccgcuugccuaggcaaaucauaugcacaaauguggacucuuauguacuuucauagacgagauuuaagacuagccgcuaacgccauuugcucugcuguuccuagucauuggguuccaacaucgagaacuacauggucgauucaugcaaagcaugaauggaugacgacagaagacaugcuagcuguauggaacaggguuuggauacaagaaaaccccuggauggaagauaaaacgccaguagaaaguugggaagagguuccauaucuugggaagcgagaagaucaauggugcgguucacuuauaggauugacaucucgugcaaccugggcgaaaaacauccaaaccgcaaucaaucaaguaaggagcuuaauaggaaaugaggaauauacggauuauaugcccaguaugaaaagauucaggagagaagaggaagaggcggggguacuuugguaa

SEQ ID NO: 22385 - RNA, 9876 nt, Artificial Sequence
  derived and/or modified CDS sequence (opt6) from DENV-2__EU482626__SS-prME
acagcugggguuauugugauguuaauaccgaccgcuauggcauuccacuugaccaccagaaauggagaaccacauaugauaguugggcgacaggaaaaaggaaaaucguuguuauuuaaaaccgaagacgguguuaauauguguacguuaauggcaauagaucucggagaacucugcgaagacaccauaacauacaaaugcccgcuuuugagacagaaugaacccgaagauauugacuguugguguaacucgacaucaacgugggugacauacgguacuuguacaaccacuggagaacaucggagagaaaaacgaaguguagccuuggugccccauguaggaaugggacuugaaacaagaacggaaacauggaugucaucagaaggugcauggaaacauguucaaagaauugaaacauggauccuuagacauccaggauuuacuauaauggcagccaucuuagcauacacaaucggaacgacgcacuuccaaagagcucucauuuuuaucuuauuaacagcuguugcgcccuccaugacaaugcgguguauaggaauaucgaacagagauuuuguagaaggaguaaguggagguaguugggucgacauaguccuggaacaugguaguugugugacaacuauggccaaaaacaaaccgacacuggauuuugaacuaauuaaaacggaggcaaaacaaccggcaacuuugcgcaaauacuguauagaagcuaaauuaacaaauacuaccaccgaaucacguugcccuacccagggagaacccagucucaaugaagaacaggauaaaagguucauaugcaaacauaguaugguugauaggggauggggaaauggauguggacuuuuuggaaaaggagguauaguuaccugcgcaauguuuacaugcaagaaaaauauggaagguaaaguugugcaaccugaaaacuuagaauauacaauuguaauaaccccacauagcggugaagaacacgcagugggaaaugacaccgggaaacauggaaaagagaucaaaauaacgccacagucaucuauuacagaggccgagcuuacuggauacggaacaguaacgauggagugcagcccacggacaggauuagacuuuaaugaaaugguauuauuacaaauggaggauaaagcaugguuaguucaucggcaaugguuccuggacuuaccuuugcccuggcuaccuggagcugauauacaaggaucgaauuggauccaaaaagaaacauuaguaacuuucaaaaacccgcaugcuaagaaacaggacguuguaguuuuagguucacaagaaggugcaaugcauacagcgcucacgggggcaacagaaauacagaugucaucugguaacuuacucuucacagggcaucuaaaaugucgacuaaggauggauaaauuacagcugaagggaaugagcuacagcauguguaccggcaaauucaaaauaguuaaagaaauagccgaaacccaacacgguacuauaguaauaagaguacaguaugaaggggauggaagccccuguaagauuccauucgaaauuacagauuuagaaaaacgacauguccuaggccggcuaauuacuguaaacccuauuguaacugaaaaggacucaccugugaauauugaagcggagccacccuuuggggacaguuauauaauuauuggagucgaaccaggucaauugaaguugaauugguucaagaaagguucaucuauuggccagauguuugaaacuacaaugcguggagcgaaacggauggcgauacuaggcgauacugcuugggacuuuggaagccuuggagguguauucacaucuauuggaaaggcucuacaccagguauucggagcaauauauggcgcagcuuucucaggaguuucauggacuaugaagauuuuaauagggguuauuauaaccuggaucgggaugaauagucgaaguacaaguuuaagcguaucacuuguuuuagucggugucguaacauuauaccucggugcgguaguacaagcugacagugggugugucguuucauggaaaaauaaagaacugaaauguggcucaggcauauuuauaacugacaacguacauacuuggacggagcaauauaaguuccaaccagaauccccaaguaagcuagcaucggcaauacaaaaagcacacgaagaagggauuuguggcauucgaagcgucacaagacuugaaaaucuuauguggaaacaaauuacaccagaauuaaaucauauucucagugaaaacgaagucaaacuuacuaucaugaccggagauauaaagggaauaaugcaagcaggaaaaagaagccuacgaccacagccaacacaauuaaaauauucuuggaaaacauggggcaaagcaaaaaugcuaucgacagagagccauaaucaaacuuuccucaucgaugggccugaaacggcagaauguccaaauacaaauagggcauggaacucacuugaaguggaggauuacgguuucggaguauuuacuacuaauauaugguugaaauuaagagagaagcaagacguauucugugauucgaaacuaaugucagcugcaaucaaggauaaccgugcgguucaugcagauaugggauauuggauugaaucagcacuaaaugacaccuggaagauggagaaagcaucuuuuauagaaguuaaaagcugucauuggcccaaaagucauacacuauggagcaauggaguacuugagagugaaaugauuauacccaaaaauuucgcggguccaguaucacagcauaauuauagaccaggauaccauacucaaacggcgggaccuuggcaucuaggcaaacuugaaauggauuuugacuuuugugaggggacgacaguugugguuacggaggauugugguaaccggggcccaucacuacgaacaacuacagcauccgggaaauuaauaacugagugguguuguagguccugcacucuaccaccuuuaagguaccgaggugaagacgguugcugguacggcauggaaauuagaccucuuaaagagaaagaagagaaccuaguaaauucuuuaguaacugccggacauggucagauugauaacuuuagucuagguguucugggcauggcauuauucuuagaagaaaugcuuagaacacgcaucgggacaaagcacgcaauauugcugguggcaguuagcuuuguaacauuaaucacuggaaacaugucguuuagggauuuaggaagaguaauggugaugguuggugccacuaugacugacgauauagguauggggguaacuuaccuagcauuacuggccgcuuucaaaguccguccaacguuugcugccgggcuuuuguuacgaaaauuaaccagcaaagaacucaugauggcaacaauagggauagcgcugcuuucucagagcacuauacccgaaacaauccuugaacuaacggaugcucuagcacugggaaugaugguucucaaaauaguaagaaacauggaaaaauaccaacuagcagugacaauaauggcuauaucaugcguacccaaugccguuaucuuacagaacgcauggaaaguaaguugcacgauacuagcggccguaucgguaaguccguuauuauuaacaaguagucaacaaaaagcagauuggauuccuuuggcauugacaauuaaaggucuaaauccuacugcaauuuuucuuacaacgcugucaagaacaaguaagaaacgaagcuggccucuaaacgaggccauuauggccguagggaugguguccauacuagcaagcagcuuacuaaagaacgacauuccaaugacggguccauugguggcgggcggguuacuaacuguuuguuacgucuuaacaggaaggucugccgauuuggaauuagaacgagcagcagacguuaaaugggaggaccaagcagagauaucaggaucaagcccaaucuuauccauaacgaucucggaagaugguaguaugaguaucaaaaaugaagaagaagaacaaacauugaccauauuaauaaggacagguuuauuaguuauuucaggcguauucccggucucaauacccauaacggcugcggcaugguaucuuugggagguuaagaagcaacgugcaggcguguuaugggauguuccaucaccgccacccgucgaaaaagcagaguuagaagauggcgcauauagaauaaagcagcguggaauuuugggcuauagccaaauaggugcgggaguuuauaaggaaggaacauuucacacuauguggcauguuacucgaggcgcgguauuaaugcaccgaggaaaaagaauagaacccucaugggccgauguuaagaaagauuuaauaagcuauggcggugguuggaaguuagaaggggaguggaaagagggagaagaaguacaaguucuggcccuagaacccggcaaaaacccuagggcaguacaaacuaagccuggaauauucaaaacaaauacaggaacgauaggagcuguaagccuagauuucucaccugguacgucagguucgccaauuguagauagaaagggaaaaguuguugggcuauacggaaacgguguuguaacuagaucaggcgcauacguaucggcuauugcucaaacagagaaaaguauagaggauaauccagaaauagaggacgacauuuucagaaagaaacgauugacaauuauggacuuacacccaggagcgggcaaaacaaaaagguaucuccccgcgauuguucgugaagcgaucaaaagaggauugagaacauuaaucuuggcaccgacuagaguagucgcagcagaaauggaagaggcacucagaggacuuccaauucgauaucaaacccccgcaauaaaaacagaacauaccggaagggaaauaguugauuuaaugugucaugcuacauuuacaaugcgucuacuuagccccguucgggugcccaacuacaauuuaauaauuauggaugaagcacacuuuacugacccugcuucaauugccgcgaggggauauauuucaacgagaguugaaaugggagaggccgcuggaauuuuuaugacggcgacgccaccaggauccagagacccuuucccucaaagcaacgcaccgauuauggacgaagaacgugaaaucccugaacgaagcuggaacuccggacaugaauggguuaccgauuucaaagggaaaacaguaugguuuguuccaucaauaaaagcugggaaugauauugcagccugccugaggaaaaacgggaagaaagugauucaacugucgcgcaaaacauuugauucagaauauguaaaaacucgugccaacgauugggauuucguggucacaacugauauuucagaaaugggagcaaauuucaaagcagaacguguuauagauccuagaagauguaugaagcccguaauccucacugauggugaagaaagagugauuuuagcgggcccaaugcccguaacgcauucaucggcagcacaacgucgugggagaauaggcagaaaucccaaaaaugagaaugaccaauacauuuacaugggggaaccacuggagaaugacgaagauugugcucacuggaaagaagcaaaaauguuacucgacaauauaaauacaccugaggguauaaucccuagcauguuugaaccagaaagagaaaaaguagaugccauugauggggaauauagauuacgaggugaggcacgaaaaacuuuuguggaucuaaugagaagaggggaccucccgguaugguuagcauauaaaguagcugccgaagguaucaauuaugccgaccguaaguggugcuucgacggaauaaagaauaaccagauacuugaagaaaauauggaaguagaaauauggacuaaggaaggagagcguaagaaacuuaaaccuagaugguuagacgcccgcauuuauucagauccucuggcucuuaaagaauuuaaagaguucgcagcgggcaggaaaagccucacacuuaauuuaauaacugaaaugggacgcuuaccgacauuuaugacacagaaagcacgaaaugcguuagauaaccuugcaguucuacauacggcugaagcaggaggacgcgcauacaaccaugcucuaagcgaacuucccgaaacacuagagacucuuuuacuccugaccuuauuagcgacuguuacgggaggaauauuccuguucuuaaugucugggaaagguauaggaaaaaugacgcuugggauguguuguauuaucacggcuagcauacucuuaugguacgcucaaauucagccgcauuggaucgcugcaagcauaauucuagaguucuuucuuauuguacuacuaaucccugaaccagaaaaacagcgcacgccgcaagacaaccagcugacuuacguugucauugcuauacuaacagucgucgccgccacuauggccaaugaaaugggcuuccuugaaaagacgaagaaagaccuuggacucggaagcauaacuacccaagaaagugaaucaaauauccuagacaucgacuuaagaccugcaucggcguggaccuuauaugcagucgcaacuaccuucguuacaccuaugcuuagacacagcauagaaaauagcagugugaauguauccuuaacagcaauugcaaaucaggcuacuguuuugauggguuugggaaaagguuggccacuauccaaaauggauauaggggucccacuacuugcuauaggaugcuauucucaaguuaauccgauaacuuuaaccgccgcauuacuucugcuaguggcccacuaugcgauaauagguccugggcuacaagccaaagcaacuagagaagcccaaaagagagcagccgcuggaauaaugaaaaacccaacuguugauggcauaaccguaauagaucucgagccaauucccuacgacccaaaauucgaaaaacaacucgggcaaguaaugcuuuuaauccuauguguuacacagguccuuaugaugcggacaacuugggcucuuugcgaggcccuuacacuagcuacaggaccuauuagcacauugugggagggaaauccaggccguuuuuggaauacuacuauugcuguuuccauggccaauauuuuuagggggaguuaucucgcgggagcuggcuuguuauuuucuauaaugaaaaacacaacaaguacacguaggggaacggggaauaucggagaaacacuaggugaaaaguggaaaucuaggcuaaaugcauuagggaaaagugaguuccagaucuauaaaaagucaggcauucaggaaguugauagaacguuggcaaaggaaggcauaaaaagaggagaaacugaucaccacgcuguaucgcgaggauccgcuaaacuacguugguuuguggagaggaauaugguaacgccugagggcaaaguagucgacuuaggaugugguagagggggauggaguuacuauuguggaggccuuaaaaacguccgagagguaaaaggucuaacaaaagguggcccgggucacgaagaaccaauaccaaugucuacguacggcuggaaucugguacgccuucaguccgggguagacgucuucuuuacuccaccugagaaaugugacacucuacucugcgacauaggagaaagcucgccuaacccaacaauugaggcuggacgcacucuacggguucucaaucuaguagaaaauuggcucaacaauaauacgcaauuuugcauuaaagucuuaaauccguacaugccaaguguuauagagaaaauggaagcgcugcaaagacaguacgggggagcccuagugaggaauccauugaguagaaacucaacacacgaaauguauuggguaucaaaugcgacaggaaauaucguaaguucaguaaauaugaucucgagaaugcuaauuaacagguuuaccaugaaacacaagaaagcaacauaugaaccagauguugaccuagggagugggacacgcaacauaggaauagaaucagaaauuccaaacuuggauauaauugggaagcguauagaaaagauaaagcaagagcaugaaauuagcuggcauuaugaucaagaucacccuuacaaaaccugggcauaucacggcagcuaugaaacuaagcaaaccggaucagcuucgaguauggugaauggaguagucagacuacugacaaaaccaugggaugugguaccuauggucacucagauggccaugacagacacaacuccuuucggacagcagagaguuuuuaaagagaaaguagauacacggacgcaagaaccaaaagaagggaccaagaaacugaugaaaauaacggcugaguggcucuggaaggaauuagggaagaaaaagacaccuaggauguguacgagagaagaauuuacuaagaaaguuagaucaaaugcggcucuuggagcaauauuuacagaugaaaauaaauggaaaagugcacgagaagcaguagaagauggucgauucugggaauugguagacagagaaagaaaucuccacuuagaagguaaaugugagaccuguguguacaauaugaugggcaaaagagagaagaaauugggugaguucggcaaagcaaaaggcucuagagccauaugguauaugugguuaggagcaagauuccuugaguucgaagcacuaggcuucuuaaacgaagaucauugguuuucacgcggcaauucccuaucaggcguggagggcgaaggccuacacagacuaggauacauuuugcgggauguggguaagaaagagggcggagcaauguaugcggacgacacagccggaugggacacuagaauuacacuggaagauuuaaagaacgaagaaauggucacaaaucauaugaaaggcgaacacaagaaacuagcggaagcuauauuuaaacuaacauaucaaaacaaaguaguaagaguacagagaccuacaccaagggggacagucauggacauuauaucucguagagaccagcgaggcagcggacaaguaggaacauacggauuaaacacauuuacuaauauggaagcgcaacuuauaagacagauggaaggcgaaggcauuuuuaaaucgauucaacauuuaacagccacagaagagauagccguacagaacugguuggcacgaguaggacgagaacguuuaagcagaauggcaauaaguggagaugacuguguaguuaaaccuauagacgacagauucgcuagugcccugacggcgcuuaacgacaugggaaaaguaagaaaagacauucaacaaugggaacccagucgaggcuggaaugacuggacucagguacccuuuugcucucaccacuuucacgagcuuguaaugaaagauggucgaguacuggugguaccaugucgcaaucaagacgaauugauaggcagagcacgaauaucucaaggagcaggauggucacucaaagaaacugcaugucuagguaaaucguaugcgcaaauguggacucuaauguauuuccacagacgugaucugagacuggcagcgaaugccauaugcagugcugucccaagucacuggguuccgaccagucgaacuacguggucaauacaugccaaacacgaauggaugacgacagaagauauguuagcaguguggaaccgagucuggauccaagaaaauccguggauggaagacaaaacaccgguggaaagcugggaagaaguaccuuaucuugggaagagggaagaccaguggugugguucacuuauugggcuaaccucaagagccacaugggccaaaaacauccaaacggcaaucaaucaaguaagguccuuaauagguaaugaagaguacacagacuauaugccuucgaugaagagauuuagaagagaagaagaggaagcuggaguccuaugguag

SEQ ID NO: 22386 - RNA, 9876 nt, Artificial Sequence
  derived and/or modified CDS sequence (opt6) from DENV-2__EU482629__SS-prME
acggcaggcgugauaguaauguugauaccaacagcuauggcguuucacuuaacaacgagaaauggcgaaccgcauaugauuguaggccgacaagaaaagggaaaaucacuauuauuuaaaaccgaggacgguguaaacauguguacgcucauggcuauugaccuaggagaauuaugugaagauacuauuacguacaaauguccacuccucagacaaaaugaaccagaagacauagacuguuggugcaauagcacuagcacguggguaacauauggaacauguacuacgacaggugaacaucgaagagaaaaacguuccguagcuuuagucccgcacguagguaugggacuagaaacaagaacagaaacauggaugucgucugaaggagcuuggaaacacgugcaaaggauagaaaccuggauucuuagacauccaggcuuuaccauaauggcugccauucucgccuauaccauugggacuacccauuuccaaagagcacuuauuuuuauacuucuuacugcugucgcgccaagcaugacaaugcguuguauagggauaagcaaucgugauuuuguugaaggaguguccgguggaaguugggucgauauaguauuagagcaugggaguugugucaccaccauggcaaagaacaaaccgacguuagauuuugaauuaauuaagacugaagcuaaacaaccagcgacacucagaaaauauuguauagaagcgaaauuaacgaacaccacaacugaaucucgaugcccaacacaaggugaaccuucauuaaaugaagagcaagacaaaagauuuauauguaaacauucuaugguggaccgcggcuggggaaaugguuguggguuauucgggaaagggggaauaguaacgugugcaauguucaccuguaagaagaauauggaaggaaaaauuguccaacccgaaaauuuggaauacacaaucguaaucacaccccauucuggugaagaacacgcgguugguaacgauacaggaaagcacgggaaagaaaucaaaaucacgccacaaaguaguauaaccgaagccgaauuaaccggauaugggacagugacgauggaauguagcccacguacaggccuagacuucaacgagaugguacuacuacaaauggaggauaaagccuggcuaguacauaggcaaugguuccuggaucucccguuaccguggcuaccuggugccgauacccaagguaguaauuggauacaaaaagaaacacuaguuacuuuuaaaaacccacaugcaaaaaaacaagacgucguaguccuaggaagucaagagggggcaaugcacacugcucugaccggagcaacagaaauucaaaugaguaguggaaaccugcuuuucacaggucaucuaaagugucgacucaggauggauaaauuacagcugaaggggauguccuauucgauguguacggguaaauuuaaaaucguaaaagaaauagcggaaacccaacacgggacaauaguuauuagaguacaauacgagggagacgggagcccaugcaaaauaccguuugagaucacugaccuggaaaaaagacauguucuaggucgauugaucacggugaacccaauaguaacagaaaaagauuccccuguuaauauugaagccgaaccaccauuuggagacucguauauaauuauaggaguggagccuggucaacuaaaguuaaauugguuuaaaaaaggaucgaguauaggccaaauguuugaaacgacgaugcgcggcgcuaagcgaauggccaucuuaggggacacugcaugggacuuugguaguuuaggaggugucuucacuaguauuggaaaagcacugcaucagguauuuggagcaaucuauggagcugcauuuuccgguguauccuggacgaugaagaucuuaauuggaguuaucauaacuuggauaggaaugaacagcagaucaacuagcuuguccguaagcuugguacuuguagggguaguaacuuuauacuuaggagcaauggugcaagccgauucaggaugcguaguuucuuggaaaaauaaagaacucaaaugugggucaggcauauuuauaacggauaacguacauacguggacagagcaauacaaauuucaaccagaaucaccuuccaaguuagcauccgcuauucaaaaagcucaugaagaaggaauuuguggcauaagaucuguaacgagacucgaaaauuugauguggaagcagauaacgcccgaauuaaaucauauauuauccgagaaugagguuaaacucacaauuaugacaggugauauaagaggcauaaugcaagcagguaaaaggagcuuaaggccacagcccacugaacuaaaguacaguuggaagacuuggggcaaggcaaaaauguuaucaacagaaucacauaaccagacguuucugauugauggaccugagaccgcggaguguccuaauacgaacagagcauggaauaguuuagagguagaggauuacggauucgguguguuuacaacuaacauaugguugaaguuaagagagaagcaggacguauuuugugauaguaaguuaaugagcgcagcaauaaaagauaauagagcuguccaugcagacaugggcuacuggauugaaagcgcuuugaaugacacauggaaaauggaaaaagccaguuucauugaaguaaaauccugccacuggccaaaaagucauaccuuaugguccaaugggguacuagaaagcgaaaugauaauaccuaaaaauuuugcaggucccguaucacagcauaauuacagaccuggauaccacacucaaacggcgggcccuuggcaccuaggaaaauuagagauggauuucgaucugugcgaagggacgacggucguggugacagaagauuguggaaaucgcggucccucacuccgaaccaccacagcuucuggaaaauuaauaacagaaugguguugucguucguguacccucccgccgcuuagguacagaggcgaagauggauguugguacggaauggaaauaagaccccuaaaagaaaaggaagaaaaccucguaaauagcuuaguuacugcgggccauggacagauagauaauuuuaguuuggggguccugggcauggcacuauucuuagaagagaugcuacgaacacguauuggcacaaagcaugcuauuuugcucguagccguuucauuuguaacguuaauaaccgggaacaugucauuuaaagaucuuggucggguaaugguuaugaugggugcaaccaugacagaugacauaggaaugggagucacauauuuagcccuuuuagcggcauuuaagguaaggccuacguuugcagcaggucugcuuuugcguaagcugacgucaaaagaauuaaugauggccacaauuggaauagcauuauugucccaaucgacuauuccagaaacaaucuuagaacugacggacgcucucgccuuagguaugaugguacuaaagauaguucggaauauggaaaaauaucagcucgccguaacgauaauggcaauuaguugugucccuaaugcaguaaucuugcagaacgcuuggaagguuucauguacuauacuugccgcugugagcguuagcccauuacuguuaacaucaucacaacaaaaagcugacuggauuccccuggcauuaacaauaaaaggacugaauccuacggcaauuuuucuuacgacucuaucuagaacaucgaaaaagagaucauggccucuuaaugaagcaauuauggcugugggcaugguaucaauccuugcaagcuccuuacuaaaaaaugacauuccaaugacagggccccuagucgcaggcggacuccucacuguguguuacgucuugacgggacgcagugcugauuuagaacuagaacgcgcagcggacgugaaaugggaggaucaggcggagauuaguggauccucaccaauucuaaguauuacaauuagugaggauggcucaaugaguauuaagaacgaagaggaagaacagacauuaacaauacucauaaggaccggacucuuaguaauaaguggaguauucccuguauccauccccauuacugcagcagcgugguaccuaugggaaguuaaaaaacagagagccgggguauugugggauguaccaucaccuccaccaguagaaaaggcggaacuagaagauggagcauauagaauaaagcagagaggaauauuaggauauucucaaauaggugcuggugucuauaaagaaggaacauuucauacgauguggcauguaacacguggagcaguucuuaugcacagagggaagcgcaucgaaccaagcugggcugacgucaagaaagaucuaauaagcuauggaggaggauggaaauuagaaggagaauggaaagaaggugaagaagugcaagucuuagcccuagaaccagggaaaaacccccgcgcaguucagaccaaacccggcauuuucaaaacuaacacagggacuaucggagccguaucauuagauuucaguccuggcacuagugggucgcccauugucgauagaaaaggaaaaguagucggcuuguauggcaacggugucgugacucgaucaggagcuuacguguccgcaauagcccagacagaaaagagcauagaagauaacccagaaauagaagaugauauauucagaaaaaaaaggcucacuauuauggacuuacaccccggugccgguaaaacuaaaagauaccucccugcaauaguaagggaggcgauuaaacggggacuaaggacuuuaauucuagcgccuacucggguaguggcagcggaaauggaggaagcucucaggggacuaccaauacguuaucaaacaacagccauuaaaacagaacauacuggaagagaaauuguagauuuaaugugccacgcaacuuucaccaugagacuucugagcccaguacgcguuccgaauuauaaucuuaucauuauggacgaagcgcacuuuacugauccagccuccauagcagcgcgggguuauauaucaacuaggguagaaaugggagaagcagcggguauauucaugacugcuacaccucccggaaguagagauccuuuuccgcagaguaaugcgccuauaauggacgaagaacgcgagaucccggaacgauccuggaauucuggacaugaauggguaacagauuucaaaggaaaaacggucugguuuguaccuucaauaaaagcaggcaaugacaucgcagcaugccuucgaaagaauggcaaaaaaguaauacaauugagcagaaaaacauucgacuccgaauacguuaaaacuagagcaaacgauugggauuucgugguaacaacagauauaucggaaaugggagcgaauuucaaagcagaaagaguaaucgacccacgcaggugcaugaagccugucauauugacggacggggaagagcgagucauauuagccggacccaugccaguaacgcauucaagcgcggcgcaacgcagaggucgaauuggaagaaaucccaaaaaugaaaaugaccaguacauuuacaugggagaaccuuuagagaacgaugaagauugcgcacauuggaaagaagcaaagauguuacuagauaacaucaacacaccagaagguauaauacccaguauguuugaaccagagcgagagaaaguggacgcaauugacggugaauacagauuacgaggagaagcgagaaagacauuuguagaccuaaugcgccgcggagaccuaccagucugguuggcauacaaaguggcggcugaaggaauuaauuacgcagaucggaaauggugcuuugaugguauuaaaaauaaucaaauucuugaagaaaacauggaagucgagaucuggacgaaagagggugaaagaaaaaaauugaagccuaggugguuagaugcgcgaauuuacagcgacccuuuggcacuuaaagaguuuaaagaauuugccgcuggacguaaauccuugacucuuaauuuaauuacagagauggggcguuuacccacuuucaugacacaaaaagcccguaacgcauuagauaaucuggcuguccuacauacggcugaggcagguggacgcgcuuacaaucacgcacugagcgaauuaccagagacccuggaaacgcuauugcuacuaacuuuauuagcuacagugacuggaggcauauuucucuuucucaugagcggcaaggggauagguaaaaugacacucgggauguguugcauuauaacagcaucaauucuccuaugguaugcccaaauacaaccucauuggauugcagcaaguauuauauuagaguuuuuccugauaguauuacuaauaccugaaccagaaaaacaacgaacaccgcaagacaaucaauugacauauguggugauugcaaucuuaacaguugucgcagcuacuauggcaaaugaaaugggauucuuagaaaaaacaaaaaaagaucuaggucucggcagcauaacaacacaggagucagaaaguaauauccuugauaucgauuuaagacccgcgagcgcuuggacucuuuaugcuguugcaaccacuuuuauaacuccaauguuaaggcauucaaucgaaaacagcagcgucaauguaaguuuaacagccaucgcaaaccaggcuacgguccuuauggggcuuggcaaaggauggccauuaucaaaaauggauauaggagugccucuuuuggccaucgguugcuauagucagguuaauccaauaacacugaccgccgcgcuacuacuacuaguagcgcauuaugcgaucaucggacccggauuacaagcuaaagcaacgcgagaggcucaaaagagagccgccgcgggaaucaugaagaacccgacgguagauggcaucaccgucaucgacuuagaaccuaucccguaugacccuaaguuugagaaacaacucggacaaguaaugcuccucauacuaugugucacucaaguuuuaaugaugcgaacaacaugggcuuuaugcgaagcauugacauuagcuacuggaccuauaucgaccuuaugggagggaaauccaggaagauucuggaacacaaccauugcaguaucaauggcgaauaucuuucgcggcucuuaucuagcaggugcugggcuauuauuuaguauuaugaaaaauacgacaaacacacgcaggggaaccggaaacaucggagaaacucuaggagagaaauggaaaagccgucugaacgcccugggaaagucagaauuucagauauacaagaaaucaggaauucaagaaguagaccgaacacuagcaaaagaagguauuaagcgaggagaaacagaucaccaugcaguuucucgagggucagcgaaauuaagaugguuugucgaacguaacaugguuacgcccgagggaaaaguuguugaucuuggguguggaagaggcgguuggucauacuauugcgggggauuaaaaaauguaagagaaguuaagggacuaacuaaagguggccccggacaugaggagcccauaccuaugaguacguacggcuggaaccuggucagacuccaaucagggguugauguauuuuucacgccaccugagaagugcgauacccuauuaugugacaucggugaaucuagcccaaaccccacgauagaggccgggcguacucuaagaguacucaauuuaguagagaauuggcucaacaauaauacacaauuuuguaucaaaguauuaaaccccuauaugccuaguguuauugaaaaaauggaagcuuuacaacgaaaguauggaggagcgcuaguaaggaauccacucucuagaaauucaacacaugaaauguacuggguuucuaaugcgacaggaaacauaguuaguucagucaauaugauaucaagaaugcuuauaaauagguuuacaaugaagcacaaaaaagcuacauacgaaccagacgucgaucuaggaagcggaacacgaaauauuggcauugaaucagaaauacccaauuuagauaucauaggaaaacggauagaaaagauaaaacaagagcacgaaacaaguuggcacuacgaucaagaucauccuuacaaaacuugggcguaccauggcuccuacgagacgaaacagacaggauccgcuucuaguaugguaaauggagugguaagacuacuuacaaaaccaugggauguugugccaauggugacacaaauggcaaugacagauacuacuccguuuggacagcaaagaguguuuaaggagaaaguagauacaagaacucaagagccaaaagaggggacaaaaaaauuaaugaaaauuacagcagaauggcuguggaaagaacuagggaaaaagaagacuccacgcaugugcacucgugaagaauuuacaaggaaagugcgcucaaaugcagcacuaggagcaauauucacagaugagaauaaauggaagucugcucgggaagcaguugaggauggcagauuuugggaauuaguagacagagaaagaaauuuacacuuagagggcaaaugugagacuuguguuuauaauaugauggggaagagggaaaaaaaauuaggagaguucgguaaagccaaaggaucuagagccaucugguauaugugguuaggcgcacgauuccuugaguucgaagccuuagguuuccuaaaugaagaccauugguucucacgaggaaacucauuaucagguguagaaggggaaggcuuacacaggcuagguuacaucuugcgugaugugggaaaaaaagaggguggugcaauguacgcagacgauacagcagguugggacacaagaauaacguuagaagacuuaaagaaugaagaaaugguuacgaaccacaugaaaggcgagcauaaaaaacuugcugaggcaauuuucaaacuaacguaccaaaauaaggugguacgaguccaacguccaaccccaaggggaaccgucauggauaucauuucucguagggaucagagaggaagcgggcagguggguacuuaugguuugaauaccuuuacaaacauggaggcucaauuaauacgacagauggagggcgaaggcauauucaagucuauacagcaccuaacugcaacagaagaaauagccguucaaaauuggcuagcccgagugggacgagaaagguugagucgaauggcuauuucgggugacgacuguguagucaaaccgauagaugacagguuugcauccgcacugaccgcacuuaacgacaugggcaaaauaagaaaagauauucaacaaugggaaccgucacguggcuggaaugacuggacgcaaguaccguuuugcagucaucacuuccaugaacuuguaaugaaagauggaagaguauuaguagucccuugccguaaccaagaugaacuuauagggagagcgcgcaucucacagggagcaggcuggucuuugaaggaaacagcaugccuuggaaagucauaugcucaaauguggacacuaauguauuuccaccgucgagauuugagacuugcugcuaaugcaauaugcagcgcggugccaagccauuggguaccaacaagccguacaacuuggucuauucaugcaaagcaugaauggaugacaacugaggauauguuagcgguuuggaauagaguuuggauccaagaaaacccuuggauggaggauaaaacaccaguugagucgugggaagagguaccauacuuagggaaaagagaagaucaauggugcggaucacuuaucgguuuaacuagccgagcaacuugggcgaaaaauauacaaaccgcaauuaaccaaguacgaagccuaauaggaaaugaggaauacacugacuauaugccaucaaugaaacgcuuucguagagaagaggaagaagcggggguucuuugguga

SEQ ID NO: 22387 - RNA, 9876 nt, Artificial Sequence
  derived and/or modified CDS sequence (opt6) from DENV-2__FJ390390__SS-prME
acggccgggguuauuguaauguuaauuccaaccgcaauggcauuucauuugacaacuaggaauggagaaccucauaugauugugggaagacaagaaaaagggaaaucacuacucuuuaaaacagaagaugguguaaauaugugcacgcucauggcuauagaucuaggagaacuaugcgaagacacuauuacauauaaaugcccacuacuacgucaaaacgaaccagaagauauugauuguuggugcaauagcacaucaacguggguaacauaugggacaugcacaacgacaggagaacauagaagggaaaaacggagcguugcauuaguaccccauguaggaaugggguuggagacacgaacggaaacauggaugucuagcgaaggagccuggaaacauguucaaaggauagagaccuggauauuaagacauccuggauuuacgauaauggcggcaauacuggcuuauacaauuggcacaacgcauuuucaaagagcacuaauauuuaucuuguugacagcuguggcuccuucgaugaccaugagaugcaucgguauaucaaaccgggacuuuguagaggggguaucaggaggaucuuggguagacauaguauuagaacauggcucgugcguaacaacaauggcgaaaaacaaacccacacuugacuucgaauugauaaaaaccgaagcuaaacaaccagcuacauuaaggaaauauuguaucgaagcuaaacuaacuaacacgacaacugaaucccguugcccuacccaaggugagccuagccuaaacgaggaacaagauaaaagauuuauaugcaaacauagcaugguagacaggggauggggcaaugggugcggacucuucggcaaaggaggaauaguaaccugugcgaaauuuacguguaagaaaaauauggaagggaaaguuguacaaccugaaaauuuggaauauacuaucguaaucacuccucauucuggggaagaacaugcuguuggcaaugauacuggcaaacaugguaaagagauaaaaauaacgccacagucuucaauuacugaagcagaauuaacaggcuauggaacuguaacaauggaauguucaccuaggacuggacuagauuuuaacgaaaugguacuacuucaaauggaagacaaagcauggcuaguucaucgacaaugguuuuuggaucuaccauuaccguggcuuccgggggcugauacacagggguccaauuggauccaaaaagaaacguuaguaacauuuaaaaacccacaugcaaagaaacaagauguagugguuuuggggucccaagaaggagccaugcacacagcuuuaacuggagcuaccgaaauucaaaugaguaguggaaaccuauuauucacgggucauuuaaaaugucgucucagaauggauaaacuucaauuaaaaggaaugucuuauagcauguguacagggaaauucaaaauagucaaggaaauagcagaaacgcaacacgguaccauaguuauacgaguucaauaugaaggagauggaaguccauguaagauuccauuugaaauaacggaucuagaaaaacgacacguuuuggggcgacuuauuacaguaaacccgauugugacugaaaaagauagccccgucaauauagaagccgaaccacccuucggagacuccuacauaauuauaggaguggaaccuggacaguugaaauuaaauugguucaagaaagggucuuccauuggucaaauguuugaaaccacgaugagaggagcgaaaaggauggccauuuuaggugacacugcuugggauuucgguucucuaggaggagucuuuacaagcaucgguaaagcgcuccaccagguuuuuggugcaaucuauggagcugcguucucuggcgugaguuggacuaugaaaauuuugauuggggugauaauuacuuggauaggaaugaacucaagaucaacaucuuuaaguguaucacucguguuaguagguguuguuacucuauaccuuggagcaaugguccaagcagauucgggguguguggugucuuggaagaauaaagaacuuaagugcggcucaggaauauucauuacugauaaugugcauacauggaccgaacaauauaaauuucaaccagaaucaccguccaaauuggccucagcaauccagaaagcucaugaagaagggauaugugguauacguaguguuacaagacucgagaauuuaauguggaaacagauuaccccagaauugaaccacauuuuaucugaaaacgaaguuaaacuuacaauuaugacaggggauauuagaggaauaaugcaggcuggcaaaagaucauugcgcccgcaaccaacggaacucaaguacucauggaaaaccuggggcaaagcaaaaauguuaucaacagagucacauaaccaaacguucuugauagauggcccagaaacagcugaauguccaaauacuaauagagcauggaacucacuggaagucgaagauuacggauuuggcguuuuuacgacuaauauaugguuaaaacuccgagacaagcaagauguauuuugugauaguaaauugaugagcgcagcuaucaaggacaaccgugcuguccacgcugacaugggcuacuggauagaaucagcguugaacgacaccuggaagauggaaaaggcuucauucauagaaguaaaaucaugucauuggccaaaaucacauacucuuuggucaaauggaguauuagaaucggagaugauaauaccaaagaacuuugcagguccugugagccaacauaacuaccgcccuggguaccacacucaaacggcaggcccauggcauuuagggaaauuagaaauggauuuugacuugugugaagggaccaccguaguagugacagaagauugcggaaaccgaggaccaagccugcguacaacaacagcuucagguaagcuaauuacugaaugguguugcagaucuuguacucuucccccucugcgguacagaggagaagacgguugcugguacgggauggaaaucagaccuuugaaggagaaagaagaaaacuuagucaauagccuagucacagcgggccacggacaaauagacaauuuuucauuaggcguauuaggaauggcguuauuguuagaggaaauguuacggacacggauugguacgaaacaugcaauauugcucguagccgucagcuuuguaacgcuaaucaccggaaauaugaguuucagagacuuagggagaguuauggucauggugggggcgacuaugacagaugacauagguauggguguaacauacuuagccuuauuagccgcauucaaagugagaccuacauucgccgcaggccuauuguuacggaaauugacaaguaaggagcuaaugauggcgaccauugguaucgcgcugcuaucacagagcacaaucccugaaaccauucuagaacuuacagaugcgcuagccuuagggaugauggugcuuaaaaucguacggaacauggagaaauaucaacuagcagucacagugauggcaaucucaugugugccuaaugccgucauauuacaaaacgcguggaagguaaguugcacaauucuagcagcaguuucggucaguccacuacuacuaaccagcucccagcagaaagcggacuggauaccgcucgcacuaaccauuaaaggguuaaauccaacagcaauauuuuugacaacacuaucaaggacaaguaagaaaaggagcuggccacuaaaugaggcuaucauggcaguuggaauggugucuauucuagcgucuucacugcuuaaaaaugacauuccgaugacaggccccuuaguagcgggagguuugcugaccguuuguuacguacuuacagggcgcucugcugacuuagagcuggaaagagccgcagauguaaaaugggaagaucaagcagaaauuucuggguccucaccgauacugaguauaacaauaucagaagaugguaguaugagcaucaaaaaugaagaagaagaacaaacauuaaccauauuaauaagaacgggacuauuaguaauauccgggguauucccuguaagcauucccauaacagcagccgcaugguaucuuugggaagucaagaaacagcgggccggcgucuuaugggacguuccaaguccuccaccuguagagaaagcggaauuagaagacggagcauauagaauaaagcaaaggggaauacucggauauucucaaauuggggccggaguuuauaaagaggguacauuucauaccauguggcauguaacucgaggugcugucuuaaugcacagagggaagagaauagaacccuccugggcagacgucaagaaagauuugauaucauacgguggugguuggaaguuagagggcgaauggaaggaaggagaggaaguacaaguauuagcauuagaacccggcaagaauccgcgagcaguacaaacaaaaccagguauauuuaagaccaauacaggaacaauuggugccguuagccuggacuuuucacccggaacuucuggaagcccaauugucgauaggaaagguaaagugguaggacuauauggcaauggcguaguaacaagaaguggggcuuacgucucagccaucgcacaaacagaaaaauccauugaagauaaucccgaaauugaagaugauaucuuccgcaagaaaagacuaacaauaauggaucuucacccuggagcggggaaaacgaaacgauaucuaccagcaauaguaagagaggcgauaaaacgaggucuacguaccuuaauacuugcaccaacacgaguaguugcagcagaaauggaagaagcgcugagaggacuaccuauucgcuaccaaacaaccgccauaaagacggaacauacaggaagagagauuguggaccuaaugugucacgcgacuuuuacuaugcgucuauuaagucccguucgaguaccaaauuacaauuugauuauaauggacgaggcccauuuuaccgaccccgcaucaaucgcggcucgaggcuauaucaguacacggguggaaaugggggaggcugcuggaauuuuuaugacggcgacgccgcccggaagcagagauccguuuccgcaaaguaaugcgccgaucauggaugaagaaagagaaauaccagaacgaucauggaauagcggucacgaauggguuaccgacuuuaaaggaaaaacgguaugguucguucccuccauuaaagccggcaacgacauugcagcuugcuuacguaaaaacgggaagaaagucauucaauuaucaagaaagacauuugacagcgaauaugucaagacaagagcaaacgacugggacuuuguaguuacaacugacauaagugaaaugggagcuaacuucaaagcagaaagaguuauagacccaaggagaugcaugaagcccguaauacucacggauggugaagagaggguuauacuugccggaccaaugccgguuacucauucuagcgcggcacagaggagagggaggauaggaagaaauccuaaaaaugaaaacgaccaauauauauauaugggagaaccacuugagaaugacgaagauugugcacauuggaaagaggccaagaugcuacuggauaauaucaacaccccggaaggaauaauaccaaguauguuugaaccugaacgugaaaaaguggacgcaauagauggagaauacagauuaagaggggaagccaggaaaacauucguugaucuaaugagacggggugauuuaccggucuggcuagcauacaaagucgcagccgaaggcauaaauuaugccgacagaaagugguguuucgauggaauuaaaaauaaucaaauucuugaagagaauauggaaguugaaauuuggacuaaagaaggcgaaagaaagaaguugaagccacgguggcucgaugcacgcauuuacucggaucccuuggcccuaaaagaguucaaagaguucgcugcaggucguaaaucacuuacucucaaccuuaucacagaaaugggcagacucccaacauucaugacacagaaggccagaaacgcccuugacaauuuggccgugcuacauacagcggaagcuggaggcagagcauauaaucaugcauuaucggaacuuccggaaacgcuugaaacacugcuauuauuaacccuucuggcuacuguaacgggaggaauuuuccuguuuuuaauguccgguaaaggcauagguaaaaugacucuugguaugugcugcauuauuacugcuucgauuuuacuaugguacgcgcaaauacaaccacauuggaucgcugcgucaauaauucuugaguucuuucuaauaguauuacugauaccagagccggaaaaacagcgaacaccccaagauaaucaauuaacuuaugucguuaucgccauauuaacagucgucgcggcaacaauggccaaugaaaugggguuuuuagagaaaaccaagaaagaucuaggucuagguucaauaacuacacaagaaucugaaaguaauauauuagacaucgauuugagaccugcaagugcauggacauuauaugcgguagcaacgacauucguuacucccaugcuuagacacagcauugaaaauucgucaguaaacguaucuuuaacagcuauugcaaaucaagcaacgguacuaaugggguuaggaaaaggguggccuuugaguaaaauggauauuggaguacccuuacuugcuauuggaugcuacucccaaguuaacccaauuacacuaacugcugcacuccuacuauuaguagcucauuacgcaauaaucggcccuggccugcaagccaaagcuacucgugaagcccagaaaagagcugcggcaggaauuaugaaaaacccaacaguggauggaaucacaguaauagauuuggaaccgauuccguaugacccaaaauucgaaaaacaauuaggacaagucauguuacucauauuauguguaacccaaguacuuaugaugcguacuacaugggcucuaugugaagcgcuaacacuagcaacgggaccgauaaguacauugugggaagguaauccggguagauuuuggaacacuacaauagcagugucaauggccaacauauucagaggaucuuauuuggcuggggcuggcuuacucuuuucuaucaugaaaaauaccaccaacacgcgucguggaacaggaaacauaggcgagacuuuaggagaaaaguggaagagucgacuaaacgcucuagggaaaagugaauuucaaauauauaagaaaaguggcauucaagaaguagacaggacacuagcgaaagaagguauuaagaggggcgaaacagaccaccaugcgguuucaagagggucagcaaaauuacgaugguuuguugagcgaaauaugguuacgccugagggaaagguggucgacuuagguugcgggcgcgguggauggucuuauuauuguggcgggcucaaaaacgucagagaagugaaaggacuaacuaaaggaggaccuggucaugaagaaccaauaccaaugaguacguauggauggaaucucguacgacuucaaucagguguugauguguucuucaccccuccagaaaagugcgauacauuauuaugugauauaggugaaaguucaccaaacccgaccauugaagcaggacgaaccuugcgcguucuaaaccucguugaaaauuggcuaaauaauaauacucaauuuugcaucaagguguuaaaucccuacaugcccucaguuauugagaaaauggaggcccugcaaagaaaguauggcggagcgcuugugcgaaauccacuaucaagaaacagcacacacgaaauguauugggucucaaaugcaacuggaaacaucguuagcucuguaaauaugauaagucgaauguuaauuaaucguuucacaaugaaacacaagaaagccacauaugaaccugauguagaccuaggaaguggcacaagaaauauuggaauugagagugaaauccccaaucuagauauaauaggaaagagaauagaaaagauaaaacaagaacaugaaacgucuuggcacuaugaccaagaucacccguacaaaacgugggcauaccauggcucuuacgagacgaaacagacgggaucagcaaguagcauggugaacggaguaguucgccuacuaaccaaaccaugggauguaguaccaauggugacccaaauggcgaugacggauacgacaccuuuuggacagcagagaguuuuuaaagaaaaaguagauaccaggacucaagaaccaaaagagggaacaaagaaacuuaugaaaauaaccgcagaaugguuguggaaagaauuaggcaaaaagaaaacaccgagaauguguacucgagaagaauuuacgagaaaagucaggaguaacgccgcguugggggccauuuucacagaugaaaacaaauggaagagugcgagagaagcgguggaagacgguagguuuugggagcuaguagauagagaaagaaaucugcauuuagaagguaagugugaaacaugcguuuauaacaugaugggaaaaagagaaaagaaacuaggagaguucgggaaggcaaaagguagccgagccauaugguacauguggcuaggugcuagauucuuagaguucgaagcccuaggcuuucuuaacgaagaucauugguucucgaggggcaacaguuugucaggagucgaaggggagggacuacaccgauugggcuauauucuacgggacguagggaagaaagaaggaggggcaauguaugcagacgacacagcugggugggauacucgaauaacuuuagaagauuuaaagaacgaagaaaugguaacaaaccauaugaaaggcgagcacaagaaacuagcagaagcaauuuuuaaauuaacauaucaaaacaaaguaguuagaguacagcgaccgaccccgagaggcacagugauggacauuauuucaagacgugaccagagaggauccggacaaguagguaccuaugguuuaaauacauuuacuaauauggaagcucaacuaauacgccaaauggaaggugaaggaauauucaaaaguauacaacauuuaaccgccacagaagagauagcaguccagaacuggcuagcaaggguugggcgagaacgguugagucguauggcaauaucaggagacgacuguguagugaaaccgauugacgacagauuugcuagcgcacuuacagcuuuaaaugauaugggaaaagugcgcaaggacauccagcagugggaacccaguagaggauggaaugacuggacacaaguuccuuuuugcucccaccacuuucacgaguuaguaaugaaagaugguagaguacuugucguacccugccgcaaccaggaugaguuaauaggcagagcaagaauaucucagggagcugguuggucuuuaaaagaaacugcuugucuugggaaaagcuaugcacaaauguggacauuaauguauuuucaucgccgagaucuccgcuuggcggcuaacgcgauauguagcgcugucccgucccacugggucccaacuucucguacaacaugguccauccacgcgaaacacgaauggaugacgaccgaagacaugcuagcaguauggaauaggguauggauacaagaaaacccuuggauggaagauaagacucccguagaaucaugggaagagguaccuuauuuagggaagcgugaggaccaaugguguggaucacuaauuggguuaacgaguagggcuacuugggcuaagaacauacagacugccauaaaucaaguucgcagucuaauugggaacgaagaguauacagauuauaugccuucaaugaaacgauuccgaagagaagaagaagaagcuggaguuuuaugguaa

SEQ ID NO: 22388 - RNA, 9876 nt, Artificial Sequence
  derived and/or modified CDS sequence (opt6) from DENV-2__FJ390391__SS-prME
acugcuggugugauagucaugcucauaccaacugcuauggcuuuccaucuaaccacgcgaaacggagaaccgcauaugauuguaggaaggcaagaaaaagggaaaagucuacuauucaaaacagaggauggaguuaacaugugcacgcuuauggcgauagauuugggcgagcucugcgaggacacuaucaccuauaaauguccauuacugcgucagaaugagccugaagauauagacugcugguguaacuccacauccaccugggucaccuauggcacauguaccacaacaggagaacauagaagggagaaaagaucagucgcauuggucccacacgucgguaugggauuagagacgagaacugaaaccuggauguccagugaaggugcauggaagcacguccaacguauagaaaccuggauauuacgucacccaggcuucacaauaauggcagcuaucuuagcauacaccauagguaccacgcauuuccaacgugcguuaauuuuuauuuuauuaacugcgguggccccuucuaugacuaugcguuguauuggcauaagcaaccgugauuuuguugaagguguuucuggaggaucauggguagacauaguucuagaacacggcagcuguguuacaacuauggccaaaaauaaaccaacuuuagacuuugagcuaauaaaaacugaagccaaacaacccgccacucuuagaaaguauugcauagaggcaaaguugacuaauaccacgacagaaucuagguguccaacacaaggggagcccaguuugaaugaagaacaagauaaaagauuuauauguaaacauagcauggucgaccgcggauggggaaauggauguggacuauucggcaaaggugggaucguaacuugcgcaauguucacaugcaagaaaaauauggaagggaaaguuguucagcccgaaaaccuagaguacacuauuguuaucacaccgcauagcggugaagaacacgcaguugguaaugauacaggcaaacauggcaaagaaauaaaaauaacaccucaaucgucaauaaccgaggccgaauuaaccggcuauggaaccguaacaauggagugcagcccgagaacugggcuggauuuuaacgaaaugguacuucuucaaauggaagacaaggccuggcucguacaucgacagugguuucucgaucuccccuuaccauggcugccgggugcagacacucaaggaucaaauuggauucaaaaagagacucuuguuacuuuuaaaaauccacaugccaagaaacaagacguaguaguccuaggaagucaagaaggagcaaugcacaccgcgcuuaccggcgcaacggagauucaaaugagcuccgggaaucugcuguuuacuggacauuugaaaugucgacuuagaauggacaagcuacaacuaaaaggaaugucauauucuauguguacaggaaaauucaaaauaguaaaagagauugcagagacgcaacauggaaccauagugauaagagugcaauacgaaggagauggcucaccuuguaagauacccuuugagauaacagaucucgagaaacgacauguacuaggcagauuaauaacaguaaauccaaucguaacugaaaaagacucuccaguaaacauugaagcggaaccaccuuucggagacucauacaucauaauagggguggaaccuggacaguuaaaauuaaauugguuuaagaaagguagcaguauuggacagauguuugaaaccacaaugcguggagcuaaaagaauggccauucuaggugauacagcaugggauuuugguucccuaggagguguauuuacuuccauaggaaaagccuuacaucaaguuuucggagcgaucuauggagccgcguuuagcggaguuagcuggaccaugaaaauucucauaggaguaauaauaacauggauagggaugaacucuagaucaacaagucuuucaguaagucuagucuuggucggaguugucacacuauaccuuggugccgucguacaagcagacuccggauguguagugucauggaagaauaaggaacucaaaugugggucaggaauauucauuaccgauaauguucauaccuggacagaacaauacaaauuccaaccagaaucacccuccaaacuagcauccgcaauucaaaaggcgcaugaagaggggaucuguggcaucagaucaguaacaagauuggaaaaccucauguggaaacagauaaccccagaauuaaaucacauucuaucugaaaaugagguuaaauuaacuauaaugacuggggauauuaaagguauaaugcaggcaggaaagagaucacuccgaccucagcccacagaacuuaaauacucuuggaaaaccuggggaaaggcgaagaugcugaguacagaaagucauaaucaaacauuuuuaauugauggccccgagacagcggaauguccgaacacaaaucgugcguggaauagcuuagaaguagaggauuauggcuucgggguauucaccacuaacauuugguuaaaauuaagagagaagcaggacguauucugcgacucuaaacuuaugucugcagcgaucaaagauaaccgagcaguucaugcugacaugggauauuggauugaaucagccuuaaacgauaccuggaaaauggagaaagccuccuuuauagaggucaaaucgugucauuggccuaagucucauacguuauggucuaacggcguucuagaaagugaaaugaucauucccaaaaauuucgcaggcccagugucacaacacaauuauaggccgggcuaucacacacaaacagcugguccauggcacuuagguaaauuagagauggauuucgauuuuugcgagggaacaacagugguaguuacagaagauuguggaaaccgagguccaucguuacgaacaacuacugcaucaggaaaacuuauaacggaaugguguugccgaucaugcacauuaccaccuuuacgauaucggggagaagauggauguugguauggcauggaaauccgcccucuaaaagagaaagaagaaaacuuaguuaacucuuuaguaaccgcgggucauggucaaauagacaauuucucccugggcguacuaggaauggcccuauuccuagaagaaaugcuuagaacaagaauuggaacuaagcaugcaauacuccuuguagccguguccuuuguaacacugauuacagguaacaugucuuuuagagaucuuggacggguuauggucauggugggagcgacuaugaccgaugacauuggcauggggguaacuuaucuagcacuuuuggcagcauucaaaguccggccaaccuucgcggcagggcuccuauuaaggaaguuaacaucaaaggaauuaaugauggcuacuauaggcauagcccucuuaagucaaucuacuauaccagaaacaauauucgaacugacagaugcauuagcauuggggaugaugguucucaaaauagugcgcaauauggaaaaauaccaacuagccguaacaauuauggccauuucaugcguacccaaugcagugauauuacagaaugcguggaaagucucauguacaauauuagcagccgucagugugaguccccucuugcuaacguccucgcagcaaaaggcugauuggauaccguuggcauugacgaucaagggcuuaaauccaacugcaauauuuuugacuacuuuaucgcgaaccaguaagaaaagaucauggccacuuaaugaagcaauuauggcuguagguaugguuucuauccuugcaaguucucuguugaaaaaugauauuccaaugacgggaccauuaguagcaggagggcugcuaacuguaugcuacguuuuaacugggcgaucagcagauuuagagcuagaacgugcggcugacguaaaaugggaagaccaagcagaaauaucagggucaagcccaauucuaucaaucacaauuucugaagacgguucgaugucuaucaaaaaugaggaagaagaacaaacccuuacgauuuuaauuagaacuggauuacuuguaaucucaggcguuuucccaguuucuauuccaauaacagcagcugcuugguauuuaugggagguaaagaagcaacgcgccggaguuuuaugggacguaccuucaccuccuccaguggaaaaggcugaacuugaggauggugcguauagaaucaaacaacgugguauacuaggauacagucaaauaggugcggguguuuauaaagaaggaaccuuccauaccauguggcauguaacacgaggugcaguucuaaugcaucggggaaagaggaucgagccaucgugggcggacgucaagaaagaucuaauaucauauggagggggcuggaaacuugaaggugaauggaaggaaggcgaagaagugcaaguccuagccuuagaaccgggaaagaacccaagagcuguacaaaccaaaccgggaauauuuaaaacaaauacgggaaccaucggagcagugagucuugauuucucucccggaacuagcgggagccccauuguagauaggaagggaaaaguaguuggucucuaugguaacggcguagugacuaggucgggagcuuauguauccgcaauagcgcaaacugaaaaaucuauagaagauaauccagaaauugaagaugauauuuuuagaaagaaacggcuaacuauaauggacuuacauccgggagccggcaaaacaaaacgauauuuaccugcaauagucagagaagcaauaaaaagaggucugagaaccuugauuuuagcaccuacacgagucguugcagcugaaauggaagaagcguuacguggauuaccaauaagguaccaaaccccagcaauaaaaacagaacauacaggucgugaaauuguagacuugaugugucacgcgaccuuuacaaugagauugcugagcccugucaggguacccaauuauaaccuuauaaucauggacgaagcccauuucacagacccugcuaguauagcagcacgaggguauauuaguacuagaguggaaaugggugaggccgcugguauauucaugacagcuacaccaccaggaucacgagauccauucccucaaaguaacgcaccgaucauggaugaagaaagagagauaccugaacgaucguggaacucuggucaugagugggucacugauuuuaaaggaaaaacaguaugguucgugccaaguaucaaggcagggaaugacauugccgcuuguuuacggaaaaaugggaagaaagugauacaacucagccgcaagacauucgauucggaauauguaaaaacuagggcaaaugacugggauuucguaguaacuaccgauauaucagaaaugggggcaaacuuuaaagcugaacguguaauagauccaagaagauguaugaaacccgugauuuuaacugacggagaagaaaggguaauucuggcuggaccuaugccuguaacucacaguuccgcagcacaacgaagaggaaggauagggagaaacccaaagaacgaaaaugaccaauauaucuacaugggagagccccuugaaaacgacgaagauugcgcucauuggaaagaggcaaaaauguuguuggacaacauuaauacuccggaggguaucauaccaaguauguuugaaccggaacgugagaaaguagaugcaauagauggcgaauaccguuuaagaggagaagcccgaaaaacauucguagaucugaugagaaggggagaucugccaguauggcuugcuuauaagguggcugcagaagguauaaauuaugccgacagaaaaugguguuuugacggaaucaaaaacaaucaaauccuggaagaaaauauggaaguagagaucuggacgaaagaaggugagcgaaagaaauugaaaccgagguggcuggaugcacguaucuacucagauccgcuagcuuuaaaagaauuuaaagaguucgccgccggacgaaaaagccuaacacuuaaccucauaaccgaaaugggcagauuaccgacguucaugacacagaaggcaaggaaugccuuagauaaucuugcaguucugcauacugcugaagcggguggucgagccuauaaucaugcauuaucagaacugccagaaacacuagaaacacuuuuauuacugacacuccuggcaaccguuacaggaggaauauuuuuauuccucaugagcggaaaagguauaggaaaaaugaccuuagggaugugcugcauaauaacugcuucaauauugcugugguacgcacaaauucaaccgcauuggauagcggcuagcauaauauuagaauuuuuccuaauaguguuauuaauaccagagcccgaaaaacagagaacaccucaagauaaucaacuuacguacguugucaucgcaauauugacuguaguagcugcaacaauggcaaaugaaauggguuuucuagagaagaccaaaaaggaccucggguuagguucuauaacgacacaagaaagcgaaucaaauauucuggauauagauuuaagaccagcaagugcuuggacacuuuacgcaguagcaacaacuuuuguaacaccuauguugcggcauucaauagaaaauucuucagugaaugucucccugacagccauagcaaaucaagcuacgguacugaugggauuaggcaaaggguggccauuaucgaaaauggacaucgggguuccccuacuagcgaucgguuguuacagccagguaaauccuauaacucuaacggcggcguuguuauuauugguugcucacuaugccauuauuggacccggauuacaagcaaaagccacaagggaagcucagaaacgagcagcagcuggaauaaugaaaaauccuacaguggaugggaucacggugauugacuuggaaccuauaccuuacgauccuaaguucgaaaagcaauugggucaaguaaugcuucugauuuuauguguuacacaaguguuaaugaugagaacaaccugggcacuuugugaagcacuaacauuagcaacaggaccaauaagcacacuuugggaaggaaacccaggcagauucuggaauacuacaauugcugugucuauggcaaacauauuccgaggcucauaucuugcaggagcuggauuauuauucucaauaaugaagaacaccacaucaacacgaagagggacaggaaauauaggugaaacacucggagaaaaguggaagucgagauuaaacgcccuugguaaaagcgaauuucagaucuauaagaaaagcggcauucaagaaguagaccguaccuuagcaaaagaaggaaucaaacgaggagagacggaucaccacgcggugaguagggguucagccaaauuacgaugguuuguagaaagaaauaugguaacaccggaaggaaaaguaguggaccuaggauguggcagaggaggguggagcuauuacugcggaggacugaaaaauguuagagaaguuaaagggcucacuaaggguggccccggacaugaagaaccaauccccauguccacauacggcuggaauuugguuagacuucagucugggguagauguauucuuuacgcccccagaaaaaugcgacacuuuauugugcgauauuggugaaucgucacccaacccaacaauagaagcagggcgaacucuacgcgugcuaaauuuaguagaaaacugguuaaauaacaacacgcaauuuuguauaaaaguacucaacccguauaugccuagcguuauugagaaaauggaagcucuacaacgacaguaugguggggccuuagugcgaaacccgcucaguagaaauuccacacaugagauguauuggguuucaaaugcaacaggaaacauugugucaucuguaaauaugauaagcagaaugcuaaucaauagguuuacaaugaaacauaagaaagccacguaugagccggauguugacuugggcucaggaacccggaauaucggaauagaaaaugaaauucccaacuuagauauuauugguaaacgcaucgagaaaauuaaacaggaacacgaaaucaguuggcauuacgaccaggaucauccauacaaaacaugggccuaucauggcaguuacgaaaccaaacagacuggaagcgcaucaagcaugguuaacggugucguccgacuacuuacaaagccgugggacgugguaccaaugguaacacaaauggcuaugacagauacaacaccuuuugggcaacaaagggucuuuaaagaaaaaguagauacucgaacgcaggaacccaaagaagguacuaagaaauuaaugaaaauaacagcggaaugguuguggaaagaacuggggaaaaagaaaacuccaagaauguguacucgagaggaguucacuaagaaaguuagaucuaacgcagcguuaggagcaauauuuacagaugagaauaaauggaaaagcgcaagagaagccgucgaggacggaagauucugggaauuaguggaucgugaacgaaaucuacaucuagaaggaaaaugugaaacgugcguuuauaauaugauggguaaaagggaaaagaaacuuggagaguuugggaaagccaaaggaagucgugcgauaugguauauguggcucggugcacgguucuuagaauuugaagcacuuggauuucuaaaugaagaucacugguuuagucguggaaauucacugucagguguggaaggagaagggcuacauagacuugguuacaucuuaagggaugucgguaagaaagaaggaggggcaauguaugcugaugacaccgccggcugggauacaagaauaacguuagaagaucugaaaaacgaggagauggugacuaaccauaugaaaggagaacacaaaaagcuagcggaagccaucuuuaaacuaacauaccaaaauaaaguuguccgagugcaaagaccaaccccacguggaacaguaauggacaucauaagucgccgagaucagcgagguagcggucaagucgguacauacggacuaaauacauucacuaauauggaggcccaacuaauaagacaaauggaaggugaagguauauucaaaucgauacagcaccuaacagcaaccgaggaaauagcgguccaaaauugguuagcaagggucggaagagagaggcuuucuagaauggcuauaagcggugaugauuguguaguuaagccaauagaugacagauuugcguccgcucuaacagcguuaaacgacaugggcaaaguacggaaggauauacagcaaugggaaccgucaagaggauggaaugacuggacgcaggucccuuucuguucccaucauuuucacgaauuaguuaugaaagauggccgaguucuaguagugccaugccgaaaccaagacgaacuuauuggucgagcaaggaucagccaaggcgcaggauggucauuaaaagaaacagccugccuggguaaaucuuaugcacaaauguggacccuaauguacuuccauagacgagauuuacggcuugcggcuaacgcaaucuguucugcaguaccuucacauuggguccccacuucaaggaccacgugguccauucaugccaaacaugaauggaugacaacagaggauaugcuggcgguauggaauagagucuggauucaagaaaauccuuggauggaagauaaaacaccuguagaaucaugggaagaagucccauacuuaggaaaacgcgaagaucaauggugugggagucugauaggacuuacgagucgggccacaugggcuaagaacauacagacagcaauaaaccagguaagaagucuuauagguaaugaagaauacacagauuacaugccguccaugaaacgauucaggcgagaggaggaagaagccggaguccuaugguaa

SEQ ID NO: 22389 - RNA, 9876 nt, Artificial Sequence
  derived and/or modified CDS sequence (opt6) from DENV-2__FJ882593__SS-prME
acagcuggaguuauaguaauguuaauaccgaccgcaauggcauuccaccugaccacacgaaacggugaaccucauaugauuguagggagacaagaaaaagggaaaucauuacucuucaaaacggaagauggcgugaauauguguacauugauggcuauagaucuaggcgaauuaugcgaagacacuauaacauacaaauguccgcuacuacggcaaaacgaacccgaagacauugacuguuggugcaacucaacaagcacaugggugacguauggaacuuguacuacuaccggcgaacaucgacgggaaaaacgcaguguggcacuuguaccccauguagggaugggacuagaaacaaggacggaaacuuggaugaguagugaaggagcguggaaacacguccaaagaauagaaacauggauucuaagacaccccggcuuuacgauaauggcagcaauauuagcauacaccaucgguacaacgcauuuccagagagcauuaauauuuauacuccuaacagcuguagcucccucuaugacgaugagaugcauaggaauuaguaaucgagauuuuguugaaggaguaaguggcggcucauggguagauauugugcuagaacauggcaguugcguuacaacaauggccaaaaauaaaccaacauuagacuuugaacuuaucaaaacagaagcaaaacagccagcaacauuaagaaaauacuguauagaagcaaaacuuaccaacaccacaacagaaucuagaugcccaacacaaggcgaacccaguuuaaacgaagaacaagauaaaagauucauauguaaacauucgaugguagaccgagguuggggaaacgguugcggauuauucggaaaaggagggauagucacuugugcaauguuuacguguaagaaaaauauggaagguaaaguagugcaacccgaaaauuuagaauacaccauugugauaaccccucacucuggcgaagaacacgcgguagggaacgacaccggcaaacauggaaaagaaauaaaaauaacaccacagaguucgauuacugaagcggaacuaaccggguaugguacggugacaauggagugcagcccacguacaggauuagauuucaaugagaugguauugcuucaaauggaggauaaagcguggcuagugcauaggcaaugguuccuagaucuaccacuuccgugguuaccaggagcugacacacaggaaaguaauuggauacaaaaagagacacuuguaacuuuuaaaaacccacacgccaagaaacaggauguaguugucuugggaucacaagaaggagcaaugcacacagcucucacaggagcaacugaaauucaaauguccucaggcaaucucuuguucacuggucaucuaaaaugccgcuuacgaauggacaaacuacagcugaaggguaugaguuauucuauguguaccgguaaguuuaaaauuguaaaagaaauugcagaaacccagcaugguacaauuguaauccgaguacaguaugaaggcgaugguagcccguguaaaauucccuucgaaauaacagauuuagagaaaagacauguccucgggagauugauuacugugaauccuauugucacagaaaaagauaguccagugaacauugaggcugaaccuccauucggagauuccuauaucaucauaggugucgaaccaggucaacuuaaacuaaacugguuuaagaagggaucgagcauugggcaaauguucgaaacaacgaugcggggugccaaaaggauggcuauccuaggugauacagcuugggauuucggcucacuagguggagucuucacgucuauaggaaaagcacuucaccaagucuuuggcgcgauuuauggggcagcguuuucggguguaucauggacuaugaaaauuuugauaggcguaauaauaacauggauuggaaugaauagucguagcacgagucuaagugucucuuugguauugguagguguggugacgcuguaccuaggagcugucguucaagcagacagcggauguguggugaguuggaaaaauaaagaacuaaaauguggaucaggaauauuuauaacggacaacguccauacuuggacagaacaauauaaauuucaaccagagagcccaagcaaacuagcaucggcaauucaaaaagcacaugaagagggaaucugugguauucguaguguuacacgacuugaaaaucugauguggaaacaaaucacaccggagcuuaaucauauucugagcgaaaaugaagugaaacuaacaauaaugacaggcgacauaaaagggaucaugcaagcggguaagagaagucuacgaccucagccgacagaauuaaaauauuccuggaagacuugggggaaggcaaaaauguuaucaacagaaagccacaaucaaacguuuuugauagauggaccggaaacagcagagugccccaacacuaaucgugcuuggaacucauuagaaguggaagacuauggauucggaguauuuacaacaaauauauggcuaaaacuucgagagaaacaggauguuuucugugauuccaaguuaaugucugccgcaauuaaagacaacagggcaguacaugcggauaugggcuacuggauagaaagcgcguuaaacgauaccuggaagauggaaaaggcuaguuucauagaagucaaaaguugucauuggccuaagucccauaccuuauggucuaacgguguacucgaguccgaaaugauaauacccaaaaacuuugcgggaccagucagucagcauaauuaucgaccagguuaccauacacaaacagcuggaccuuggcacuugggaaaacucgaaauggacuuugauuuuugugaaggaacaaccguggucgucaccgaagacugcggcaauaggggaccgucauugcggacaacuacagccagugggaaguuaaucacggaaugguguuguagguccugcacucuuccuccucuacguuauagaggggaagacggaugcugguaugggauggagauuaggccguuaaaagagaaagaagaaaacuuaguaaauucucuaguuacggcuggacacggacaaauagauaauuuuucauuaggcguauuaggaauggcguuguuuuuggaagaaauguuaagaacccgcauuggaacuaaacacgcgauauuacucguagccguuucuuuuguaaccuuaauaacgggaaacaugagcuucagagaccuaggccgagugaugguuaugguuggggcaacaaugacggaugauauagggauggggguuacguaucuugcauuacuagcagccuuuaaaguucguccaacguucgcagcaggacuucuguugaggaagcucaccagcaaagaacucaugauggcuacaauaggcauagcucuacuuucucaaucgacgauaccagaaacaauauuagagcuaacggaugcauuagcucuagguaugaugguauuaaagaucgugcgcaacauggaaaaauaucaauuagccguaaccauaauggccauaaguugcgugccuaaugcagucauacuucaaaaugcuuggaaagugaguuguacaauccuggcagccgugagugucagcccguuauuauuaaccucuucacaacaaaaagcagauuggaucccauuagcccucacgaucaaagggcucaaccccacugcaaucuuccuaacgacacuaagcagaaccagcaagaaaagaaguuggccguuaaacgaagcuauaauggcaguugggaugguuucaauauuagcaucgagucuauuaaagaacgauauaccaaugacuggaccucugguugcaggaggguugcucacaguauguuauguuuuaacagggcgaucagcagacuuagaauuggaaagggccgcagacguaaaaugggaggaucaggcugaaauaucuggcagcucaccgaucuugucaauuacgauaucugaagauggcuccaugagcaucaaaaaugaagaagaagaacaaacucucacuauuuuaauccguacaggacuucuaguuauaaguggaguauucccuguaucaauuccgauuacugcugcagcaugguaccuuugggaggucaagaaacagagagccggcgugcucugggacguacccucuccaccacccguugagaaagcggagcuagaggauggagcauaucgaauuaagcaaaggggcauacuaggauauagccaaauuggggcgggcguauauaaagaaggaacuuuccauacaauguggcauguuaccagaggugcaguucuaaugcauagaggaaaaagaauagaaccuaguugggcagaugucaaaaaggauuuaauaucuuauggcggaggauggaaauuagaaggagaguggaaagaaggcgaggagguacaaguauuagcacuagagccaggcaaaaauccgagagccgugcaaacgaaaccuggcauuuucaagacaaauacugguacgauaggugcaguuucacucgauuuuucuccagggaccucaggaaguccuaucguggaucguaaaggcaaaguuguuggccucuacgggaauggagucguaacccguucaggagcguacguaucagcaauagcgcaaacagaaaagaguauugaagacaauccugaaauugaagaugacaucuucagaaagaaacgccuaacuaucauggaucuacauccaggcgcgggcaaaaccaaaagauaucuaccagcaauugugcgugaggcuauaaaaaggggauugcgaacacuaauauuagccccgaccagaguaguagcagcugaaauggaagaagcacuuagaggccuacccauaagauaccaaacaccagcaauaaaaaccgagcauaccggaagagaaauaguugacuuaaugugucaugcaacguucacgaugcguuuacuaucuccaguacgagugccaaauuacaaccugauaauaauggaugaagcucauuucacggauccagcauccauugcagcaagaggauauauauccacgcgaguugaaaugggcgaagcagcagguauauucaugacagcaacaccgccuggaucccgagauccuuuuccgcagaguaacgcaccaauuauggacgaagaacgugaaaucccugaaaggucguggaacucaggacacgaauggguuacugauuuuaaggguaaaacaguaugguucgugccuucaauaaaagcuggaaaugauauagcagcuuguuuaaggaaaaacgggaagaaaguaauucaacugaguaggaagacguucgacuccgaguauguaaaaacucgagcaaacgacugggauuucguuguuacuacugacauaagcgagaugggugcuaauuucaaagcagagcgaguaauugauccuaggcgauguaugaaaccggugauucuaacagauggagaagaacgggugauccuggcggggccaaugccgguaacacacucgucagcggcacaaagaagggggcgaaucgggagaaaucccaaaaaugaaaaugaucaauacauuuauaugggagaaccgcuagaaaaugaugaagauugugcacauuggaaagaagccaagauguuacuugacaacauaaauacgccggaaggcaucauaccaucaauguuugagccagaaagagaaaagguggaugccauagacggagaauacagauugagaggugaagcgcgaaagaccuuugucgaucuaaugagacgcggagaucuuccaguauggcuagcuuauaaaguggcugccgaaggaaucaacuaugcagaucgaaaaugguguuuugaugguaucaaaaauaaccaaauucuagaggaaaacauggaaguagaaaucuggaccaaagaaggagaaaggaaaaagcuaaagccaagaugguuagacgcgagaauauauucugauccauuggcacuaaaagaguucaaagaauuugcugcuggaagaaaaucucuaaccuugaaccugaucacagaaaugggccguuuacccacguucaugacccagaaagcuagaaacgcucuagauaaucuagcaguauuacauacagcagaagcaggagggagagcauacaaucacgcuuuaucagaguugcccgaaacuuuagaaacccuacuucucuugacauuacucgcaacaguuacaggugguauauucuuguuucuaauguccgguaaagguauagguaaaaugacucucggaauguguuguauuauuacagcaucuauauuacuuugguacgcacagauccagccucacuggauugccgcuucuauuauacuggaguucuuuuuaauaguauuauuaauuccagaacccgaaaaacagaggacuccacaagauaaccagcuaacauacguuguaauugcuauauuaacugucguagcagcaacuauggccaaugagaugggauuuuuagagaaaacaaagaaggaucuagguuuaggaagcauaaccacucaggaaagugagucaaauauacuugauauugaucuacgcccggcaucugcauggacacuauaugccguagcgacuacuuucguaacuccgauguuaagacacuccauugaaaauagcaguguuaacgucucguugacagcaauagccaaucaagcaacugugcuuaugggacucgguaagggcuggccgcucuccaaaauggacauaggaguuccacuuuuggcaauugguugcuauucacaaguaaaucccauuacacuaacggcugcuuuacuacuacugguugcucauuaugcuauuauagguccagguuuacaggcaaaggcaacacgagaagcucagaagcgagcagccgcaggaauaaugaaaaauccuacuguagacggcauuacagucauugaucuggaaccaauacccuacgaccccaaauuugaaaaacaacuaggacaaguaaugcuacuaauauuaugugucacacaaguucuaaugaugcgcacgacaugggcuuuaugugaggccuugaccuuagccaccggacccauaucaacgcucugggaagggaacccagguagauucuggaauacaaccauagccguaagcauggccaauaucuuucgagguucuuauuuagcuggugcaggucuucucuuuucaauuaugaaaaauacuacuagcacgcgucgaggcacagguaauauaggcgaaacacuuggcgaaaaauggaaaagcagacuaaaugcguugggaaaguccgaguuccaaaucuauaagaaaucagguauccaggagguggauagaacauuagcaaaagaagguauuaaacgaggagaaacagaccaucacgcaguuagucgaggaagugcuaaacucagaugguucguagaacgaaauaugguuacuccagaaggaaaaguuguugacuuggguuguggaagaggagguuggucuuauuacugcggaggauugaaaaacguaagagaaguaaagggccuaacgaagggaggaccaggucaugaagaaccgauaccgaugagcacauacggauggaacuuaguaagguuacaaagcgguguagauguguuuuucacaccuccugaaaaaugugacacucuacugugugacauuggagaaucaucaccgaauccgacaauagaagcaggacgaacauuacggguuuugaauuuggucgaaaacugguuaaacaauaacacucaauucuguauaaaaguuuugaaucccuauaugccauccguaauagagaaaauggaggcuuugcagcgucaguaugguggagcacucguacgaaauccacucucucgaaauucaacacacgaaauguacugggugucuaacgcuacagggaauauaguaucaucaguaaauaugauuucacgaaugcuuauaaauagguucacuaugaaacacaagaaagcaacguacgaaccagaugucgauuugggaucaggaacacguaacauaggaaucgaaucugaaauccccaauuuagauauaauuggcaaaagaauagagaaaauaaagcaagagcacgaaauauccuggcauuaugaucaggaucauccuuauaagacaugggcuuaucacggauccuaugaaacaaagcaaacugguagcgccaguucaaugguaaauggcguagucagauuauugaccaagcccugggaugucgucccuaugguaacacaaauggcuaugacagacacaaccccuuuuggccaacaaaggguuuuuaaagaaaaaguugacacaaggacacaagaaccgaaagagggcacaaagaaacucaugaaaauaaccgcugaaugguuauggaaagaauuaggaaagaagaagacacccagaauguguacucgugaggaguucacuaagaaagucaggagcaaugcugcauuaggugcaauuuucacagaugaaaacaaguggaaaagugcccgcgaagcuguugaggacggaagguucugggaauuaguagaucgggaaagaaauuuacaucucgaaggcaaaugcgaaacauguguauauaauaugaugggcaaaagagagaagaaacuaggugaauuuggaaaagcaaaaggaucuagggcgauaugguacaugugguugggagcaagauuuuuagaguucgaagccuuaggguuccuuaacgaagaccacugguuuucacgaggaaacucgcugagcggagucgaaggcgagggacugcaccgucuagguuauauacuccgcgaugucggcaaaaaggaaggaggagcaauguaugcagaugauacggcagguugggauacaaggaucaccuuggaagaucugaaaaacgaagagaugguaaccaaucacaugaaaggagagcauaaaaaguuagcagaagcaauauucaaguuaacauaccaaaauaagguuguacguguacaaagaccaacaccgcgugggacagucauggacaucauaucacgaagagaccaaaggggaucuggccaaguagguacuuacggcuuaaacacauucacuaauauggaggcccaauuaauacgucaaauggaaggugagggaaucuuuaaaaguauucaacaucuuacggcgacagaagagauagcagugcaaaauuggcucgcacgagugggaagggagagacuaaguaggauggcuauaucaggggaugacugugucgugaaacccauagaugauagauucgccagugcguuaaccgcgcuuaacgauauggguaaaguaagaaaagacauucaacaaugggagccaucuagagguuggaaugauuggacacaaguacccuucugcucgcaccacuuccaugagcugguuaugaaggacggucgaguuuuaguugugccaugucgcaaccaagacgaguuaauagguagggcgcgaaucagucaaggagccgguuggucccuuaaagagacggcuugccuaggaaaaagcuaugcacaaauguggacacuaauguauuuucacagaagagacuugcgacuggcugcgaacgcaauuuguucggcggucccaagccauuggguacccacaagcagaacaacaugguccauacacgcaaagcaugaauggaugacaacagaagauauguuggcugucuggaaucgaguguggauacaggagaauccauggauggaagauaaaacaccaguugaaucaugggaagaaguuccauaccuagguaaaagagaagaucaauggugcggcucacuuauugggcugacuucccgugcgacaugggcaaagaauauacagacagcaaucaaccaaguacgaucauuaauagguaacgaagaguauacugauuauaugccaagcaugaaaagauuuagacgagaagaagaagaagcaggcguccuaugguaa

SEQ ID NO: 22390 - RNA, 9876 nt, Artificial Sequence
  derived and/or modified CDS sequence (opt6) from DENV-2__FJ182014__SS-prME
acugcggggguaauaguuauguuaauaccaacggcaauggcauuucacuuaacgaccagaaauggggaaccucauaugauuguagggagacaagaaaaagguaaaagucuacuguucaaaacagaagaugggguaaauauguguacccuuauggcgauagaucugggagaauuaugcgaagacacaauaacuuauaaauguccauucuugcgccaaaaugaaccggaagacaucgauuguugguguaacucaacaaguacauggguuacauauggaacguguacgacuacgggugaacauagaagagagaaaagaucagucgcuuuagucccgcauguaggaaugggauuagaaacgagaacagaaacauggauguccagugaaggcgcguggaaacauguucaacgcaucgaaacguggauccuuagacauccuggguuuacuauuauggccgcgauauuagcauacacaauuggcacgacacacuuucaaagagcucucauauuuauauuguuaacagcuguagcaccaucaaugacaaugcgauguauagguauauccaauagggacuuuguagaaggggucucaggaggcagcuggguagauaucguuuuagaacacggaucaugcguaacaacgauggcuaaaaacaaacccacccuugauuuugaacucauaaaaaccgaagcuaaacaaccagcaacacuacgaaaauauugcauugaagccaaauugaccaacaccacaaccgaaucaagauguccaacgcaaggagaacccucccuaaacgaagaacaagauaaaagguucaucuguaaacacucaaugguagaucgagguuggggcaacgguugugguuuauuugguaaaggggguauuguaacuugcgcgauguuuacgugcaagaaaaauauggaaggaaaaguuguccagccugaaaacuuagaauauacaaucgucauuacuccacauucaggcgaagaacaugcaguagggaacgacacaggaaaacaugguaaagaaauaaaaaucacuccgcagagcucaauuacggaagcugaacuaaccggauauggaacuguuacgauggaaugcaguccucgaacuggcuuagacuucaaugaaauggucuuauuacaaauggaagauaaagccugguuaguacaccgacagugguuuuuggauuugccauuaccuugguuaccuggugcagauacucaaggcuccaauuggauacagaaagaaacccuaguaacauucaaaaauccacacgccaagaaacaggacguggucguucuuggaagccaggaaggagccaugcacacugcauuaacaggggcaacagaaauucaaaugagcagcgguaaucuucuuuuuacuggacaucuaaaaugccguuuacgcauggacaaauuacaacuaaaaggaaugucuuacaguauguguacuggaaaauuuaaaauaguaaaagaaauagccgaaacgcaacacggaacgauuguuauucgcguacaauaugaaggagauggcagcccuuguaaaaucccuuucgaaauuacagaccuugagaaacgucacguuuuaggaagacuuauaaccguaaauccuauaguaaccgaaaaagauagcccagucaacauagaagcugagccgccauucggagacaguuacauuauuauuggaguggaaccgggacaacuaaaacuaaacugguuuaagaaagguaguucgauuggacaaauguuugagacaacaaugagaggagcaaaacguauggcaauacuuggcgauacagcaugggauuuugguucucuaggagggguuuucacaagcauaggaaaagcauugcaccaaguguuuggggcgaucuauggugcugcauucaguggcgugucauggaccaugaaaauacuuauuggggucauaaucaccuggauaggaaugaacucacgaucaacaucacuuucgguaucuuuaguuuuagugggcguuguaacauuauauuugggagcaguugugcaggcagacagcgguuguguagugagcuggaaaaacaaagaauuaaaaugcggauccgguauuuuuauaacggauaauguacauacauggacagagcaauauaaauuucagccggaaucuccuucgaaacuagcaucggcuauccaaaaagcacacgaagaaggaauauguggaauacgauccgucacgagauuagagaaucugauguggaaacaaaucaccccugaauuaaaucauauauuaagugaaaacgaaguuaaacugacaauaaugacaggugauauaaaaggcauuaugcaggcggguaaaagaagccuucggccacaaccaaccgaauuaaaauauucguggaaaacuuggggcaaagcaaaaauguuaucuacggaaucgcacaaucagacuuuucuaaucgacgggccggaaacugcugagugcccgaacacaaacagagcauggaacucauuagaaguggaagacuauggguuuggcguuuucacgaccaauauuuggcuaaaacuccgugagaaacaagacguauuuugugauucgaaauuaaugagcgcggcuauaaaagacaacagagcaguucaugcagauaugggauacuggauagaaagugcacuaaaugacaccuggaaaauggaaaaggcuucuuucauugaaguaaagucaugucauuggcccaaaucgcauacucuauggucuaaugggguauuagagucagagaugaucauaccaaagaauuuugcagguccaguaucccaacauaacuaccguccaggauaccauacgcaaacagcaggcccuuggcaucucggaaaacuugaaauggauuuugauuuuugugagggcacaacaguuguaguaaccgaagacugcggaaauagaggaccgucacuaaggacaacaacagcaagugguaaguugaucaccgaguggugcugccguaguuguacacugccuccgcuucguuaucgaggugaggacgguuguugguacgguauggaaaucaggcccuuaaaggaaaaagaagaaaaccuggugaacaguuuaguaacugcaggccauggacaaauagauaacuuuucauugggagucuugggcauggcguuguuccuagaagagaugcugagaacacgaauaggaacaaaacaugcuauacuuuuaguugccgugagcuuuguaacguuaauaacuggaaauaugucauucagagaucuaggacggguaaugguuauggucggugcuacaaugacugaugauauuggcauggguguaacuuaucuggcauuacuagccgcuuucaaagugagaccgacuuuugcagcaggacuauuguuaaggaaacugaccaguaaagaguuaaugauggccacaauaggcaucgcacuccuuucucagucaacaaucccugaaaccauucucgaacuuacagacgcccuugcacuuggaaugauggucuugaaaauaguccgaaacauggaaaaauaucagcuggcaguuaccauaauggcuauaucaugcguaccaaaugcuguaauauuacagaaugccuggaagguaucuuguacuauauuagcagccgugaguguaaguccauuacuauugacuucuucucagcagaaagcggacuggauaccgcuagcucuuacgauuaaaggcuugaacccaacugcgaucuuccucacuacgcuaagcagaaccaguaagaaaagaaguuggccguuaaaugaagccaucauggcuguuggcaugguuucaaucuuggccaguucccugcugaaaaaugacaucccgaugacugguccgcuaguugcuggaggacuuuuaacggucugcuacguuuuaacaggucguucggcagaucuugaguuagagagggcugcagaugucaagugggaagaucaggcugagaucucaggaucaucgccaauauuaucgauaauuauaucggaagacgggagcaugucaauuaagaaugaggaagaggaacaaacauuaacgauacuaauaagaacaggucucuuaguaaucaguggagucuuuccaguuucuaucccaauaacggcugcagcaugguaccucugggaagucaagaaacagagagcggggguuuuaugggauguaccgucuccuccaccaguagaaaaagcugaacuagaagauggagccuauagaauaaagcaacgaggaauauuaggauauucacaaauaggagcaggaguauauaaagaaggaaccuuccauacuauguggcauguuaccagaggggcuguuuuaaugcaucgagggaaaagaauugaaccuuccugggccgaugucaagaaagaccucauuucauacgguggagguuggaaguuagagggugaauggaaagaaggugaggaaguucagguccuggcuuuagaaccuggcaaaaauccaagagcaguccaaacgaaaccaggaauauuuaaaacaaacacuggaacaauaggcgcagugagccuagacuuuucaccaggcacgagcggauccccgauaguggaucgcaaggggaaagucguuggauuauauggaaauggcgucguuacuagaucaggagcauaugugucggcaauugcgcaaacggagaaaaguauagaggauaacccagaaauagaagacgacaucuuucgcaagaaacgucuaaccauaauggaccugcacccaggugcgggaaagacuaaaagauaccugccugcgaucguuagagaagccauuaaacgaggauugagaacauuaauccuggcuccuacucggguuguugcugcggaaauggaagaagcgcuacgaggacuaccgauucgauaccagacacccgcuauuaagacagaacauaccgggagagaaauaguggaucuuaugugccaugcuaccuuuacgaugagacuucucaguccugugcgaguaccaaauuacaaucuaauuauaauggacgaagcacauuucacagauccugcaucgauagccgcucgaggguacauaaguacgagaguugaaaugggagaagccgcaggcaucuuuaugacagcaacgccaccaggcucucgagacccguuuccccaaagcaacgcgccaauuauggaugaagaacgagaaauaccggagcgcaguuggaacagugggcaugaaugggugaccgacuuuaaaggcaaaaccguuugguucguuccaucuauaaaagcuggcaacgauauagccgcauguuuacguaaaaacggcaagaaaguaauucaauuaagucguaaaacauuugauagugaguacgucaagacucgagcaaaugauugggauuucguuguaaccacugacauuagugaaaugggggcuaacuuuaaagcagaacgagugauagacccaaggcgguguaugaaaccaguaauucugacagacggggaagaacgggugauucuggcugguccaaugcccguaacacauaguuccgccgcacaaagaaggggucgaauuggaagaaaccccaaaaaugaaaacgaccaguacauauauaugggagaaccuuuagaaaaugaugaagacugcgcacacuggaaagaagcaaaaauguuguuagauaacaucaacacgccagaagguauuaucccaagcauguuugagccggaaagagaaaaaguugacgcgauagauggcgaauauagauugcgaggagaggcucgaaagacguuugucgacuuaaugagaagaggagaccuaccaguauggcucgcguauaagguagccgcugaggggauaaacuaugcggacagaaaguggugcuucgaugguauaaagaacaaccaaauccuagaagagaauauggaaguggaaaucuggaccaaagaaggggagcgaaagaaauuaaaaccgagguggcuugacgcucggauuuauagcgauccucuagcacuuaaagaguucaaagaauuugcagccggccgcaaaagucuuacacuaaacuuaauaacagagaugggcaggcuuccuacguuuaugacacaaaaagcaagaaacgcauuggauaaccucgcgguuuuacacacugcggaagcuggugguagagcauauaaccaugcauuaucagaacucccggagacucucgaaacgcuacuguuauuaacauuguuagccacaguuacgggaggaauauuuuuguuucugauguccggaaaagguauagggaaaaugacccuaggaaugugcuguauuaucaccgcuucuauacuucuaugguaugcucaaauucaaccccauuggauugccgcaucaauuauacuugaauuuuucuugauaguguuacuaauccccgaacccgagaaacagcguacaccacaggacaaccaacuaaccuaugucgugauagcaauacuaaccgugguagcagcaacuauggcuaaugaaauggguuuucuagagaaaaccaagaaagaccuaggauugggaaguauaacuacucaagaaagugaauccaacaucuuagauaucgauuuacgaccugccucagcuuggacacucuaugcugucgccacaacuuuuguuacaccuaugcugcggcacagcauugaaaacagcaguguaaauguuagccuaaccgccauugccaaccaagccaccguacuaaugggccucggcaaaggauggcccuuaucaaaaauggacauagguguacccuuguuggcaauaggaugcuacucacaaguuaacccuauaacucuuacagcagcauuacuucuuuugguggcacauuaugcaaucauugggccuggauugcaggcgaaagcuacacgggaagcacagaagagagcugcagcaggcaucaugaaaaauccaaccguggauggaauuaccgugauugauuuagaaccgauaccuuacgauccuaaauuugaaaaacagcuaggacagguaaugcuauuaauacucuguguaacacagguguuaaugaugagaaccacuugggcacuaugugaagcucucacuuuagcaacugguccuauuucuacucuaugggaagguaauccuggaagauucuggaauacuacaauagcuguauccauggcaaacauuuuucgaggaagcuaccucgcgggagcaggauugcuuuucucuauaaugaagaauacuacaucgacccgaagggguacgggcaauauaggagaaacucuuggagaaaaauggaaaucacgauuaaaugcuuugggaaaauccgaguuccagauauauaagaaauccggcauucaggaagucgacagaacucuagcuaaggaagguauuaagcguggagaaacggaccaucacgcugucucucguggaagcgccaaauuacggugguuuguagagcgcaauaugguaacaccggaagguaagguuguugaccuuggaugcggacgaggaggcuggaguuauuauuguggggguuugaaaaauguaagggaaguaaaagguuuaacaaaaggcggaccaggacaugaagaacccauccccauguccacauacggauggaaucuagugcgacuucaaaguggcguugauguauucuuuacuccaccagaaaaaugugacacgcuacuaugcgauaucggugaauccagcccaaauccuacuauugaggccggucgaacccugagaguauugaaccugguugaaaacuggcuuaacaacaacacucaauuuuguauaaagguucuaaaucccuauaugcccucuguuauugaaaagauggaagcgcuucaaagacaguacggaggcgcuuuaguaaggaauccgcuaucaagaaacucaacccaugaaauguacugggucucaaacgcgacagguaauauuguaaguucaguaaauaugauuucucgaauguuaauaaaccgauucacuaugaaacauaagaaagccacauaugaaccugauguugacuugggauccggaacaaggaauauaggcauugaaucagagauaccaaaccuagauaucauaggcaagaggauagagaagauaaaacaggaacaugaaauaaguuggcauuaugaucaagaccacccauauaagacaugggcauaccaugggucuuacgaaacuaagcagacagguuccgcaucaaguaugguaaacggaguggugcgguugcuaacaaaaccaugggacguugucccaaugguaacucagauggcaaugacugauacuacgcccuucggacaacagagagucuuuaaagaaaaaguagauacgagaacucaagaaccuaaggaggguacuaagaaacuaaugaagauaacagcggaauggcuguggaaagaacuaggcaagaagaaaaccccaagaaugugcacuagggaagaauuuaccaagaaaguaaggucaaacgcggcacuaggcgcaaucuuuacugacgaaaauaaauggaaaagugcaagggaagcaguugaggacggaagguuuugggagcuaguagacagagaacggaauuuacauuuagaaggaaaaugcgaaacaugcgucuauaauaugaugggaaaacgugagaagaaacuaggcgaguucgggaaggcuaaggguucccgugccauaugguacaugugguuaggggccagguuucuggaauuugaggcacuaggcuuccucaacgaggaccacugguucucuaggggaaauucucuaucugguguggaaggugaggguuuacauaggcuaggauauauucuaagggaugucggcaagaaagagggcggagcgauguaugcugacgauaccgcaggaugggacacucguauaaccuuagaagauuugaaaaaugaagagaugguuacaaaccauaugaaaggagaacauaagaaacuagcagaggcuauauucaaauuaacauaccaaaacaaaguaguaagagugcaacggccuacuccucguggaacuguaauggacauuauaucacgcagggaccagcgagggagcggccaggugggcacguaugguuuaaauacuuuuacaaauauggaggcucaacuaauaagacaaauggaaggagaggguauauuuaagucaauacagcaucugacugcaaccgaagaaauugcaguacagaauuggcuugcacguguaggaagagaacgccuuucuagaauggcaauaaguggugacgauugcguagugaagcccauagaugauagauucgcaucagccuuaacagcauuaaaugacaugggaaaaguacguaaggauauucaacaaugggaaccgagucgaggguggaacgauuggacacaaguuccuuuuuguucgcaucauuuucacgaauuaguaaugaaagauggaagagugcucguagucccauguagaaaccaggacgaauuaauaggacgugcaagaauuucacaaggagcuggauggucguuaaaagaaaccgcuuguuugggaaaaucauaugcgcaaauguggacguuaauguauuuucaucgacgagauuuacgacuagcugcgaacgcgauuuguagcgcagucccaucacauuggguaccaacauccagaacaacauggucaauacaugcuaaacacgaauggaugacuacugaagacauguuggcgguauggaacagggucuggauacaagaaaacccuuggauggaggacaaaacgcccguagaaucuugggaagaaguccccuaucuaggaaaaagagaggaccaguggugcggcaguuuaauaggccucacaagccgagcaacuugggcuaagaauauacaaacagcuauaaaucaaguacgauccuugaucgguaaugaagaguauacggauuauaugcccaguaugaaacgauucagaagggaagaagaagaggcugguguucuuugguag

SEQ ID NO: 22391 - RNA, 9876 nt, Artificial Sequence
  derived and/or modified CDS sequence (opt6) from DENV-2__FJ547090__SS-prME
acugcaggcgugauugucaugcuaauucccacagcgauggcuuuucauuuaacaacacggaauggugaaccacauaugaucgugggacgccaagaaaaagggaaaucccuauuguuuaaaacugaagauggaguaaauaugugcacauuaauggcuaucgauuuaggggaacuaugugaagacacaauaacguacaaauguccccuucugagacaaaacgaaccugaagauauugacuguuggugcaauaguacuucaacuuggguaacauauggaacauguacgacaacaggugaacauaggcgugagaaaagauccguggcccuaguuccacacguagggaugggacuagaaacuagaacagaaacuuggaugucuucagaaggugcauggaaacacguccaacgcauagaaacauggauauuaagacauccgggguuuacaaucauggcugcuauauuggcauacacuauuggaaccacacacuuucaacgagcacucauuuucauucuucucacagcuguugcaccgaguaugacuaugcguuguauaggaauaucaaacagagacuuuguugaaggcgugucggguggauccuggguagacauaguacuagaacauggguccuguguuacaacgauggccaaaaauaaaccaacauuagacuucgaacuuauuaaaaccgaagcaaaacaaccugcaacuuuacgaaaauauugcauagaagcuaaacuuacaaauacuacuacggaaaguagaugccccacacagggggaaccgucacuuaaugaagaacaagacaaaagauuuauuuguaaacauaguaugguugaucgaggaugggggaauggcuguggacuguuuggaaaaggagggauaguaacgugugcuauguucacaugcaagaaaaauauggaaggaaaaguagugcaaccggaaaaccuagaauauacgaucguuauaacaccacauagcggagaagaacacgcaguaggcaaugacacggguaaacaugguaaagaaaucaaaauaacaccucaaaguuccauuaccgaagccgaauuaaccggcuacggcacuguaacuauggaaugcucaccgagaacuggguuggauuucaaugaaauggucuuauugcagauggaagacaaggcuuggcugguccaucggcaaugguuccuggaucugccacugcccuggcuaccaggagccgauacacagggauccaacuggauacagaaagaaacccuaguaacauuuaaaaacccacaugccaagaaacaagaugugguuguuuuaggcucccaggaaggagccaugcacaccgcacuuaccggugcgacugaaauccagaugaguagcgggaaucuacuauucacaggccauuugaaauguaggcuaagaauggauaaacuccaauuaaaaggaauguccuacucaauguguacuggcaaauuuaaaauaguaaaagaaauagcagaaacacagcacggcacuauaguaaucagaguacaauaugaaggcgacgggagcccguguaaaauaccguucgaaaucacggaccuagaaaaacgacauguccuaggccgauuaauuacaguuaauccaauaguuaccgaaaaagauucaccaguuaacauugaagcugaaccuccuuuuggugauucauacaucauaaucggaguugaaccaggccaacuuaaacuuaauugguucaagaaaggaagcaguauugggcaaauguuugaaacuacuaugagaggugcuaaacgaauggccauauugggagauacagcaugggauuuuggauccuuaggagggguauucacuuccauaggcaaagcacuacaucaagucuuuggggccauuuauggugcagcuuuuucaggcguaaguuggacuaugaaaauauuaauugguguaaucauuacuuggauuggaaugaacagcagaagcacuucguuaagugucucacuuguucuaguggguguagugaccuuauaccuaggugcugucguccaggcagacucaggauguguagugucauggaagaauaaggaacugaaaugcgguucaggcauuuuuauuacggacaauguacauacauggaccgaacaguauaaauuucaaccagaaucuccuucuaaacuagcgagugccauucaaaaagcacacgaagaagguauuugcggaauuagaagcgucacaagauuagagaauuuaauguggaagcaaauaaccccagaacuaaaccauauccucagcgagaaugagguaaagcucacaauaaugacaggagauauaaaagggauaaugcaagccggaaaacgaagucugcguccacaacccacugaacugaaauauaguuggaaaacauggggaaaggcgaaaaugcuaaguacugaaagccauaaucaaacauucuugaucgaugggccagaaacagcagagugcccgaacaccaauagagcguggaacaguuuagaaguggaagacuauggauuuggcguguucacaaccaacauaugguuaaaacugcgcgaaaaacaggacguauuuugugauucuaaguuaaugucggcgacaauuaaagauaacagagccguccaugcagacaugggauauuggauugaaagcgcccugaaugacacguggaaaauggaaaaagcaucuuuuauagaggucaaaucaugucauuggccuaaaucacacacucuguggucaaauggaguuuuagaaagugaaaugauaauaccuaaaaauuuugcugguccuguaucacagcauaauuauagauuggguuaccacacucagacugcaggcccuuggcauuugggaaaacuugaaauggauuuugacuuuugugaaggaaccacaguuguaguuacagaagauugcgggaaccgaggacccagcuuaaggacuacaaccgcaucaggaaaacuaaucacggagugguguuguagaucgugcacauuacccccucuaagguacagaggagaggauggauguugguaugguauggaaauucgaccacuaaaagagaaagaagaaaauuuagugaacucucuugugacagcugggcacggacaaauugauaauuucagucucggaguacucgggauggcauuauuucuugaagagaugcuaagaacgagaauagggacaaaacaugcuaucuuauuagucgcggucagcuuuguaacuuuaauuacuggaaauaugucauuucgggauuuaggacgaguaauggucaugguaggggcaaccaugacagaugacauuggaaugggugucaccuacuuagcguuacuagcagcauuuaaagugaggccaacauucgcagcagggcuauuacuaaggaaauuaacuucaaaagaacuuaugauggcaacgauugggauagcauuauuaagucagucuaccaucccggagacuauauuagaacuaacagacgcacucgcacuagguaugaugguguuaaaaauaguuaggaauauggagaaguaucaauuagcaguaacuauuauggcuauuucuugcguaccaaaugcggucauacuacaaaaugcguggaaagucagcugcacuauauuggcggcaguauccguaucgccauuauugcuuaccucaagucaacaaaaggccgauuggauuccacuggcacuaaccauuaaaggacuuaacccaacugcgauauuuuuaacaaccuuaagccggaccaguaaaaagaggucuuggccucugaacgaagcaauaauggccgugggcaugguaaguauucuugccucaucauuacugaagaaugauaucccuaugacugguccuuuaguagcuggagggcuuuugacuguaugcuacguucuaacuggacgcucugccgaucuagagcucgagagagcugccgauguaaaaugggaagaucaagcagagauaucaggcucauccccuauuuugaguauaacaauaucagaagacgguucaaugaguaucaaaaacgaagaagaagaacaaacccuuacuauccucauaaggacugggcuauugguaauaucaggaguauuuccuguaucaauacccauaacggcagcagcgugguauuuaugggaagucaaaaagcaacgugcaggaguuuuaugggacguaccgaguccacccccugucgaaaaagcagagcuugaagacggagcauaccgaauaaaacagcguggaauauugggauacagucaaauuggagccggugucuacaaagaaggcacauuucacacuauguggcauguaacucggggcgcaguuuuaaugcauagagggaaaagaaucgaacccucaugggccgacguuaagaaagaucucaucagcuacggagguggguggaaacuagaaggagaauggaaagagggagaagagguucaaguacuugcauuagaaccaggaaagaacccacgagcaguucaaacgaaaccaggcauauucaagacuaauacaggcacuauuggagcuguuagucucgacuucagcccgggaacaagugguuccccaauaguggaucguaaaggcaaaguuguaggauuauaugguaauggaguagucacucgcaguggggcauauguaucggcgauugcgcaaaccgagaaaaguauugaagauaauccugaaauugaggacgauauuuuucguaagaagaggcuaaccauaauggaucuacauccaggugcugggaaaacuaaaagauauuuaccggcgauuguucgcgaagcuaucaaacgaggcuuaagaacguuaauauuagcuccaacacgaguuguggcggcugaaauggaagaagcccugcguggccuuccgauaagauaucagaccccggcaauuaaaacagaacacacagguagagaaauuguugaccugaugugucaugcuacauuuacgaugagauuacuuucacccguuagaguaccuaauuauaaucuuauaauaauggaugaagcccacuucaccgacccggcaaguauagcagcaaggggauauauuucgacgagaguagagaugggagaagcggcugguauauucaugaccgcuacaccuccggguaguagagacccauucccacagucaaaugccccaauaauggacgaagaaagggagauaccggagaggaguuggaacucugggcacgaauggguaacugauuuuaaaggcaagacgguaugguuuguaccaucaauaaaagcaggcaaugacauagcagcuugcuugaggaaaaaugggaaaaagguuauucaacuuuccaggaaaacuuuugacucagaauaugugaaaacccgugcaaacgauugggacuuuguugugacuacugauauuuccgaaaugggugccaauuuuaaagcggaacgggugaucgauccacgaagauguaugaagcccguuauuuuaaccgacggcgaggagcggguuauauuagcuggaccuaugccggugacacacagcagugcagcucaaaggcgcgggagaauaggaagaaacccuaaaaaugagaaugaccaguauauuuauaugggagagcccuuagaaaacgacgaggauugugcgcauuggaaagaagccaaaauguuauuagauaacauuaauacaccagaaggaauuaucccaagcauguucgaaccagaaagggaaaaaguagaugcaauugauggggaguauagacuccguggugaagcgcgaaaaacuuucguugauuuaaugagacgaggagacuugcccguauggcuugccuauaaaguagcggcggaaggaauaaacuaugcggauaggaaauggugcuucgaugggaucaaaaauaaccaaauccuagaagaaaacauggaaguagaaaucuggacaaaggaaggugagcgcaagaaauuaaaacccagaugguuggaugcuagaauuuauagugacccucuggccuugaaggaguucaaagaauuugcugcagggagaaagucucugacacuaaauuugaucacagagaugggucgacucccuacauucaugacacaaaaagccagaaaugcauuagacaaccucgcaguguuacauacagcugaagcaggagggagggcauauaaucaugcauugagugaguuaccagaaacacuugaaacuuuguuacucuuaacuuugcuagccacaguuacgggcgguauuuuucuauuccuuaugaguggaaaagguauuggaaaaaugacucucggaaugugcugcauaauuacagcaaguauauuguuaugguacgcacaaauucagccgcauuggauagccgcuucaauuauccuagaguucuuucugaucguccuuuuaauuccagaaccagaaaagcaaaggacuccacaggauaaucaguugacuuauguuguaaucgcaaucuuaacgguugucgcagccacaauggcaaaugaaaugggauuuuuggagaaaacaaagaaagauuuaggguuaggguccauaacuacacaagaaagcgaaagcaacauacuagacauugaccugcgaccugcgucggccuggaccuuauaugcaguugcgacuacuuuugugacaccaaugcuacgucacucaaucgaaaauagcucgguuaauguuagccuaacagcgauagcaaaucaggcaacaguacugaugggauuagggaaagguuggccacuuuccaaaauggauauagggguacccuugcuagcgauugguuguuacagucaggugaauccgauaacucucacugcagcucuacuguuauuagucgcgcauuacgcgauuauagguccgggccuacaggcaaaagcuacccgagaagcgcagaaaagagcugcagcggguauaaugaaaaauccaacaguagauggcauuacuguuauugaucucgaaccaaucccauaugauccaaaauucgaaaaacaguuaggacaaguaauguuguuaauccuaugcgugacgcaaguucuaaugaugagaacaacaugggcccuaugugaggcacucacuuuggcaacuggaccgauaucaacauuaugggaagguaauccaggaagguucuggaacacaaccauugcaguaucaauggcuaauauuuuuagggggucauauuuagccggugcaggguuacuguucaguaucaugaaaaauaccacaucaacacgacgggguacggguaauaucggggaaacguuaggagaaaaauggaagaguagauugaacgcauuaggcaaaagugaguuucaaauauauaagaaaagcgguauccaagaaguagaucgaacauuggcuaaagaaggaauuaaaagaggggaaacggaucaucacgcuguaucaagagguagugcgaaguuacggugguuuguagaaagaaacaugguaacacccgaagguaaaguaguagaccuagguugcggcagaggcggguggucguacuacugugggggacuuaaaaauguaagagagguaaaaggacuaacuaaaggaggcccuggucaugaggaaccuauaccaaugucgacguauggauggaauuuaguuagauuacagucuggcguggacguauucuuuaccccacccgaaaagugcgauacacugcuuugcgacauaggugagucaagccccaacccaacaauagaagcaggcaggacucucagaguauuaaacuugguggaaaauuggcuaaauaauaacacucaauucuguauuaaaguccugaauccguacaugccgagcgugauagagaaaauggaagcauuacaacgacaauacgggggcgccuuaguucgcaacccacuuucacguaauucaacccaugaaauguauugggugucaaaugcgacaggaaauauuguaucgucaguaaacaugauaucuagaauguuaauaaaucgauuuacaaugaaacacaagaaagccacauaugaaccagacguagauuuggguaguggaacuaggaacauugguauagaaucugaaauaccaaaucuagauauaauaggaaagcggauagagaaaauaaaacaagaacaugagauuucguggcauuaugaccaagaucacccguacaaaaccugggcuuaucacgggucguaugagacaaaacaaacgggaucggcaucgucaauggugaaugguguggugcgguuacugacaaagccuugggacguggugccuaugguuacucaaauggcgaugacagauacgacaccauuuggacagcagagaguauuuaaggagaaaguggacacacgaacacaggaacccaaagagggaacaaagaaacuuaugaagauaaccgcagaauggcuguggaaagagcucggcaagaagaaaacaccacgcauguguacacgcgaagaauuuacuaagaaaguccgcucuaaugcagcacuuggcgcuauauucacggacgaaaauaaauggaagagugcaagggaagcaguugaagauggaagauuuugggaacucguagaccgugaaagaaaucuccaucuagaaggaaagugugaaacuuguguuuauaacaugaugggaaagcgagagaagaaauuaggagaguucggaaaagcaaaaggcagcagggcuauaugguacauguggcuaggagccagauuuuuggaguucgaagcacucggcuuucuaaacgaagaccacugguuuucacgaggaaacagccucaguggaguagaaggugaagguuuacaucgauuagguuacauucugcgcgacguugguaagaaagaaggcggugcaauguaugcggaugauacagcuggaugggacacccggauaacguuagaagauuuaaagaaugaagagaugguuacuaaucauaugaaaggagaacacaagaaacuagcugaagccauauuuaaauuaacauaucaaaacaagguuguaaggguacaacggcccacuccacgcgguacaguuauggacauaauuaguagaagggaucaacgugguuccggccaaguaggaacuuacggauuaaacacauuuacuaauauggaagcacaguugauaaggcagauggaaggagaagggauauuuaaauccauucagcauuugacggcuacagaagagauugcuguacaaaacuggcuagccagaguagggagagaaagauuaucgaggauggcgauaucaggcgaugacugcguaguuaaacccauagacgauagguuugccagugcccucacagcucuaaaugacaugggaaagguuaggaaagacauucaacaaugggaacccagccgaggcuggaaugacuggacacaagugccguucuguagucaucauuuucaugaauuaguuaugaaagaugguagagugcuuguagucccauguagaaaccaagacgaauugaucgguagggcucggauaagccaaggagcugguugguccuuaaaagagaccgcaugccuugguaaaaguuacgcacaaauguggacacuuauguauuuucaccgcagagacuuacgacuugcagcaaacgcaauauguagcgcgguuccuucucauuggguaccuacuucgagaacaaccuggucaauacacgcuaaacaugaguggaugaccacugaagauauguuagcaguuuggaaucgagucuggauacaagaaaauccauggauggaagauaagaccccaguugagaguugggaagaagucccauaccuagguaagagagaagaccaaugguguggaucauuaauuggguugacaagcagggcaacuugggcaaagaacauacaaacagcaaucaaucagguuaggagccugauuggaaaugaagaauauacggauuauaugccguccaugaaaagauucaggcgcgaagaagaagaagcugggguucucugguga

SEQ ID NO: 22392 - RNA, 9876 nt, Artificial Sequence
  derived and/or modified CDS sequence (opt6) from DENV-2__EU482630__SS-prME
acagcaggaguuauaguuauguuaauuccuacugcuauggcauuucauuuaacgacgagaaauggagagccucauaugauaguaggaaggcaggaaaaagggaaaucccuacuauuuaaaacagaagacggaguaaauauguguacauuaauggccauagauuuaggagaauugugugaggauaccauaacuuacaaaugcccguuccuuaggcaaaaugaaccggaagacauagauuguuggugcaacucuacaagcacgugggucacuuaugguacauguacaacaacgggugaacaucgucgggagaaaagaaguguugcucuaguaccacauguaggaaugggccuggaaacuaggacugaaacguggaugaguucugaaggagcuuggaaacauguucagaggauagagacauggauacuaaggcaccccggcuucacaauaauggcggcgauccuagcguauacgauaggcaccacucacuuccaacgggcgcuaauauucauuuuauugacagcuguagcaccuaguaugacaaugaggugcauaggaauaucaaacagagauuuuguugaagggguuagcggcggaucauggguggauauuguauuagagcaugguucaugcguaacgaccauggcaaaaaauaaacccacucuugacuuugaacuuaucaagaccgaagcgaagcagccagcgacauugagaaaauauugcaucgaagcaaaacuaacuaauacuacaacagaaagcagauguccuacucagggagaaccuucucuaaaugaggagcaagauaaaagauuuaucuguaaacacaguaugguugacagaggauggggaaauggcugcggcuuauucgguaagggaggaauaguuacuugcgcuauguuuacauguaaaaaaaacauggagggaaaggucguacaacccgagaaucuagaauacacaauugucaucacaccacacuccggggaagaacacgccguagggaacgacacagguaaacacgguaaagagaucaaaaucaccccacagaguaguauuaccgaggccgaacugacaggauaugguacagucacgauggaauguucgccacguacaggguuagacuuuaacgagaugguacugcuucaaauggaagauaaggcgugguugguacacaggcaaugguucuuagauuuaccccugccaugguugccaggagcagacacccaaggaucaaacuggauucagaaagaaacucuaguaacuuuuaaaaacccgcacgcgaagaaacaagauguaguaguacuuggcucacaggagggugcgaugcacacggccuuaacaggggccacagagauucagaugagcucuggcaaccuucuuuucacaggacaucuuaaguguaggcuaagaauggauaaauuacaauuaaaaggaaugaguuauucuauguguacaggaaaauucaaaauaguuaaagagauagcagaaacucagcaugguaccauuguuauaagagugcaauaugaaggagacggcucaccuuguaaaauuccauucgaaauuaccgauuuagaaaaaagacacguauuaggccgauugauaaccguaaauccuauuguaacugagaaagauuccccaguuaauaucgaagcagaacccccuuuuggcgacucauauauuaucauagguguagaaccagggcaguugaaauugaacugguucaaaaaaggcaguucuauaggucaaauguucgaaacaacuaugaggggagcuaaacgcauggccauucuaggugacacugcaugggauuuuggauccuuaggaggaguguuuacaaguauaggaaaagcauuacaucaagucuucggugccauauauggugcugcauucaguggaguaagcuggacaaugaaaauucuaauagguguuauaauaacauggauaggaaugaauucaaggucaacgagccuuucgguaucuuugguccuuguaggugucgugaccuuauaccuuggagccgugguucaggcagauaguggauguguagugaguuggaaaaauaaagaauuaaaaugugguucaggcauuuuuaucacggacaacguucauacauggaccgaacaauauaaauuccaaccugaaucuccaagcaaacuugcuucagccauucagaaagcucaugaagaaggaauuugcggaauuagaucagucacccgguuggaaaacuuaauguggaaacagauaacgccagaauuaaaucacauauugucagagaaugaagucaaguuaaccauuaugacgggugauauuaaggggauaaugcaggccggaaaacggucacugcguccccaaccaacugaauuaaaauauucauggaaaacuuggggaaaggcuaaaaugcuuaguaccgaaucucauaaccagacauuucucauagacggcccagaaaccgcugaauguccuaauacaaaucgcgcauggaauucuuuagagguugaagacuacggguuuggggucuuuaccacuaauaucuggcuuaaacuacgagaaaaacaagacguauucugcgauucgaaauuaaugucagcugcuauaaaggacaacagagccguacaugcagacaugggauauuggauagagucagcauugaaugacacauggaaaauggaaaaagcaagcuuuauugaaguuaaaucgugccacuggccaaaaucacauacacuuugguccaaugggguuuuagagagcgaaaugaucauaccaaaaaacuucgcuggaccuguaucacaacacaauuaccgaccagguuaccauacacaaacagccgggccuuggcaucuaggaaaauuagaaauggauuuugauuucugcgaaggaacaaccguagucgucacagaagauuguggaaauagagggccaucucuuagaaccacgacggcaucagguaaauuaauaacagagugguguuguagaucuugcacacuaccuccgcugagguacaggggugaagaugguuguugguauggaauggaaauuagaccccugaaggaaaaagaggaaaaccuagucaauucucugguuaccgcaggacacggacaaauagauaauuucucacuagguguacuggguauggcucucuuuuuagaagagauguuaaggacacguauagguacgaaacaugcaauucuguugguggcagucaguuuuguaacgcuaauaacagggaauaugucguuccgugaucuggguagaguuauggucaugguuggagcaacaaugacggaugauaucggcauggguguaaccuacuuagcacuucuugcugccuuuaaaguaagaccgacauuugcagccgguuugcugcucagaaaauuaacuaguaaagaauuaaugauggcgaccauagguauugcuuuauugucacaaaguacuauuccugagacgauacuugaacuaacugaugcuuuggcauugggcaugaugguguugaaaauaguaaggaacauggagaaauaucaauuagccgucacgauaauggcuauuucauguguaccaaacgcaguuauucuacaaaaugcauggaaaguaucauguacuauucuggcagcaguaucuguuucaccauuauuguuaacgaguagucaacaaaaggcagacuggauacccuuagcguugacgauaaaagggcuaaauccuaccgcuauuuuuuugacaacucuaucacgcacauccaagaaaagauccuggccucucaacgaagcaauaauggccguugggaugguuagcauacuugccaguucucuucugaaaaaugauauacccaugaccgggccauuaguagcaggcggacugcuaacuguauguuacguacuaacuggucgaucugcagaucuagagcuggaaagggccgcugacguaaaaugggaagaccaggcagaaauaaguggcaguagcccaaucuuaucgauuacaauaucugaagacgguucgaugucaauuaaaaacgaagaagaggaacaaacuuuaacaauuuuaauacguaccggauuauuaguaaucucgggaguauuuccagucaguauuccaauuacagcagcagcaugguaccuaugggaagugaaaaaacaacgagccggaguccugugggacguaccuuccccaccaccagucgaaaaggccgaacucgaagauggugcauauagaauuaaacagagaggaauucugggauacagccagauaggugcagguguguauaaagaagguacauuucauacaauguggcacgugacaagaggagcggucuuaaugcaucgggguaaaagaauugaacccuccugggcagacguaaaaaaagaccucauaucuuacggaggcggauggaaacucgagggagaauggaaagaaggagaggaaguacaagucuuagcccuugaaccagguaaaaauccgagggcagugcaaaccaagccaggaauuuuuaagacaaacaccggaacaaucggugcugucucacuagauuucucaccugguacaagcggaucuccaauuguagacagaaaaggaaaaguuguaggacuuuauggaaauggugugguaacucgaucaggagcauauguuucugccauugcucaaaccgaaaaaucaauagaagauaauccagaaaucgaggaugauaucuucaggaaaaaaagauugacuaucauggacuuacauccgggagcagguaaaacaaaacguuacuugccggcgaucgucagagaggccauaaagcggggauuacgaacgcucauccuagcacccacucgaguaguggcagcagaaauggaagaggcgcuccguggcuugccaaucagauaccaaacaccagcaaucaagacggaacauacagguagagaaaucguagauuuaaugugccaugccacauucacaaugcgauuacucucucccguacgcgucccaaauuacaauuuaauaauaauggaugaggcacauuucacagaucccgcaucuauagccgcaagggguuauauaaguacacgaguagagaugggugaggcugcagggaucuuuaugacugccacacccccugguucaagagauccguucccacagaguaaugcuccaaucauggaugaagaaagagaaaucccugagagaucauggaacucuggacacgaauggguaacagacuuuaaaggaaaaacugucugguuuguacccucuauaaaagcaggcaacgauaucgcggcaugcuuaaggaagaauggaaaaaagguuauccaguuaagcagaaaaacguuugauucugaauacgucaaaacucgagcgaaugauugggacuuuguugugacuacggauauaucagaaaugggugcaaauuucaaagcugaacgagugauagauccuagacguuguaugaaaccgguaaucuuaacagauggcgaagagcguguuauauuagcgggaccgaugcccgucacacauucaagugcagcucaacgacgaggacguauaggacggaauccaaagaacgaaaaugaccaauauauauauaugggggagccccuugaaaacgacgaagacugcgcgcacuggaaagaagcuaagauguuacuagauaacauaaauacuccagaaggaauaauaccaucaauguuugaaccugaacgagaaaagguugacgcuauagauggagaauauagacuuagaggagaggcacggaaaacauuugucgaccugaugcguagaggggaucugcccguauggcuagcguacaagguugcagcagaagguauaaauuacgccgauagaaaaugguguuuugauggcauaaaaaauaaccaaauauuggaagaaaauauggagguagaaauuuggacgaaggaaggugaacgaaaaaaauuaaagccuagguggcuggacgcacgcauuuacagcgacccacuagcucuaaaggaauucaaagaguuugcagcugguagaaaaucacuaacguuaaaccugauaaccgaaaugggaagacugcccacuuuuaugacucaaaaggcacgcaaugcccuugacaaucuugcgguauuacauacagcagaggcugguggcagagcauauaaucacgcgcuaagugaauugcccgaaacccuggagacguugcuauuauuaacacuacuagcaacagucacagguggaauuuuccuauuuuuaaugucagguaaaggaaucgggaaaaugacucuagggaugugcuguauuauaacagccagcauacuccucugguacgcucaaauacaaccacacuggauugcagccagcauuauacuugaauucuuccugauaguauuacuaaucccagagccggaaaaacaacgaacuccacaagacaaucagcuuaccuaugucguaauagcaauuuugacagugguugcagcuacuauggcaaaugaaaugggauuccuugaaaaaaccaagaaagacuuagggcuaggaaguauaacuacccaagagucugaaucaaauaucuuagacaucgaccuaagaccggcgagcgcguggaccuuauaugcaguagcuacgacauuugugacuccaaugcuacgacacucaauugaaaauaguucggucaauguaucacucacagcaauagcaaaucaagcuacaguucuaaugggacuuggaaaaggauggccucuuaguaaaauggauauugggguaccccuucucgcgauagguugcuauucucagguaaauccuaucacacuaaccgcugcguuacucuuauuaguagcacauuaugcgaucauagguccaggacuucaagcaaaagcgacccgagaggcccaaaagcgagcggccgcuggaauaaugaaaaaccccacuguagauggaauuacaguuaucgacuuggagccgauaccauacgaucccaaguuugaaaagcaacuuggacaaguaaugcuccuaauauuauguguaacucagguccucaugaugaggacgacaugggcacuuugcgaagcuuuaacacuugcaacagggccaauaucgacucuaugggaagguaacccagggcgcuuuuggaacacaaccauagccgucaguauggcuaacauuuuucgcgggucauauuuggcaggcgccgguuuauuauucaguauaaugaaaaacacaacgucuacgagaagggguacagguaacauuggggaaacacuuggggaaaaguggaaaaguagacuuaaugcauuaggcaaaagcgaauuucaaauuuauaaaaaauccgggauccaagaaguagauagaaccuuagcaaaagaaggaauaaaacguggagaaacggaucaccaugcagucucucggggaucagcuaaacuuagaugguuuguagaaagaaacauggucacaccagaagggaagguuguugaucuaggauguggaagaggcggauggagcuacuauuguggaggauuaaaaaaugugcgggagguaaaaggauuaacuaaaggaggaccaggucacgaagagccuauuccaaugucgacuuacggauggaaucuuguacguuugcaaucuggggucgauguauuuuuuacaccaccugagaaaugcgacacucuacuuugugacauaggagaaucuagcccaaaccccacaauagaggcaggaaggacguugagagucuuaaaccuaguggagaacugguuaaauaauaacacgcaguuuugcaucaaagugcuaaaccccuacaugccaucuguaauugagaaaauggaagcacuacaacgucaguacgguggggcucuagugcgaaauccucuaucccgaaauucaacacaugaaauguauugggucaguaacgcgacuggaaauauagugucgaguguaaacaugauaucgagaauguuaauaaacagauuuacuaugaaacauaagaaagcaacguacgagccggaugucgaucuugggaguggaacacggaacauagguauagagagugaaauaccaaaccuagacauuauagggaaacgcauagaaaaaauuaaacaagaacaugaaauaucauggcauuacgaucaggaucauccguauaagacuugggcauaucauggaucauacgaaaccaaacaaaccggaagcgcaucaucuaugguuaauggcgugguccggcuacugacaaaaccaugggaugugguucccaugguaacacaaauggcgaugacggauacuacgcccuuugggcaacagaggguuuuuaaagagaaaguugacacaagaacgcaagaaccuaaggagggcacaaaaaaauuaaugaaaaucacggccgaaugguuauggaaggaauugggcaagaaaaaaacuccuagaaugugcacccgagaagaauuuacaaaaaaaguuagaucuaaugcugcguuaggggcuauuuucacggacgaaaauaaguggaagucggcuagagaagcagucgaggauggaagguucugggaacugguagauagagagcgaaaucuccauuuagaagguaaaugugaaacaugcguauauaacaugauggguaagagagaaaaaaaacuaggcgaauucgggaaggcaaaaggaucgcgcgcaauuugguauauguggcugggugccagguucuuagaauucgaagcgcuaggcuuucuuaaugaggaucauugguuuagccgagguaacagccucucaggaguagaaggugagggucuacauagauuggguuacauucuaagggauguagggaagaaagaggguggcgcuauguaugccgaugacacggcaggaugggauacccguauaacgcuagaggauuugaaaaacgaggagauggucacgaaucacaugaaaggggaacauaaaaaacuagccgaagcgaucuucaaacuaacuuaccaaaauaaagugguacguguacagagaccgacuccacgagguacugucauggacauuauaagcagacgagaccagcgagguagcgggcaaguugguacauauggguugaacacauucaccaauauggaggcucaacuaauacgacaaauggaaggugaaggcauuuuuaaaucgauacaacauuuaaccgcaacagaagaaaucgcaguacagaacugguuagcaagaguggguagagaaagauuaagucgaauggcuauaucuggugaugauugcguaguuaaaccgauagacgaccguuucgcaagugcauuaacugcucuaaaugauauggguaaaguccgaaaagacauucaacaaugggaaccaagcaggggauggaaugacuggacacaagugccuuucuguucgcaucauuuucacgaacucguuaugaaagaugggcguguauuaguagucccguguagaaaccaagaugaguuaauaggccgcgcuaggauuucccagggugcuggauggucacuaaaagaaacggcaugccuaggaaaaucauaugcucaaauguggacacuaauguauuuccauagacgagaucuccgauuagccgcaaacgcaauauguagcgcggugccaagucauuggguuccuacaagucgaacaaccuggucuauacacgcuaaacacgaauggaugacgacggaagauaugcuugccguauggaacagaguauggauacaagaaaacccuuggauggaagauaaaacaccaguagagagcugggaagagguuccauauuuagggaagcgugaagaccaguggugcggaucucuaauagguuuaacuucucgugcaaccugggccaagaauauucagacggccaucaaucaaguucguucauuaauuggcaacgaagaauacacagauuacaugcccaguaugaaacgauucaggagagaagaagaggaagcugguguauuaugguaa

SEQ ID NO: 22393 - RNA, 9876 nt, Artificial Sequence
  derived and/or modified CDS sequence (opt6) from DENV-2__FJ882594__SS-prME
acggcuggaguaauaguaauguuaauaccuacggcgauggcauuucaccuuacaacucguaauggagaaccucacaugauaguuggucgacaagaaaaagguaaaucauugcuauucaaaacggaagacggaguaaacauguguacacuuauggcuauagauuuaggagaauuaugcgaagauaccauaacauauaaaugcccacuacugagacaaaacgaaccagaagacauagauuguuggugcaauucaacuagcacuuggguaacauauggaacuuguacuacaacgggugaacauagaagagaaaaacgaucuguugcguuaguuccgcauguaggaaugggauuagaaacacgaacugaaacguggaugaguagcgaaggugcauggaaacacguacaacgaauagaaacuuggauauuacgacauccuggcuuuaccauuauggcggcaauauuggcauacacgauuggaaccacacacuuucagcgagcccuuauauuuauacuuuugacagcagucgcaccaucaaugacgaugcgaugcaucgguauaucgaauagagacuucguagaaggugucuccggggguaguuggguagacaucgugcuagaacaugguagcuguguuacgacaauggcgaaaaauaaaccaacccuggauuucgaauuaauuaaaacugaagcaaaacaaccagccacauuacguaaauacugcauagaagcaaaacugacuaauacgacaaccgaaucacgauguccaacacagggcgaaccaucauugaaugaggaacaagacaaacgguucauaugcaaacacagcaugguagaucgggggugggguaauggcuguggacuuuucgguaaaggcggcaucguaacuugcgccauguuuacuuguaagaaaaauauggaaggaaaaguaguucagccagaaaacuuagaauacaccauuguuaucacaccacacucuggagaggaacaugcaguaggaaacgacacuggaaaacauggcaaagaaauuaaaaucacaccucaauccagcauuacagaagcagaacuaaccggcuaugggacaguuacaauggaaugcucgccaaggacaggccuagauuucaaugaaauggugcuacugcaaauggaagacaaggcuuggcugguucacagacaaugguuuuuggaucuaccauuaccuugguuaccaggagcagauacacagggauccaacuggauacagaaagagacccuaguuaccuuuaaaaacccacaugcaaagaaacaagacguugucguccuaggcagucaagaaggagccaugcauacagccuuaacaggagccacugagauucaaaugucgagugguaauuuauuguucacaggacaccuaaaauguagauuaaggauggauaaacuacaguuaaaaggaaugucauauuccaugugcaccgguaaauucaaaauaguuaaagaaauagccgaaacacagcauggaacgauaguuauaagggugcaauacgagggcgauggaucgcccugcaaaauaccuuuugaaauuacagaucucgaaaaacgucacguacuaggacgccuaauaacuguaaauccaauugucacugaaaaagacucaccugucaacauagaagcugaaccaccguuuggagauucauauauaauaauaggaguugagccaggacaauuaaaauuaaauugguuuaagaaaggaucuuccauugggcaaauguucgaaacuacaaugagaggagcaaaaagaauggcaauacuaggagauaccgcaugggacuuuggcaguuuagguggaguauucacgagcaucggaaaagcucuacaucagguauuuggugcgauuuauggugcugcauucucggguguuucauggacaaugaaaauccucaucggggugauuauaacauggauaggcaugaacucccggucaacuucacucagcguaucacugguacucguaggcguuguaacacuguaucuuggagcuaugguacaagcagauucaggauguguagucagcuggaaaaacaaagaacuaaaaugcggaagcggaauuuucaucacagauaauguacauacuuggacagaacaauauaaauuccaaccugaaagcccgucaaaauuagcuagcgccauacaaaaagcucacgaagaaggcauaugugguauacggaguguuacaaggcuagaaaaccuaauguggaaacagauaacuccagaauuaaaccauauacugucugaaaacgaaguaaaacuuacuaucaugacuggugacauuagaggaaucaugcaagccggaaaacgcucacucagaccacaaccaacagaacucaaauauucuuggaaaacaugggguaaagcaaaaaugcuaucaacugagagucauaaccagacuuucuugauagacggacccgaaaccgcagaauguccaaauaccaaccgagcauggaacagucucgagguagaagauuauggguucggaguguucacaacgaauauauggcuaaaauuacgagaaaaacaagauguauuuugcgauagcaaacuuaugucugcagcaauaaaagauaacagagccguacacgcagacauggguuauuggauagaaucugcacuaaacgacacguggaaaauggaaaaagcgucauucauagaaguaaaaucaugccacuggccgaaaagucauacacuauggaguaacggaguccuagaauccgaaaugauuauccccaaaaacuuugcaggacccguaucucaacauaauuaucgcccagguuaccacacacaaacugcagggccauggcaccuagggaagcucgagauggauuucgauuuaugugaagggaccaccguaguugugacagaagauuguggaaaucgaggucccucguugaggaccacgacggcaucugguaaacugauaacugaauggugcugcagaaguuguacucuuccgccgcuuagauaucgaggcgaagaugguugcugguaugggauggagauaagaccgcugaaggaaaaagaagaaaauuuaguaaauuccuuaguaacugcaggacauggacaaaucgauaauuucaguuuagggguacuugggauggcauuauuccuggaagaaauguuacggacuagaauagggacaaaacaugccauacuuuuaguugcaguaucauuuguaacacucaucacaggaaacaugagcuuuagagaccuugguagaguuauggugauggucggagcuacaaugacagaugacauagguaugggggucacauaucuugcauuguuagcagcuuuuaaagugcguccaacauuugcugcggggcuuuuacugcguaaguuaacaaguaaggaacucaugauggcaacaauaggaauagcauuguuaucccaauccacuaucccagaaaauauauuggaauugacugacgcccucgcacuugguaugaugguacuuaagauagugaggaauauggaaaaauaucaauuagccgucacaaucauggcuauuaguugcgugccgaacgccgucauccuucagaacgcuuggaagguuaguugcacgauucuugcagcuguaucagugaguccgcuccuauuaaccucuucucagcaaaaagcagacuggauacccuuggcuuuaaccauaaagggacugaauccuacugcaaucuuccuuacaacccuaagcagaaccagcaagaaacguagcuggccguuaaaugaagcaauaauggcagugggaauggugucaauauuagccucuucguuacugaaaaaugauaucccaaugacaggucccuuaguagcgggaggcuuauuaacagucugcuauguuuuaacaggaagaucugcagaccuugagcuagagagagcggcagacguuaaaugggaagaucaagcugagauauccgguucuucgccaauacugucaauaacgaucucagaggauggauccaugucuaucaaaaacgaagaggaagaacaaacgcuuacgauuuugaucagaacaggcuugcucgugauaucuggaguauuccccgucagcauaccaaucaccgcagcggccugguaucuaugggaaguaaagaaacagcgagcaggaguccuuugggauguacccucaccgccaccaguggaaaaagcagaguuagaagauggagccuauaggauaaaacagagaggaauacuaggcuauagccaaaucggagcugggguauauaaagaaggaaccuuccauacuauguggcacgucacgagaggagcugugcuuaugcauagagguaaacggaucgaacccucaugggcagaugucaagaaagacuuaauaaguuauggaggcggauggaaacucgaaggggaguggaaagagggagaagagguucaaguucuugcucuugaacccggcaaaaacccucgcgccguacaaacaaaaccaggcauauucaaaacuaauacuggaacaauuggagcuguuucacuagauuucagcccaggaacaucuggcuccccgauuguagacagaaaaggaaaaguggucggauuguacgguaaugguguaguaaccagaucuggugcauauguaagugccaucgcacagacagaaaaguccauagaagauaauccagagauagaagaugacauuuucaggaagaagcgauuaaccauuauggaccuacauccaggggccgguaaaacuaaaagauaucuuccugcuauugucagagaagccauuaaaagaggacuccgaacccuuauauuggcuccaaccaggguuguagcugcagaaauggaagaggcucuuagaggauuaccuaucagauaucaaacgacagccauaaagacugagcauacgggcagagaaauagucgaccucaugugucaugccacauucacuaugcgacuacuauccccaguacguguaccaaacuauaauuugauuaucauggacgaagcucauuucacggaccccgccucgauugcagcaagaggcuauauaucaacccgaguugaaaugggagaagcagcgggaauauuuaugacagcuacacccccaggcucaagggauccuuuuccccaaucaaaugcuccuaucauggaugaagaaagggaaauccccgaaagaagcuggaacaguggucacgaaugggugaccgauuucaagggaaaaacuguaugguuugugccuucgaucaaggcagguaacgacauugcagccuguuuacguaaaaacggaaagaaaguaauacaacucucacgcaaaacauuugauucugaguacguaaaaacccgcgcuaacgauugggacuuugugguuacaacugauaucucggaaaugggggcaaauuuuaaagcagaaagagucauugaccccaggcgauguaugaagcccgugauccuaacugacggugaggagcgagucauucuagcaggaccuaugccuguaacacauucguccgcagcccaacgcagaggaagaaucgguagaaaucccaaaaacgaaaacgaucaauacauuuacaugggagaaccucuagagaacgaugaagacugugcucauuggaaagaggcgaaaauguuauuggacaauauaaauacgccagaaggaauaauaccgaguauguuugaaccugagagagaaaagguagaugcaaucgacggagaguauagacucaggggcgaagcuagaaagacguucguagaucuaaugcguagaggggaucucccgguaugguuagcguacaaaguagcugccgaagguauuaauuaugcagaucggaaguggugcuuugaugggauuaaaaacaaucaaauucuugaggaaaauauggaaguggaaauuuggacaaaagaaggugaaaggaagaaacuaaaaccaaggugguuagacgcuagaauauauucugauccuuuagcguugaaggaauuuaaagaguucgcagcuggaagaaaaucucucacuuugaacuuaauaaccgaaaugggcagacugcccacguucaugacacaaaaagcuaggaacgcucuagacaaucuggcaguucugcacacagccgaagccggagggcgggcauacaaccacgcuuuaucagaacucccugaaaccuuagagacgcuccuuuuauuaacuuugcucgcaacgguuacaggaggcaucuuucuauuuuuaaugucaggaaaaggaauuggcaagaugacucuagggauguguuguauaauuacugcguccauuuuacuuugguacgcucaaauccaaccucauuggauagcggcaaguauaauuuuggaguucuuucuuaucguauuauugaucccugaacccgaaaaacaacgaacgccacaagauaaccaauuaacauacgugguuaucgccauauuaacaguuguggccgcuacgauggccaaugaaauggguuucuuggagaaaacuaagaaagacuugggcuuaggaucaauuacgacacaggaaucagaaaguaacauauuggauaucgaucuaagaccggcaucagccuggacgcuuuaugccguugcgacuacguuugugacaccgauguuacggcauucaaucgaaaacucaucuguaaacguaaguuugacagcaauagccaaccaggcuacaguucucaugggacugggaaaaggauggccauuaaguaaaauggacauaggaguuccauuauuggcgauaggcugcuauucucaaguaaauccuaucacacuaaccgcagcacuacuacucuuaguggcccacuaugcuauuauuggcccaggacuacaagcaaaagcgacaagagaagcgcagaaaagagcugcugcuggaauaaugaagaauccaaccguagauggaauaacgguuauagaccuagaaccuauaccguacgacccaaaauuugaaaaacaacugggucaagucaugcuuuuaauucugugcguuacacaaguacucaugaugcggacgacaugggcuuugugcgaggcuuuaacucuggcgacaggaccuauuucaacgcuuugggaagggaauccagggcgauuuuggaauacuacuauugcgguuagcauggcgaauauauucagaggaucuuaccucgcaggggcuggguugcuauucucuauuaugaaaaacacaacaaauacacgacgaggaacugggaacauaggugaaacccucggugaaaaauggaaaucacgauuaaacgccuuagguaaaucggaauuucaaauuuacaagaaaucaggcauacaagagguagaccgcacauuagcgaaggagggaauuaaacguggugaaaccgaucaccacgcaguuagucgggguagugcaaaacuucgaugguuuguggaacguaauaugguaacccccgagggcaaaguuguagaccuagggugcggccguggugguugguccuauuauugcggagggcucaagaacguucgugagguuaagggacucacaaaagguggcccuggacacgaagaaccaaucccaaugaguacuuacggauggaauuuaguacgauuacagaguggcguugacguauucuuuacaccaccugagaagugcgauacuuuguugugcgacauaggggaaucaucgccuaacccaacuauagaagcuggacgaacacuuagaguucuaaaccugguggaaaauuggcucaacaauaauacacaguucuguauaaaagucuuaaacccauacaugccauccguuauugagaagauggaggcauuacaaagaaaauauggaggagccuuaguccggaacccgcugagcagaaauaguacgcaugaaauguauugggucagcaaugcaacggguaacauagugucaucaguaaauaugauaucaagaaugcucauuaacagauucacuaugaaacauaagaaggcaacauacgaaccagauguagauuuaggcucuggaaccaggaauaucggaauagagucagaaaucccaaacuuagacauaaucggaaaaagaaucgagaaaauuaaacaggaacacgaggccaguuggcacuaugaccaagaccacccauacaagacaugggcguaucacgguucauacgaaacgaagcagacgggcuccgcaaguaguaugguaaacggugugguacgacugcuaacuaaacccugggauguaguaccaauggucacgcaaauggcaaugacugacacaacaccguuuggccaacaaagaguauucaaggaaaaaguggacaccagaacacaagagccuaaagaaggaaccaagaaacuaaugaagauuacggcggaauggcuguggaaagaacugggcaagaagaaaacaccacgaauguguacucgggaagaguuuacgaagaaaguaagaagcaaugcggcccuaggggcaauauucacugaugagaauaaguggaaaucggcuagggaagcuguagaagaugggagguuuugggaguuaguugaucgggaaaggaaucuacacuuagaaggaaaaugcgaaacaugcgucuacaacaugauggguaaaagagagaagaaacuaggugaauuuggacgcgcgaaaggaaguagggcaauuugguauaugugguugggagcacgauuccucgaguucgaggcacucggauuuuuaaaugaagaccacugguucucaagggguaauucacuaucugguguagagggugaagggcuccaccgacucggguauauacuucgagauguaggcaagaaagaaggcggcgccauguacgcugacgauacugcagguugggauaccaggaucacucuagaagaucuaaagaaugaagagaugguuacuaaccacaugaaaggugaacacaagaaauuagcagaagcuauauuuaaacugaccuaccaaaacaaaguugugaggguacaaagacccacacccagaggaacaguuauggauaucauaagucggcgcgaucaacgcggaucagggcaaguggguacauauggcuugaauacguuuacuaacauggaagcccagcuuauacgacagauggaaggugaaggaauauuuaaaaguauucaacaucucacggcuacagaagaaauagcaguacaaaacuggcuagcuagaguuggaagagaacgacuaucucgaauggcuauaucaggggaugauuguguaguaaaaccgauugacgauagguucgccagugcacuaacagcauugaaugauaugggaaaaguucguaaagauauacaacaaugggaacccagucgcggcuggaaugauuggacacaaguaccauucugcucgcaucacuuucaugaacucguaaugaaagauggcaggguuuuaguuguaccuugcaggaaccaagacgaauuaauaggacgggccaggauaucccaaggugcuggauggucacuaaaagaaacagcaugccuagggaaaagcuaugcccaaauguggacuuuaauguacuuccauagacgggaucugcgucuagcugcaaaugcgauuuguucggcgguacccucacauugggucccgacaaguagaacgacauggagcauucacgcgaaacacgaauggaugacaacagaggauauguuagcaguauggaaccguguuuggauccaagagaacccguggauggaagauaaaacgcccguugagucaugggaagaggucccauauuuagggaaaagagaagaccaaugguguggcagcuugaucgguuuaacgagcagagcuacaugggccaaaaauauucaaaccgcaaucaaucagguacgcagccugauaggcaacgaagaguauacagauuacaugcccagcaugaaaagauuuaggcgagaggaggaagaggcuggaguauuaugguag

SEQ ID NO: 22394 - RNA, 9876 nt, Artificial Sequence
  derived and/or modified CDS sequence (opt6) from DENV-2__FJ205885__SS-prME
accgcaggagucauaguuauguuaaucccaacugccauggcauuccaucuaacuacucgcaauggagaaccacacaugaucguggggagacaagaaaaaggaaaaucgcuucuuuucaaaacagaagaugguguuaauaugugcacacuuauggccauagaucuuggagaacuaugugaagacacaauaacauacaaaugcccuuuauuaaggcagaaugaaccagaagauauugauuguugguguaauucaacaucaacauggguaacauaugggacaugcacgacaacaggugaacaccguagggagaaaaggucaguggccuuagucccacacguaggaaugggacuagaaaccagaacugaaacuuggauguccagugaaggagcauggaaacacguccaaaggaucgaaacuuggauacuacgacacccugguuucacaauuauggcugccauauuagccuauacaauagguacaacgcacuuucaaagagcucuaauauucauacugcuaaccgcaguagcaccgucgaugacuaugcguugcauugggaucucaaacagggacuucgucgaaggagucaguggggguaguuggguagauauuguucuugaacacggaucaugugucacgaccauggccaaaaauaaaccuacguuagauuuugaauugauaaaaacugaagcuaaacaaccagccacguuacgaaaauauuguauagaagcaaaacuaacgaacacaacgacagaaucgagauguccuacccaaggugaaccuucacucaaugaagaacaggauaaaagauucaucugcaaacauucuaugguugacagagguuggggaaacggcugugggcuauuuggaaaaggaggaauuguaaccugugcaauguucacauguaagaaaaauauggaaggcaaaguaguccagccugaaaacuuagaauacacuauuguuauuacuccacacaguggggaagaacacgcagucggaaaugacacagguaaacauggcaaagaaauaaaaauuacuccgcaaaguaguauaaccgaagcagaacuuacuggguacggaacaguaaccauggaaugcaguccacgcaccggccucgacuuuaacgaaauggugcugcuacaaauggaagauaaagccuggcuaguucacaggcagugguucuuggaucucccccuacccugguuaccuggugcugacacucagggauccaacuggauacaaaaagaaacuuuaguaacguucaagaauccucacgcuaagaaacaagaugucguagucuugggaagucaagagggggcgaugcauacugcccuaaccggcgcuacagagauacaaaugagcaguggaaaccuauuauuuacugggcauuuaaagugucguuuaagaauggauaaacugcaauuaaaagguaugagcuacaguauguguacagguaaguuuaagauaguaaaagagaucgcggaaacacaacaugguaccaucguaauaaggguacaguaugaaggagauggauccccaugcaaaauuccauuugagauuacggaucuugaaaagaggcacguucuaggaaggcuaauuacgguuaacccgauuguaacugaaaaagacagcccagucaauauagaggcggaaccuccuuuuggcgauaguuauauuauuaucgggguugagccuggacaauuaaaacuaaauugguuuaaaaagggaucuucuauuggacagauguuugaaacaacuaugagaggagcaaagcguauggccauacuaggggauaccgcuugggauuuugguucauuagguggugucuuaacaucaaucggcaaggcccugcaccaaguauuuggcgcaaucuauggcgccgcguucucgggcguaucuuggaccaugaaaauacucauuggggucauaauaacauggauugguaugaacuccaggucuaccucucucucaguaucacucguauugguggguguagugacauuguacuuaggcgcuguuguucaagcugauucggguuguguaguuucuuggaagaacaaagaacuaaaaugugguucuggaauauuuauaaccgauaauguucacacuuggaccgaacaauacaaauuccaaccugaaagcccuagcaaacuggcgucagcaauccagaaagcacaugaagaggguauuugugguauacgaucaguuacacgacucgaaaacuuaauguggaaacaaauuacaccagaauuaaaccacauccugagugaaaacgaaguaaaacuuacuauuaugacaggagauauaaaagggauuaugcaagcagggaaacguagcuuaagaccacaaccaacagaauuaaaauauaguuggaaaacauggggaaaagcgaagaugcuaucuacugaaagccauaaucaaacuuuccuaauagacgguccugagacugcugaauguccuaacacgaaucgagcguggaacucauuggaaguagaggacuaugguuucggcguauuuacaaccaauaucuggcugaaacucagagagaaacaagacgucuuuugcgauagcaaguuaaugucggccgcaauaaaggacaaucgcgcugugcaugcagacaugggguauuggaucgaaucagcauugaacgauaccuggaaaauggaaaaggcaucauuuauagaaguaaaaucaugccauuggccaaaaucgcauacucuauggucaaauggaguuuuagaaagugaaaugauaauaccuaaaaauuucgcgggcccuguuucacaacacaauuauagaccagguuaucacacacaaacagcugguccauggcaucuagguaaacucgaaauggauuuugauuuuugcgaaggcacaacuguuguaguaacugaggauugcggaaacaggggaccgucacugcguacaacgacugcguccggcaaacuaauaacagagugguguugccguucaugcacacugccgccuuuaagauaccgaggugaagaugguugcugguacgggauggagauuagaccauuaaaagaaaaagaagaaaaucuaguaaauagccugguuacugcuggucacgggcaaauagauaacuuuagccuuggagugcuuggaauggcccucuucuuagaagaaaugcugcgaacaagaauugguacaaaacacgccauacuauuaguagccgucucuuucgugaccuuaauaacaggcaacaugagcuuccgagaucucggacgaguaauggucaugguuggagcaacuaugacagacgauauaggaauggguguaacauaccucgcucuacuugccgcuuucaaaguaagaccuacauuugcugcaggguuacuauuaagaaagcugacaucaaaggaacuaaugauggcaacuauaggcauugcccuacuuucucaaucaacaauaccugaaaccauccuagagcuaacggacgcucuugcauuaggcaugaugguucugaaaaucgugaggaacauggaaaaguaucaauuagccguaacaauaauggcgauuucgugcgugccgaacgcaguaauuuuacaaaaugcauggaaaguaaguugcacuauccuugcagcugugucaguuaguccucuacuauugacgucuucucaacaaaaagcugauuggauaccuuuagcauuaacaauaaaaggucuuaauccaaccgcgauauuucucacuacauuaucccgaacaaguaagaaaagaaguuggccccuuaacgaggcaaucauggcaguaggaaugguuaguauacuggcgucuucauuguugaaaaaugauaucccaaugacagggcccuuaguugcuggaggucuauuaacuguaugcuacguauuaacgggaagaucggcagauuuagaauuagaaagagcggcagauguuaaaugggaagaccaagcagagauuucuggcucaagucccauacuaaguaucacaaucucagaagacgggucaaugagcauaaagaacgaagaagaagaacagaccuuaacaauauuaaucaggacaggccugcuagugaucucagguguguuuccgguuagcauuccaauaacagcagcugcgugguaucuaugggaagucaaaaagcaaagagcuggaguguugugggauguuccaaguccaccuccuguugagaaagcagaguuagaagauggcgccuaucgaauaaaacaaagagguauauuggguuacucacaaauaggugcuggcgucuacaaggaagggaccuuccauaccauguggcauguaacaagaggggcaguuuuaaugcacagagggaaaagaauagaaccgucaugggcugaugugaagaaagaccuaaucucauacggagggggauggaaacucgagggugaguggaaagaaggagaagaaguucaaguguuagcauuagagccagguaaaaauccucgugcuguucaaacaaaaccugguaucuucaaaacgaacacgggcaccaucggcgccguuuccuuggauuuuucaccagguacaagugguucaccaauaguagaucgcaaaggaaaaguagugggcuuauacggaaaugggguaguuacucggucuggagcuuaugucucugcaaucgcgcaaaccgagaaaucaauagaagauaauccugaaaucgaagaugauauauucaggaagaaacgauuaacuauaauggauuugcacccuggcgcugggaagacaaaacgauaccuaccagcaauaguacgagaagcuauuaaaagaggauugcgaacccuuauuuuagccccuacacgcguagucgcugcugaaauggaagaagcacuuagaggccuacccauuagguaucaaacacccgcaauaaaaacugagcauacaggcagagaaauuguagauuugaugugucacgccacguucaccaugagauuacuguccccagugagggugcccaacuauaaucuuauaauaauggacgaagcacauuuuacagauccagcuucuauagcagcucguggcuauauuucaacgagaguugaaaugggugaagcagcggguauuuuuaugacagcaacaccuccgggaaguagggauccauuuccgcagaguaaugccccgauaauggaugaagaaagagaaauaccagaaagaucuuggaacucuggucaugaguggguuacugacuuuaagggaaaaacaguaugguucguaccaucgauaaaagcgggaaaugacauagcggcuuguuuaaggaaaaaugggaagaaaguaauccaacugucaagaaagacuuucgauucugaauacguuaaaacacgcgcaaaugacugggauuuuguugugacuacugauauaucagaaaugggagcaaauuuuaaagcagaaagaguuauagauccuagacguuguaugaaaccggucauauuaacggauggggaggagaggguuauauuagccggaccuaugccaguuacccauucaagugcagcccaacguagaggcaggauaggaagaaaucccaagaaugaaaacgaucaauauauauacaugggagaaccccuggagaacgaugaggauugugcacauuggaaagaagcuaagauguuacuggacaauaucaacacacccgagggaauaauuccgagcauguucgaaccugaaagggaaaaaguugacgcgauagacggcgaauauaggcuuaggggagaggcacggaaaacguuuguugaucuuaugaggaggggugauuugccaguauggcuggcuuacaaaguagcugccgaaggaauaaacuacacugauagaaaauggugcuuugauggaauaaagaauaaucaaauacuugaagaaaacauggaaguugaaauuuggacgaaagaaggagaaaggaagaaacuuaaaccacguugguuagaugcaagaaucuauucagacccacuagcacugaaagaguucaaagaguucgcugccggcagaaaaucucuaacuuuaaaccucaucaccgaaaugggacgguuaccaacuuuuaugacucagaaggcacgcaacgcacuggauaacuuggcuguuuugcauacugcagaagcaggaggacgcgcauauaaucacgcucuaucggaacugccagaaacacucgagacauuacuacuacuuacauuacucgcgaccguuaccgggggcauuuuucuguuccucaugucggguaaaggaauuggcaagaugacucuagguaugugcuguauaauaacugcuucaauucuccuaugguaugcacaaauacaaccacauuggauagcggcgaguauaauacuagaguucuuccuaauuguacuauuaauacccgaaccugagaaacaaagaacaccucaagacaaucaauugacauauguaguaaucgcaauacugacgguagucgccgcgacaauggccaaugaaauggguuucuuggagaaaacgaagaaggauuugggacuugguucaauaacuacccaggagagcgaaaguaauauuuuggauauagaccugagacccgccagcgcauggaccuuauaugcggucgcuacaacuuuuguaaccccuaugcuaagacauagcauugaaaauucaucaguaaaugucagcuuaacagcaauugcuaaccaagcgacaguccuaaugggauugggaaaaggguggccucugucuaaaauggauauaggcguacccuuacucgccauuggcugcuauucacaaguaaacccgaucacacuuacagcagcacugcuucuccucguggcucacuaugcaaucauugguccagggcugcaagcaaaggcuacuagagaagcacaaaaacgggcagccgccggaauaaugaagaacccuacaguagaugggaucacgguaauagaccuugagccuauacccuacgauccgaaauuugaaaagcaauugggucaaguuaugcugcuaauacucugugugacacaaguacuuaugaugcgcacuacuugggcauugugcgaagccuuaacacuugccacuggaccuauaucuacuuugugggagggaaaucccgguagauuuuggaauacuacuauagcugucuccauggcaaacauuuuuagaggcucauaccucgccggugcaggacuacucuucaguauaaugaaaaacacuacaucuacccgacgaggcacgggaaauauaggcgagaccuuaggagaaaaauggaaaaguagacuuaaugcgcuagguaaaucugaauuucaaauuuacaagaaaucagguauacaagaaguugacagaacacucgccaaagaagguauuaagagaggggagacugaccaucaugcagucucacgggguucagcgaaauuacguugguucguagagagaaauaugguaacuccagaaggaaagguugucgaccuaggaugcgggcguggggguuggucauauuacugugguggucucaagaaugugagggaaguuaagggacucacaaaggguggcccaggacacgaggagccaauccccauguccacguauggcuggaaucuuguuagguugcaaaguggaguugacguauucuucacucccccagaaaaaugcgacaccuuauugugugacauuggggaaagcucaccaaauccgacaauugaggcaggacggacccuacguguguuaaaucuagucgaaaacugguuaaauaacaacacucaauucugcauaaagguucugaauccauauaugccaucagugauagagaaaauggaagcacuacagcgacaauacggaggggccuuaguaaggaacccccuuucaagaaacucuacccaugaaauguacuggguaucaaaugcaacaggaaacaucguaucaaguguaaacaugauaaguagaauguuaauaaauagauuuacgaugaaacacaagaaagcaaccuaugaaccugauguagaccuagggucagggaccagaaauauagggauugaauccgaaauaccgaaccuagauauuauuggcaaaagaaucgagaaaauaaaacaagaacaugaaauuucauggcacuaugaccaagaucauccuuacaaaacuugggcuuaucacgguaguuaugaaaccaaacagacagggagugcauccucuaugguaaauggagugguacguuuauuaacaaagcccugggauguaguucccauggucacucaaauggccaugacagacacaaccccauuuggacagcagagaguauuuaaagaaaagguagacacaagaacacaagaaccgaaagaaggaacuaagaaauuaaugaagauuacugcggaauggcucuggaaggaacuuggaaagaagaaaacacccagaaugugcacuagggaggaguucacacgaaaaguuagaaguaaugcagcauugggagccauuuucacugaugaaaauaaauggaaaucagcaagagaagcgguagaagacggcagauuuugggagcugguagauagggaacguaaucuucaucuggaaggcaaaugugagacgugcguauacaauaugauggggaaaagggagaagaaauuaggagaauuuggaaaagcaaaagguucacgcgcuauuugguauauguggcucggggcaagguuucuagaguucgaggcccucggauuuuuaaacgaagaucauugguucagcaggggaaacagucucucuggaguggaaggcgaaggguuacauagacuuggguauauccuccgagaugugggcaagaaagaaggaggugcaauguacgcugacgacacugcggguugggacacaagaaucacccuugaggacuugaaaaaugaagaaauggugacaaaucauaugaaaggugaacacaaaaaguuagcugaagcaauauucaaguuaacauaccaaaauaaaguagucagaguacaacggcccacacccagagguacggucauggauauaauuucaagaagggaucaaagaggaagcgggcagguaggaaccuacggacuuaacaccuuuaccaauauggaggcucaacuaauaagacaaauggaaggagaggguauauuuaaaucaauccaacauuugacagccacggaagaaaucgcaguccaaaauuggcucgcuagaguuggcagagaaagacuaagcagaauggcaauaaguggagacgauugugucgucaaaccaaucgacgaucgcuuugcaucagcccuaaccgcacucaaugacauggggaaaguaaggaaagacauacaacaaugggagccuucccgagguuggaacgacuggacacaggugccuuucuguucacaucacuuucacgagcuaguaaugaaggauggacgagugcugguugucccauguagaaaucaggaugaacuuauaggacgagcaagaauaagccaaggagcagguuggaguuugaaagagaccgcgugcuuggggaaaagcuacgcccagauguggacacuuauguacuuucaccgcagagaccuuagacuagcugcgaaugcuauauguucggcaguaccuucccauuggguaccaacaucucgaaccacgugguccauucacgcgaaacaugaauggaugacaacagaagauaugcuagcaguguggaauaggguauggauacaagagaauccguggauggaagacaaaacgcccgucgagucgugggaagaaguaccguaccuugggaaacgugaggaucaaugguguggaucacuaauaggacuaacaucacgagcgacaugggcgaaaaacauucaaacugcgauaaaccaaguaaggucauuaaucgggaacgaagaguacacagauuacaugccaucgaugaaacgauuuagaagggaagaagaggaagcugguguacucugguaa

SEQ ID NO: 22395 - RNA, 9876 nt, Artificial Sequence
  derived and/or modified CDS sequence (opt6) from DENV-2__FJ744743__SS-prME
acagcggggguaauugucauguuaauucccacagcaauggcauuucaucuaacaacaagaaauggagaaccccauaugauaguggguagacaggaaaaaggaaaaagccuacuauuuaaaacagaagacgguguaaauaugugcacacuuauggcaauagaucuaggugaacuaugugaagauacuaucacuuauaaauguccauuguuaaggcaaaaugaacccgaagauauagacuguugguguaacagcacuagcacauggguaacauaugggacauguacaacaacuggagaacaucguagggagaaacgaucugucgcucuuguaccucacguaggcaugggucuggaaacacguacagaaacuuggaugucgagugaaggcgcauggaaacaugugcagagaauugaaacuuggauacugaggcaucccggcuuuacaaucauggcagcaauauuagcauauacgaucgggacuacacacuuucaacgcgcucuaauauuuauucuguuaacagcagucgcgcccucaaugacaaugcggugcaucgguauauccaauagggacuuuguagaagguguuagugguggcagcuggguugauauagugcuagaacaugggucaugcguuacaaccauggcgaaaaacaaaccaacguuagacuucgaacugauuaaaacggaagcaaaacaaccugcaacauugagaaaauacuguauugaagcuaaacuuacuaauaccacuacagagaguagauguccuacucagggugagcccucgcuaaaugaagaacaagacaaaagauuuauauguaaacacucaauggucgaucgcggauggggcaauggaugcggccuauuuggaaaaggcgggaucguaacuugugcgauguuuaccuguaaaaagaacauggaaggaaagguaguacaaccugaaaacuuagaauacacuauuguaaucaccccacauagcggagaagaacacgcagucgguaaugauacggguaaacacgggaaagaaauaaaaauuaccccacaaucaagcauuacagaggcggaauuaacaggguaugguacugucacuauggaaugcucuccacgcaccggcuuagacuuuaacgaaauggugcugcuacaaauggaagacaaagcguggcuuguccacagacaaugguuucuagaccucccacuaccuugguugcccggagcugauacacaaggcucaaauuggauccaaaaagaaacucuaguaacguuuaaaaauccccacgccaagaaacaagauguugugguuuuaggaagucaagaaggugcaaugcacacugcacugacaggugcuaccgagauucaaaugucaaguggaaaccuccuauucacaggacauuugaagugccguuuaaggauggauaaacuccaacugaaaggaaugagcuauucgauguguacaggaaaauucaaaauaguaaaggaaauagcagaaacgcaacacggaacaaucguaauuagaguucaauaugagggcgaugguagcccuuguaaaaucccauucgagauuacagaucuugagaaaagacauguguuagguagacuaaucacuguaaacccgauaguaaccgggaaagacucaccuguaaacauagaggcugaaccaccuuuuggcgauucuuacauaauuauugguguugagccgggucaguugaaacucaacugguucaagaaagguaguucaauugggcaaauguucgaaacgaccaugcgaggagcgaaaaggauggcaauacuaggagacacagccugggacuucggcaguuugggagggguauuuacaucaaucggaaaagcccuacaucaaguauuuggagcaauauacggagcugcguucaguggagugucuuggacaaugaagaucuuaaucggagugaucaucacauggaucggaaugaacagccgauccacuucuuuaagcgucucauugguccuaguaggaguaguaacacuuuaccuaggggccguugugcaggccgauagcgguuguguaguauccuggaagaauaaagaauuaaaaugcgggucagguauauuuauuacggacaacgugcacacauggacugaacaauauaaauuccaaccagagucaccuaguaaauuagccucugccauacaaaaagcacacgaagaagggauuuguggaauacgauccguuacaagguuagaaaaccuaauguggaaacaaaucaccccagaacuaaaccauauacuuucagaaaacgagguuaaguuaacaauaaugacaggcgacauaaaaggcauaaugcaagcaggaaagagaucacuauggccacagccaacugagcuaaaauauagcuggaaaacaugggggaaggcuaaaaugcuaagcacagaaagccacaaucaaacuuucuuaaucgauggaccggaaacagcagaaugcccaaacaccaauagagcauggaacuccuuagaaguagaagacuauggcuucgggguauucacuacuaacauauggcuuaaauugcgggaaaaacaggauguauucugugauucaaaacucaugucugcugcuaucaaagacaaccgagcuguacacgccgacaugggguacuggauagaaucggcacugaaugacacauggaaaauggaaaaagcgucuuucauagaaguuaagucgugccauuggccuaaaagccacacucuguggucaaaugguguacuugagucugaaaugauaauaccgaaaaauuuugcggguccaguaucacaacauaacuauaggccggguuaccauacucaaaccgcuggaccauggcacuugggcaagcucgaaauggauuuugauuuuugugaaggcacaaccguuguaguuaccgaggacugcggcaaccguggaccaucacuucguacaacuacggcgagcggcaaacuuauaacagaaugguguugcagguccuguacccuuccuccacuacgauauagaggagaggacggcuguugguacggcauggaaauacgaccacuaaaagagaaagaagaaaacuuaguaaauagucuagucacugcaggacauggacagauugauaauuuuagcuuaggcguccuagguauggcccuauuuuuagaggaaauguugcguacccgcauuggaaccaaacaugcaaucuuguuaguugcagucaguuucguaacacuaauuacuggaaauaugucauucagagaccuaggaaggguaaugguuaugguaggagcaacuaugaccgaugauauagggauggggguaacuuacuuagccuuacuagcagcauucaaaguccggccuacauuugcagccgggcuacuauuaagaaaacucaccuccaaagaauuaaugauggcuacaauaggcauagcucuacuaagccaaaguacaauaccagaaacuauccuagaauuaacggacgcucucgcgcuaggcaugaugguucuaaaaaucgugcggaacauggaaaaauaucaguuggccgugaccaucauggcaauaucuuguguaccgaacgcuguuauucuacaaaaugcguggaaagucagcuguacgaucuuagcagcuguuaguguauccccgcuacuccuaacaucaucucagcagaaagcugauuggauaccauuggcauuaacaauaaagggucugaauccgacugcuauuuuucuuacaacuuuaucacgaaccagcaagaaaagaucguggccccuaaaugaagccauuauggcaguaggaaugguaucaauacuggccuccagucuuuuaaagaaugacauuccuaugacagguccgcuaguagccggaggucuacuaaccguuuguuacguacugacgggcagaagugcggaccuagaacuagaaagagcggcggauguaaaaugggaagaucaagcugaaauuaguggcaguucucccauucuaucgauaacgaucucugaagaugguucuaugucaauuaaaaaugaggaagaagaacaaacauuaaccauuuuaauuaggaccggccuuuuggucaucucagguguguucccaguaagcauucccauaacugccgccgcuugguacuugugggaaguaaagaaacaaagggccgguguguuaugggacgucccuagcccuccgccuguagaaaaagcugaguuagaagauggggcauacagaauaaaacaacgagggauauuaggcuacucacaaauuggagcaggagucuauaaagaagguacauuucauacgauguggcauguaaccagaggagcggucuugaugcauagagguaaaaggauagaaccuaguugggccgauguuaagaaagaccuaaucaguuauggaggagguuggaaauuagaaggagaguggaaggagggugaagaaguacaaguacucgcauuagaaccaggcaaaaauccccgcgccguccagacgaagccaggaauuuuuaaaacaaauacugguacgauaggagcuguuagucuagacuucucacccggaacuagcggcucaccaaucguagacagaaaagggaaaguaguuggauuauaugguaacggggucguaacacggucaggugcauaugucucggcaauagcacagacagaaaaaucaauugaggauaauccugaaauagaggaugauauauucaggaagaaacgacucacaauuauggaccuacauccgggcgcagggaaaacuaaacgcuaucucccugccauaguaagagaggcgaucaaacgaggauuaagaacacuaauacuagcuccaacacgaguagucgcugccgagauggaagaagcguuacgaggauuaccuauuagguaucagaccccugcaaucaaaacugaacauacuggucgggagauuguggaucuaaugugucacgcaacauucacaaugaggcuguuaaguccaguucgagugccaaacuacaacuuaauaauaauggacgaagcccauuuuacagacccagcaagcaucgcagcaagaggauauaucucuacgagagucgaaaugggugaagcggcugguauauuuaugaccgccacgccacccgggucccgagacccguuuccacagucgaaugcaccuauaauggaugaggaaagggaaaucccagaaagaucauggaacucggggcaugaaugggucacagauuucaagggaaaaacaguuugguucguaccaagcauaaaagcaggaaaugacauugcugcuugucuaaggaaaaauggcaaaaagguaauucaauuaagcagaaagaccuuugauagcgaauacgugaaaacacgagcaaaugacugggauuucguaguaacaacugacauaucugaaaugggcgcaaacuucaaagcugaacguguaauugauccaagaagauguaugaaacccguaauauuaacagauggcgaagaacguguaauacuugcaggcccaaugccgguuacacauuccucugccgcgcaaagaagaggaaggauaggaaggaacccuaaaaaugagaaugaccaauacaucuauaugggagaaccacucgagaaugaugaagauugugcacauuggaaggaagcaaaaauguuacuugacaauauaaauacgccugaaggaauuauaccaucaauguuugaacccgagcgggaaaagguagaugccauagacggagaauaccguuuaagaggggaagcgcgaaaaacauucguagauuuaaugaggcgaggcgaucuccccguguggcuagcguauaagguagcggcagaaggcaucaauuacgcggauagaaaaugguguuuugauggaauuaaaaauaaucaaauucuggaagaaaauauggaaguagaaaucuggacaaaggaaggugaacguaagaaacuuaaaccacgcugguuagacgccaggauauacucggacccacuugcgcuuaaagaauuuaaagaguuugcugcugguagaaaaucauuaacgcugaacuuaauaaccgagauggggcgcuuaccgacguucaugacccaaaaggcuagaaaugcauuagacaauuuggcuguguuacacaccgcggaggccggugguagagccuauaaccacgcccuuuccgaacuaccugagacccuggaaacucuauuacuacucaccuuauuagcaaccgucacaggagguauauuuuuguucuuaaugucuggaaagggcauagggaaaaugacacucggaaugugcugcauuauaacagcaagcauauuacugugguacgcgcaaauccaaccgcacuggaucgcagcuaguauuauacuugaguucuuucuuauuguuuuacuaauucccgaaccagaaaaacaaagaacaccgcaggacaaucaacucaccuacguugucauagcaauauugaccguaguugccgccacaauggcgaaugaaaugggguuucuagagaagaccaagaaagauuuaggacucggaaguguaacaacacaggaauccgaaucaaauauacuagauauugacuuacgaccggcuucagcauggacgcuauacgccguagcgaccacguucguaacaccaaugcuaagacacucuauugaaaauucuaguguuaauguuagcuugacagcaauagccaaccaggcaacaguccuaauggguuuaggaaaaggauggccauuaagcaaaauggacauaggagugccacugcuagcaauagguuguuauagucaaguuaauccaaucacgcuaaccgccacucuguuaagguucguggcucaauacgccauaaucgguccuggacuacaggcuaaggcaacgcgcgaagcacagaaaagagcagccgcgggcauaaugaagaacccgacggucgaugguauaacagucauagaucuugaaccgauaccauaugacccgaaauuugaaaagcagcuaggacagguaaugcuauuaauucuuugcguuacacagguacucaugaugagaaccacgugggccuuaugcgaggcuuugacacuugcuaccggacccaucucgacucuaugggaaggaaauccgggacgauucuggaacacuacgauugccgucuccauggcuaacaucuuuaggggaucuuauuuagcuggggccggucuuuuauuuucaauuaugaaaaauacaacuucaacaagaagaggaacggggaacauaggggaaacuuuaggugagaaauggaaaucaagacugaaugccuuaggaaagagcgaauuucaaauuuacaagaaaagcgggauucaagaaguagaccgaacgcuagcaaaggaaggcauuaaaagaggagagaccgaccaucacgccgucuccagagggagcgcaaaauugagaugguucguugaaagaaauaugguaacacccgagggaaaaguuguagaucucggcuguggucgaggagguuggaguuauuacugcggugguuuaaagaauguacgugagguuaaaggguuaacaaaagggggaccugggcacgaagaaccaauaccuaugucuaccuacggauggaauuuaguuagacuacaaucagguguggauguauucuuuacuccgccagaaaaaugcgauaccuuauuaugcgauaucggggaaaguucaccuaauccuacaauugaagcagguagaaccuuaagaguucucaaucugguagaaaauuggcucaauaauaauacacaauucuguauaaaaguacucaacccauauaugccuagugugauagagaaaauggaggcucuacaaagacaauauggaggugcccucguucgaaauccuuuaucgcgaaauucaacacaugaaauguacuggguaagcaacgcaacugggaacauaguuuccucaguuaauaugauuucaagaauguuaauaaaucgauuuacuaugaagcauaagaaagcaacuuaugaaccugauguggacuuggguagcggaacaagaaauauuggaauagaaagugaaauucccaauuuagacauaauuggaaaacgcaucgagaaaauaaaacaagaacaugaaauaaguuggcauuacgaccaggaucauccauauaagacaugggcauaccauggaagcuaugagacaaagcaaacagguagugcgucaucaaugguaaaugguguaguccgccucuuaacaaaaccaugggaugugguuccgauggucacacaaauggcaaugacagauacuacccccuucggacagcaaagaguauuuaaggaaaaagucgacaccagaacccaagagccuaaagaaggaaccaagaaacuaaugaaaaucacggcggagugguuauggaaagagcuugguaaaaagaaaaccccacggaugugcacgagggaagaauuuacaaagaaaguuaggucaaacgcugcacuaggagccauauuuacugacgaaaauaaauggaaauccgcaagagaagcaguggaagacggucguuucugggaacugguugaucgcgaacgcaaucuucaucuggaaggcaaaugcgaaaccuguguauauaacaugaugggcaaaagggagaagaaauuaggugaauuuggcaaggcaaaaggaucucgggcgauaugguacauguggcuaggggccagguuuuuggaauuugaagcacuggguuuccucaaugaagaccacugguuuagucgagguaauagucugagcggugucgagggugaaggccuacauagacugggauacauucuccgagauguaggcaagaaagaaggcggagcaauguacgcagaugauacagccgggugggauacccguauaacccuugaagaccuaaagaaugaagaaauggugacuaaucauaugaaaggagagcacaagaaauuagcagaagcaauauucaagcucacuuaucaaaacaaaguuguaagagugcaaagaccaacaccaagaggaacgguaauggauauaaucucacggagagaucaaagagguucgggacaaguuggaacauacggucugaauacuuuuacuaauauggaagcucaacugauaagacaaauggaaggugaagguauauuuaaaucuauucaacaucuuacggcaauagaagaaauagcaguucagaauuggcuugcaaggguaggucgagagagacugucccgaauggcaauaucuggggaugacugugucguaaagccaaucgacgaucgcuucgcgucagcgcuuacggcccuaaaugauauggggaaaguucgcaaagauauacaacaaugggaaccauccagaggauggaacgacuggacacaaguccccuuuugcucucaucauuuccacgaauuaguaaugaaagauggacgagugcuaguaguaccuugccgaaaccaagacgaguugaucggucgcgccaggauaucacagggagcuggauggagccuuaaagaaacggcgugccuagggaaaaguuacgcacagauguggacacuuauguauuuucaucggagggauuuaagauuagcugcaaacgcaauuuguuccgccguacccucacacuggguaccaacaucgagaacuacuuggucgauccaugcgaaacaugaguggaugacgacggaagauaugcuugcaguauggaacagaguauggauccaagaaaacccauggauggaagacaaaaccccagucgaaaguugggaagaaguaccguacuuaggaaaaagagaagaucaauggugugguucgcuuauaggacucacaagucgcgcaacgugggcgaaaaauauccagaccgcuauaaaucaagucagaucauuaauaggaaacgaagaauauacagacuacaugccgaguaugaaacguuuuagaagagaagaagaggaagcgggaguacuuugguag

SEQ ID NO: 22396 - RNA, 9876 nt, Artificial Sequence
  derived and/or modified CDS sequence (opt6) from DENV-2__JN819424__SS-prME
acagccggaguaaucgugauguuaauaccgacugcuauggccuuucacuugacaacaagaaacggugaaccacacaugauuguaggacgacaggagaaaggaaaaucuuugcuauuuaaaacagaagacggaguaaacauguguacucuaauggcgaucgaucuuggagaacuaugcgaggacacgauaacauacaaauguccacuacuaagacaaaaugagccagaggauauagacugcuggugcaauaguacaucaacuuggguaacauacggaacuuguacuacaacaggagaacaucgaagagagaaaagaucuguagccuuaguuccacacguaggcauggggcuggaaacaagaacugaaacguggaugagcucggaaggggcuuggaaacacguacaacgaauugaaacauggauacugagacaccccggcuuuacaaucauggcagcaauacuagcauacaccauaggaacuacccacuuucagagagcucuaauauuuauauuacuuacugcuguagcacccaguaugaccaugcggugcauaggaauaucaaacagagauuucguagaaggcguauccggcggaucuuggguagauaucguauuggaacacggaaguuguguuacuacgauggccaaaaauaaaccaacauuagacuuugaauugauuaaaacagaggcgaaacaaccggccacauuaagaaaauacugcauagaagcaaaacuaacgaacacaacgacagaaagucgaugcccuacucaaggugaacccagcuuaaacgaagaacaagauaaacgauuuaucugcaaacauucaaugguagaccguggguggggaaacgguuguggcuuauucggaaaaggcgggauugucacgugcgcgauguuuacaugcaagaaaaauauggaaggaaaagugguucaaccggaaaauuuggaauauacaauaguaauuacgccacauaguggcgaagaacacgccgugggaaaugauacugggaaacacgggaaagagauaaaaauuacgccacaaucaucgauuacugaggcugaauuaacugguuacggaacagucacaauggaguguuccccacggacgggucuagacuucaaugaaaugguccucuuacagauggaagacaaagcauggcucguacauagacaaugguuccuggaucugccgcuaccaugguuaccuggagcugauacccagggaucaaacuggauacaaaaagaaaccuuaguaacuuuuaaaaacccucaugcuaagaaacaggauguuguuguuuugggcagccaagaaggugccaugcauacugcacuaaccggagcaacagaaauucagaugaguagcggaaauuuauuauucaccggucaccucaaaugccgacuacguauggacaaacugcaacuaaaaggaaugagcuacagcauguguaccggcaaauuuaaaauaguaaaagagaucgcagaaacacaacauggaaccauuguaauaagggugcaguacgaaggagaugguucuccaugcaaaauaccuuucgaaauaacagauuuagagaaacgacacguacuugggcgccuaauuacugucaauccaaucguaacagaaaaagauaguccaguuaacauagaggcagaaccgccauucggagacuccuauaucauaauaggaguagagccuggacaauuaaaauuaaauugguuuaagaaagggucaucaauaggccagauguuugaaacuacaaugcgcggggcuaaaagaauggccauauuaggugacacugcuugggacuuugggucauuaggcggaguuuuuaccaguaucggaaaagcacuccaccagguauucggagcuaucuacggagccgcuuuuuccggaguuucuuggaccaugaaaauccugauaggcguaauaauuacguggauagggaugaacucaagaaguacgucacuaucaguaucacuuguuuuagucggagugguaacuuuguaucucggcgcgguaguccaagcugacucaggguguguaguuaguuggaaaaauaaagaacucaaguguggaucugguauauuuauaaccgauaauguacauaccuggacggaacaguauaaguuccaaccagaaucgccaagcaaauuggccucagcaauccaaaaggcacacgaagaagggauaugcggaauacguucggucacaagauuagagaacuuaauguggaaacaaauaacaccagaacugaaccauauccugucggaaaaugaaguaaaacuaacgauaaugacaggggacaucaaaggcauuaugcaggcgggaaagaggaguuuacgaccccaaccgacugaacucaaauauaguuggaaaacauggggaaaagcaaaaaugcucucgacugaaucccauaaucaaacguucuuaauagauggacccgaaacagcagaaugcccuaacaccaaucgugccuggaacucauuagaaguggaagauuacgguuuugguguauucaccacgaauauuuggcuaaaacuacgggaaaaacaagauguguuuugugauagcaaauuaaugucagcuucaagcaucgauaauagagcagugcacgcagauaugggguacuggauggaaucugccccaagugauaguuguaaaauggaaaaagcgaguuuuaucgaggacaaaucaugcuauuggccaaacucacaacaccuauggucaaauggugucuuagagagcgaaaugauuuuucccaagaacuucgcagggccggugucgcaacauauuuauaggccggguuaucauacgcaaacugcuggcccguguaaccuagguaaacuagagauggacuuugacuuuugcgaagguaccacugugguuguaacagaagauuguggaaaucggggcccgucucugagaacaacgacugcuucaggaaaauuaaucacagaaugguguugucguucauguacucuaccaccgcuuagguaucgaggagaagaugguuguugguauggaauggaaauacgaccccucaaagaaaaagaagaaaaucuaguuaauagucuggugacagcuggccacgggcaaaucgacaacuuuucuuuggguguacuaggaauggcguuauuccuagaagaaauguuaagaacccgcauaggcacuaaacaugcuauauugcucguugccguuucuuuugugacauuaauaacaggaaacaugucauuuagagaccuagguagaguuauggugauggucggagcuacgaugaccgaugauaucgguaugggugucacauauuuggccuuacuggcagcuuuuaaaguacggccaacuuuugcagccggccuccucuuacgaaaauuaacaagcaaagaacuaaugauggcuaccauaggaauagcuuuauuaagucaauccacgauaccagaaacaauccuugaacugacggaugcgcucgccuugggaaugaugguucugaaaauaguaagaaacauggaaaaauaccagcuagcggugacgaucauggcgauuagcugcguaccuaacgcaguaauuuugcaaaaugcuuggaaagugaguugcaccauauuagcugccguuucagugucgccuuuguuacuuacgucaagucaacaaaaagcggacuggauaccacucgcacugacaauuaaagguuuaaacccaacagcaauuuuccuuacaacacuuaguagaaccucaaagaaacgaucauggccacugaaugaagcuaucauggcaguaggaaugguuaguauucuggccaguagcuuacucaaaaacgauauuccaaugacuggucccuugguagcuggaggacuucuaacaguuuguuacguauugacggggcgaucggcagauuuagaauuagaaagggcggccgauguuaaaugggaggaucaagcggagauauccggaaguaguccaauauuauccaucacgauuucagaggaugggagcaugaguauaaagaacgaagaagaagaacaaaccuuaacuauuuuaauacgcacuggucuacuuguaaucucugguguuuuucccguaucgauaccuaucacggccgcagcaugguaucuuugggaagucaagaaacagagagccgguguccuuugggaugugccgucaccaccgcccguugagaaagcagaguuagaagauggagccuacaggauaaagcaacgugguauauuaggauauucacaaaucggugcaggaguguacaaggaggggacauuucauaccauguggcacguuacaagaggugcaguccugaugcacagaggcaagcguaucgaaccuagcugggccgacgucaagaaagacuuaauaaguuaugguggugguuggaaauuagagggagaguggaaagaaggggaggaaguucaagugcuggcuuuagaaccuggcaaaaauccaagggcgguccaaaccaagccgggaaucuuuaaaacuaauacgggcacgauuggagcagugaguuuagacuuuaguccagggacaagcggaagcccaaucguggauagaaaggguaaaguugugggccuauacggaaacggaguaguaacgagaaguggugcauaugucagcgccaucgcgcagacggagaagaguauagaagauaauccugaaauagaagaugauauuuucaggaagaaacggcuaacaauuauggaucuacauccuggagcuggcaaaacuaaaagauaccugccagcaauaguucgagaagccauaaaacggggacuaagaacuuuaauucuagcaccuacgcgggugguagcugcugaaauggaagaggcauuaagaggauugccaauaagauaucaaacgccagcgauuaagaccgaacauaccggucgugaaaucguagauuuaaugugucaugccacuuucacaaugcguuuacuauccccaguaagggucccgaauuacaaucuuauaaucauggacgaagcucauuuuacagaccccgcaucaaucgccgcuagaggauacauuaguacaagaguagagaugggcgaagcagcuggaauauuuaugaccgcuacaccaccgggcucacgagacccuuucccucaaagcaaugcuccaauuauggaugaagaaagggagauaccugagaggagcuggaacaguggccaugaauggguaacggauuuuaagggaaagacugugugguuugugccaagcauuaaagccgguaacgacauugccgcauguuuacggaagaaugggaagaaagucauacaacuaagcagaaaaacauucgauucggaauacguuaaaacuagagcuaaugacugggauuuugucgugacuacagacauuagugagaugggagcaaacuuuaaagcagaaagaguuauugacccuagacgauguaugaagccugucauacuaacugacggagaagaaagagucauuuuggcagguccuaugccuguuacccauaguuccgcggcacaacguagagguagaauuggcagaaacccuaaaaaugaaaaugaucaauauaucuauaugggagagcccuuagaaaacgaugaggauugugcccauuggaaggaggcaaaaauguuguuagacaacauaaacacuccggaaggaauuauuccaucuauguucgaacccgaaagagaaaagguggaggcaaucgacggcgaauaucgguugagaggugaagcgagaaaaacauucguagauuuaaugagacguggagauuuaccuguucgucuugcuuauaaaguagcugcagaaggcauaaauuaugccgaucgaaagugguguuuugauggaaucaaaaauagccaaauacuggaagaaaacauggaaguagagauauggacuaaagagggcgagagaaagaaauuaaaaccaaggugguuagaugcaagaauuuauagugauccccuggccuugaaagaguucaaagaguuugcugcaggucgaaaaucccuaacucucaacuuaauuacagagaugggaagacucccaacuuuuaugacacaaaaggcccggaaugccuuggauaacuuagccguccuacacacagcggaagccggagguagagcauauaaccaugcucuuuccgaacuaccagagacauuagaaacucuccuucugcuuacgcuuuuagcgaccgugacaggagggauauuuuuguuucuaaugucuggaaaaggaauaggcaaaaugacauuaggcaugugcugcauaauuacugcaucuaucuuguuaugguacgcacaaauucaaccucauuggauagcagcgucgaucauuuuggaauuuuucuuaauaguucuucuuauaccugaaccagaaaagcagagaacaccucaagauaaucaauugacguauguaguaauugcuaucuuaaccguaguagcagccaccauggcuaacgaaaugggauuccuagagaaaacaaagaaagaucuagggcuaggaucaaucacaacgcaagagagugaauccaauauauuagauauagaccucaggcccgcuucagcuuggacuuuauacgcagucgcaacaacuuucgugacuccaaugcuacgucauaguaucgaaaauucauccgugaacguguccuugacugcaauugcaaaccaagccacuguuuuaaugggauuaggcaaagguuggccguugucaaaaauggacaucggaguacccuuauuagcaaucggauguuauagucaggucaacccaauaacauuaacggcugcuuuauugcuauuaguagcccauuacgcuauuauuggccccggccuacaggcuaaggcaacucgugaagcccaaaaacgagcagcugcggguauaaugaaaaaucccacuguagaugguaucaccguuaucgaccuagagcccauaccauaugaccccaaauuugagaaacagcuaggucaagugauguuacuaauacuaugcgugacccaaguucuaaugaugaggacuacuugggcucuaugcgaggcacugacucuggccacuggaccaauaaguacccugugggaagguaacccuggacgauuuuggaauacaacaaucgcagucagcauggcaaauauauuccguggaaguuaccuagcaggagcuggauuguuauuuuccauaaugaaaaauacgacaucaacucgaagagguacgggcaauauuggagagacauugggagaaaaauggaaaagucgacuaaacgcgcuggguaaaagugaguuccagauauacaagaaaaguggcauacaggaaguagaccggacauuggccaaggaaggaaucaaaagaggagaaacggaucaccaugcgguaucaaggggaagcgcgaaacuaagaugguucguagaacgcaacaugguuacacccgagggcaagguaguugauuuagggugugggcgagguggauggucuuauuauuguggaggauuaaagaacgucagggaagucaaaggauuaaccaaaggcggaccgggucaugaagaaccaaucccgaugucaaccuauggauggaaucuagugagacuacaaaguggcguugauguauucuuuacaccuccagaaaaaugugacacacuauugugugauauaggagagagcucaccaaauccaacaauagaagccggaagaacucuucgugucuuaaaccuaguugagaauuggcuaaacaacaacacucaguucuguauaaaaguucugaauccauauaugccgagcgucauagaaaagauggaggccuuacagagacaauaugggggagcgcuuguuagaaaccccuuaagccgcaacucgacacacgaaauguacugggugagcaaugccaccggaaacauaguaucuaguguuaauaugauauccagaauguugauuaauagguuuacaaugaagcacaagaaagcuacguacgaacccgauguagaccuaggaagcggcacaaggaauauaggaauugaaucugaaauacccaaucuagauauaaucgggaaacguauagagaaaauuaaacaggaacaugaaauuucauggcacuaugaucaagaccacccuuauaaaacuugggcguaucauggcucauaugaaacuaaacaaaccggaagugccagcagcaugguuaaugguguaguaagauuacuaacuaagccaugggauguggucccgaugguaacacaaauggcaaugacagacaccacaccuuuuggacagcagagaguauucaaagaaaaagucgauacacgcacccaagaaccgaaagaagguacuaaaaaguuaaugaaaauuaccgcugaaugguuauggaaagaguuaggcaagaagaaaacacccagaaugugcacgagagaagaauuuaccaagaaaguaagaucuaacgccgcucuaggggcaauauuuacagaugaaaauaaauggaaaucagccagagaggcuguugaagauggacgauuuugggaauuaguugauagggaaaggaacuuacauuuagaaggcaaaugcgagacauguguuuauaauaugauggguaaaagggaaaagaaacucggugaauuuggaaaagcaaaaggcagcagagcuauaugguacaugugguuaggggcccgguuccuagaauuugaggcgcucggguuucugaacgaagaucauugguucucaagaggaaauagucugucugguguugaaggagaagggcuacauaggcuuggcuacauauugagggacguagggaagaaagaaggaggagcuauguaugcggaugacacugcgggaugggauacacguauaacacucgaagaccuuaaaaacgaagagaugguaacuaaucauaugaaaggggaacauaagaaauuagccgaagcaauuuuuaaacuaacuuaucaaaauaaggucguucguguacaaaggccaacuccccgugggacagugauggauauaauaagucgucgagaccaacggggcuccggccaaguagguacguacggguuaaacacauuuacgaauauggaggcucaacucauucggcaaauggaaggugaagguaucuuuaaaaguauucaacaucucaccgcuacagaagaaauagcaguccaaaauuggcucgcacgaguaggaagagaaagauuaucgagaauggcuaucucuggggacgauugugucguuaaaccuauagaugauagauuugcuagcgcauuaaccgcacuuaaugacaugggaaagguacgaaaagacauccaacaaugggagccaaguagggguuggaaugauuggacacaaguucccuucuguucacaucauuuucaugaacuugugaugaaagauggucguguccuaguaguuccuuguagaaaccaggacgagcuaauuggcagagcaaggauuucucaaggcgcgggauggagccugaaggaaaccgcguguuuggguaaaucauaugcacaaauguggaccuugauguacuuccaucgcagggaucugagauuagcagccaacgcgauauguagcgccguuccaagccauuggguacccaccucacggaccacuuggucgauccaugcgaaacaugaauggaugacgaccgaagacaugcuggcaguauggaacagaguguggauccaggaaaacccuuggauggaagacaagacaccgguggagucgugggaggaaguaccauaccuugggaagagagaagaucaaugguguggcaguuuaaucgggcuaacuucacgcgcaacgugggccaaaaauauacaaacagccauuaaucaaguacguucuuuaauaggcaaugaagaauacacugauuauaugccaagcaugaaacgauuucggcgagaagaagaagaagccggagugcugugguga

SEQ ID NO: 22397 - RNA, 9876 nt, Artificial Sequence
  derived and/or modified CDS sequence (opt6) from DENV-2__FJ744741__SS-prME
acagcuggagugauaguaauguuaauacccacggccauggcauuucaucuuacuacacgcaauggagaaccgcauaugauugucgggcgucaagaaaaaggaaaaucguuauuguucaaaacugaagauggcguaaauauguguacucuuauggcuauagauuugggcgaacugugcgaagacacgauuacguauaaauguccucucuugagacaaaacgaaccagaagauauugacugcuggugcaacucuacaaguacaugggugacauaugggacaugcacgacuaccggagaacauagaagggaaaaacguagcguagcacugguuccacacgucggaaugggguuggaaacuagaacggaaacauggaugaguucugagggggcuuggaaacacguacaaagaauagaaaccuggauucuaagacacccagguuuuacaauuauggcggcaauucuagcauacaccauagggacuacucauuuucaaagggcacuaaucuuuauccuuuugaccgcgguagcgccaucgaugacaaugaggugcauaggcauaucuaaccgggacuuuguggaagggguaucaggcggaucuugggucgauauaguacucgaacaugguaguugcguaacuacaauggcuaaaaauaaaccgaccuuggacuucgaacuaauaaaaacagaagcaaaacagccggcaacacuaagaaaauauuguauagaagcuaaacugacaaauacuacgacagagagcagauguccaacucaaggugaaccaucacuuaaugaagaacaggacaaaagauucauuugcaaacauagcaugguagacagaggcuggggaaacgguugugggcuuuuuggaaaaggcggaauaguuacaugcgcuauguuuaccuguaagaaaaauauggaagggaaaguaguccaaccugaaaaccucgaauauacaauagugaucaccccucauucaggcgaagaacaugcaguaggaaacgauacagggaaacacggcaaagaaauaaaaauuacuccccagucaaguauaacagaagcugaacucacaggauaugggacagugaccauggaauguuccccacggacaggucucgauuucaaugaaauggucuuacuacagauggaagauaaggcuugguuaguacacagacaaugguucuuggaucucccuuuaccaugguuaccgggagcagauacgcaagggucuaauuggauucaaaaagagacuuuggucacuuucaaaaauccacacgccaagaaacaagauguagucguccugggcucacaagagggcgcgaugcauacagcgcugacuggagcaacagaaauacaaauguccucuggaaaucugcuuuuuaccggccauuuaaaaugucgacugagaauggacaaauuacaauugaaaggaaugaguuauagcaugugcacaggaaaauuuaaaauaguaaaagaaauugccgaaacacagcaugggaccauuguuauacgaguacaauacgaaggcgacggaucacccugcaaaauaccuuuugaaauaacggaccuagagaaaagacauguauuaggacgauuaaucacaguuaaccccauuguaacugaaaaagacucgccggucaacaucgaagcggagccgcccuuuggagauaguuacaucaucaucggaguggaaccaggacaauugaaauuaaauugguucaagaaagguucuaguauaggucagauguucgaaacuacaaugaggggagccaaacggauggcaauuuuaggagauacagcaugggacuuugggagcuuaggagggguauuuacaucaaucggaaaagcccuacaucagguguucggagcaauauauggagccgcauuuucaggaguuucuuggaccaugaaaauccuaauaggagucauaauuacauggauugggaugaacucucgcucgacaagccuaucagugucacuuguauuagugggagucguuacucuauauuugggagcaaugguccaagccgacucaggauguguaguuucguggaaaaacaaagagcucaaaugugguagugguauuuuuauaacagacaacguccacacguggacagagcaauacaaauuccaaccugaaucaccgaguaaacucgcuagugcaauucaaaaagcccacgaagaagguauuugcggaauccguucgguaacccgguuagaaaaucugauguggaagcagauaaccccugaauuaaaccauauacugagcgaaaaugaaguuaaacuaacaauaaugacuggagauauuagagguauaaugcaagcagguaaacggucucucaggccacaaccaacugaacuaaaauacuccuggaaaacauggggaaaagcaaagaugcugucgacugaaagccacaaccaaacauuucuuauagaugguccagaaacagcagaguguccaaacacgaauagagcauggaauagucucgaaguagaggauuauggcuuugggguguucaccacgaacauuugguugaaacuucgcgaaaaacaagacguauuuugugacaguaaguuaaugucugcagcaauaaaagauaaccgugcaguucacgccgacaugggguauuggauagaaucggcucuaaacgacaccuggaaaauggaaaaagcaucuuucauugaaguaaagaguugccauuggccgaaaagccacacacuauggaguaacgguguauuggaaagcgaaaugauaauuccuaaaaacuucgcaggaccggucucgcaacacaauuaccgcccuggcuaucacacucaaacagccggaccguggcauuugggaaaacucgagauggacuuugaccuaugugaaggaacaacagucgugguuacagaagauugcgguaaucgaggccccucacuuaggacaaccacagcaagcggaaaauuaauaacugagugguguugccgcaguuguacauugccuccacuccgguacagaggcgaggaugggugcugguauggcauggagauuaggccuuuaaaagagaaagaagaaaaccugguuaauucuuuaguaacagcagggcauggacaaauugauaauuuuucccuagguguauuggguauggccuuguuucuagaagagaugcuaaggacucgaauuggaacuaagcaugcaauucuauugguagcugugaguuuugugacauugauuacgggcaauaugucauuccgggacuuaggaagggugaugguaauggugggcgcgacaaugacggaugacauaggaauggguguaacuuauuuagcccuuuuggcagcguuuaaaguaagaccaacauucgcggcuggucuccuacuaagaaaacugaccucaaaggaguugaugauggcaacuauaggaaucgcucuuuuaucgcaaucaaccauaccagaaacgauauuagaacuaacugacgcacucgcguuagguaugaugguccucaaaauuguccgaaacauggaaaaauaccaacuugccgugacaaucauggcaauuagcugugucccaaaugcggugauucuacaaaaugcauggcgcguaagcugcacaauuuuagccgcaguuuccguaucgccuuugcuuuuaaccuccucccagcaaaaagcugauuggauuccccucgcauuaacaauaaaaggacuaaauccuacggcaauauucuuaacaacccuaagucgcacgagcaagaaaagauccuggccucugaacgaggcaauaauggccguugggauggugucaauauuagccuccucguuauugaagaaugauauuccaaugacagggccgcuaguagcaggaggcuuacugacaguaugcuauguauugacagggaggucggcagaccuugagcuagaaagagccgccgaugugaaaugggaagaucaagcggaaauaucggguucuuccccuauacuuaguauaacaauaucagaagauggaucaaugucaaucaaaaacgaggaagaggaacaaacacucacaauacucauucguacaggacuuuuagugaucuccggggucuucccaguuaguauaccaauuacugcggcagcgugguaccugugggaagucaagaaacagcgcgcuggcguauuaugggauguaccuucuccacccccgguagaaaaagcggaauuagaagauggugcauauagaaucaaacaaagagggauauuaggguacucacagauaggggcggguguguacaaagaaggcaccuuccacaccauguggcauguaacucgcggagcagugcuaaugcacagaggcaagcggauugaaccaucaugggcagauguuaagaaagacuugauuucuuauggugggggcuggaaacuugaaggugaauggaaggaaggagaggagguacaaguguuagcacucgaaccugggaagaauccaagggcuguacagaccaagccuggaaucuuuaaaacgaauacugggacaaucggagcuguuucgcuagauuuuagcccggguacuucuggaucacccauuguagaucgaaaaggaaaagugguugguuuauaugggaacggaguaguaacaagaagcggagcguaugugucagcaauagcacaaacagagaaguccauagaagacaauccagaaauagaagaugauauuuuucgaaagaaacgccuuacgauaauggaucuccaucccggagcuggaaaaacaaagcgauaucuacccgccauaguaagggaagcaauaaagagaggucuccgcacccuaaucuuagcaccaacccgcgugguagcggcagaaauggaagaggcccuaagaggauuaccuauuagauaucaaaccaccgcuaucaaaacagaacauacaggacgagaaauagucgaccugaugugucacgcgacauuuaccaugcgucuauuaagcccaguuagagugcccaauuauaaucucauaauaauggaugaagcgcauuuuacugauccagcuucaauugcagcacggggauauauuuccacuagagucgagaugggcgaagcggcgggcauuuuuaugacagcuacaccuccaggcucaagagacccauucccucaaaguaaugcgccaauaauggaugaagaaagagagauaccugaaaggucauggaauagugggcaugaauggguaacagauuuuaaaggaaaaacuguuugguuuguaccuucaaucaaggcuggcaacgacauagcagcuuguuuacggaaaaaugguaagaaaguaauucaacugucaagaaaaacguuugauucagaauacguaaagacucgagcaaacgauugggacuuuguaguaacuacagauauaucugaaaugggcgcaaacuuuaaggcugaaaggguaaucgacccuagaagauguaugaaaccagugauauuaacugacggagaagaacgagucauacuagcagguccaaugccgguuacccauaguucggcggcucaaagacgagguaggauaggacgaaaucccaagaacgaaaacgaucaauacauuuacaugggggaaccacuagaaaacgaugaagauugcgcacauuggaaagaagcgaagauguuauuagauaacauaaauaccccugaagggauaauaccaucgauguucgaaccugaaagagaaaagguggaugcaauagauggagaauauagacuaagaggcgaagcacguaaaacuuuuguagauuuaaugcgcaggggagauuuacccguauggcucgcauauaaaguagcggcagaggggauaaacuaugcugacaggaaaugguguuuugauggcauuaagaauaaucaaauucuagaagagaacauggagguggaaauuuggacuaaagaaggugaaagaaagaaacuuaaacccagaugguuagaugcgagaauauacucggauccuuuagcacuaaaggaauuuaaagaauuugcggcgggaagaaagucacuaacgcuaaaucuaauaacggaaaugggaagauugccgacauuuaugacucagaaagcuagaaacgcguuagauaauuuagcugugcuacauacagccgaagcuggugggagagcauauaaucaugcauuaagugaacuuccagaaacauuagaaacgcuacuguuauuaacguuacuagcaacaguuaccggcggcauauucuuguuucuaaugagugggaaagggauaggaaaaaugacucucgggauguguuguauuauaacugccaguauacuacuuugguaugcgcaaauacagccacauuggauagcggcuucaauaauucuagaguucuuccugauaguuuuacuaauaccagaaccagagaaacagcgcacgccacaggauaaccagcuuacguacguugugauagcaauacuaacuguaguugcagcaacaauggcuaacgagaugggauuuuuagagaagacuaagaaagaucucgggcuugguagcauuacuacacaagaaagugaaucaaacauauuagauauugaccugcgaccugccucagcuuggacucuauacgccgucgcgacuacguuuguuaccccgauguuaagacauucgauagaaaauucaucggugaacguaucacuuacugcgauagcaaaccaggccaccguacuaaugggacuugggaaaggauggccuuugucuaaaauggacauugguguuccgcuacuugcaaucggauguuacagccagguuaacccaauaacucuaacugcugcacuauuacuauuaguagcgcacuacgcaauaauaggccccggucuucaagcuaaagcuaccagagaggcucagaagcgagcagcugcugguauaaugaaaaacccaacaguugauggaauaacaguaaucgaccuugaaccgauuccuuaugacccuaaauuugaaaaacaacucgggcagguaaugcugcuuauacuaugcguuacgcaaguuuuaaugaugaggacaacaugggcacuaugugaagcccuaacacucgcaacggguccaauaucuacgcugugggaaggcaauccggggagguuuuggaauacgacuauagcuguaucuauggcaaacauauuuagaggaagcuaucuugcuggcgcaggccuauuauuuagcaucaugaagaauaccacaaacacaagaagggggacuggaaacauaggggaaacauuaggggaaaaauggaaaaguagacuaaacgcauugggcaagucggaguuccagauauauaagaaaucuggaauccaggaggucgauagaacguuggccaaggaagguauaaaacgaggggaaacggaucaucacgcgguuagcagagguagcgcuaagcuacgcugguuuguagaacgaaauaugguaacaccugaagguaaaguagucgacuuagguuguggcagaggggguuggucauacuacuguggaggucuuaaaaauguucgugaaguaaaggggcuaacgaaaggcggaccugggcacgaagaaccaauacccaugucaacguacggauggaacuuagucagauuacaaucaggcguagauguauucuuuacuccaccagaaaagugugauacccuacuuugcgacauuggagaaucgucgccaaauccuaccauagaagcagguagaacauuaagaguucucaauuuaguagaaaacuggcuaaauaauaauacacaauucugcauaaaaguacuaaacccuuacaugccuagcguuauagagaaaauggaggcacugcaaaggaaauauggcggcgcauuaguucggaacccgcuuagcagaaacucaacgcaugaaauguacugggucuccaaugcaacagggaauauagucaguucagucaauaugauaucaagaaugcuaauuaaucgguuuacgaugaaacacaagaaagccacauaugagccagauguugacuuggggucaggcacccgaaacauaggcauagaaucagaaauaccaaaccuugacauuauuggaaaaaggaucgagaaaauuaagcaagaacacgagaccucauggcacuaugaucaagaucacccauacaaaacgugggccuaucacggaucauaugaaaccaaacaaaccgguagcgcaucuucaauggugaauggcguagucaggcuccugacaaaaccgugggauguaguuccuaugguaacacaaauggcaaugacagauacuacuccuuucggucaacagcgaguauuuaaagaaaaagucgacacacggacucaggaaccaaaagaagggaccaagaaacuaaugaaaauuacagcggaaugguuauggaaggaauuagggaagaagaaaacuccaaggaugugcaccagggaagaauuuacgcgaaagguacggaguaacgcagcguuaggagcaauauucacugaugaaaauaaauggaaaagcgcaagagaagcagucgaagacgggagauuuugggaguuagucgacagagaaagaaauuuacacuuggaaggaaaaugugaaaccuguguguauaauaugaugggcaagagagagaagaaacuuggugaauuuggaaaggcgaaaggaucacgggccauaugguacaugugguuaggagcccgauuuuuagaguuugaagcauuaggauuccuaaaugaagaccacugguucuccagaggcaacagucuaucuggagucgaaggugaaggucuccaucgacugggauacauacuccgcgaugugggaaagaaagaggguggcgccauguaugcugaugacacagcuggaugggauacaagaaucacauuagaggacuugaaaaacgaagagauggucacuaaucauaugaaaggugaacacaagaaacucgccgaagcaauauucaaacucacauaucagaauaaaguuguaaggguacaaagaccaacaccuagaggaacagucauggauauaauaagucggagagaucaaagagguucaggccaaguuggaacauauggucuaaacacguuuacaaauauggaagcacaacuaauuagacagauggaaggcgaaggcauauuuaaaucaauccagcaucucacagccaccgaggaaaucgcaguacaaaacugguuggcgcguguagggcgcgaaagacuuaguaggauggcgaucuccggggaugacuguguaguaaagccuauugaugauagauuugcaucagcauuaaccgcacuuaacgauauggguaaaguucguaaagacauucaacaaugggagccaucacguggguggaacgauuggacucaaguaccuuucugcucucaccacuuucacgaguuaguuaugaaagauggccggguucuaguuguaccaugcagaaaucaggaugaacuaaucggucgagcaaggauaucacagggggccggauggaguuugaaagaaacagcuugccuaggaaaaucauaugcacaaauguggacacuaauguauuuccauaggcgggaccuaagacuagccgcaaacgcuauaugcagcgcaguuccuagucacuggguuccaacauccaggacuacauggucgauacacgccaaacacgaauggaugacuacggaagauauguuagcaguuuggaauagaguauggauccaagaaaaccccuggauggaagauaaaacuccaguugagagcugggaagaaguacccuaccuuggaaaaagggaagaucaaugguguggcagcuuaauaggcuuaaccucuagagcaacgugggccaaaaauauacaaacugcgauaaaucaaguaaggagucugauagggaaugaggaauauacagacuacaugccgucaaugaagcgauucagaagggaggaggaagaggcuggcguucuuugguga

SEQ ID NO: 22398 - RNA, 9876 nt, Artificial Sequence
  derived and/or modified CDS sequence (opt6) from DENV-2__FJ744703__SS-prME
acggcuggaguaauaguuauguuaaucccgacugcaauggcauuucauuuaacgacucguaauggagaaccccacaugauagugggucgucaagaaaaagggaaaucacuuuuauuuaaaacugaagauggagugaauaugugcacuuuaauggcuauagauuugggugaacuaugugaagacacuauuaccuauaaaugcccccuucuuagacaaaaugagcccgaagacaucgacugcuggugcaauagcacgucuaccuggguuacuuauggaacauguaccacuacaggagaacacagaagagagaaaaggaguguugcucuagucccccacgucgguaugggacuugaaaccagaacugaaacguggaugagcagcgaaggugcauggaaacacguacaaagaauagaaaccuggauauugaggcauccaggauuuacaauuauggcggcaauccucgcauacacuauuggaacaacacacuuucaaagagcguuaaucuuuauauugcugacugcgguagcacccucuaugacaaugcguugcauuggaaucucgaauagggacuuuguugaggggguuaguggaggaucauggguggauauaguacuagagcacggauccuguguuacuacaauggcgaaaaacaaaccuacacuagauuucgaacuaauuaagacagaggcaaagcaaccagcaaccuugaggaaguauugcaucgaagcaaaacugacuaauaccacuacagagagccguugccccacucagggagagccuagucuaaaugaagaacaagauaaaagauucauaugcaaacacaguaugguugaucgaggaugggguaacggauguggucuauucggaaaaggcggcauaguuacuugcgcaauguuuacuuguaagaaaaacauggaagggaaaguuguucaaccggaaaaccuagaauauacaaucguuauaacaccacacuccggugaagaacaugcaguagguaacgacacgggcaaacacggaaaagaaauaaaaaucacgccgcaaagcucaauaacugaggcagaguuaacagguuauggaaccguaacuauggaauguaguccucgcacugguuuagauuuuaaugaaaugguauugcuacaaauggaagauaaggcaugguuagugcaccgacaaugguuuuuggauuugcccuuaccuugguuaccaggcgcggauacucaaggaagcaauuggauacaaaaagaaacuuuaguaacauuuaaaaauccucacgccaagaaacaagacgucguaguucucggaucucaagaaggggcgaugcauacagcuuuaaccggagcgacagaaauacaaaugucaucaggcaaucuucuuuuuacaggucaucuuaaaugcagauuacggaccgacaaacuucaauuaaaagggaugucauauuccauguguacagguaaauuuaaaauuguaaaagaaauugcagagacacaacauggaacgauaguaauaaggguacaguacgaaggggacgggucuccauguaaaauaccauuugaaauaacagacuuagagaaacgacacguacuuggcagacucaucacugugaaucccauuguuacagagaaagauucgccagucaacauagaagcggaaccuccuuucggagacagcuacauaauaauaggagucgaacccggacaauuaaaacuuaacugguucaaaaaggggucaucgauaggacaaauguucgaaacuacaaugaggggagcaaaacgaauggccauccugggcgauacagcuugggauuuugguucguuaggagguguauucacaucgauuggaaaagcacugcaucaaguuuuuggagcaauuuauggagcggcuuuuaguggugugucuuggaccaugaaaauauuaaucggcguuauaaucaccuggauagguaugaacucuaggucaacaagucuaucgguaagucuaguauuaguagguguaguaacauuauaccuaggagcgguaguacaagcagacuccggcuguguaguaucauggaaaaauaaagaauuaaagugugggucgggaauauuuaucacagauaacguccauacauggacagagcaauauaaauuucaacccgagucaccgucuaaacuggccagugcgauucaaaaagcgcacgaagaagggaucuguggaauaagaagugucacccgguuagaaaaucugauguggaagcaaaucacaccagagcuaaaccacauacccagugagaaugaaguaaaauugacaaucaugacaggugacauaaaagguauuaugcaggcugguaaacgaucuuuacgaccucaaccgacggaacuuaaauacucauggaaaacgugggguaaagcuaaaauguugaguacagagagucacaaucaaacauuccucauugaugguccugagacagcagagugcccaaacacgaauagagccuggaacucuuuggaaguagaagacuacgguuuugggguauuuacuacuaauauauggcugaaacuccgagaaaagcaagacguauuuugugauagcaaauugaugagugcggccauaaaggauaaccgcgcugugcaugcugauauggguuauuggaucgaaucagccuugaaugauacauggaagauggaaaaagcgaguuucaucgaaguaaaauccugccauuggcccaaaucucacacucuuuggucuaauggagucuuagaaucugagaugauaauacccaaaaauuuugcaggccccguuagccagcauaauuauagaccuggauaccauacccaaacugcuggaccguggcaccuaggaaaacuagaaauggacuucgacuucugugaggguaccacaguaguuguuacagaagauugugggaacagaggaccaucgcuuagaacaacaacagccucggguaaacugauuacagaaugguguuguaggaguuguacccuaccaccccucagguaccguggagaggacggcugcugguaugggauggaaauaaggccucugaaagaaaaggaagaaaaccucgugaauagucuaguuacggcaggccacggucaaauagauaacuucagcuuagguguauuaggcauggcuuuguuuuuggaagaaaugcuuaggacuagaauuggaacaaaacacgcaauauugcucguagcaguauccuucguuacacucauuacagguaauaugucauuccgagauuuaggacgagugauggugaugguaggagcuacuaugacagaugauauuggaauggggguuaccuaucuagcauuacuugcugcauuuaaaguucgaccaacuuuugcugccggacuuuuauuacggaaacugacgucuaaagaauugaugauggcuacuauaggaauagcgcugcuaucacaguccacgauaccagaaacaauauuggaacuaacggaugcuuuggcccuaggcaugaugguacuaaaaauaguucgaaauauggagaaauaucaacuagcaguaacgauaauggcgaucagcuguguaccaaacgcugucauauuacaaaaugcguggaaaguaucaugcacaauauuagcugcagucucaguuucuccacuccuacugaccucaucacaacaaaaggcggacuggaucccguuagcacucaccauaaaaggguuaaauccaacugcaauauuucuaacaacccuaucucguacuucuaagaagagaagcuggccacuaaacgaagcgauuauggcaguagguaugguaucaauauuagcgaguucccuuuuaaagaaugauauuccaaugacugguccuuuaguugcaggaggauuacugaccgucugcuacguucuaacaggaagaucugcugaccuagagcucgaaagggcagcagaugugaaaugggaagaccaggccgaaauuucaggcaguagcccaauucuuucuaucaccauuucagaagaugggucaaugagcauuaaaaacgaagaagaagaacaaacccuaaccauauugauuagaacggguuuacugguaaucagcggaguauuuccuguauccauaccaauaacugcugcagcuugguauuuaugggaagugaagaaacaacgggcgggagucuugugggacguaccuagcccaccaccaguugaaaaggcagaacuggaagacggcgccuaucggauaaagcagagagguauucugggauauagucaaauaggugcagggguauauaaagaggggaccuuucauacuauguggcacguaacaaggggagcugugcuaaugcacagaggcaaacgaauugaacccagcugggcugacguuaagaaagacuuaaucaguuauggaggggguuggaaauuggagggagaauggaaagaaggugaggagguccaaguucuggcucuugaaccaggaaagaacccaagagcagugcaaaccaagccgggaauuuuuaaaacaaacacaggaaccauuggugccguaagucuugauuuuucgcccggaacgucuggaucuccgauugucgacagaaagggaaaaguuguaggacuguauggaaacgguguuguuaccagaucaggggcuuacgucuccgcaauugcacaaacagagaaaaguauugaagauaauccggaaauagaagaugauauuuuucggaagaaaagguuaaccauaauggaccugcacccaggugcuggaaaaaccaaacgguaucuuccagcgauugucagggaagcuaucaagagaggucuuagaacuuugauccuugcccccacucgagucguugcagcagaaauggaggaggcuuuacggggacuuccgauuagguaccaaacucccgccauuaaaacugaacauacagguagggagauaguagauuuaaugugucaugcaacguucaccaugaggcuguuaucgccuguaagaguaccaaacuauaauuuaaucauuauggaugaagcccauuuuacggauccagcaaguauugcggcaagagguuauauuucgacacguguggaaaugggugaagcugcugggauuuuuaugaccgcaacaccacccgguuccagagacccauucccacagucaaaugccccaaucauggacgaagaacgcgagauacccgaacgcucauggaacucaggucacgaaugggugacugacuuuaaggguaaaacgguaugguuugugccaucuauuaaggcagggaaugauaucgcugcuugucuaagaaagaacgggaagaaaguaauacagcucuccagaaaaacauuugauucagaauacgucaaaacacgagcaaacgacugggauuuuguaguaacaacagacaucucggaaaugggagcaaacuuuaaggcggaacgugucauagauccaagaagaugcaugaaaccaguaaucuuaacugacggcgaagaaagaguuauacuugccgggccaaugccggucacucauucgucagcagcgcaacgacgaggaagaaucggccgaaauccuaaaaaugaaaaugaucaauauauauauaugggagagccccuagagaacgaugaagacugugcgcacuggaaagaagcaaagauguuauuagauaauauaaacaccccugaaggaauaauaccaucgauguuugaaccugaacgggaaaaaguagaugcaauagauggagaauaucgauuacguggagaagcaagaaaaacguucgucgaccuaaugagaagaggggaccucccaguaugguuggcguacaaagucgcagcugagggaauuaauuaugcagaucgcaaauggugcuuugacggaauuaaaaacaaccaaauauuagaagaaaacauggagguugagauauggacaaaagaaggggagaggaagaaacuuaaaccacgcugguuagacgcgcggauauauagcgauccguuagccuuaaaagaauuuaaagaauuugcugcaggcagaaaaucauuaaccuugaaucuuauaaccgaaaugggaagauuaccuacuuucaugacccaaaaagcacgcaaugcccuagauaauuuagccguucugcauacugcagaggcuggaggaagggccuauaaucaugcauugucugaauugcccgaaacgcuggaaacacuguuauuauuaacguuauuggcgacagugacaggugggauauuccuauuuuugaugagcggcaaaggcauaggaaaaaugacgcuuggaaugugcugcauuauuacagcaucuauauuacuuugguaugcucaaauacaaccgcauuggauugccgcuucgauaauauuggaauuuuucuuaauuguacuacugaucccagaaccagaaaaacaaagaacaccacaggauaaccagcuuacauauguugugaucgcaauccuaacuguuguagcggcaacaauggcaaaugaaaugggauuuuuagagaaaaccaagaaagaucuaggucucggcaguauaacuacacaagaaucagagucgaacauauuagacauugauuugcgaccggcgagcgcauggacgcuauaugcaguagcaacgacguucguuacuccgaugcucagacauucuauagagaauaguucggucaauguaucgcuaacagcuauagcgaaucaagcuacgguauuaaugggccuggguaagggguggccccugagcaaaauggauauugguguuccauuacuagcaaucgguuguuauucucaaguaaauccuauaacacuaacagcagcacuccuauuauuaguagcacacuacgccauaaucggcccuggauuacaagcaaaagcuacacgagaggcucagaaaagggcugcagcagguaucaugaaaaauccuacaguugaugggaucacaguuauagaucuugaaccaauaccguacgauccaaaauuugaaaaacaauugggacaggucauguuauugauacuuugugucacgcagguauuaaugaugagaacuacgugggcuuugugcgaagcauuaacccucgcaacuggaccgauaagcacacucugggaaggaaacccgggacguuucuggaauacaaccauugccgucaguauggcaaauauuuuuagggguaguuauuuagcgggggcgggauuauuguuuucuauaaugaaaaacacuacaucaacaagacgugguacgggaaauauaggcgaaacacucggagaaaaauggaagucacgacucaaugcucuaggcaagucugaauuucaaauauacaaaaagucuggaauccaagaagucgaucgcacacuggcuaaagaagguauuaagcguggagaaacugaucaccacgcaguaucccgggggagcgcuaaauuaaggugguucguugaacgcaacaugguaacacccgaaggcaaaguaguggaccuaggauguggucgaggcggcuggucuuauuauuguggcggguugaaaaauguaagagaagucaaggggcuaacuaaaggcggacccggacaugaagaaccaauuccuauguccacauaugguuggaauuuggugcgacuucaaagcggaguagacguauucuuuaccccaccggaaaagugugauacacuacuuugcgacauaggagaaucgagucccaacccaacuauagaagccggucgaacguuaagaguauuaaaucuuguagaaaacuggcuaaauaauaauacacaguuuuguauuaaaguauuaaauccauacaugccaucuguaauugagaaaauggaggcacuacaacgucaauauggaggcgcucuugugcguaauccuuugucucggaauaguacacaugaaauguacugggugucaaaugcaacuggaaacauagucagcucggugaacaugauuagcagaaugcuaauaaaccgguucacgaugaagcauaagaaggcuacguaugaaccggaugucgaccuagguaguggaacucgcaauauuggaauagagagugaaauaccuaauuuggacauuauagggaaaagaauugaaaagauuaagcaagaacaugaaaucucuuggcauuaugaccaagaccauccauacaaaacgugggcuuaucaugggucuuaugaaacaaagcagacuggcagugcauccaguauggucaacggugugguacgccuauuaacaaaaccaugggauguugugcccaugguaacacagauggcuaugacggacacaacaccauuuggucaacaacgagucuuuaaggagaaggucgacacaaggacucaagaaccuaaagaagguacuaaaaagcucaugaaaauaacagcagaauggcuuuggaaagaguuaggcaagaagaaaaccccaagaauguguaccagagaagaauuuaccaagaaagucagaucaaacgcggcucucggggcaauuuuuacagaugaaaauaaauggaaaagugcuagagaagcaguagaagaugguagauuuugggaacuugucgaucgcgagagaaaucuacauuuagaagguaaaugugaaacuugcguauacaauaugaugggaaaaagagagaagaaauugggagaguuugggagagcaaaagggagcagagccauaugguacauguggcucggagcgcguuuucuggaauuugaagcacuugguuuucucaacgaggaccauugguucucccgcgggaacucuuuauccgggguggagggggaaggacuucaucggcucgguuacauucugagagacgugggaaagaaagaaggcggcgcuauguaugcagaugacacugcuggaugggauacaagaauuaccuuagaagaucuaaagaaugaagaaauggucacaaaccacaugaaaggagaacauaagaaacuagcugaagccaucuuuaaauuaacauaccagaacaaaguuguacgaguacaaagaccaacgccgcguggcacaguuauggacauaauuucuagaagagaccagaggggcuccggacaaguagggacauauggccuaaacacauucacaaacauggaagcacaauuaaucaggcaaauggagggggaagguaucuuuaaaucuauacaacaucuuacagcaacagaggaaauugccguucaaaauuggcucgcucgaguuggaagagaaagguugucucggauggccaucucgggggacgauugugucguuaaacccauagaugauagguucgcuuccgcucuaacagcauugaacgacauggguaaaguaagaaaagauauccagcaaugggaacccagcagaggcuggaaugauuggacucaaguaccauuuuguagccaccauuuccaugaacuuguaaugaaagauggucgaguccuaguaguaccuugccggaaccaggaugaauugauagguagagcccggauaucacaaggugcaggauggucacuuaaagaaacagcaugucuagguaaaucguaugcacaaauguggacucuaauguauuuucacaggcgagaucucaggcuugcugcaaacgccauuugcucagcugucccgucccauuggguaccaacaagcagaacaacauggucgauacaugcaaagcaugaauggaugacaacggaggacauguuggcagucuggaacaggguuuggauacaagagaacccauggauggaagauaaaacaccuguagaaaguugggaagaaguccccuauuuagguaaaagggaggaccaaugguguggaucauuaauuggccugacaucacgagcaacaugggccaaaaauauccaaacggcuauaaaucaggugagguccuuaaucggcaacgaggaauauacugauuacaugcccucaaugaagcgauuucgcagggaagaagaagaagccggugugcucugguaa

SEQ ID NO: 22399 - RNA, 9876 nt, Artificial Sequence
  derived and/or modified CDS sequence (opt6) from DENV-2__FJ850067__SS-prME
acagcagggguuauaguaaugcuuauuccgaccgcuauggcuuuucaucuuaccacgagaaauggagaaccacauaugauuguaggaagacaagaaaaagggaaaucccuauuauuuaaaacagaagaugguguaaauauguguacguugauggcuauagaucuaggagaacuaugcgaagauaccauuacuuauaaauguccauuauuacgacaaaacgaacccgaagacaucgauuguuggugcaauucgacaucaacgugggugacauauggaacaugcacaaccacaggggaacaucgucgugagaaaaggagcguggcuuuaguaccacacgucggaaugggauuagaaacaaggaccgaaacuuggauguccucggaaggggcuuggaaacauguccaaagaaucgaaacauggaucuuaagacauccagguuucacgaucauggcagcaauuuuagcguacacaauaggaacuacacacuuucaaagagcgcuaaucuuuauuuuauuaacugcaguugcuccaucgaugacaaugagauguauaggaaucucaaaccgagauuucguagaagggguauccggaggcucauggguugacauaguauuggaacacggaucuugcgugacgaccauggccaaaaauaaaccuacuuuagauuuugaacuuaucaaaacggaagcuaaacaaccugcaacgcuuaggaaauauuguauagaagcuaaacuaacgaauacaacuacggaaucacgauguccgacucagggagaaccaucauuaaacgaagaacaagauaaacguuuuauaugcaaacacucaaugguagaucgaggguggggaaauggcugcggacuauuuggaaaaggaggcauagucacaugugcaauguucacauguaagaaaaauauggaaggaaaaguuguacagccugaaaaucuagaauauacaaucgugauuacaccucacagcggugaagaacaugcaguugguaaugacaccggaaaacacggaaaagaaauuaaaaucacaccacagucaagcauaacagaagcagaacuaacaggauaugguacgguuacaauggaaugcucaccacguacaggucuagacuuuaaugaaaugguacuauuacaaauggaggauaaagcaugguuaguccacagacaaugguuuuuggacuugccauugccauggcuaccuggcgcagauacccaagggucgaacuggauacaaaaagaaacccuaguaacguucaaaaauccccaugccaagaaacaagacguaguaguuuuaggaucucaagagggagcuaugcacacggcuuuaacgggcgcuaccgaaauucagaugucaucaggcaacuuacuauuuacaggacauuugaaaugcagguugcggauggacaaauugcaauuaaaagguaugucauauagcauguguacaggaaaauuuaaaauagucaaagagauagcagagacccagcauggaacgauaguaauucgaguacaauaugaaggagacgguucgccauguaaaauuccuuuugagaucacagacuuagaaaaacgacauguacucggacgacuaauaacuguaaacccuauaguaacagaaaaagacucaccaguaaacaucgaagcggaaccaccuuuuggcgacucauacauaauaauaggaguugagccugggcagcucaaacucaauugguuuaagaaaggaaguucuauuggacagauguucgagacaaccaugagaggagcgaaaaggauggcuauccuaggcgacacagcuugggauuuuggaucguuagguggaguuuucacaaguauuggaaaagcguuacaccaggucuucggcgcaauuuacggagcggcguucucuggaguaagcuggacaaugaaaauauuaauaggaguuauuaucacauggauuggaaugaauagcagaucaacaucacuaucagugucauugguccuaguggggguagucacacuauauuuaggagcaaugguccaagcugauaguggcugcguuguaaguuggaaaaacaaagaacuuaaauguggaagcggcauuuucauaacugauaauguacacacuuggaccgaacaauacaaauuucaaccggaaucaccgucuaaauuagcuuccgcaauucaaaaagcgcaugaggaaggaaucuguggcauucguucggucacacggcuugagaaccuuauguggaaacaaauaacaccugaauuaaaucacauacucucggaaaaugaaguaaaacuuacaauaaugacgggagacauccgcggaaucaugcaagcagguaaacguagccuaaggccgcaaccuacagagcucaaauacaguuggaaaacauggggcaaagccaaaaugcucucaacggagucucacaaucaaacuuucuugauagacgggccggaaaccgcagaguguccgaauacaaaccgugcguggaacucauuagagguagaggauuacggguuugggguuuuuacaaccaauauaugguuaaaauugagagaaaaacaggacguuuucugcgauaguaaacuaaugagugccgcuauaaaagacaacagagcuguccaugcagacauggguuauuggauugaaagugcguugaaugauacuuggaaaauggaaaaggcuucauucaucgaaguuaaaucgugccauuggccuaaaucacauacauuauggagcaauggcguacuugaaucagaaaugauaauacccaaaaauuucgcaggaccgguaucacagcauaauuauagaccuggcuaccauacgcaaacggcgggcccauggcauuuggguaaacuagaaauggacuuugauuugugugaagguacaacggugguuguaacugaagauuguggaaacagaggaccuucguugagaacaacgacugcuucagggaaacuuauuacagaaugguguuguagguccuguacguuaccaccucuuagauaccgcggggaagacggcugcugguauggaauggaaauaagaccguuaaaagagaaagaagaaaauuugguaaauucauuaguaaccgcaggucaugggcaaaucgauaauuucagcuugggaguuuuagguauggcccuauuuuuagaggagauguugcgaacacgcauagguacaaaacacgcuauacuuuuaguugccgugucguucgugacucuaauuacugguaauaugucuuuuagggauuuaggacgaguaaugguuaugguaggugcuacaaugacagaugauauuggaaugggaguaacuuacuuggcacuauuagcagcauuuaaagucagaccgacauuugcagcaggccuccuucuucgaaaauuaacaagcaaagaacuuaugauggccacuauaggaauugcgcucuuaagccagaguacuauuccugagacaauucuugagcuaacagaugcucucgcauugggcaugaugguuuugaaaauuguaagaaacauggagaaauaccagcuagcugucacgauaauggcaauaagcuguguccccaaugcagugauucuacagaaugcauggaaaguuaguuguacuauccuagcggcaguuucaguuucaccguugcucuuaacaaguucucagcaaaaagcugauuggaucccucuagcucuaacgaucaaaggacuaaauccuaccgcuauauuuuugacgacuuugaguagaacuuccaagaaacgcuccuggccacuaaaugaagccauuauggcaguaggaaugguaagcauacuggcgucauccuuauugaaaaaugacauucccaugaccggacccuuaguugccggaggauuauuaaccguguguuaugugcuaacaggucgguccgcagacuuggaacuugaacgcgcugcagauguaaaaugggaggaccaagcugaaauuagcggauccucuccaauauugagcauuacuauuucagaagacggcucuaugaguauaaagaacgaagaagaagaacaaacacugaccauauugauacgaacaggucuuuuaguaauauccggcguauuuccagucucuauaccaauaacugcugcagcgugguaucuuugggaagucaagaaacaaagagcaggaguacuuugggacgugccgaguccaccaccaguagaaaaagcugaguuggaagacggagcuuacagaauaaaacaaagggguauauugggauauucccaaauaggugcaggcguuuauaaagagggaacguuucacacgauguggcauguuacgcgaggagcgguccuuaugcacagagguaaacgaaucgagccgucaugggccgacgugaagaaagaccucauuaguuaugguggcgguuggaaauuagaaggugaauggaaagagggggaggaaguccagguucuggcauuagaacccggcaaaaacccacgggcugugcaaacaaaaccagguauauuuaagaccaacaccggaacaauaggagccguaucgcuagauuuuagcccaggaacgucuggaucgccuauaguagacagaaagggaaaaguaguugguuuauaugguaauggaguugugacacgaucgggugccuacguuucagcuauugcgcagacagaaaagucaauugaggacaauccagaaauagaggacgauauauuccgaaagaaaagacucacuauuauggaccuacauccuggagccggaaagacuaaaagguacuuacccgccauaguucgugaagcaaucaaaagaggacucagaacuuuaauacuugcgccgacuagggucguagcagcagagauggaagaggcacugcgcggccuaccuauacgauaucagacgacagcaauuaagacugaacauaccgguagagaaauaguugaucucaugugucaugcaacauuuaccaugagacuuuuaucuccaguucgcguaccgaauuauaauuuaauaauaauggaugaagcacauuuuaccgauccagcuucaauagcggcacgagguuauaucucgacacgaguggaaaugggagaagccgcagggauauuuaugacagcaacacccccaggaagccgagauccauuuccgcagucaaacgcaccuauuauggacgaagaacgcgaaauuccugagcgcucguggaacucgggacacgaauggguaaccgacuucaaagggaaaacaguuugguuugucccuagcauaaaagcugggaaugacauagcggccuguuuacggaagaauggcaagaaagucauucaacucucacguaaaaccuuugauucugaauaugucaaaacuagagcaaaugauugggacuucguuguuaccacagauauaucagaaaugggagcaaauuuuaaagcagagcgaguuauagacccaagaagguguaugaaaccggucauauuaacagauggcgaagaacgaguaauucuagcaggaccaaugccaguuacgcauaguucugcagcucaaagacguggccgcaucggacgcaacccuaaaaaugaaaaugaccaauauauauauaugggugaacccuuggagaacgaugaggauugugcccacuggaaagaagccaagauguuauuagauaauauuaauacuccagagggaauuauacccaguauguucgaaccugaacgagaaaaaguggaugcaauagauggugaauauagguugcgaggagaagcacgaaaaacauucguugaucugaugaggcgcggggaccugccuguguggcuggcuuauaaaguugcagccgaaggcauaaauuacgcugauaggaagugguguuuugacggaaucaagaacaaccagauauuagaggaaaacauggaaguugagauuuggacaaaggaaggagagaggaagaaacugaaacccaggugguuggacgcaagaauauauagcgauccacucgcacugaaggaauuuaaagaauuugcugcgggacgcaaaucgcucacacuuaaucuaauaacugagaugggcaggcuccccacuuuuaugacccaaaaagcucguaacgcauuggauaacuuagccguacuacauacggcagaagccgguggccgugcauauaaccacgcauugagcgaacuuccagaaacuuuagaaacgcuuuuauuauugacacuacuagcaacaguuacaggcggcauauuucuguuuuugaugucgggaaaagggauaggaaagaugaccuuaggaauguguugcauaauaaccgcguccauuuuauuaugguaugcgcagauacaaccucacuggauagcugcgucgauaauacuugaguucuuuuuaauuguucucuuaauuccagaaccagaaaagcaaaggaccccacaagacaaccagcuaacuuacguugucaucgcuauucuaacuguuguagcugcgacuauggcaaaugaaaugggguuccuugagaaaaccaagaaagaucuaggucucggcuccauaaccacccaagaaucggaaucaaauauacuagacaucgaccuacggccggccucagcauggacacuauaugcaguagcuacuacacuuguaacuccuauguuaagacauuccauagaaaacucuucgguaaaugucucucuaaccgcgauagcaaaccaggcaacuguacuaaugggucuagguaaagguuggcccuuaaguaagauggauauaggcguaccauuacucgcuauaggcuguuacagccaaguuaauccaauaacacucacagccgcguugcuacuccuagucgcccauuacgccauuauaggaccuggccuccaagcuaaggcuacccgggaagcucagaaaagagcugcugcugguauuaugaagaaccccacaguugacggaauaacaguuauugauuuagaaccaaucccuuaugacccaaaauucgagaagcagcuaggucaaguaaugcugcuuauacuuugcguuacgcaagugcugaugaugcgaacgacaugggccuugugugaagcauuaacucuugcgacaggaccuauuucuacacucugggaagguaacccugggcguuucuggaacacaacaauagcuguaucaauggcaaauauuuuccguggaucuuaccuugcaggggcaggucuuuuauucuccauuaugaaaaauacgaccaacacccgcagaggaacgggaacaaucggcgaaacgcugggugaaaaguggaaaagcagauuaaaugcguuaggcaaaagugaguuccagauuuauaagaaauccggaauacaggaaguugacagaacacuggcgaaagaagguauuaaacgcggagaaacugaccaccaugcaguuuccagggggagcgcaaagcucagaugguuugucgaaaggaacauggucacgccagagggcaaagugguugaccuaggaugugggagaggggguugguccuauuacugugggggacugaaaaacguaagagaaguaaagggucuuacaaaaggcggaccugggcacgaagaaccaauacccaugucaacuuauggauggaacuuaguucggcuacagaguggugucgauguuuucuuuacgccaccagaaaaaugcgaaaccuuauuaugcgauauaggggagagcucaccaaacccuacaauagaagcaggacgcacccuuagaguacugaaccuuguagagaacugguuaaacaauaacacacaauucuguauaaaaguacucaaucccuauaugcccucuguaauugaaaagauggaggcuuuacagagaaaauaugggggcgcccuggugaggaauccucuaucgaggaacucaacucacgagauguacugggugucaaaugcaacagguaauauaguuuccagcguaaauaugauaucaagaaugcuuauaaauagguuuacgaugaagcacaagaaagcuacuuaugaaccugacguggaccuuggaaguggaacgaggaacaucggaauagagagugaaauuccaaauuuagauauaauagguaaaaggauagagaaaaucaagcaggaacaugaaacaagcuggcacuaugaccaagaccaucccuacaaaacuugggcauaccaugguuccuacgagacuaaacagacuggauccgccucaucuaugguuaacggaguuguuagacuauuaacuaaacccugggauguaguaccuaugguuacucaaauggcuaugacagacacuacaccuuucggacagcaacgaguauuuaaagaaaaaguagauacccgcacucaggaaccaaaggagggaacuaagaaauuaaugaaaauuaccgcagaaugguuauggaaagaauuaggcaagaagaaaacgccaagaauguguacucgugaggaguucacaagaaaagugaggucuaaugccgcacuaggugcaaucuucacagaugaaaacaaauggaaauccgcgcgggaagcaguagaagacggacgauuuugggaacucguugacagagaacgaaauuuacaucuagaaggaaaaugugaaacaugcguguauaauaugaugggaaagagagaaaagaaacuuggugaauuugguaaagccaaagggucaagagcaauaugguauauguggcuaggcgcaagauuucuggaguucgaagcauuaggcuuucucaaugaagaucauugguucucaagggguaacaguuuaagcggaguugagggagaaggacuacaccguuuaggcuauauacuuagggacgucggcaagaaggaagggggagccauguaugccgaugauacggcugguugggauaccagaauuacguuggaagaccugaaaaacgaagaaaugguaaccaaucauaugaaaggcgagcauaaaaagcuagcagaagcuauuuucaaacucacuuaccagaauaagguagugcguguucaaagaccuaccccacgaggaacaguuauggacauaauaagccgacgugaucaacguggaaguggacaaguaggaacuuauggucuaaauacauucacaaacauggaagcccaacuaauaagacagauggagggagaggguauauuuaaaucuauucaacacuuaacugccaccgaggaaauagcaguacagaacugguuggcuagagucgggagggagagguuaagucguauggcuauaucaggggacgacuguguugugaaaccaauugaugaucgguuugcuagugcacuuacagcacugaaugauauggggaaaauccgcaaagacauacaacaaugggagccaucucgcggauggaacgacuggacacagguuccauucuguagccaccauuuucaugaauuaguaaugaaggacggaagaguuuuggucgugccuugcagaaaccaagacgaacuaauuggucgagcacggauaucacaaggagcuggauggucauuaaaggagaccgcaugccuuggaaagucauaugcacaaauguggacauuaauguauuuccaccggagggaucuuagacucgcagcuaaugcuauaugcuccgccguuccaucucacuggguccccacaucaagaacaaccuggaguauucaugcgaaacaugaauggaugaccacagaagacauguuggcuguuuggaaccggguuuggauccaggaaaacccuuggauggaggauaaaacuccagucgagucuugggaagaagucccguaucuugguaaaagagaagaccaauggugcgguucccugauaggccuaacgagucgggcaacuugggcuaaaaauauacaaacagcgauuaaucagguaaggagccuuauaggaaacgaggaguauaccgacuauaugccaagcaugaaacgguuucgaagggaagaagaggaggcuggaguguugugguaa

SEQ ID NO: 22400 - RNA, 9876 nt, Artificial Sequence
  derived and/or modified CDS sequence (opt6) from DENV-2__FJ850060__SS-prME
acugcuggagugauugugauguuaauucccacugcgauggcuuuccaccuaacaacaagaaauggugaaccccacaugauuguaggaagacaagaaaaagggaaaagucuacuuuuuaaaacagaagauggaguuaauauguguacucugauggcaauugaucuaggagaguuaugugaagauaccauaaccuauaaaugucccuuacuaagacaaaacgaacccgaggacauugauuguuggugcaacuccacuucaacuugggugacauauggaacguguaccacaacaggugaacaucgacgugaaaaacggaguguagcucuggucccgcacguaggaaugggauuagaaacacgaacagaaacauggaugucuucagaaggagcauggaaacacguccagagaauagagaccuggauuuuacgucacccuggauucacuauuauggcugcaauauuagcauacacaaucgguacuacccacuuucaacgagcguugauuuuuauauuauugacggcgguagcacccaguaugacaaugcgauguauaggcaucagcaacagggauuuuguugaaggcguuucgggagguuccugggucgauauaguauuagaacauggauccuguguuacaacgauggcuaagaacaaaccaacucuugauuuugaauuaauuaaaacugaagcuaaacaaccagcuacgcugaggaaauauugcauugaagcaaagcugacaaacacgacuacggaaagucggugccccacucaaggagaaccgagccuaaaugaagaacaagacaaacguuucauuugcaagcauucaaugguugauaggggaugggguaauggauguggauuauuugguaaaggaggcaucgucacuugcgccauguucacguguaagaaaaacauggaaggaaaaguaguccaaccggaaaaccucgaguacacaauuguaauaacaccacauucgggggaagaacacgcuguagggaaugacacggguaaacacgggaaagaaaucaaaauaacgccccaaucuucgauaacagaggcugaacucacaggauacggaacaguaacgauggagugcucaccaagaaccgguuuggauuuuaaugaaaugguuuuguuacaaauggaagacaaagcauggcuggugcaucgacaaugguuccuggaucugccuuuacccugguuacccggggcagauacgcaagggucaaacuggauccagaaagagacccuagugacuuucaagaacccacacgcuaaaaagcaagauguaguuguccuagguucacaagaaggcgcuaugcacacagccuugacgggugcuacagaaauccaaaugucuucuggcaaccuauuauuuacgggacaccuaaaguguagauuaagaauggacaaacuacaauugaagggcaugaguuauuccauguguaccggaaaguucaaaauaguuaaagaaauugcugaaacgcaacauggaacaauaguaauuaggguacaauacgaaggagacgguaguccauguaagaucccauucgaaauuacagaucuugagaaaagacacgugcucggaagauuaauuacagucaaucccauuguaacugagaaagauucacccguaaacauagaagcagaacccccuuucggagacaguuacaucauuauuggaguugaaccugggcaacugaaauuaaacugguuuaagaaagguagcucuauuggccaaauguucgaaacaacaaugcgaggagcuaaaaggauggcaauacuuggagacacagccugggacuuugguagucuaggaggaguauucacaucaauaggaaaagcgcuccaucagguauuuggagcuaucuauggugcagcuuucucuggggugucuuggacaaugaaaaucuuaaucggaguaauuauuacauggauugguaugaauagcagaagcacaagccucuccguaucuuugguauuaguagggguugucacacuauaccuaggggcaaugguacaagcugauagcgguuguguuguaucuuggaaaaacaaggaguuaaaaugcgguuccggaauuuuuauaacagauaacguacauacuuggacggaacaguauaaauuucaaccggagucaccaagcaaauuagcgagcgcgauucaaaaagcacacgaggaaggaauaugcgguauaaggagcgugacucgacuagaaaaccugauguggaaacaaauaacuccugaacuaaaccauauacuaagugaaaaugaaguaaaacuaacuauuaugaccggagacauaaaggguauuaugcaggcaggaaaaaggagucuuaggccccagccaacggaauuaaaauacucauggaaaacauggggcaaggcaaaaauguuaucuaccgaaucacauaaccagacauuuuuaaucgauggucccgaaacugcggaaugcccaaauacuaaucgugcauggaacagcuuggaaguagaggacuauggguucggagucuuuacaaccaacauaugguuaaaacugcgcgaaaaacaggacguauuuugcgacaguaaauugaugucagcggcaauaaaagauaaucgggcgguacaugccgacaugggcuacuggauagaaagugcauugaaugacaccuggaaaauggaaaaagcaucauucauugaaguuaagucaugucacuggccaaaaucucauacucuguggaguaauggaguucuagaaucagagaugauuauaccgaaaaacuucgcggggccgguuagccagcauaacuaccgaccaggauaccauacccaaacugcugguccauggcaucuaggcaaauuggagauggacuuugauuugugugaaggaacaacggucgucguaacagaagauuguggaaacagaggcccaucgcuucgcacgaccacggcuucagggaaauuaauaacagaaugguguugccggucauguacgcugccacccuugagauaccguggagaagaugguuguugguauggcauggaaauccgccccuuaaaagaaaaggaagaaaaccuaguuaacagcuuggugacggccggucacggacaaauugauaauuucuccuuaggcguuuugggcauggcacuauuccuugaagaaaugcuaagaacaaggauagguacgaagcaugcuauauuauuaguugcaguuucauuuguaacauugaucacuggaaacaugucuuuuagagaucuaggaagaguaaugguaaugguaggagccacuaugaccgacgauauagggauggguguaacguauuuagcauuauuagcugccuucaaaaucagaccaacguuugcagcaggauuauuauugcgaaaauuaaccaguaaggaacuaaugauggcuacaauuggaauagcuuuauuaagucagucaaccaucccugagacuauauuagagcuaacugaugcuuuagcauugggcaugaugguuuuaaaaauugugagaaauauggaaaaguaucaacuggcagucacuauaauggcaaucaguuguguaccuaaugccguaauuuugcaaaaugcguggaaaguauccugugcgauucuggcugcagucucaguaucgccuuuacucuugaccaguucucagcaaaaagcugacuggauaccacuugcgcugaccaucaaaggccucaacccgacggcuauuuucuuaacgacucuaucaagaacaucuaagaaaagaucauggcccuuaaaugaggcuguuauggcuguugguauggugagcauucuugcaagcagcuuacucaaaaaugacauacccaugacaggaccauuagucgcaggagguuuauuaacgguauguuauguuuugacgggucggagcgcugaccuggaacuggaacgcgcugccgacgugaaaugggaagaucaagcggagauuagugggagcaguccuauauuaucaaucacaauuagugaagacgguuccaugucaauaaagaacgaggaagaagaacaaacuuuaacaauucuaauuaggacaggucugcuaguaauauccggaguauuuccaguuagcaucccaauaaccgcugcagcuugguaccuaugggaagucaaaaagcaaagagcaggaguucuaugggacgucccaucuccaccgccuguugaaaaagccgaguuggaggauggugcauauagaauaaaacagagggguauauuaggauauagccagauaggugcagggguuuauaaagaaggaacuuuccacaccauguggcacguaacucgaggagcagucuuaaugcaucgagggaagagaauagaacccuccugggcagauguuaagaaagauuuaauuagcuauggcggagguuggaaacuagagggugaauggaaagaaggugaagaggugcaaguauuagccuuagaaccagggaagaacccaagggcaguucaaacuaagcccgggauuuuuaaaacuaauacuggaacaaucggggcaguaucuuuagacuucagucccggaacaaguggaagucccauaguagaccguaaagggaaaguuguaggcuuguaugggaauggcguuguuacacggucaggggcauacguaagcgccauagcccaaacagaaaaaucgauagaagauaauccagaaauugaagaugacauuuuuaggaagaaacgauuaacaauuauggauuuacacccgggugcuggaaaaaccaaaagauauuuaccggcuauaguucgcgaagcuauuaagaggggccuucgcacgcucauauuagcgcccacgaggguaguugcagccgaaauggaagaagcauuacgggguuuaccuauaagauaucaaacgccggcgauuaagacggaacauacaggaagagagauugucgacuuaaugugucaugcaaccuuuaccaugagauuauuaucuccuguccguguaccuaauuauaauuuaauaaucauggacgaagcacauuuuacggacccugcuuccauugccgcccguggauauaucagcacacgggucgaaaugggagaagcugcuggaauuuuuaugacagcaacaccaccagguagcagagaccccuuuccucaauccaacgccccaauaauggaugaggaacgggaaauaccugaacgaucguggaacucaggacaugagugggugacagauuuuaaaggaaaaacaguuugguuuguaccgucaauaaaagcuggaaaugauauagccgcgugccucagaaagaauggcaagaaagugauacaacuaucgcgaaaaacauuugauucggaauacgucaagacacgagcaaaugauugggauuuugucguuacaaccgauauaucggagaugggggccaauuuuaaagcagaaaggguuauagaccccaggaggugcaugaaaccagucauucugaccgauggugaagaaagaguaauccucgcaggcccuaugccaguuacacacucuagugccgcgcaaagaagagggagaaucgggcguaacccuaaaaaugagaacgaucaauauauauacaugggagaaccucuagagaacgaugaggacugugcucauuggaaagaggccaaaaugcuacuagauaauaucaauacacccgaagggauaauccccaguauguuugaaccugaaagggaaaaaguugacgccauagauggugaguaccgacugagaggugaagcgaggaagacuuuuguagaccugaugcggcgaggagauuuacccguuuggcuggcauacaagguagcagcagaaggaauuaauuaugcugauagaaagugguguuuugaugguaucagaaacaaucaaauccuugaagagaauauggaagucgaaauauggacaaaagaaggagagcgaaagaaauuaaaaccgagauggcuugacgcacggauauacucugauccauuagcgcugaaggaguuuaaggaauuugccgcaggaaggaaaucucuaacucugaaucucaucacggaaauggguaaauuaccuacauucaugacucaaaaggcaagaaaugcgcucgauaaccucgcuguucugcacacagcggaggcuggcgggagggcuuauaaccaugcgcuuucagaguugccugaaacauuggagacccuguuacugcugacauuacuugccacaguaacugggggaaucuuccuuuuccuaauguccggaaagggaauagguaaaaugacgcuuggcaugugcuguauuauaacugcgucaauacuauuaugguacgcucaaauccagccccacuggauagcugcaaguauuaucuuagaguucuucuugaucguccuacuaauuccagaaccugaaaaacaaaggaccccucaggauaaccaacucacuuacguaguuauugcaauacuaacuguaguagcggcaacaauggccaacgaaaugggauuccuggagaaaacaaagaaagaccucggacuaggcucgauaaccacgcaagaaucggaauccaacauucuugacauagacuuaaggccggcaagugcauggacucuuuaugcaguagccacuacauucguaacacccaugcugaggcauuccauagaaaauucaagugucaacguuagccugacagcuauagcaaaccaagccacgguauuaaugggcuuagguaaaggauggccguuaaguaaaauggacauaggugugccuuuguuagcaauaggaugcuauucacaggugaaucccaucacgcuuacggcagcacuccuguuauugguggcccauuacgcaauaauaggucccgguuugcaagcaaaagcaacccgugaggcucagaaacgagcagcugcugggauaaugaaaaacccuacuguagacggcauuacggucauagaccuagagccuauaccauaugaccccaaguuugaaaaacaauugggacaaguuaugcuacuaauacuuuguguuacgcaaguucucaugaugagaacuacaugggcauugugugaagcucuaacgcucgcuacagguccuauaaguacgcuaugggaaggcaacccagguagauucuggaauacaacaauugcaguaagcauggcaaauauuuuuagaggaagcuaccucgccggugcaggccuacuauucucuauaaugaaaaauacaacuaauacucggcgaggaacggguaauauuggugaaacauuaggugaaaaauggaaaagucgucuaaacgcuuuaggaaagagugaguuccaaauuuacaagaagucgggaauacaggagguagaucgaacacuagcuaaggagggaauuaaaaggggagaaacagaucaccacgcuguuagccgaggcagugcgaaacuacgaugguuugucgaaagaaacaugguuaccccggagggaaaggucguugauuuaggauguggaaggggaggauggaguuauuauugcggaggacuaaagaacguuagagaaguaaagggacuaacgaaaggcggccccggacaugaagaaccaauaccuaugagcacguauggauggaaucuagucagacuucagucaggcguugauguauucuuuacacccccagagaaaugcgauacccuacuuugcgacauaggggaaagcagucccaaccccacaauagaagccgggaggaccuuaagaguucugaaccucguagaaaacuggcuuaacaauaauacacaauucugcauaaaaguccugaauccauauaugccaaguguaauagagaaaauggaagcauuacaacgaaaguaugguggagcccuaguacgcaauccguugaguaggaauagcacucaugaaauguauugggugucaaaugccacuggaaauaucguuuccucuguuaauaugaucucaaggauguugauaaacagauuuaccaugaaacacaagaaggccacuuaugaaccggacguagauuuagggagugguacucgaaauaucgguaucgagucggagauaccaaacuuagacauaauagguaaacguaucgagaagauaaaacaggaacaugaaacaaguuggcacuaugaucaagaccacccuuacaaaacuugggcauaucauggcucuuacgaaaccaaacaaacuggaucagcaaguuccaugguaaacggaguaguucgguuacuaacaaagccaugggauguuguaccuauggugacacaaauggcgaugacggauacaaccccuuuuggacaacaacgcgucuuuaaagaaaaaguggauacaaggacacaagagccuaaggaagguacuaagaaacuuaugaaaauaaccgcagaguggcucuggaaggaacuaggcaagaagaaaacgccccguauguguacgagagaggaauuuacaagaaagguuagaagcaaugcagcauugggugcuaucuucaccgacgaaaacaaauggaaaagcgcacgugaagcggucgaagacggaagauucugggagcucguugaccgagaacgaaauuuacaccuugaagggaaaugugagacguguguguauaauaugaugggaaaaagggaaaagaaacuaggugaguucgggaaagccaaaggcucaagggcaauaugguauauguggcugggcgcaagguuccuagaauuugaagcauuaggauuuuuaaacgaagaccacugguucagccgcggaaacagcuuauccgggguggaaggggaagggcuacaccgauuagguuacauccuaagagacgugggaaagaaagagggaggugcgauguaugcggaugacacugcaggaugggacacaaggauaacucuugaagaccuaaagaaugaagaaaugguaacaaaucauaugaaaggcgaacacaagaaacuagcugaagcaaucuuuaaauuaaccuaucaaaacaaaguagucagaguacaaagacccacgccacgaggaacugucauggauauaaucucccgucgagaccagagaggaucaggacaagugggaacauauggucuaaauacuuuuacaaacauggaagcacaacucauucgucaaauggaaggagagggaaucuuuaaaaguauacaacaucuaaccgcaacagaagagauagcuguacaaaauuggcuggcgcggguaggaagagagagacuaagcagaauggcuaucucuggugacgauugugucguuaaaccuauugacgauagauucgcgagcgcucuuacagcucucaacgacauggggaaaguaaggaaagauauucagcaaugggagccuucucgcggauggaacgauuggacccaaguaccauuuugcagccaccauuuucaugaacucguaaugaaagauggaagaguauuagugguuccaugcagaaaucaagaugaauugauuggacgagcacgaauaagccaaggagcaggauggagucuaaaagaaacugcaugucuaggaaaaaguuaugcacaaauguggacuuugauguacuuucaccguagggaccuaagauuagccgcaaacgcgauuugcagcgcagucccuccccauuggguaccgacgucccguacuaccuggucuauucaugcaaagcacgaauggaugacuacagaagauauguuagcaguauggaauagaguauggauccaaggaaaccccuggauggaggacaaaacuccuguggaaaguugggaagaaguaccauauuuaggcaagagagaagaucaauggugcggaagucuaauugguuugacuagcagagccacaugggccaagaacauacaaacugccauuaaucaagugaggagccuaauuggaaaugaagaauacacagauuacaugcccaguaugaaacgcuuucgacgcgaggaagaagaagcaggcguuuuaugguaa

SEQ ID NO: 22401 - RNA, 9876 nt, Artificial Sequence
  derived and/or modified CDS sequence (opt6) from DENV-2__FJ850061__SS-prME
acggcagggguuauaauaaugcugauaccuacggcaauggcuuuucaccugaccacaagaaacggagaaccucacaugauuguaggaagacaggaaaaagguaaaagucuauuauucaaaacugaggaugggguaaauauguguacuuuaauggcaauagaccuaggagagcucugugaagauacaauaacauacaaaugcccacuuuugaggcaaaacgaaccagaagauauagacuguugguguaacucuacaaguaccuggguaaccuauggcacauguacgacuaccggggagcaucgacgagagaaaagaucaguugcgcuagugccucauguagguaugggacuugaaacaaggaccgaaacauggauguccucugaaggcgcauggaaacacguccaaagaaucgaaacauggaucuuaaggcauccaggauuuacgaucauggcugcaauacucgcauauacaauugguacuacacauuuucagagggcauuaauauucauccuacuaacugcaguggcaccgaguaugacaaugagauguaucggaauaucaaauagagauuuuguggaaggaguaagugggggaaguuggguagauauaguacucgaacaugggucaugcguaacuacaauggccaaaaauaaaccuacucuagacuuugaguuaauaaaaacugaggcuaaacaaccugcuacacuuagaaaauauuguauagaggcaaaacuuacuaacacaacaacagagagcagauguccaacgcagggugaaccaagucuaaacgaagaacaagauaaaagauucauauguaaacacagcaugguagaccgaggcuggggcaacggguguggauuauuuggaaaagguggaauaguaacaugcgcaauguuuacaugcaagaagaauauggaagggaaaguuguacaaccugagaacuuggaauauacuauaguuauaaccccucauuccggugaagaacaugcugucggaaaugauaccgguaaacaugggaaagaaauuaaaauuacaccacagaguucuauuacagaagcagagcugacugguuaugguacgguaacaauggaguguaguccccgcacgggacuagauuuuaaugaaaugguacuauuacaaauggaagacaaagcaugguuagugcauagacaaugguuucuagaucuccccuuaccguggcucccaggagcugauacacagggaucaaauuggauucaaaaagaaacauugguaacuuuuaaaaacccacaugcuaagaaacaggacgugguaguacuaggaagucaagagggugcaaugcauacagcauugacgggugcgacugaaauucaaaugucgucaggcaauuuauuauuuacggggcauuuaaaauguaggcuacguauggauaaauuacagcuaaaaggcaugucuuacagcauguguacagguaaauuuaaaauagucaaagaaauugcagaaacacaacacgggacaauaguuauacguguacaauaugaaggcgacggaucaccguguaaaauaccuuuugagauuacagacuuggaaaaacgccauguuuuagggcgucucauuacaguaaauccaauaguaacugagaaagauaguccaguaaauauagaagcugaaccgccauucggugacaguuauauaauuauagggguagaaccggggcaauuaaaacugaacugguuuaagaaaggcucauccauaggacaaauguuugcuacuacaaugcgcggugcuaaacggauggccauacuuggggauacagcaugggacuuuggaucgcuuggagguguauucacaaguaucggaaaggcuuugcaccagguauuuggugcuauuuauggcgcugcauucucugguguaucuuggacuaugaagauauuaaucggugucauaauuacuuggaucgggaugaacucuagaucuacaucguuauccgugagcuuaguucuuguaggagucguaacgcuauaucucggggcaaugguucaagcugauagcggguguguaguaagcuggaagaauaaggaauuaaaaugcgggagcggcaucuuuauaacugauaacguccauacauggacugagcaauauaaauuccaaccugagagcccaucaaaguuagcaucagcaauucaaaaagcacaugaagaggggauauguggcaucaggucggugacaaggcucgaaaauuugauguggaaacaaaucacuccagaacucaaccacauacuaagugaaaaugagguuaaacuaacaauuaugaccggagacauaaagggaaucaugcaagcggguaaaaggucucugcggccucaaccgacggaacucaaauacaguuggaaaaccugggggaaagcaaagaugcugucuacagaaucgcauaaucagacguuucugaucgauggaccggaaacggcugaaugcccuaacacuaauagggcauggaacagcuuagaaguagaagauuauggauuugguguuuucacgacgaacaucugguuaaaacuuagagaaaagcaagauguuuucugcgacucaaaauugaugagugcagcaauaaaggacaaucgugcuguucacgcagacaugggauauuggauagaauccgcccuaaaugacaccuggaaaauggaaaaagcauccuucaucgaagucaagaguugccauuggccgaaaucgcauacucuguggaguaacgggguuuuagaaagugagaugauaauuccgaagaacuuugcagguccagugucacagcacaauuaccgaccaggguaucauacacaaacagcaggaccuuggcaucucggaaaauuagaaauggacuucgaucuaugcgaaggcaccacagucguaguaacagaagauugcggaaaucgcggucccagcuuacguacaacaacugccuccgggaaguugauaacagaaugguguugcagguccuguacccuaccgccucuacgcuaucggggagaggaugguuguugguauggcauggaaauuagaccacucaaagaaaaggaagaaaaccugguaaacagcuuaguuacagcaggccacggucaaauugauaacuucucacuagguguacuagguauggcucuguuccuugaagagaugcuccgaacaagaaucggaacaaagcaugccauccuguuaguagcagucagcuucguaacacucauaacaggaaacaugucauuuagagaccucggacgggugauggugaugguaggugcgacaaugacugaugacauaggaaugggaguuacuuauuuagccuuguuagcggcguucaaggucaggcccacauuugcugcaggguuacucuugagaaaguugacguccaaagaacuaaugauggcaaccaucggcauagcacuucugagucaauccacaauaccagaaacgauacucgaacuaacagacgcacuugcgcugggaaugaugguacugaagaucguaagaaacauggagaaguaucagcuggcaguaacaauaauggcaaucagcugcguaccgaaugcaguaauucuacagaaugcauggaaaguuuccuguacgauauuagcggcagugucgguuucaccacuacucuuaacaucuagucaacaaaaggcagacuggauuccccuggcccuaacaauaaagggucucaaccccacugcaauauuucuaacuacucuuucucgaacaaguaagaaaagaucguggccgcucaaugaggcgauaauggcgguugguaugguaucaauccuagcauccagucuauuaaagaacgauaucccaaugaccgggccccuuguugcaggcggucuauuaacaguaugcuacguauuaacgggaagaagugccgaccucgaacuagagcgagccgcagacgucaaaugggaagaucaagcagagauaucagggagcaguccuauccuaagcauaaccauuagugaagacggaucgaugagcaucaaaaaugaagaggaagaacagacgcuaacaauacuaauuagaaccggcuugcuagucauaucgggaguguuuccuguaaguaucccuauaacagcugccgccugguaucucugggaaguuaagaaacaacgagcugguguguugugggauguacccucaccgccacccgucgagaaagcagaguuagaagauggugcauauagaauuaaacaacgaggcauuuuaggauauucgcaaauaggugccgguguguacaaggaggggaccuuccacacuauguggcauguaacgcgaggagcgguccuaaugcacagagguaaaaggauugagcccucgugggcagauguuaaaaaggaccuaauuuccuacgggggaggauggaaauuggagggagaguggaaagagggugaagaagugcaaguguuggcacuggaaccugggaaaaacccccgcgccguacaaacuaaacccggaauauucaaaacaaacacaggaaccauaggugcaguuucauuagauuucucgccagggacgagcggcagccccauuguggaucgcaaaggaaaaguagucggauuauauggaaauggaguagugacuagaucaggagcguacgugucugccauugcgcaaacugaaaaguccauugaagacaauccagaaauagaagacgauauuuuucggaaaaagcgguugacuauaauggaccuacauccaggcgcagggaaaaccaaacgauaccuccccgccaucguacgagaagcgauuaagaggggucuuagaacucuaauuuuggcaccuacaagaguaguugcagcagaaauggaagaagccuuaagaggucugccaaucagauaucagacuccagcaaucaaaaccgaacauacaggccgcgagauuguagaccucaugugucaugcaacauuuacgaugcgacuauuaagcccagucagagugcccaacuacaaucuuauaaucauggaugaggcucacuucacggauccagcuucaaucgcagcuagagguuauauaucaaccagaguagaaaugggagaagccgccggcauauucaugacugcaacaccaccggggaguagagauccauuuccgcaauccaacgcuccgauaauggacgaggaacgggaaaucccagaaagaagcuggaacucgggacaugagugggucaccgacuuuaaaggcaagacaguuugguucguuccuaguauaaaggcuggaaacgacauagcagcaugcuugaggaaaaauggcaagaaaguaauacagcuaucucgaaaaacauuugacagcgaauaugucaaaacaagggcuaacgauugggauuucguuguaacuacagauauuagcgaaaugggagcaaauuuuaaagcugaaaggguaaucgauccgagacgguguaugaaaccuguaauacuaacugacggcgaagaacgagugauauuagcagguccaaugcccgugacucauaguagugcagcccaaaggagaggcagaauagggcgaaauccgaagaacgaaaaugaucaguauauauacaugggugaaccccuugaaaaugaugaggauugcgcacacuggaaagaagcaaaaaugcucuuagacaacauuaauacacccgaaggaauaaucccaucgauguucgaaccggagcgcgagaaaguagaugcaauugacggagaguaucgauuacguggcgaagccagaaaaacauucguggaucuuaugaggcgaggugacuugccgguuuggcucgcauauaagguugcggccgagggaauuaauuaugcagaucgaaaaugguguuuugauggaauuaaaaauaaucaaauacuagaagaaaauauggaaguagagauuuggacaaaagaaggcgaaaggaagaaauugaaaccaagauggcuagaugcucgaauuuacucugauccacuggcuuuaaaagaauuuaaagaguucgcagccgguaggaagucucugacuuugaaccugaucacagagauggggcgauuaccgacauucaugacccaaaaagccagaaaugcacuagacaauuuagcaguguuacauaccgccgaagcaggagggagagcauauaaucacgcccugucugaauuaccagaaacacuagaaacuuuauuauuauugacacuauuagcaacaguaacugggggcauauuuuuauucuuaauguccggaaaagggauaggaaaaaugacccucggcauguguuguauuauuacagcaagcauccuauuaugguaugcccaaauacaaccgcauuggauagcagcuaguaucauuuuagaguuuuuccuaauuguacuauuaauaccagagccagaaaaacaacguacuccacaagauaaucagcuuacuuacgugguuauagcaauacugaccguuguagcugcgacaauggcaaacgaaaugggcuuccuugaaaagaccaagaaagauuugggacuagguaguauaacuacccaagaguccgagucaaacauacuagacauagaccuaagaccggcgucggcauggacccucuaugcagucgcaacuacauucguaaccccaaugcugcgacauucgauugaaaacaguucagugaauguuucuuuaacugcuaucgccaaccaagcgaccguccucaugggacuaggaaaaggcuggccgcuauccaaaauggauauaggcguuccauuguuagcgauuggauguuauagucaagugaaaccaauuacauuuacagcggcacuauuacuccucguagcacauuaugcuauuaucggcccaggccuacaagcaaaagcuccaagagaagcacagaaaagagcugccgcagguauaaugaaaaauccaacgguugauggcauuacaguaauagaccucgaaccuauacccuaugauccaaaauucgaaaaacaauuagggcaaguaauguuauuaauauuauguguaacacaaguacuuaugaugagaacuacuugggcauuaugugaggcuuuaacgcuagccaccggacccauaucuacuuuaugggaaggcaacccuggucgguucuggaauacaacaauagcaguuagcauggccaauauuuuucguggcaguuaucuagcgggagccggacugcuuuuuaguaucaugaaaaauacgacaaauacacguagagggaccgguaauauaggcgagacccugggagagaaauggaaaaguagacuaaaugcacuugguaagagcgaguuccaaauauacaagaaaucgggaauacaagaaguagauagaacauuagcaaaggaaggcauaaaaaggggcgaaacugaccaucacgccguaaguaggggguccgcuaaauuaagaugguucguggaacgaaacaugguaacgccugaagggaaggucguagaccuaggcugcggacgaggugguuggucauauuacuguggaggauugaaaaacgugagagaaguaaaaggcuuaacaaaaggagggccaggacaugaagaaccaauaccaaugucaacauaugguuggaaucuggucagacuacaaagugguguugauguuuucuucacacccccagaaaaaugcgacacacuuuuaugcgauauuggcgaaucaucgccaaauccuacgaucgaagcaggucgaacucugaggguauuaaauuuaguagaaaauuggcugaacaacaauacucaauuuuguauuaaaguucugaauccauauaugccgagcguaauugagaagauggaggcccuacaaagaaaauauggcggggcucugguccggaacccguuaucccgaaacagcacacacgaaauguauuggguuuccaacgcgaccggaaacauagucucgucugucaacaugauaaguaggaugcucaucaaucgauuuaccaugaaacacaagaaagcuacauaugaaccugauguugaucucgggucuggaacaagaaauauuggcauagaaucugaaguaccaaauuuggacauuaucggaaaaaggauagagaaaauaaaacaagaacacgagaccucauggcacuaugaucaagaccauccauacaaaacgugggccuaucauggcucauaugaaacgaaacaaacuggcagugcuucaucaaugguaaacgggguaguuagacuauuaacuaaaccuugggauguugucccaaugguaacccaaauggcaaugacagauacuacuccuuuuggucaacagcgagucuuuaaagagaaaguagauacccgaacccaggagcccaaagaaggcacuaagaaauuaaugaaaauaaccgccgaaugguuauggaaagaacucggcaagaagaaaacuccccggaugugcacccgagaagaguucacacgaaaaguucgaaguaaugcugcauugggggcgauuuuuacagaugaaaauaaauggaaaagcgcacgcgaagcuguugaagacggaagauuuugggagcuaguugaccgagaaagaaaucugcaucuagaagguaaaugugaaacauguguauacaauaugauggguaaaagagagaagaaauuaggagaauuuggcaaagcaaaagguagccgugcuauaugguacauguggcugggagccagguuccucgaguucgaagcucugggguuucuaaacgaagaccauugguuuucuagagguaauucccuaucuggcgucgagggggaaggauuacaccgacuaggcuauauacuaagagacguuggcaagaaagaagggggagcgauguaugcagacgauacagcaggaugggacacgagaauaacuuuagaagaucucaaaaaugaggaaaugguaacaaaucauaugaaaggagagcacaagaaauuagccgaggcaaucuucaaacuaacauaccaaaacaaagucguaagaguacaaaggccaacgccucgugguaccgucauggauauaauaucaagacgugaucaaagagggaguggacagguagggacauauggguugaacaccuucaccaauauggaagcacaguuaauaaggcaaauggaaggggaaggaaucuucaaaucaauacagcacuuaaccgcaacagaggaaauagcaguacaaaauuggcucgcccgaguagggagagaaaggcuaucgcgaauggcaauuucuggugaugauuguguaguaaaaccaauagaugaccgauucgcuucugcccuaacagcguuaaacgacauggggaaagugcgaaaggacauccagcagugggaaccuagccgugguuggaaugauuggacucaagugccuuucugcucucaucacuuucaugaauuaguaaugaaggauggucgugucuuggucguuccaugucguaaucaagacgaguugauaggacgggcaagaauaagccaaggagccggguggucccugaaagagaccgcuuguuuaggaaaaagcuacgcacagauguggaccuuaauguauuuucacaggcgggaucuacgauuagcugcaaacgcaauauguagcgcaguucccccacacuggguaccuaccagcagaacuacuuggucgauucacgcaaaacacgaauggaugacgaccgaggauauguuggccgucuggaacagaguguggauccaagaaaacccuuggauggaagauaaaacuccugucgaaagcugggaggaagucccauacuuaggaaaaagggaagaccaauggugugguagcuuaauugguuuaaccagcagagcaacuugggccaaaaacauacaaacggccauaaaccaaguaagaagucugauaggaaacgaagaauacacggauuacaugccaagcaugaagcgauuuaggagagaagaagaggaggcugguguacucugguaa

SEQ ID NO: 22402 - RNA, 9876 nt, Artificial Sequence
  derived and/or modified CDS sequence (opt6) from DENV-2__FJ744709__SS-prME
acugcuggggucaucgucaugcugauaccgacagcgauggcauuucaucuaacaacgaggaauggagaaccacacaugauuguuggaagacaagagaaaggaaaaucccuuuuguuuaaaacugaagacggcgucaauaugugcacauugauggcaauugacuugggagaauuaugugaagauacaaucacauauaaaugcccacugcugagacaaaaugaaccggaagauauagauuguugguguaacagcacuucaacguggguaacauauggaacaugcaccacaacaggugaacaucgaagagaaaaacggaguguggcccuaguaccucacgucggcaugggauuagaaacucgaacagaaacuuggaugagcucagaaggggcauggaaacauguacagaggauagaaacauggauucucaggcacccuggguucaccauaauggcagcgguacuggcuuacacaauaggcacuacccacuuucaaaaggcuuuaauauuuauauuauuaacagcgguagcuccuagcaugacgaugagguguauaggaauaucuaaucgcgacuuuguugaaggagucucaggaggaagcuggguugacaucguauuagaacacggaaguugcguaacgacaauggcuaaaaauaaaccgacguuagacuuugaacuaauuaaaacugaagcgaaacaaccggccacuuugaggaaauauuguauagaagccaaacuaacgaauacaacuacggaaucacgguguccaacccagggugagccuucauuaaacgaggagcaagauaaaagauucauuuguaaacauuccaugguagauagagguugggguaauggaugugguuuauucggcaaaggugguauagucacgugugcaauguuuaccugcaagaaaaauauggaggguaaaguggugcagcccgaaaaccucgaauacacaaucguuauuacaccacacucgggagaagaacaugccgugggcaaugauacugguaaacauggcaaagagaucaaaaucacgccacaaucuaguauaacagaagcggaguugacuggauacggaacugugaccauggaguguagccccaggacgggccucgauuucaacgagaugguccuauugcaaauggaagacaaagcaugguuaguacacagacaaugguucuuagaucucccguuaccauggcucccuggugccgauacacaagguucuaacuggauacaaaaagaaacuuuaguuacauucaaaaacccacaugcaaagaaacaagauguaguaguccugggaagccaagagggggcaaugcauacagcauugacaggugccaccgaaauacagaugucaucuggaaaccugcuauucacaggucaccucaaaugucggcugcgaauggacaaacuucaauuaaaaggaaugucguauagcaugugcacuggaaaauuuaaaaucguuaaagaaauugcugaaacgcaacaugguacgauaguaauaagaguacaauaugagggggaugguucgcccugcaaaauaccguucgaaauuacggaucucgagaaacgacacguauuggggcgauuaauuacagugaacccuauaguaacagaaaaagacaguccgguaaauaucgaagccgaaccgccuuuuggugauucauacauaauaaucggugucgagcccgggcaacucaaacuaaauugguuuaagaaagguaguucaauuggacaaauguucgaaacaacaaugagaggagcuaaacgaauggcuauccuaggagacacugcaugggacuucggauccuuagggggaguauucacaaguaucggaaaagcguugcaucaaguguucggagcgauuuauggugcagccuuuucuggaguuucauggacuaugaaaauuuugauuggaguuaucauaacauggauuggaaugaacuccagaagcacgucuuugucgguaagccuuguguuaguaggagucguuacucuuuaucuaggcgcgguaguacaagcagacaguggaugcguuguaucauggaaaaauaaagaauuaaaaugcggaucaggaauauucaucacagacaauguucauacguggaccgagcaauacaaauuucagccggaaucuccaucuaagcuagccagugcaauccaaaaagcacacgaagagggaauaugcggcauuagaucagucacgcguuuggaaaaccuuauguggaagcaaauuaccccagaauuaaaccacauuuuaucggagaacgagguaaaguuaacaauaaugacaggcgauauuaagggaauaaugcaagcugggaaacgaucccugagaccacaaccgacugaacuaaaguauucuuggaaaacauggggaaaggcaaaaaugcugagcacagaaucccacaaucaaacguuuuuaaucgacgguccugaaacugcagaauguccgaauacgaauagagcauggaacagucucgaaguugaagauuaugguuucggagucuucacuacuaauauuugguuaaaacuaagagaaaaacaagauguguuuugugacucuaaacuaauguccgcagcgauuaaagacaaucgcgcuguacacgcugauaugggauauuggauugaaagcgcacuuaaugauacauggaaaauggagaaagcgagcuuuauagaaguaaaaaguugucauuggccuaaaucgcacacucuuuggagcaaugggguacuagaaucggaaaugauaauaccuaaaaauuuugcaggcccaguaucacaacacaauuauagaccagguuaucauacacaaacagcagggccguggcaucucgggaagcuagaaauggauuuugauuuuugcgaagguacuacagugguugugacagaggauugcgggaaccgcggaccgagccucagaacuaccacagccucgggaaaacuaaucacagagugguguugucguagcugcacauuaccuccucucagauacagaggagaagauggguguugguacggaauggaaauaagaccgcucaaagaaaaagaagaaaaccuaguuaauagucuaguaacagcaggccauggucaaauagacaacuuuucuuuaggcguacuugggauggcucuuuuccucgaagaaauguuaagaacccggauagguacuaagcaugcgauccugcugguagcaguaaguuucgugacucuuauaacuggaaacaugucauucagagaccucgggagagugauggucauggucggagcgacaaugacagaugacauagguaugggugugacauaccuagcguuacuugcagccuuuaagguccguccaacauucgccgcaggucuauuauuacguaaguuaacuuccaaagaacuuaugauggcgaccauugguauugcauuauuaagucaaagcacgauacccgaaacaauauuagaacugacggaugcucuagcacuagguaugaugguucugaaaauaguccgaaauauggaaaaauaccaauuggccgucacgauaauggcuauaucauguguucccaacgcugucauucuacaaaacgcguggaaaguaucgugcacaauucuugcagcaguuagugugucaccuuuacugcuaacaucuagccaacaaaaggcagacuggauaccccuagccuuaacuauuaaaggucugaacccuaccgcgauauuuuuaacaacacuaucucggacgucaaagaagagaucguggcccuuaaaugaagcaaucauggcagucggaaugguaucaauacuggcgaguucacuacucaaaaaugauauaccuaugaccggaccucuaguggcaggaggacuacuaacgguuugcuaugucuuaacgggacgaagcgcugauuuagagcuagaaagagcugcagacguaaaaugggaagaccaggcugaaauaagugguucuucacccauacuuuccauaacuauaucagaagacgguucuaugucaaucaaaaaugaagaagaagaacagacacuaacuauacuaauccggacuggauuguuaguaaucucagggauuuuuccuguaucaaucccaauaacagccgcagcuugguaccucugggagguaaagaaacagagggcagggguguuaugggacguaccaaguccacccccaguugaaaaagccgaauuggaagauggugccuaccguauaaaacagaggggaauacuagguuauagccaaauuggugcugggguauauaaagaggguaccuuucauacuauguggcaugucacuagaggggcuguauuaaugcaucgaggcaaaagaauugaaccaucaugggcagaugugaagaaagaccucauaucauacggagggggauggaaacuggaaggcgaguggaaagaaggugaagaaguucagguucuagcuuuagaaccagggaaaaauccgcgagccguacagacuaagccagguauauuuaaaacaaacacuggaacaauuggagcggugucucuugauuucaguccugguacgucagggucccccauuguggauagaaaaggaaagguugucggacucuacggcaacgguguaguaacuaggaguggugccuaugugagugcaauagcacaaacugagaaaucuauagaggacaauccugagauugaagaugauauuuuucguaagaaaagacuaacuaucauggaccuacacccuggagcuggaaaaacuaaacgcuaucugccagccauaguaagagaagcaauuaaacgaggacuaaggacauuaauccuggcuccaacuagaguaguagcagcugaaauggaagaagcauuaagaggucuaccgauacguuaccaaacuccugcuauuaaaacggagcacacagguagagaaauugucgaucuaaugugucaugcaaccuuuacuaugcgacuauuaaguccuguaagaguucccaacuauaaucugauaauuauggacgaggcccauuuuacugauccagcuucgauagcggcuagggguuauaucucgacucguguagaaaugggcgaggcugcgggaauauuuaugacagcuacuccuccaggaagucgagauccuuuuccucagucaaacgcaccaauaauggaugaggaaagagaaauuccagaaaggucauggaacucuggccaugaauggguaacagauuucaaagggaagacaguaugguuugucccaucaauuaaggcagguaaugacauagcagcauguuuaaggaaaaacgggaagaaaguaauacaauuaucgagaaaaacauucgauagcgaauacguuaaaacacgagccaacgacugggauuuugugguuacuacugacaucagcgagaugggagcaaauuuuaaagcggaaaggguaaucgacccucgucgauguaugaaaccaguuauauugacagauggggaagaaagagucauucuagcaggaccaaugccaguaacacacuccucagcugcgcagagaagaggccguaucggaagaaauccgaaaaaugaaaaugaccaguacauuuacaugggagaaccuuuagaaaaugaugaagauugcgcccacuggaaagaagcaaagauguuguuagacaauauuaauaccccugaaggaauaauaccaaguauguuugaaccagaaagagaaaaagucgaugcaauagauggagaauacagacuucguggagaagcaagaaaaacauuugucgaucuaaugagaagaggagacuugccagugugguuagcuuacaaaguugcggcagaaggcauaaauuauacugacaggaaaugguguuucgacgguaucaaaaacaaucaaauacucgaagaaaauauggagguugagauauggacaaaggagggcgaaagaaagaaacugaagccccguuggcuugacgcgcgaauauacagugauccgcuagcauuaaaggaauuuaaagaguuugcagcagggagaaaaaguuuaacccuaaauuuaauuacagaaaugggucggcucccaacauucaugacacaaaaagcaaggaaugcccuagacaauuuggcaguauuacauacggcagaggcaggagggagggcuuacaaucaugcauuauccgaacuuccagaaacucuagaaacacuauuauuauuaacucuacuugcaaccgugacuggagggaucuuccuauuuuuaaugucugggaaagguauaggcaaaaugacauuaggcauguguuguaucauaacagcuucuauucuacucugguacgcacagauacaaccacacuggauagcugcaucgauuauauuagaguucuuucugauaguauugcuuauaccagaaccugagaagcaacgaacuccccaagauaaccaauuaaccuauguagucauugcaauucuuacaguaguugcggcuacgauggcgaaugaaaugggauuuuuggagaaaaccaagaaagacuuaggccucgguaguauaaccacccaagaaagcgagaguaauauacuggauauagauuuacguccggcuucggccuggacucuuuaugcaguagcuaccacauucguaacaccuaugcuucgccauucaaucgaaaacucaucuguuaauguuucguuaacagcaauugcuaaccaagcuacaguucucaugggccuagguaaaggguggccccuaucaaaaauggauauagguguucccuuacucgcgauaggaugcuacucacaaguaaaucccauaacuuuaaccgccgcucuauuauuauugguagcucauuaugcuauaaucgguccaggacugcaagcaaaagcaacaagagaagcacagaaaagagcggcggcagguauaaugaaaaauccaacaguagaugguauuacaguaauugaucucgaaccuauaccauaugauccuaaauuugaaaagcaauuaggacagguuaugcucuugauucuauguguuacgcagguucuaaugaugaggacuacuugggcauuaugugaggcacuuaccuuagcgacugguccaauuaguacgcuaugggagggcaauccagguagauuuuggaacacaaccauugcuguaucaauggcuaacauuuucaggggaucuuaucuagcuggagcuggguugcucuuuucaauuaugaagaacacaacuucaaccaggagaggcacaggaaacauuggcgagacacuuggagaaaaguggaaaucgagacuaaacgcauuggguaaaagcgaauuucagaucuacaagaaaagcggaauacaggaaguagacaggacguuagcaaaagaggggauaaaaagaggggaaacggaucaucaugcagucagccgagggagugcaaaacuuagaugguuugucgaacguaauauggugacuccugagggaaaggucgucgaccugggaugcggcagaggcgggugguccuacuacuguggaggguugaaaaacguaagagagguaaaaggucucacaaagggugggcccggacacgaggagccuauaccgaugagcacguacgguuggaauuugguaagacuacaaagcggcguagacguguucuuuaccccaccggaaaaaugugacacccuacuuugcgauauaggggagaguucaccgaauccuacuaucgaggcuggaaggacucuucgaguacuaaauuugguagaaaacuggcuaaauaauaauacgcaauuuuguauuaaaguuuuaaauccuuauaugcccuccgugaucgagaaaauggaagcacuucagagacaauacggaggagcucuuguacguaacccacuaucccguaauuccacucacgagauguacuggguaucaaacgcaacugguaauauagugaguucagugaacaugauuagucgaaugcugauaaacagauuuacuaugaagcauaaaaaggcaacguaugaacccgacgucgaucuugggagcgguacccgcaauauaggaauugaaagugagaucccuaaucuagacaucauugguaaacggauagaaaagauaaaacaggaacacgaaaucucguggcauuacgaccaggaucacccuuauaaaacaugggcauaucauggaucguacgaaacuaaacaaaccgguuccgcaagcaguaugguaaacggaguggugcgucuauuaacuaaaccaugggacgucguacccaugguuacucaaauggccaugacagauacaaccccauuugggcaacaaagaguauuuaaagagaaggucgauacucgaacccaagagccaaaggaggggacuaagaaacuuaugaaaauaacugcugaguggcucuggaaagaacucggaaggaagaaaacaccgagaauguguaccagagaagaauuuacuagaaaaguuagaucaaaugcagcauugggagcuauuuucacagaugaaaauaaauggaaaucagcucgcgaagcaguagaagaugggagauuuugggaauuaguggaucgcgaaagaaaccuucauuuagaaggaaaaugugaaacuugcguauacaauaugauggggaaaagagagaagaaacuuggugaauuuggaaaagcaaaagggagucgagcuaucugguacauguggcuaggugcaagguuucuggaauuugaggcgcuuggcuuuuuaaaugaagaucacugguucucgagagagaacucguuauccgggguagaaggcgaaggauugcauagguuaggauauauauugagagaugucgguaagaaagaaggcggagcaauguaugccgacgacacggcagguugggacacuagaauuacacuggaggaucucaagaaugaagaaauggucacaaaucauaugaaaggagaacacaagaaacuggcagaagcgauauuuaagcuaacuuaccaaaacaaggucguaagaguucaacgaccuacgccgagggggacagucauggacauaaucucaagaagggaccaaagaggaagcggacaagugggaaccuacggacuaaauacguuuacaaauauggaagcacaauuaaucaggcaaauggagggagaagguauauuuaagagcauccaacaccuaacugcaacggaagaaauugcaguucaaaacuggcuugcaagagucggccgugaacgucucuccagaauggcaauaagcggugacgacugcguaguaaaaccaauugacgaccgcuuugcaucagcucuaacagcacuaaaugacaugggaaaaguaaggaaagauauucagcagugggaacccagcagagguuggaacgacuggacacaaguaccuuucugcagucaccacuuucaugaacuuguuaugaaagauggcagaguauuaguaguaccuuguagaaaucaagacgaauuaauaggaagggcaagaauaagccaaggagcuggcuggucauuaaaagaaacggccugucuugggaaaucauacgcccaaauguggacuuuaauguacuuccaccgcagagauuuacgacuugcugcuaacgcuauaugcagugcuguaccaucacacugggucccgacuuccaggacaacauggaguauccacgccaagcaugaauggaugacaacagaggauauguuagcgguauggaacagaguguggauucaagaaaauccauggauggaggauaaaacgccaguagaaaguugggaagaaguacccuauuuagggaaacgggaagaccaguggugcggaucacuaauaggcuugacuucacgagcaacuugggcuaaaaauauacaaacggccaucaaccaaguucguucccugauagggaaugaagaguauacagauuacaugccaucaaugaaaagauucagaagggaagaggaagaagcaggaguguuaugguaa

SEQ ID NO: 22403 - RNA, 9876 nt, Artificial Sequence
  derived and/or modified CDS sequence (opt6) from DENV-2__FJ744708__SS-prME
acugcuggaguuauuguaauguugauuccuacagcgauggcguuucacuuaacaacaagaaauggagaaccgcauaugauaguugggagacaggaaaaaggcaaaucgcuauuguuuaaaacagaagaugguguuaauaugugcacguuaauggcgauagacuugggugaacuaugugaagacacaauuacuuauaaauguccauuguugagacagaaugaaccagaagacauugacuguugguguaauucaaccucuacuuggguaacauacggaaccuguacgacaacaggagaacaccguagagagaaaagaagugucgcacucgugccucauguuggaauggguuuggaaacacgcacagaaacuuggaugagcucagaaggcgcauggaaacaugugcagagaauagaaacguggauccuccgucacccagguuuuacaauuauggcagcaauucuagcauauacgauaggaacaacacacuuccaaagagcguuaaucuucauauuacucaccgcaguugccccuucaaugacaaugcgaugcaucgguaucaguaaccgugacuuuguagaaggugucaguggcgguucauggguugauaucguauuggagcacgguucuuguguuacuaccauggccaaaaauaaaccuacucucgacuuugaauuaaucaaaacagaggcaaaacaaccugcaacauuacguaaauauuguauagaggcaaaacuaacuaauacaacaacugaaucaagauguccaacccaaggcgaaccaagucuuaacgaagaacaagauaaaagauucauauguaaacauagcaugguagacagagguugggguaacgguugcggacuauucgggaaaggcgguauagugacaugugcaauguuuaccuguaagaaaaauauggaaggaaaaguuguccagccagaaaaucuggaauacacgauagucauaaccccacauuccggugaggaacacgccguagguaacgauacgggaaaacacgggaaagaaauaaaaauuacuccucaaaguucaauaacagaagcagagcuaacagguuauggaacaguuacuauggaaugcuccccuagaacgggauuggauuucaaugagaugguguuauugcaaauggaggauaaagcauggcuuguccauagacaaugguuuuuggaccucccacuaccguggcugccaggagccgacacacaaggaagcaacuggauccaaaaagaaacccuagugacuuucaaaaauccccacgccaagaaacaggacguaguaguucuugguucgcaggaaggcgcaaugcauacugcguuaaccggagcuaccgaaauacaaaugagcagcgguaaucuauuguuuacgggccacuugaaauguagguuaaggauggacaaauuacaauuaaaaggcaugagcuacucuaugugcacugguaaauucaaaauagugaaagaaauagcagagacccagcaugggacuauaguaauacguguacaguacgagggugaugggucgccuuguaaaaucccuuuugaaauaaccgacuuagaaaaacgucauguacuagguagauuaauaacugugaauccaauaguaaccgaaaaagauucaccaguuaauauagaggcggaaccaccauuuggagacuccuauauuaucauagggguugaaccuggacaguuaaaauuaaauugguuuaagaaaggcucaucgaucggccaaauguuugagacgaccaugcguggagccaaaaggauggccauacugggggacacagcaugggauuucggaucguuaggcggcguguucaccucaauaggaaaagcguuacaucaagucuuuggagcaauauauggagcugcguucaguggaguaucuuggacuaugaaaauucuuaucgguguaauaauaaccuggauagguaugaacucccgaucgacaucguugucagucagucuuguucuuguaggaguuguaacguuauaucucggggccguagugcaagcugauucggguuguguaguaucguggaaaaauaaagagcugaaaugugguucaggcauauuuauuacagacaaugugcacaccuggacugaacaguauaaauuucaaccagaaucgccaaguaaacuugcaagcgcuauacaaaaagcccacgaagaaggaaucugcgggauaagaucgguaacucgcuuagagaaucuaauguggaaacaaauaacgccggaauugaaucauaucuugagugagaacgaagucaagcucacuaucaugacuggugauauuaaggggauuaugcaagcagggaagagaagucugcguccgcaaccuacggaauugaaguacucuuggaaaaccugggguaaagcuaagaugcuuaguacggagucucacaaccaaaccuuccuuauugacgguccugaaacggcugagugcccaaacacaaacagagcuuggaacuccuuagagguugaagauuauggauuuggaguguucacaacgaacaucuggcucaaauugagagagaaacaggauguauuuugugauuccaaauugaugucugcugcaauuaaagacaauagggcagugcacgcggauaugggauacuggauugaaucugccuuaaacgauacauggaagauggaaaaggccagcuuuauugaaguaaaaucgugucauuggccaaaaucccauacccuuuggaguaacggaguauuagagucugaaaugauaauacccaaaaauuuugcagggccuguaucacaacacaacuauagaccaggauaucacacccaaacagcaggaccguggcaucuaggaaaauuggaaauggauuuugauuucugugaagggacaacaguaguuguuacagaggauugugggaaccgaggcccuucauugagaacuacaacagcuagugguaaacucauuacugaguggugcugcagaaguuguacauugccaccacuaagauauagaggagaggacgguuguugguacggcauggaaaucaggccacuaaaagaaaaagaagaaaauuuaguuaauaguuuggugacugcgggucauggacaaaucgauaauuuuucauuggguguguuggggauggccuuauuuuuggaagagauguuacggacuagaaucgguacgaaacaugcaaucuuauuaguugcgguuagcuucgugacucugaucacggggaacaugagcuuucgagaccucggaagaguuaugguaaugguuggagcaacuaugacugaugauauagguaugggagucacauauuuagcccuucuugcagcauucaaaguuaggccaacguucgcagcggguuuacuacuaagaaaacuuacaucaaaagaauugaugauggcuacgauugggauugcccucuuaucacaauccacuauaccagaaacaauacuagaacuaaccgacgcucuagcacucggaaugaugguauuaaaaauagucagaaacauggaaaaauaccaguuggcagucacaaucauggcgauaaguuguguaccuaacgccgugauccuacaaaaugcuuggaaaguaagcuguacaauacuugcagcggugucugucuccccacuccuuuuaaccagcucgcagcaaaaagcugauuggauaccuuuagcauugacgauuaaaggacuaaauccaacagccauauuucugaccacccuaucuagaacaucaaagaaaagaaguuggccuuuaaaugaggcuauuauggcggucggaaugguuucuauacuggcaucaucauuacuuaaaaacgauauaccaaugacaggaccauuaguagcagggggacuauuaacagucuguuacguucuuacagggcguagugcugaccuagaacuagagcgcgcagcggaugucaaaugggaagaucaagcagagauaaguggguccuccccuauauuaucuauuacaaucagugaagauggcucgaugucuaucaaaaacgaagaagaagaacagaccuugacaauauugauuagaacuggacuucugguuauauccgggguuuucccaguuucaauaccaauaacagcugccgcaugguaucuuugggaagucaagaaacagagagcuggaguuuuaugggauguuccaagcccaccuccaguugaaaaagcagaacuagaagacggugcguauagaauuaagcaacgagguauccucggauacucccaaaucggugcaggaguuuacaaagaggggacauuucacaccauguggcaugugaccagaggagcaguacuaaugcaucgaggaaagcgcauagaaccuaguugggcggacguuaagaaagaucuaauauccuacgguggcggauggaaacuugaaggugaauggaaggaaggugaagaaguacagguauuagcauuagaaccagguaaaaacccucgagcaguucagacuaagccgggaaucuuuaaaaccaauacgggaacaaucggagcgguaucucuagacuuuucaccaggcacuagcggaucaccaaucguugauagaaaagguaaagucguaggacuauacgggaacggaguaguaacaagaucaggagcauauguaucggcgauugcccaaacagaaaaguccaucgaagacaauccggaaauagaagaugacauuuuucgcaagaaaagacuuacaauaauggaccuucacccaggggcaggcaagacuaaacgauaucuaccggcgauaguuagggaggccauuaaaagaggauuacguacacugauacucgcuccaacaagggucguugcagcagaaauggaagaagcucuccgcggcuuaccuauuagauaucaaacaccagcgauaaagacugagcauacgggcagggagauaguugaccuaaugugucaugcaacguuuacaaugcgccugcuuucaccaguacguguccccaauuauaaucuuauaauuauggaugaagcacauuucaccgauccagccaguaucgccgcacgagguuauauuucuacgagaguagaaaugggcgaggccgcggggaucuuuaugacagcuacaccaccugguucucgagaccccuucccgcaaagcaaugcuccgauaauggacgaggaaagagaaauuccugaaaggaguuggaauagcgggcacgaauggguuacagauuuuaaagggaagacaguaugguuugugccgagcaucaaagcgggcaaugauauugcagcuugccuuaggaaaaaugggaagaaaguuauucagcugagcagaaaaacuuucgacucggaguacguaaaaacaagagccaacgacugggacuuuguagugacaacugacauuagcgaaaugggggcaaauuucaaagcagaaagaguuaucgauccaaggagguguaugaagccagucauauuaacggacggagaggaacgaguaauucucgccggaccuaugcccguaacucacucgagcgcagcgcaaagaaggggaaggauaggccguaaccccaagaacgaaaaugaucaauauauauauaugggugaaccuuuagagaaugaugaagacugugcacauuggaaagaggcaaaaaugcuucucgauaacauuaacacgcccgagggaauaaucccguccauguuugaacccgaacgagagaaaguagacgcgauagauggagaauacaggcucaggggugaagcaaggaaaacguuuguggaccuaaugagacguggugacuuaccuguauggcuagcuuacaaaguggcagcagaagguauuaauuaugcugaccgcaaauggugcuuugauggaaucaaaaacaaccaaauauuagaagaaaacauggaaguugaaaucuggaccaaggagggagagagaaagaaacuuaaaccacgcugguuagaugcacgaauauacucggacccauuagcacugaaagaguucaaagaauuugcagcuggaagaaaaagccuuacacuuaacuuaauuacagaaauggggcgucugccgacauuuaugacacaaaaagcaaggaacgcacuagacaaccuugcuguacuacacacagccgaagcaggaggacgcgcguauaaucacgcucucucggaacuuccagaaacuuuagaaacucuuuuauugcuuacacuucuagcaacgguaacuggagguaucuuuuuguuccuaaugagcggcaaaggaauagguaaaaugacccucggcauguguuguauaaucacagcaaguaucuuacucugguacgcagaaauccaaccucauuggaucgcugcuucuauaaucuuggaauuuuucuuaauaguacuauuaauuccggaacccgaaaagcagagaacgccucaagacaaccaacuaaccuacguagucaucgcaauauuaacaguuguggcagccaccauggcuaacgaaaugggguuccuagagaaaacuaagaaagaccucgguuuaggcagcauaacgacgcaagagagcgagucaaauauauuagacauugauuuaagaccugcaagcgcauggacguuauaugccguagcaacuacguucguaacuccuaugcuaaggcauucaaucgaaaacagcagcguaaauguaucccugacugcuaucgccaaucaggcuacaguucuuaugggauuagguaaaggauggccuuuaagcaaaauggauaucgguguaccgcuguuggcaaucggcugcuauagccaagucaauccuauaacccucaccgcugcgcuacuguuacuuguagcacauuaugcuauuauaggcccagguuuacaggcuaaagcaacucgugaagcccaaaaacgugcugcagcagguaucaugaaaaauccaacgguagaugguauuacugugauagacuuagaaccaauaccauaugauccaaaguucgaaaaacaacucggacaaguuauguuacucauccuauguguaacccaaguacuaaugaugcguaccacgugggcccuaugugaagcauuaacucuagcuacaggcccaauaucaacuuuaugggaggguaacccuggcagguuuuggaauacgacaaucgcuguuaguaugguaaauauauuuucugguaguuaccuugcaggagccggucugcacguccccuuacguaaaaacacucuacguacccgucgcgggacuggaaacacaggagaaacuuuaggcgaaaaauggaaaucaagacuuaacgcccucggcaaauccgaguuccagauuuauaagaaaagcggaauccaggaaguugauagaacccuugccaaggaggggauuaaaaggggcgaaaccgaucaucaugcgguuucacgggguagcgcuaaauuacgaugguucgucgagagaaacauggucacgccagaaggcaaaguaguggacuuaggcuguggccgggguggauggucguauuacugcgguggcuugaaaaacgugagggaagugaaaggacuuaccaaaggcggaccuggacacgaggagcccauaccgaugucgacauauggauggaauuuggugcgacugcagaguggaguagauguauucuuuacgccaccagaaaaaugcgauacacucuuaugugacauaggcgaaagcagcccuaaucccacgauugaagccgggagaacacuaagaguauuaaauuuaguagaaaacuggcugaauaacaacacacaauucugcauaaagguguuaaauccauauaugccaagcgucauugagaagauggaagcauuacaacgucaauaugguggagcauuggugagaaauccuuuauccagaaauucuacccacgaaauguauuggguaagcaaugcaacggggaacauagugagcucaguuaacaugauaucucggauguuaauaaacagauucacaaugaaacauaagaaagcaaccuacgaaccagacguagauuuaggcucuggcacaaggaacauugguauagagucugaaaucccaaauuuggauaucauugguaaacgaauagagaaaauuaaacaggaacaugaaauaucguggcauuaugaucaagaucacccuuacaaaaccugggcuuaucauggaucuuacgaaaccaagcagacugguagugcgaguucaaugguaaauggaguuguuagauuacuuacuaaaccgugggauguuguacccaugguuacucagauggcuaugacggacacaacccccuuuggacaacaaagaguauuuaaagaaaaaguagauacaagaacacaagaaccaaaagaaggaacaaagaaacuaaugaaaauaacagcugaguggcuauggaaagagcuugguaagaagaaaacuccgagaauguguacaagagaagaauuuacuaagaaaguucguucgaacgcagcgcuuggagcuaucuuuacugacgaaaacaaauggaaauccgcucgagaggcaguugaagaugguagauuuugggaacucguagaccgcgaaagaaaucuacaucuugagggcaaaugugaaacaugugucuauaauaugauggguaagagagagaagaaguuaggugaauuuggaaaagcaaagggaucacgagcaaucugguauaugugguuaggggcaagauuucuugaguucgaagccuuaggcuuuuuaaaugaagaucacugguuuucacgagguaacucuuuaaguggcgucgaaggcgaagggcuccaucgauuaggauauaucuuacgagauguaggaaagaaagaagguggcgcaauguacgcagacgauacagcuggaugggacacaagaauuacacuagaagaucuuaaaaaugaagagaugguuacaaaucacaugaaaggcgaacauaagaaauuggcagaagcuaucuuuaaauuaacauaccaaaacaaagucgugcgaguacaaaggccaacaccucgaggaacugucauggauauuauuagcagaagagaucaacgaggaucaggccaggucgggacauacggguuaaauacauuuacuaauauggaagcacaauuaaucagacaaauggaaggcgaggggauuuucaaaucaauccaacaucucaccgcaacagaggaaauugcaguacaaaacugguuagcgcgugugggaagagaaagacuuucacgaauggcgauuaguggagaugauugcguugucaaaccgauugaugauagguucgcaucugcauuaaccgcacuuaaugacaugggaaaaguaagaaaagauauacaacaaugggaaccgagucgaggcuggaaugauuggacgcaaguuccguucuguucacaccauuuucacgagcuagugaugaaagacgggcgaguucucgugguaccguguaggaaucaagaugaauugauaggcagagcuagaauaagccagggagcuggauggagccugaaagaaacggcaugccucggcaagucauacgcucaaauguggacacuaauguacuuucauaggagggaucugagauuagcggcuaaugcuauaugcuccgcuguaccaucucacuggguaccuacuagccguacuaccuggagcauacacgcaaaacacgaauggaugacaacagaagauauguuagcgguguggaaucgaguauggauacaagaaaauccauggauggaggauaaaacacccguagaaaguugggaagaaguaccauacuuagguaaaagagaagaccaauggugcggcagcuuaauuggccuaacaagucgggcaacuugggcuaaaaauauacagacugcaauuaaucaaguaagaucacuaauugguaaugaggaauauacugauuauaugccuucgaugaaaagguuuagaagagaagaggaagaagcagggguacuuugguga

SEQ ID NO: 22404 - RNA, 9876 nt, Artificial Sequence
  derived and/or modified CDS sequence (opt6) from DENV-2__FJ810418__SS-prME
acugcuggaguaauaguaaugcuuauuccgacugcaauggcuuuucauuugacaacaaggaauggggaaccucauaugauuguaggucgacaagaaaaaggcaagagcuuacuauuuaaaacagaagauggagugaacauguguacgcuuauggcaauugaccuuggggaauuaugugaagacacgauaacguacaaaugucccuuacuaagacaaaaugaaccggaagauauagauuguuggugcaauucuacaucgacauggguuacuuacgguacuugcacaacuacaggagaacaccgaagagaaaaacgcucuguugcacugguaccgcauguggggauggguuuagaaacgagaacggaaaccuggaugucaucggaaggggcauggaaacauguacaaagaauagaaacauggauuuuaaggcauccagguuucacuaucauggcagcaauuuuggcauacacgauugguacaacucacuuucaacgcgcacucauauucauauuguugacggcgguagcaccuucaaugacaaugagauguauugguauaaguaauagagacuucguggaaggcguuucaggagguucauggguagauauaguucuagaacacggcuccugugugacaacuauggccaaaaauaaaccgacguuagauuucgaacuaauaaaaacagaggcaaaacaaccagcaacauugagaaaauacuguauugaagcuaaacuuacgaacacuacaacugaaaguaggugcccaacucaaggugaaccaagccucaaugaagaacaagauaaaagauuuauuugcaaacacuccaugguugauagaggauggggaaauggcuguggcuuguucggcaaaggugggauaguaacaugcgcgauguuuacuugcaagaaaaacauggagggaaaaguuguccaaccagaaaacuuagaauacacaaucgucauaacgccccacagcggugaagaacaugcuguagguaacgauacgggaaaacacggaaaagagauaaaaaucacuccacaaucgucaaucacggaagccgaauuaacgggguauggaacaguuacaauggaguguagcccgcggacaggauuagauuucaaugaaaugguauuacugcaaauggaagacaaagcauggcuaguacaccggcaaugguucuuggaucuaccgcuaccuuggcuaccgggugcugauacucaagguucuaacuggauucagaaagaaacauuagucacauucaaaaauccucaugcgaagaaacaggacguaguaguguuaggcucccaggaaggugcaaugcauacagcauugacaggcgcuacagaaauacaaaugaguagugguaaucuacuguuuacagggcauuuaaaaugcagguugaggauggauaaacuacaacuuaaagguaugucguauucgauguguacagguaaguuuaagauaguaaaggagauagcagaaacgcagcacggcacuauaguaauacgaguucaauaugaaggagauggcucuccauguaaaauacccuuugaaauuacagauuuagagaaacggcauguucuaggaagacuaaucacaguaaacccaauuguuacugaaaaagacagcccagucaauaucgaagcagaaccacccuuuggagacucuuauauaaucauaggaguagaaccaggacaguuaaaacuaaacugguuuaagaaagguaguucuauuggacaaauguuuaagacuacgaugcguggagccaaaagaauggcuauuuugggagauacugccugggauuucggaucccuaggugguguauucacauccauaggaaaagcguugcaucaaguuuuuggggccaucuauggagcggcuuuuaguggaguaagcuggacaaugaaaauacuaaucgggguuguuauuacauggauaggaaugaacucgagaaguacauccuuaucugugucuuugguuuuaguuggcguuguaaccuuauaccuaggggcuguuguccaagcugauaguggguguguaguaagcuggaaaaauaaagaguugaagugugguaguggaauauucauaacggauaacguacauacauggacagaacaauauaaauuucaacccgagaguccaaguaaacucgcuucggcgauucagaaggcacaugaggaaggcaucugcggcauuagaaguguuacucggcucgaaaacuuaauguggaaacaaauaacaccagaguugaaucauauucugagcgagaaugaaguaaaauugacuaucaugacuggagacaucaaagguauaaugcaagcagguaagagaaguuuacgaccgcaaccaacagaacucaaauacaguuggaaaacuugggguaaagccaaaaugcuuuccacugaaagucacaaucagacuuuucuaauagacggucccgaaacagcagaauguccaaacacaaaccgggcguggaacuccuuggaaguagaagauuaugguuuugguguauuuacaacaaauauaugguugaaacucagggaaaagcaagacgucuucugcgauuccaaacuuaugucagcagccaucaaggacaacagagcgguucacgcggauauggguuauuggauagaaagcgcacucaacgauacuuggaaaauggagaaagcaucuuuuaucgaggugaaaaguugccacuggccaaaaagucauacgcugugguccaacggaguguuggagucagaaaugguaauaccgaagaauuuugcgggcccuguaagccaacacaacuaucgacccggauaccauacgcaaacagcagguccuuggcacuugggaaaauuagaaauggauuuugauuuuugugagggcacgacuguuguuguaacagaagauugugggaacagaggaccgagccuucgcaccacaacagcaucgggaaaacucauaacagagugguguuguagaagcugcacacuacccccuuuacgguacagaggcgaagauggaugcugguauggaauggaaauuaggccccuaaaagaaaaggaagaaaauuuaguaaacagcuuaguuacugccgggcacggacagauagauaauuuuagucuuggaguucuagggauggcuuuauuccuagaagaaaugcucaggacccgcauaggcaccaaacaugcaauauuguuaguagcagucaguuuuguuaccuuaauuaccggaaauaugagcuuucgggaucuugguagaguaaugguaaugguaggagcgaccaugacagaugacauaggaaugggcgucaccuauuuagcgcuucuagcggccuucaaaguccgucccacuuucgcggcuggauuacuacugagaaaacuaaccucuaaagaacuaaugauggcaacaauaggcauugcccuuuugagccaaagcacaauuccagaaacaauauuggaauuaacugaugcacuagccuuaggaaugaugguacuaaagauaguacgcaauauggaaaaguaucagcuugcaguuacgauaauggcgauuaguugugugcccaaugcaguuauauuacaaaaugccuggaaaguuaguugcacaauacuggcggcuguaucaguaaguccccuauugcuaacaucuagucaacaaaaagccgacuggauuccacuugccuuaacgauaaaaggcuuaaauccaacagcaauauuccuaacaacauuaucaaggacuagcaagaaaaggucuuggccgcuuaaugaagcaauaauggcaguuggaaugguaaguauacuagcaucaucccuacuuaagaaugauauuccaaugacgggaccacucguggcagggggacuacuuaccguguguuauguccuaaccggaaggagcgcugaucucgaauuagagagagcggccgaugugaaaugggaggaccaagcagaaauauccgggucuuccccuauacuauccauaacgauaucugaagauggaucaaugucaauuaaaaacgaggaagaggagcagacauuaacaauacuaauccgaacggguuugcugguaauaucaggugucuucccagucuccauaccaauuacugcggccgcuugguaucuuugggaagucaagaaacaaagggccggcguguuaugggaugucccuucaccuccuccuguagaaaaagcggaauuggaagauggagcuuacagaauaaaacagcgaggcauucuagguuacagucaaauaggggcgggaguuuacaaagaagguacuuuccacacuauguggcaugucacacgaggcgcaguacuaaugcacaggggcaaaagaauugaaccuucgugggcugacguaaagaaagacuuaauuucauauggcggagguuggaaacuugaaggugaauggaaggaaggcgaagaaguccaaguccuagcccuagaaccagguaaaaauccccgggccguacagaccaaaccagggauauucaaaacuaauacuggaacaauaggugcuguaagucuagauuucagcccuggcacaaguggaucccccauaguagaucguaagggcaaaguaguuggacuuuacggaaauggaguagucacccgaaguggagcauacguuucagcgauugcacaaacagaaaaaucaauugaagauaaucccgaaauugaggacgauauauuccguaagaaacgacuuaccauuauggaccuccacccaggagcaggcaaaacgaaacgcuauuuaccugcaauaguacgagaggcaaucaaaaggggucuaagaacuuuaauuuuagcaccuacaaggguaguagccgcggaaauggaagaggcacuuagaggcuuacccauucguuaucagacccccgcaauuaaaaccgaacauacaggacgugaaauuguugaucugaugugucaugcaacguuuaccaugcgguugcuaaguccaguaagagucccuaacuauaaccuuauaauaauggacgaagcucauuucacagacccggcuucuauugcugcaagagguuauauaucaaccaggguagaaaugggagaagcagccggaauauuuaugacugcuacaccucccggaagucgugauccguucccucaaagcaaugccccgauuauggaugaagagagagaaauuccagagaggucuuggaacucuggccacgaauggguaacagauuuuaaaggcaaaacaguaugguuugucccaucuauaaaagccgggaaugauauagcggcaugucuuaggaagaaugguaagaaagugauucaacugucaaggaaaacuuucgauuccgaauacguaaaaacaagggccaacgacugggauuucguaguaacgacagacauaucagaaaugggugcaaauuuuaaagcugaaaggguaauugacccacguagaugcaugaaaccagugauccuuacagauggugaagaacggguaauacuagcagguccuaugccuguaacacacagcuccgcagcacagcgaaggggacguauagggcggaauccuaaaaaugaaaaugaccaguauauauacaugggagaaccguuagagaacgaugaagacugugcgcauuggaaagaggcgaaaaugcuacuagauaauauaaauacgcccgaagggauaaucccaucuauguuugaacccgaacgcgagaaaguugaugcuauagacggggaauauagacuccgcggcgaagcuagaaaaacauuuguagaccuaaugagaagaggagacuuacccguauggcuagcauauaaaguggccgccgaaggaauaaacuaugcagaccgaaaaugguguuucgauggcaucaaaaacaaucaaauauuagaggagaauauggagguagagauauggaccaaagaaggcgagcgaaagaaauugaaaccuagauggcuagaugcaaggauauauuccgauccucuugcuuuaaaagaguucaaagaauuugccgcaggacguaaaagccuuacgcuuaaucugauaacugagaugggacgucugccaacauuuaugacucagaaggccagaaacgcucucgacaacuuggcaguauuacacacugccgaagcggguggucgggcuuauaaucaugcauuaucugaauuacccgagacuuuggaaacauuacuucuacuuacauuacuggcaacaguaacggguggaauauuucuauuucugaugucugggaaagggauaggaaaaaugacuuuaggaauguguugcauuauaacagcgagcauacuacuuugguaugcgcaaauacagccgcauuggauugccgccucaauuauauuggaauuuuucuuaauuguauuauugauuccagaaccagaaaaacaacgcacaccgcaggauaaucaacuuacauacguuguaauugcuaucuuaacuguugucgcugcuacaauggcaaaugaaaugggauuccucgaaaagaccaagaaagaccuagggcuuggcuccauaaccacgcaggaaucagaaaguaauauauuagacauagacuuaaggccugcgagcgcauggacuuuauacgcuguagcaacuacauucguaacuccuaugcuccgacauucgauagaaaauagcucaguuaauguaucacuaacagcaaucgcuaaccaagcuacgguuuuaaugggguuagggaaaggcuggccuuuaagcaaaauggauaucgguguaccuuuauuagcaauaggauguuacucacaggucaacccuaucacacuuacggcggcccuauuacuacuuguagcacauuaugcuauaauagggccagggcuucaagcaaaagcuacacgugaagcccagaaaagagcagcagcuggaaucaugaaaaauccaaccguggauggcauaacaguuauagacuuggaaccaaucccauaugauccaaaauucgaaaagcaauuaggacaaguaauguuacucauacugugugucacucaggugcuaaugaugcgcacaaccugggcuuugugcgaggcacuaacauuggcgacgggaccgauaucaaccuuaugggaaggaaauccggggagauucuggaacacuacuauagcuguaucaauggcuaacauauuuagagggaguuaucuagccggagcagguuugcuauuuagcauaaugaagaauacaacuagcacuagacgcggcacuggcaauauaggagaaacgcucggcgaaaaauggaaaucucgauuaaaugcauuaggaaaaagugaguuccagauauauaagaaaagcgguauucaggaaguagaccggacauuggcuaaagaaggaauaaaaaggggagaaacugaucaccacgcuguuagucggggguccgcaaaguugcgcugguuuguagaacgcaauaugguaacgccagaagguaaagucguagacuugggaugcggaagaggagguuggagcuauuauuguggaggauugaaaaacguuagagaagugaaaggucucacuaaaggaggaccaggccacgaagaaccgauaccaaugucaacauauggguggaaucuuguacgguuacaaucugguguagauguauuuuucacgccuccugagaaaugugacacacuacucugcgauaucggggaguccaguccaaauccaacaaucgaggccggucgcacccugagaguguuaaaucuggucgaaaauugguugaacaauaauacucaguuuuguaucaaaguacuaaaccccuacaugccuuccguuaucgagaaaauggaggcacuacagaggcaauacggaggugcucuaguuaggaauccauugucaagaaauuccacgcacgaaauguacuggguuuccaaugcuaccgggaauauuguuuccaguguuaacaugaucagccgcauguugauuaacagauuuacaaugaaacauaaaaaggcaacauaugaaccagaugucgaucuagggucaggaacccgaaauauuggaaucgaaucagaaauuccuaacuuggauauuauagguaaaaggauagagaaaauaaaacaagaacaugaaaucucauggcauuacgaucaagaucauccguauaaaacaugggcauaucacggcucuuacgaaacuaaacagacugguagugcgagcucgaugguaaauggaguuguaaggcuacugaccaaaccuugggacguaguaccuaugguaacucaaauggcaaugacugauacaacgcccuuuggacagcaaaggguuuucaaagaaaagguagacacccggacccaagaaccgaaagaagggaccaagaaauuaaugaaaaucaccgcagagugguuauggaaagaauuggguaaaaagaaaacgccacgaaugugcacacggguagaauuuacuaaaaagguccgaaguaacgcagcacuuggagcuauauuuacagaugaaaauaaauggaaaagugcacgcgaagcuguagaggacggaagauucugggagcugguggaucgcgaacguaauuugcaucuagaagggaaaugcgaaacauguguguacaauaugauggguaagcgagaaaagaaauuaggcgaauuuggaaaggccaaaggaucacgugcaauaugguacauguggcuaggugccagguuucucgaauuugaagcauuaggauuuuuaaaugaggaccauugguuuucacgcgguaauucucuuaguggaguagaaggagaaggccuccauagguuaggcuacauucugagagauguuggcaagaaagaaggaggcgccauguaugcugaugauacugcgggaugggacacaagaauaacacuagaagaccucaaaaacgaagagaugguaacaaaucauaugaaaggugaacauaagaaauuggcagaagcgaucuuuaaacucaccuaucaaaacaagguaguccguguacaacgaccuacaccuaggggcacuguuauggauaucauaagucgaagagaccaaagagguucgggccagguagggacauaugguuuaaacaccuucacaaacauggaggcgcaacuaauacgucaaauggaaggugaagguauuuucaagaguauccaacaucuuacggccacagaggagauagcuguacaaaauuggcuagcgcgaguaggacgagaacgauuaucaagaauggcaauaaguggagaugacugcgucguaaaaccaauugacgauagauucgcuucagcgcuuacugcucuaaacgauaugggcaaaguccguaaggacauacagcaaugggaacccucaagaggauggaaugauuggacacaaguuccguuuuguagucaucauuuccaugagcuaguaaugaaagauggaagaguccuaguggugccuugucguaaucaggaugaauuaauugggagagcaagaauaucgcagggugcgggauggagucuaaaagaaacagcaugccuugguaaaagcuaugcgcaaauguggacacugauguauuuccaccgacgugaucugcgacucgcagcuaaugcuauuugcucugcagucccuagccacuggguuccaacaagcagaacaacauggucgauacaugccaaacacgaauggaugacaacagaagauauguuggccguguggaaucgagucuggauucaagaaaauccauggauggaagauaaaacgccgguugagaguugggaggagguaccguaucuugggaaacgugaagaucaauggugcgguagccuuauaggacuaacgucgagagcgacaugggccaaaaacauacaaacagcaauaaaucagguccguucuuuaauaggaaaugaagaauacaccgauuacaugccaucuaugaaaagauuccgcagagaagaagaagaagcuggcguacuaugguaa

SEQ ID NO: 22405 - RNA, 9876 nt, Artificial Sequence
  derived and/or modified CDS sequence (opt6) from DENV-2__FJ639835__SS-prME
acggccggugucauuguaaugcuaauaccgacugcaauggcuuuucacuuaacaacucgaaacggagaaccacauaugauuguggggcgacaagaaaaaggaaaaucucuacuuuuuaaaacugaagauggagugaacaugugcacuuuaauggcaauugauuuaggagaauuaugcgaagacacgauuacauacaaauguccuuuguuaagacagaaugaaccggaagauauagacuguuggugcaauaguacgucuacuuggguaacguacggaacguguacaacaacuggagaacaucgcagagagaaaagaucuguagcgcugguaccccaugucgguauggguuuagaaacgagaacagaaacuuggaugagcucugaaggggccuggaaacacguacaaagaauugaaacauggauacuaagacauccaggauuuacuauaauggcugcaauuuuggcauauacgaucgggaccacucacuuucaacgggcacuaauauucauuuuacuaacagcuguagcuccgucgaugacaaugagaugcauaggaauaucaaacagagacuuuguggaaggagucaguggggguagcuggguugauauaguacuggaacacggaucauguguaaccacuauggcgaaaaauaaaccuacucuggauuuugaauuaauaaaaacagaagccaaacaaccugcaacacuucggaaauauuguauugaagcgaaauugacaaauacaacgacugaaagccgauguccaacacaaggugaaccaagucuaaacgaagaacaggacaaacgcuuuauauguaaacacagcaugguagaucguggauggggaaauggaugcggucucuucggaaaaggaggaauaguuacuugugcgauguuuaccugcaagaaaaacauggaagguaaagucguacaaccagagaaccuugaauacaccauagugauaacgccgcauucaggggaggaacaugcugucgggaaugacacagggaaacacggaaaagaaauaaaaauuacuccccaaucuucgauuacagaagccgaacucacuggauauggcacuguaacuauggagugcagcccuagaacaggauuagauuucaaugaaaugguucucuuacaaauggaggauaaggcuuggcuaguacaccgacagugguuuuuggacuuaccgcuuccaugguugccgggcgccgauacucaggguucaaacuggauccaaaaagaaacauuagucacauuuaaaaauccacaugccaagaaacaggauguagucguacuaggaucacaagaaggcgcuaugcacacugcacugacaggcgcaacagaaauacaaaugucaagcgguaaucuacuuuucacaggccaccugaaaugccgcuuaagaauggauaaauuacaacugaaagguaugagcuauaguauguguacagggaaauucaaaaucguuaaagaaauugcagaaacucagcaugggacuauuguuauaagagugcaguacgaaggggauggcaguccauguaaaauccccuuugagauaacugaucuugagaaaagacacguucuagguagguuaauuaccguaaacccgauagugaccgaaaaagacuccccaguuaauauugaggcugaaccgccauucggugauucuuauauuauaauaggcguagagccaggucaauugaaauuaaauugguuuaagaaagggucauccauagggcagauguuugaaaccacgaugcguggagcgaaaaggauggcaauucuaggugacaccgcgugggacuuuggaagucuaggagggguuuucacaaguauaggcaaagcauuacaucaaguuuucggagcgauuuacggggccgcuuucucagguguaagcuggacaaugaaaauucuaauaggaguuauaaucaccuggauaggaaugaacucaagguccaccuccuuaucugucagcuuggucuuaguaggagucguaacacuauacuugggagccguaguccaagcagacagugggugcguagucagcuggaagaacaaagagcucaaguguggaucgggaauauucauaaccgacaauguacauacuuggacagaacaauauaaauuccaacccgaaucuccgaguaaauuggcgucggcgauacaaaaagcgcaugaggaaggaauaugcgggauuagaucaguaacgaggcuagaaaaucucauguggaagcaaauaacaccagaguuaaaccauauucuaucggaaaacgaaguuaaacugacaauaaugacuggcgacauaaaggguaucaugcaagcuggcaaacgaucuuuaagaccccaaccaacugagcugaaguacagcuggaagacuugggggaaggcaaaaauguuaucgacagaaagucauaaucaaacauucuuaauugacgguccagaaaccgcugagugcccaaauacaaaccgcgccuggaauagcuuagagguagaggauuauggauucgguguauuuacaacuaacauaugguugaagcugagagagaaacaagacguauuuugcgacuccaaguuaaugucugcagccauaaaagauaauagggcgguucacgcggacaugggcuauuggaucgaaucagcuuuaaaugacacguggaaaauggaaaaagccucuuuuauagagguaaaaucaugccauuggcccaaaucacauacauuguggucuaacggaguccucgaaucugaaaugguuauacccaaaaauuucgcagguccgguaucucaacacaauuaccgacccggauaccacacacaaacugcaggaccuuggcaccuagggaaacuagaaauggacuuugacuuuugugaaggaacaacgguuguuguaacagaagacugcggaaauagagggccaucucucaggacuacaacagcaucaggaaagcuaaucaccgaaugguguugcagauccuguacccuaccaccauuacgauauagaggcgaggacggauguugguacgguauggaaauacggccacuaaaagagaaggaggagaaucuuguaaacucacucguaacugcggggcacggucaaaucgacaacuucucauuaggagucuugggaauggcacuuuuucuagaagagaugcuucggacacguauuggaacuaagcaugccauauuguugguagcuguaaguuuugugaccuuaaucacuggaaauaugaguuuucgggauuuaggacgaguaauggucaugguaggcgcaacgaugaccgacgacauagguaugggcguaacauacuuagcccuacuagcggcuuuuaaaguuaggccuacauuugcagcaggacuccuauugagaaaacucaccaguaaagaacugaugauggcgacaauaggaauagcacuucuaucacaaucaacaauaccugaaacuauccuugaauugacugaugcacuugcucuugguaugaugguacucaaaauuguccgcaauauggaaaaauaucagcuagccgugacuauuauggccauuucauguguuccuaacgcagucauacuacaaaacgcuuggaaagucucuuguacaaucuuagcugcggucucgguaaguccguuauuacuuacaagcucacaacaaaaagcggauuggaucccacuggcauuaacuauaaaaggucuuaauccaaccgcuauauuucugacuacuuuaagcagaacuuccaagaaaagaucguggccucuaaaugaagcgauaauggccgucgguaugguaaguaucuuggcuaguucauugcuaaagaaugacauuccgaugacaggaccuuuaguugccggaggacugcuaacaguauguuacguauuaaccggccgaucagcagacuuagaacuugaacgugccgccgaugucaaaugggaagaucaggcagaaaucucaggaucuuccccuauauuaucuauaacuauuucagaagaugggucaaugucuauuaaaaaugaggaagaagaacaaacguugacaauacuaauaagaaccggguuauuaguaaucuccggaguguuuccggucucaauaccuauaacugcagcagcaugguauuuaugggaaguuaaaaagcagcgagcuggagucuuaugggacgucccaagcccaccaccaguggagaaagcugaacuugaggauggggcauauagaauaaaacagcgcgguauuuugggauauagccagauaggagcaggaguguauaaagaagggacauuucauacuauguggcauguuacuagaggcgcagugcuuaugcacagaggaaaaagaauugaaccuucuugggcugauguuaaaaaggauuugauuucauacggcgguggauggaagcuagaaggggaauggaaagaaggggaggagguucaaguccuggcccucgaacccggcaaaaauccacgagcuguacaaacaaagccuggcauuuuuaaaacgaauaccggaacuauaggcgcugucucguuagacuucucccccggaacaucaggaagcccuauagucgaucgaaaggguaaagugguuggccuguauggcaacgguguugucacucguuccggagcauacguaucugcgauagcgcaaacggagaaaucuauugaagauaauccugaaauagaggacgacauuuuuaggaagaaacgcuugaccauaauggaccugcacccgggagcaggaaaaacaaaacgcuaucuaccugcuauugucagggaagccauaaaaagaggccuacgaacucuaaucuuggcgccuacacgugucguggcagcugaaauggaagaagcgcucagggggcucccaauaagauaccaaacgccugcuauaaagacagaacauacaggacgugaaauuguagacuuaaugugccacgcaacuuuuacgaugcggcuauuaucacccguccgaguaccaaauuauaaucuuauaauaauggacgaggcacacuucacagauccugcuucaauagccgcacgugguuauauaucuacucgaguggaaaugggagaagccgccgguauuuuuaugacggccacuccgccagguucucgugauccauuuccucaaucgaaugcuccuauaauggaugaagaaagagagauacccgagcgcucuuggaacucaggccaugaauggguuacagacuuuaaagguaagacggugugguuuguuccaucaauaaaagccgguaaugauauagcagccugucugaggaaaaauggcaagaaagucauacaacuaagccguaagacauucgacagugaauacguaaaaacaagagcaaacgauugggauuucgucguaacgacugauauaucagaaaugggugcaaauuucaaggcagaacggguuauagauccaagaagauguaugaaaccgguuauacuaacagacggagaagaacgcguaauccuagccgguccaaugccggucacccauagcucugcugcgcaacgacgaggaagaauuggcagaaaucccaaaaaugaaaacgaucaauauauuuauaugggcgaaccucuagaaaaugacgaggacugcgcgcauuggaaagaagcaaagaugcuauuggacaacauaaacacucccgaagggaucaucccgaguauguucgagccggaacgugaaaagguggaugcaauagauggagaauaccggcuuagaggggaggcaagaaaaacauucguugaucuuaugagaagaggagauuuaccaguaugguuagccuauaaaguugcugcugaaggcauaaauuaugcggacagaaaaugguguuuugacgguaucaaaaauaaucaaauauuagaagaaaauauggaaguagaaauauggacaaaggaaggagaacguaagaaauugaaaccacgguggcuagaugcacguauauauagcgacccccuagcgcuaaaagaguucaaagaauuugcugcaggacgaaaaucacuuacuuugaaccuaauuacggaaaugggacgacuaccaacauuuaugacucaaaaagcuagaaacgcccuagauaaucucgccguacugcacaccgccgaagcaggcgguagagcuuacaaccacgcguuaagugagcuuccggaaacauuagaaacacuucuacuauuaaccuuauuagcaacugucacagggggcauauuucuguucuugauguccggcaaaagcauaggaaaaaugacuuuaggcauguguugcauaaucacugcuucaauuuugcucuggcacgcccaaauacaaccccauuggauagccgcgaguauaauucuagaauuuuucuugauaguacuauuaauaccagaaccagaaaaacaaagaacaccacaagacaaucaauuaaccuaugucgugauagcgauauuaacaguaguugcagcaacaauggcgaaugaaaugggguuccuugagaaaaccaagaaagaccuuggacuaggcucaauaacgacgcaagagucagagagcaauauauuagacauugacuuacgacccgcauccgcauggacucucuacgcugucgccacaacguuuguuacaccaauguugcgccacucaauagaaaacucuuccguaaauguaucucuuacagcaauagccaaucaagccacuguccuaauggguuugggcaaaggguggccauuaaguaaaauggacauugggguaccccuucuagcuauagguuguuacucucaggucaauccaauuacacugacagcagccuuauuauugcuggucgcgcacuaugcgauaauagggccagggcuucaggcaaaagcuacucgcgaagcacaaaagcgagcugcagcugggauaaugaaaaauccaacuguagauggaauuacugucauagacuuagaaccaauaccauaugauccuaaauuugaaaaacaacuaggacaaguuaugcuauugauuuuguguguaacucaaguuuuaaugaugaggacuacaugggcuuuaugcgaagcucugacacuagcaaccgggccuauaaguaccuuaugggaaggaaauccuggccgauucuggaauaccacuaucgcgguaucaauggcaaauauuuuccggggcaguuacuuggcuggugcaggacugcuauucucaauaaugaagaauacaacuagcacaagaagagggaccggaaauauuggugaaacauuaggcgagaaauggaagucaagacugaacgcucuuggaaaaagugaauuucaaaucuauaagaaaucaggaauacaagaaguggauagaacuuuggcgaaggaggggauuaagagaggugaaacggaccaccaugcgguuucaagggguucugcaaaauugcguugguucguugaacguaacauggugacaccagaaggaaaggugguugauuuaggcuguggacgagguggguggucauacuacugugguggacuuaaaaauguuagagaagugaaaggcuugacaaaaggcggacccggacaugaagaaccaauuccaaugucuacauauggguggaaccugguaagacuacagucaggaguggacguguucuucaccccuccagagaaaugcgauacacuacuaugugauauaggugaguccucaccgaaucccacaaucgaagcugguagaacguuaagaguauuaaaccuuguagaaaacugguuaaauaacaacacacaguucugcauaaaaguucucaauccuuacaugcccucagugauugagaaaauggaagcacuacaaagacaauauggaggagcauuggucagaaauccguuaucaaggaacaguacgcacgaaauguauuggguaagcaaugcuacgggaaacaucgugucgagcguaaacaugauuucaagaaugcuuauaaaucgguucacaaugaaacacaagaaagcaacguaugaaccagacguugaccuaggauccggcacgagaaauauaggaauagagaaugagauuccgaauuuggauauaauugggaaaagaaucgagaagaucaaacaggaacacgaaauuagcuggcacuaugaucaagaccaccccuauaaaacuugggcauaccaugguucauaugagacaaagcaaacagguagugcaucgaguauggugaacgguguugucagauugcugacgaaacccugggacguugugccaaugguaacacagauggcaaugacagauacgacaccuuucggucaacagagagucuuuaaggaaaaaguagauacacguacacaagaaccaaaggaaggcacuaagaaauugaugaaaauuaccgcagaauggcuguggaaagaauuaggcaagaagaaaaccccgcgcauguguacgagagaagaauuuacucgcaaaguucgaaguaaugcagcucuaggcgccauuuuuacagaugaaaacaaauggaaaagugcuagagaagcagucgaggauggaagguuuugggagcugguagauagagaaagaaacuuacaucuagaagguaagugugaaacuugcguguacaacaugauggggaaaagagaaaagaaauuaggugaguuugguaaagcuaaagggucaagggcuaucugguauaugugguuaggagcaagauuuuuagaguuugaggcguuaggcuuucuuaaugaagaccacugguuuucuaggggaaacucguuaaguggaguggagggcgagggccuccaucgauuggguuacauauuaagggauguagguaagaaagaaggaggagcaauguaugcagaugacacugcagguugggacacaagaaucacccuugaagauuuaaagaaugaggaaaugguaaccaaucacaugaagggagaacacaagaaauuagccgaagccauauuuaaauuaacguaucagaauaagguuguacgcguacaaagacccacaccucgugggacuguuauggauauaaucaguagaagagaccaaagagggagcggucaaguuggaacguacggcuuaaauacauuuacgaauauggaagcccagcuaauucgacaaauggaaggagaaggaauauucaaaucaauucaacauuugacagcgacggaagagauagcgguacaaaacuggcuagcgcgugugggucgagaaagguuaucgaggauggcaaucaguggagaugacugugugguuaaaccuauagaugauagauucgcgagugcacuuacggcacucaaugauauggguaaagugagaaaagacauucaacaaugggagccuagccgaggauggaaugauuggacacaaguccccuucuguucacaccauuuccaugagcucgugaugaaagauggacgaguuuuaguaguuccaugucgaaaucaagaugaacuuauugggagagcacguauaagucaaggugccggauggagcuuaaaagaaaccgcuuguuugggaaagaguuacgcacaaauguggacacuaauguacuuucaucgucgugacuuacgacuggcugcgaaugcuauaugcagcgccguaccaucucauuggguccccaccaguagaacaacuuggagcauacacgcuaaacaugaauggaugacgacagaagauaugcucgcgguuuggaauagaguauggauacaagaaaacccuuggauggaagacaaaacuccuguagaaucaugggaggaaguuccauaccuugggaaaagagaagaucaauggugugguucacuaauaggauuaacuucccgcgcaaccugggcuaaaaauauucagacagccauaaaucaaguccguagucuuauuggaaaugaagaauauacagacuacaugccaucaaugaaacgguuccguagggaggaagaagaagcaggcgugcuaugguaa

SEQ ID NO: 22406 - RNA, 9876 nt, Artificial Sequence
  derived and/or modified CDS sequence (opt6) from DENV-2__FJ850050__SS-prME
acagccggugucauagucauguugauaccgacggcaauggcauuccacuuaacaacuagaaauggagaaccucauaugaucguagguagacaggaaaaaggaaaaagucuauuauucaaaacagaagauggaguaaacaugugcacacuuauggcaauagaucuaggagaauuaugcgaagacacuauuacguacaaauguccuuuacuaaggcaaaacgaaccugaagauauugacugcuggugcaacaguacgucgacgugggugacauauggaacuugcacaacaacaggggaacacaggcgugagaaaagaaguguugcauuagucccacaugucggaaugggacucgaaacacgaaccgaaacguggaugucuuccgaaggagcauggaaacacguccaacggaucgaaacguggauccuaagacauccuggauucacaauaauggcagcaauacuggcauacacaauuggcacuacucacuuccagagagcacuaauuuuuaucuuacuaacggccguagcuccuuccaugacgaugagaugcauagguauuucaaauagggacuuuguagaagguguuucaggaggaaguuggguagauaucguauuagaacaugguagcuguguuacgacaauggccaaaaauaaaccuacacuugauuucgaauugaucaaaaccgaagcuaaacaaccggccacauugcgcaaauauuguauagaagcaaaacuaacgaauacaacuacagaaagccguugucccacacagggggaaccaagucuuaaugaagaacaagacaaaagauucauaugcaagcauagcaugguagaucgaggguggggaaauggcuguggguuauuuggcaaaggagguauuguaacgugcgcuauguucaccuguaagaaaaauauggaaggcaagguggugcaaccagaaaauuuagaauauaccauugugauaacaccacauucaggagaagaacaugcgguagguaacgacacagguaaacacggaaaggaaauuaaaauaacgccccaaaguaguauaacagaagcagaauuaacugguuacgguaccguaacuauggaaugcaguccaaggacuggacucgacuuuaaugaaaugguacuacuacaaauggaagauaaagcauggcuaguacaccggcaaugguucuuggacuuaccgcuuccguggcuaccuggagcggauacgcaggggaguaacuggauacaaaaagagaccuuaguuacguuuaaaaauccacaugcaaagaaacaagacguagucguguuaggcagccaagaaggggcuaugcauacugcuuuaacaggugguacagagauacaaauguccucugguaaccucuuauucacaggacaucuaaaaugcagauugagaauggacaaauugcaacuuaaaggaaugucauauagcaugugcacuggaaaauuuaaaauagugaaagaaauugcagaaacacaacauggaacaauagugauccgaguucaauaugaaggagaugggaguccaugcaagauaccuuucgaaauaacagaucuggagaaaagacacguauuaggaaggcuaauuacaguuaauccgauuguuacggaaaaggacagcccaguaaauauugaagcagagccaccauucggggauucauacauaauaauuggaguagagcccggucagcuaaaguuaaauugguuuaagaaaggaucaaguaucggacagauguucgaaacaacaaugagaggagcaaagagaauggcaauucuuggugacacagcuugggauuucggaagccugggcggcguguuuaccaguauagguaaggcguuacaccaaguauuuggugcaauauacggagcugcuuucucgggagugucauggacaaugaagauucugaucggaguuauaauuaccuggauuggaaugaacucgcgcucuacaagccuauccgugagcuuaguauuaguaggaguagucaccuuauaucuuggagcugugguacaagcugacaguggauguguuguuaguuggaaaaauaaggaguugaagugcggaaguggaauauuuauaacagacaaugugcauacguggaccgaacaguauaaauuccagccugaaucaccaucuaaacucgcuagugccauccaaaaagcucaugaagagggaauaugcggaauccgcucgguaacucgauuagaaaaucugauguggaaacagauaacacccgaauuaaaucacauucuaucugagaaugaaguuaaacuaacuaucaugaccggugauauuaagggcaucaugcaagccggcaaaaggucacuuagaccacagccgacagaacuuaaguauagcuggaagacuugggguaaagcgaagauguugaguacggaaucacauaaucaaacuuuucucauugaugggccagaaacugcagaaugucccaacacgaauagagcauggaacucauuagaagucgaagauuacggcuuuggaguauuuacgacaaacaucugguuaaaauugagagaaaagcaggauguauucugcgauaguaaacuuaugucagcggcuaucaaguauaauagagccguacaugcagacaugggcuauuggauagaaagugcaccgugugauucuugggaaaugcaaaaagcaucauucauugaagucauuuccugucauuggccuaaaagucugacuuuauggucgaauggagugcuugaauccgaaaugauaauccccaaaaacuucgcagggccuguuagucaacauaauuacagaccaggauaccauacccaaacugccgggccauggcaccuaggaaaacuggaaauggauuuugauuuuugcgaagggacuaccguaguagugacugaggauugugggaaccggggaccgaguuuacgaacgacaaccgcaucuggaaaauugauaacggaaugguguuguaggucauguacacuaccuccccuaagguacaggggagaggacgggugcugguauggcauggaaauuaggccacugaaagaaaaagaagaaaaucugguaaacagccuuguaacggccggucauggacaaauagauaacuucucauugggagucuuaggaauggcccuauuuuuggaagagaugcuccgaacaaggauaggaaccaaacaugcgauauugcuuguagcaguuucauuuguaacuuugauaacgggcaacaugaguuuucgugaucucggucggguaaugguuaugguaggagcgacuaugaccgacgauauaggaaugggcguaacauauuuagcguuguuagcagcauuuaaggugagaccuacuuuugcagcaggcuugcuauuacgaaaauuaacgagcaaagaguuaaugauggccacaauagguauagcacuauuaucacaaucuacuauaccagagacgauauuagaguuaacggaugcccuugcauuagggaugaugguucuaaaaauagucagaaauauggaaaaauaccaacuggcaguaacaauaauggcaaucucauguguccccaacgcagugaucuuacaaaaugccuggaaaguuucaugcacaauuuuagcugcagugucuguuagccccuuguuauuaacaaguucacaacaaaaagcagauuggauuccacuugcauugacgauaaaaggguuaaauccgaccgcaaucuuucuaacuaccuuaucuaggacguccaagaaacggagcuggccacuaaaugaggcaaucauggcuguggguaugguaucaauacucgcguccucguugcuaaagaaugacauaccaaugacuggaccauugguagcggguggacuuuugacaguauguuaugugcuaacgggaagaucugcagauuuggaauuagaacgagcagcugauguaaaaugggaggaucaagcagagauauccggcucgaguccaauacuaagcauaacaauuagugaagacggaucgaugaguauuaagaaugaggaagaagaacaaacucuaacaauucucauucgaacgggacuucucguuaucagcggcguauucccaguaucgauuccaauaacagcugcagcgugguacuuaugggaagugaaaaagcaaagagccggcguacuaugggacguacccagucccccuccuguugaaaaagcugaacuagaggauggugcauacagaauuaagcaacgagggauacuagguuacagucagauaggugcuggaguuuauaaagaaggaacuuuucacacgauguggcacguuacacgcggagcuguccugaugcacagggguaaaaggauagagccaucuugggcagacguuaagaaagaucuaauaagcuauggugguggauggaaacuugaaggagaauggaaggagggugaagaaguacagguucucgcguuggaaccaggcaaaaauccucgcgcaguucaaacuaaaccgggaauauucaaaacuaauacaggaacaauuggugcaguuucgcuggauuuuagcccuggcacuucgggaucccccaucguugaucggaaggguaaagucguuggauuauaugguaauggagucguuacaaggucaggagcauauguaagcgcgauugcccagacugaaaaaucaauugaggacaaucccgaaaucgaagaugacauauucaggaaaaagcguuugaccauuauggauuuacauccaggugcuggaaaaacaaaaagauaucugccagcaauugugagagaagcuauaaagcgaggcuuaagaacucuuauuuuggcgccuacgagaguaguagccgcagaaauggaagaggcuuuaagagguuuaccgauaagauaucagaccccggcaauuaaaacggaacacaccggccgggagaucguugacuugaugugccacgcgacauuuacaaugcggcugcuaucgccaguaagaguacccaauuacaaccuuauaauuauggaugaagcucauuuuacugacccagcuaguauagcugcucgagguuauauuagcacgcgcguugagaugggagaggcagcuggcauauucaugacagcaacaccaccugggucgcgagauccuuuuccacaaaguaaugcucccaucauggaugaagagagagagauaccugagagaagcuggaacucaggucaugaauggguaaccgacuuuaaagguaagacuguuugguuuguaccuuccauaaaagcaggcaacgacauagcugcaugccuaaggaaaaauggcaagaaaguuauacaacuaagucgcaagacauucgauuccgaauacguuaaaacaagagcaaacgauugggauuuuguaguaacgaccgauauaagugaaaugggagcaaauuuuaaagcggaaagaguuaucgacccucgucgauguaugaaaccagugauucucacagacggagaggagcguguaauauuagcugggccaaugccagucacucacucaagugcagcacaaaggagggggaggaucgguagaaauccuaaaaaugaaaaugaccaauauauauauaugggugaaccauuggaaaaugacgaagauugugcacauuggaaggaagcaaagauguuauuagauaauauaaacacuccugaaggaauuauaccaaguauguucgaaccggaaagggagaagguagaugcgauagacggagaauaucgauuaagaggagaagcaagaaaaacauucguagaucuaaugcguagaggcgauuuaccaguauggcuagcauauaaaguagcagcugaaggaaucaauuaugcugauagaaaauggugcuuugauggcaucaaaaauaaucaaauacucgaagaaaauaugcaggaacaaaucuggacgaaagagggugaacguaagaaauugaagccacguuggcuagaugcgaggaucuauucagacccguuggcauuaaaagaauuuaaagaauuugcagcuggaagaaaaucauugacacuaaaccuuauaaccgagaugggacgguugccuacguuuaugacacaaaaagcacgaaacgcauuagacaauuuagccgugcuacacacugcagaagccggagguagagcguauaaccaugcacuuucagaacuaccugaaacauuggaaaccuuguugcuacuaacuuuacuagcaacugucacagggggaauuuuucuauuuuugaugucgggaaaggggauaggaaaaaugacacuugguauguguuguaucauaacugcauccauacuauuaugguaugcucaaauacagccacauuggauagcggcaaguauaauauuagaguucuuccuaauuguacuauuaauucccgagccugaaaagcaaagaacuccucaagauaaccaauuaaccuauguagucauugccauacuuacgguagucgcugcaaccauggcuaaugaaaugggauuuuuggagaagaccaagaaagaccuaggccucggaaguauaacgacccaagaaucggaaaguaauauucuugacauagaccuacgcccagcaucagcauggacccuguaugccgucgcaaccaccuuuguaacaccaauguuacgacauucaauugaaaacucaucuguaaauguaaguuuaacugcuauugcaaaucaggcaacgguuuugaugggauuaggaaaagguuggccauuaucgaaaauggacaucggcguacccuuacuggcuauaggcugcuauucgcaaguaaacccgauuacacucaccgcagcauuacuacuauuaguagcacacuacgcaauuauagggccgggacuacaagcaaaagcgacuagagaagcacagaaaagagccgcagcaggaauaaugaaaaauccaacaguggauggaauuacaguaauagacuuagagccaauaccauacgauccaaaauuugaaaagcaauuaggacaagucaugcuucuuaucuuauguguuacacaagucuuaaugaugcgaacgacaugggcacuaugugaggcuuuaaccuuagcaacaggacccaucucaacuuugugggaaggcaacccgggacgauucuggaauacuacgauagcagucuccauggcaaauauauuccgugguucuuacuuggcuggcgccggacuauuauucaguauuaugaaaaauacaacgucuacgagacgugggacgggcaacauaggugagaccuugggcgaaaaauggaaaagcagacuaaacgcucuugggaaauccgaguuucaaauauacaagaaaucgggaauccaagaagucgacagaacgcuugcaaaggaggguaucaagcguggagagacagaccaccaugcugugucaaggggaucagccaaacuaagaugguucguugaaaggaacauggucacaccagaggggaaggugguagacuuaggaugcggaaggggaggauggaguuacuacugcgguggccucaaaaaugugcgggagguuaaaggguuaacaaaaggaggaccgggacacgaggaaccgauaccaaugucaacauauggauggaaucuggugaggcuucaaucaggggucgauguauucuuuacgccuccggaaaaaugugauacccuacuaugcgacauuggggaaucaagucccaacccaacuauagaagcagggaggacguuaaggguauuaaacuugguugaaaauugguugaacaauaauacucaauuuuguauuaaaguuuugaauccauauaugccaucuguaauugagaaaauggaagcgcuacaaagacaauacgggggagcccuugucaggaauccuuuaucgcgaaauuccacucaugagauguauuggguaucuaaugcuacuggcaauaucgugucuucagucaauaugaucucaaggaugcuaaucaacagguuuacaaugaaacacaagaaggcuacuuaugaaccggauguagaccuuggaucuggaacaagaaacauagguauagaaagcgaaaucccaaauuuagauauuaucggaaagcgcauugagaaaauaaaacaagaacaugaaauaucuuggcauuaugaccaagaccauccauacaaaacuugggcauaccacgggaguuaugaaacaaaacagacagguucugcgucuucuaugguaaacgggguuguucgccuccuaaccaaacccugggauguaguaccaauggucacgcagauggcgaugacugauacaacgcccuuuggacaacaaagaguauuuaaagaaaagguagauacaagaacgcaggagccaaaagaaggcacuaagaaauugaugaaaauuacagcugaauggcuguggaaagaacuaggaaagaagaaaaccccucguauguguacgagagaagaauuuaccaagaaaguaagaucaaaugcagcccucggugcuauauuuacggaugaaaauaaauggaaaagcgcgagagaagcagucgaagacggaagauucugggaacuuguagaucgggagcgaaacuugcaccuagaaggcaaaugcgaaacauguguauauaacaugauggggaaacgagagaagaaauugggcgaguucggcaaagcgaaaggcagcagagcaauuugguauauguggcuaggagcgagauucuuggaauuugaggcccuaggauuccuaaacgaagaccauugguucucaagaggaaacucccuaucagguguagagggagagggccuacauagauuaggauacauacuaagagauguaggaaagaaagaggguggagcuauguaugcagaugauacagcugguugggauacucgaauuacucuggaagaucuuaaaaaugaggaaauggucacaaaccauaugaaaggcgaacauaagaaauuggcagaagcgauauucaaacuaacguaucaaaauaaagucgugagaguucagaggccgacaccaaggggaaccgucauggauauuauaagcagaagagaccaaagggggaguggacaaguaggaacauacggccuuaacaccuucacuaacauggaagcgcaguugauaaggcaaauggaaggugaaggaauuuucaaaagcauacagcaccucacugcaacugaagaaauugcuguccaaaauuggcuagcacggguuggaagggagagacuaagucguauggcaaucucaggagaugauuguguugucaaaccuaucgaugauagauucgcauccgcucugacagcgcuaaacgauaugggaaaagucagaaaagacauccagcaaugggaaccgagucggggguggaaugacuggacucagguucccuuuuguucucaucacuuucaugagcuaguaaugaaagacgguagaguauugguuguuccuugcagaaaccaagaugaguuaaucgguagagcuagaauuucgcagggcgcgggauggucuuugaaagaaacagcaugcuuggggaaaagcuacgcccagauguggacacuaauguacuuucauagaagggaucuaaggcuagcagcaaacgccaucugcucagcaguaccuagucacuggguaccgacaucccgcacgacuuggucgauucaugcaaagcacgaauggaugacaacagaggauauguuagcuguauggaacagagucuggauucaagaaaauccauggauggaagauaagacuccaguagagucuugggaagaaguucccuacuugggaaagagagaggaucaaugguguggcucgcuaaucgggcuaaccaguagagcaacaugggccaaaaacauucaaacugcuauaaaccaagucagaucacuuaucggaaacgaggaauauacggacuauaugccuucaaugaaacguuuuagaagagaagaagaggaagccggagucuugugguag

SEQ ID NO: 22407 - RNA, 9876 nt, Artificial Sequence
  derived and/or modified CDS sequence (opt6) from DENV-2__FJ639837__SS-prME
acggcaggaguuauaguuaugcugauaccaaccgcuauggcuuuucauuugacuacucgaaacggagaaccucauaugauaguuggacgucaagaaaaaggaaaaucccuuuuauuuaaaaccgaggauggugugaauaugugcaccuugauggcaauugauuugggugaauugugcgaagauacuauuacguauaaauguccucuguugcggcagaaugaacccgaggacauagacugcugguguaacuccaccucaacguggguaacuuacgggacauguacgacuacaggggaacaccgcagagagaaacguucuguugcacucguaccacaugugggaauggguuuagagacuagaaccgaaaccuggaugucuucggaaggugcauggaaacauguucagagaauagagacauggauacuuagacaucccggauuuacaauaauggcugcuauauuagcauacacuauuggaacgacucauuuucagcgugcguuaauauucauccuacuuacagcaguagcaccaaguaugacaaugcgauguaucggaauaucaaaucgcgauuuuguggaaggaguuagcggcgguucauggguugacauaguacuagaacaugguucgugugucaccacuauggcgaaaaauaaacccacuuuagacuuugaacugauuaaaacagaagccaaacagccugcaacgcugcguaaauacuguaucgaagcaaaacuaacaaacaccacgacugaauccagguguccuacucaaggcgaacccagucuaaacgaagaacaagauaaacgcuucaucugcaaacauucaaugguugaccgcggguggggcaaugggugcgggcuuuuugggaaaggaggaauaguuacgugcgcuauguuuacgugcaagaaaaacauggaaggaaaaguagugcagccagaaaaccuagaauauacuauugugauaacgccucauagcggagaagaacaugcaguuggaaaugauaccggcaaacauggcaaagaaauaaaaauuacaccacaaucgucaauaacagaggcagaauuaacgggcuaugggacggucacuauggaaugcaguccaagaacgggauuagauuuuaaugagaugguuuuacuacagauggaagauaaagcaugguuaguacaucgacaaugguuuuuagaccucccucuucccuggcuaccuggugcagacacgcaaggaucaaauuggauucaaaaagagaccuuaguuacguucaaaaacccgcacgccaagaaacaagauguuguuguuuugggaucccaggagggagcgaugcacacagcuuuaacuggagccacagaaauucaaaugucgaguggaaauuuacuguuuacggggcauuuaaaaugucguuugcggauggauaaacuucagcuaaaaggcaugaguuacucuaugugcaccggaaaauucaaaauugucaaagagauugcugagacacaacacggaacaaucgucauccgugugcaauacgaaggcgauggcaguccauguaaaauuccguucgagauuacugauuuagagaaaaggcauguacuaggacgguuaauaacgguaaaccccauuguaaccgaaaaagauucacccguaaacauugaagcagaaccgcccuuuggugacagcuauauaauaauuggaguggagccgggacaauuaaaacuuaauugguuuaagaaaggaucaaguauaggucaaauguuugaaaccaccaugcguggugcaaaaaggauggcaaucuuaggagauacagcaugggacuucggcucauuaggaggaguuuuuacaucaauuggaaaagcucugcaccaaguauuuggcgcaauuuacggcgcggcuuuuucugguguaucauggacaaugaaaauucugaucggcgucauaaucacauggauaggcaugaauaguagaaguacgucauugagcgugucucugguauuaguaggaguuguuacucuuuaccugggugcaguagugcaagccgacucaggcuguguugugagcuggaaaaacaaagaguugaaaugcggcucaggaaucuuuauuacagauaauguacacacuuggacagaacaguauaaauuucagcccgaaaguccaucuaaauuagcuucugcuauacaaaaagcacaugaagagggaauuugugggauucgcucagucacucgauuagaaaauuuaauguggaaacaaauaacgccagaguuaaaccauauucuaagugaaaacgagguaaaauuaaccauaaugacgggagacaucaaaggaaucaugcaagcuggaaaacgcuccuuaagaccacaacccacagaguugaaguauucauggaaaacgugggguaaagcuaaaaugcugucaaccgaaagucacaaccagacauuccuuauugaugggcccgaaacggcagagugcccgaacacuaauagggcauggaacuccuuagagguugaagacuacggguuuggaguuuuuacuacaaacauauggcuuaaauugcgagaaaagcaggacguauuuugugauaguaaauuaaugagcgcggcuauaaaagauaacagagcaguucaugcagauaugggguauuggauugaaagugcacuuaacgacacguggaaaauggaaaaagcauccuucauugaagucaaaucuugccauuggccaaaaucacacacauuauggucgaacgggguacucgagucagaaaugguaauccccaaaaauuuugcgggaccgguuucacaacacaacuauagacccgguuaccacacccaaacugccggaccuuggcaucugggaaaguuagaaauggauuucgauuuuugugaaggaaccaccguuguaguaacggaggauugcggcaaucgggguccuuccuuaagaaccacaacagcaucuggaaaauuaauaaccgagugguguuguaggucauguacuuuacccccguuaagauauagaggagaggacggcugcugguaugguauggaaauaaggccuuugaaggaaaaagaggaaaacuuaguuaacagucuugucacggcaggacauggccaaauugacaauuuuaguuuaggaguucuuggcauggcauuguuucucgaagagauguuaaggaccagaauagggaccaagcaugccauauuauuagucgcaguauccuucguaacucuaauaacggguaauauguccuuuagagacuuaggaaggguaaugguuauggucggugcaacaaugacagaugacaucgguauggguguaaccuauuuagcacucuuggcugcauuuaaagucagaccgacauucgcagcaggccuauuauugagaaaacuaacaaguaaggaauuaaugauggcaacaauagguaucgcauuacucagccagucaacuauacccgaaaccauacuugaguuaaccgacgcucuagcauuaggaaugauggugcuuaaaauagucagaaauauggaaaaauaucaacuugcugugacaauaauggcgaucucuugugugccaaaugccguaauacuacaaaaugccuggaagguaagcuguacaauacuggcugcagugaguguaucaccguuacuacuaacuucaagucagcaaaaagcugauuggaucccacuagcacucacgauuaaaggauuaaauccgacugcaaucuucuuaacaacccuuagcagaacauccaagaaacgaagcuggccacucaacgaagcuauaauggcaguuggaaugguaucuauauuagcgagcagucuguuaaagaacgacauuccaaugacagggccauuggucgcaggaggacuuuugacaguauguuauguauugacggggcggagcgccgauuuagaauuggaaagggcagcugacguuaaaugggaagaucaggcagagauaucugggaguucuccuauauuaucaauaacgauaagugaagacggaaguaugucuaucaaaaaugaagaagaggaacaaacucugaccauacucauuagaacugguuuacuggucaucucagguguauuuccggucucgauuccaauuacagcagcugcaugguacuugugggagguuaagaaacagagagcuggaguuuuaugggacguaccaagcccaccgccagucgaaaaagcugaguuagaagacggagccuacagaauuaagcaacgagguauauuagguuacucccagauuggggcgggcguauauaaagaagguacauuccauacgauguggcauguaacgcguggugcaguucugaugcaucgaggaaagcggauugaaccgucuugggccgaugucaagaaagauuuaauuucauacggcgguggcuggaaauuagaaggagaauggaaagaaggcgaggaaguccaaguucuagccuuagaaccaggcaaaaaccccagggcuguacagacaaaaccaggaauauucaaaaccaauacagguacuauaggggcaguaaguuuagacuuuucaccaggaacuucggggucccccaucguugacagaaaaggaaaaguaguaggguuauaugguaauggcgucguaacacgcucuggagcguauguaucggcgauagcucagacagaaaaaucaaucgaggauaaccccgaaauugaagacgauauuuuuagaaagaaacgauugacaauuauggauuuacaccccggcgcuggaaaaacaaaaagauaccuuccugccauagugcgcgaagcuauuaaacgcggcuuaaggacucuaauauuggcaccaacgcgaguugucgcugcugaaauggaagaagcgcuuagggggcucccaauacguuaccaaacgccugcgauuaaaaccgaacacacaggucgcgaaauugucgaucuaaugugucaugcuaccuuuacuaugcgccucuuaucccccguccguguaccaaauuacaaccuaauuauaauggaugaagcacauuucacugacccagcuucaauagcugcaagaggguacauaucaacaaggguagaaaugggagaagcagccgguauuuuuaugacggcuacaccgccugguagcagagacccuuucccacaauccaaugcacccauaauggaugaagaacgggagauaccggaaagaaguuggaacucuggacaugaauggguaacagacuuuaaaggaaagaccgucugguuugugccgaguauaaaggcugggaacgacauugcugcuugccuacguaaaaacgggaagaaaguaauucaauuaagccgaaaaaccuucgauucagaguauguaaaaacacgagcuaaugacugggauuuuguaguuacaacggauauuucagaaaugggagcgaacuucaaagccgagcguguuauagauccuagaagauguaugaagccgguaauuuugaccgacggugaggagcgcguaauuuuggcuggaccaaugccaguuacucacagcagugcggcacaaagacgagggcggauaggacgcaaucccaaaaaugaaaacgaucaauauauuuacaugggagaaccuuuggaaaacgacgaagauugugcacauuggaaagaagcgaaaauguugcuagauaacauuaauacuccggaaggaauuauacccuccauguucgaaccggagagggagaagguagaugcuauugauggugaauauagauugagaggggaagccagaaaaacauucgucgacuuaaugagacgcggcgaucuuccgguauggcuagcguacaaaguagcagcagaagguauuaacuaugcagauagaaaauggugcuucgacgggauuaaaaauaaccaaaucuuagaagagaacauggaaguugaaaucuggacaaaagaaggagaaaggaagaaacuaaaacccagaugguuagaugcacgaauauacucagauccgcuggcuuuaaaagaauuuaaagaauuugcagccggucguaaaucccuaacauuaaacuuaauuacagaaaugggaagauuaccaaccuuuaugacgcaaaaagcuagaaacgcauuagauaaccuugcaguacuacacacugcagaagccggaggcagagcauacaaucaugcuuuaucggaacuuccagaaaccuuggagacguugcugcugcuaacccuacuagcaacgguuacagguggaauauuucuauuucuuauguccggcaagucaauaggaaaaaugacacuaggaauguguuguauuauaacagcauccauacuccuauggcacgcccaaauacaaccacauuggauagcagcaucaauaauccuagaguucuuuuuaauaguacuacucaucccagaaccggaaaaacagagaaccccacaagauaaucaauuaacguaugugguaauagccauucucacgguaguagcagcaacaauggcaaaugagaugggauuccuagagaaaaccaagaaagauuuaggucuuggaucgauuaccacacaagaaucugaaucaaauauauuagacaucgaucuuaggccugcaagugcuuggacucuguacgcuguagccacaaccuuuguuacuccuaugcuacgacacagcauagaaaacaguuccguaaaugucagucuaacugcaauagccaaccaagccacgguauuaaugggauugggaaaaggcuggccgcuuucaaaaauggacauaggaguuccuuuacuugcaauaggauguuacagucaaguaaacccgauaacauuaacugcagcguuacuacuucuaguugcccacuacgcuaucauagguccaggauuacaagcaaaagcuacacgugaggcacagaaaagagcagcagccggaauaaugaaaaauccuacuguagacgggauaacuguaauagacuuagcgccuauacccuaugauccuaaauuugaaaagcaacuaggacaaguaaugcuccuaauucuauguguaacacaaguguuaaugaugcgaacaacaugggcauuaugugaggccuuaacuuuagcuacaggaccaauaagcacauugugggaagguaaccccgguagauuuuggaauacuacgaucgccguuucuauggcgaauauauuucgagguucauaccuugcgggggcugggcucuuauucucuaucaugaaaaacacuacaagcacaagaagagguaccggcaauauaggugaaacacuaggagaaaaauggaagucucgguuaaaugcauuggguaaaucugaauuucaaauauauaagaaaagcgggauacaagaaguggaucgaacacuggccaaagaggggauuaaaagaggggaaacagaucaccaugcuguaucaaggggaucugcaaaacuccggugguuugucgagcguaauaugguaacgccagaggggaaagucgucgaccuaggaugugggcgugguggauggucauauuauugcggugguuugaaaaacguaagagagguaaaaggucuaacuaaaggaggcccgggucacgaagaaccuauuccuaugagcacauacggauggaaucuaguccggcuucaaaguggaguagacguauucuuuacaccacccgaaaaaugugauacccuauuaugcgauaucggugaaagcuccccaaaucccaccauugaagccggaagaacauuaagggucuuaaacuugguagaaaauuggcucaauaacaauacccaauuuuguaucaaaguuuuaaacccuuacaugcccuccgugauugaaaagauggaagcauuacaaagacaauauggaggggcgcuuguacgaaauccgcucagcagaaacaguacucaugaaauguauuggguaucgaacgcaaccggcaauaucguuucuucaguaaauaugauaaguagaauguuaauaaaucgauuuaccaugaagcauaagaaagcgacuuacgagccagauguggauuuagggucggguaccagaaauauaggaauagaaaacgaaauucccaacuuagauauaauuggcaaaagaauugagaagauaaaacaggaacacgaaauaucuuggcauuaugaccaagaucacccauauaaaacaugggcuuaccaugguagcuacgaaacaaagcaaaccgguagcgcuuccaguauggugaaugguguuguacgauuacuaacaaagccuugggauguaguccccaugguaacgcaaauggcgaugacugacacaacuccauuugggcaacaaaggguguuuaaagaaaaggucgacacaagaacucaagaacccaaagaaggaaccaaaaagcugaugaaaauaacagcugaauggcuuuggaaggaauugggcaagaagaaaacaccacgaauguguacacgugaagaguuuacgcguaaaguuagaagcaacgcagcauuaggagcaaucuuuacggaugagaauaaguggaaaagugcacgcgaagcgguagaagacggaagauuuugggaguugguagauagggaacgaaacuuacacuuagaaggaaagugcgagacgugugucuauaauaugaugggaaaacgugagaagaaacuuggugaguuugggaaagcgaaaggcucuagagcuauaugguacaugugguugggggccagauucuuagaauuugaagcacugggauuccugaacgaagaccauugguucucccgaggaaauagucucagcggcgucgaaggggaggguuuacacagacuaggauauauacuucgggacgucgccaagaaagaaggaggggcuauguacgccgacgauacagcaggcugggauacaaggauaacgcucgaggauuuaaagaaugaagaaaugguuaccaaucacaugaaaggggagcacaaaaagcuagccgaagcgauuuuuaaacucaccuaccaaaauaaagucguacguguacaacguccaacgccaagaggcacuguaauggacauaauauccaggagagaccaaagaggaucaggacaggugggcaccuacggacuuaauaccuucacuaacauggaggcacaguuaauacgacaaauggaaggugaagguauuuucaaaucaauacaacaucuaaccgcaaccgaagaaauagcgguacaaaauugguuagcacguguagggagagaacggcugucgcgaauggcuauaaguggcgacgauugcgugguuaaaccgaucgaugauagauucgcaucggcacuuacggcccuaaaugauauggguaaaguuagaaaagauauacaacaaugggaaccaucucguggguggaaugauuggacccagguuccauucuguagccaccacuuucacgagcugguaaugaaagauggcagaguacucguaguaccuugcagaaaucaggaugaauugauugggcgggcuagaauaagucaaggggcaggcuggucguuaaaagaaacagcaugcuuaggcaagucauacgcacaaauguggacucuuauguacuuccauaggagagaccucagacuugcagccaacgccaucuguagugcugugccuucccauuggguaccaacuucuagaacaacguggucaauucaugcaaaacacgaauggaugaccacggaagacauguuagcuguuuggaacagagucuggauacaggagaacccauggauggaggacaagacucccguagaaucaugggaggaaguccccuaccuaggaaaacgagaagaucaauggugugguucucuaaucgggcuaaccucacgagcaaccugggcuaaaaacauacaaacagcaaucaaucaaguuaggucguuaaucggaaacgaagaauacacugacuauaugccuucaaugaaacgguuuagacgugaggaagaagaagcagggguguuaugguaa

SEQ ID NO: 22408 - RNA, 9876 nt, Artificial Sequence
  derived and/or modified CDS sequence (opt6) from DENV-2__FJ744706__SS-prME
acugcaggagugauuguaauguuaauaccuacagcaauggcauuucacuugaccacaagaaauggagaaccucauaugauaguagggagacaagaaaaaggcaaaucacuguuauuuaaaacagaagauggagucaacauguguacauuaauggcaaucgaucuuggagaauugugcgaagacacuauuacuuacaaaugcccgcuacuaagacaaaaugaacccgaagauauagacuguugguguaauucuacaucgacauggguaaccuauggaacuugcaccacgacaggagaacacagacgagagaaaagaagcguagccuugguuccacacgugggaaugggccuggaaacaaggacagaaacauggaugucauccgaaggcgccuggaaacacguucaacgaauagaaacauggauuuuacgacacccaggauuuacaauaauggcagcaaucuuggcauacacuauaggaacuacucauuuucaaagagcauuaauauuuauucuacuaacagccgucgcccccucaaugaccaugcgcuguaucgguauaucaaauagagauuucguugaagggguaucaggggguaguuggguugauaucguguuagaacauggcucuugugucaccaccauggcuaaaaauaaaccaacccuagacuuugaacucauaaaaacggaagcuaaacaaccugcaacgcuucgcaaauacuguauagaagcuaaauuaaccaauacaacuaccgaaucuagauguccaacccaaggagaaccgaguuugaacgaagaacaagacaaacgguuuauaugcaaacauucaaugguagacaggggauggggaaacggcuguggucuuuuugguaaaggaggaaucguaacuugcgcuauguucacaugcaaaaagaacauggagggcaaagugguacaaccugaaaaccuugaauauacaauuguaauaacuccucacaguggagaggaacaugcuguggggaaugacacagggaaacaugggaaagaaauuaaaauuacuccucagucgucuauuacugaagcugaacucacggguuauggaaccguuacaauggaauguucaccgaggaccggccuggacuuuaaugaaaugguucuacuucagauggaagauaaagcauggcucgugcaucgacagugguuccuagaccuaccucuaccuuggcuaccuggagcagacacucaagggucgaacuggauacagaaagagacgcucgugacuuucaaaaauccacaugccaagaaacaagauguaguuguucuuggaucucaagaaggagcgaugcacacagcgcuaacaggagccacugaaauucaaaugagcucugggaaucucuuguuuacaggacaccuaaaaugccgauuaagaauggauaaauugcaauuaaaaggaaugucauauagcaugugcacggggaaauuuaagauugucaaagaaauagccgaaacucaacauggcacaaucguaauucggguacaauaugaaggugaugguucuccauguaaaauuccauuugagauuacagaucuagagaaaagacacguuuuaggaaggcucauaacuguaaauccaauuguaacugagaaagacucaccagugaacauagaggcagaaccaccauuuggcgauuccuauaucauuauaggaguagaaccaggacagcuaaaauugaacugguuuaagaaaggaucuucgauaggacagauguuugaaacuacaaugagaggggcgaaaagaauggcaauuuugggugauacugcaugggauuucggcucacuaggggguguauucacaagcauugggaaagcgcuucaucagguauucggcgcgauauauggagcugcauuuucuggcgucucauggacgaugaaaauacugauagggguuauuauaacuuggauuggaaugaacucuagaagcacuucacucucaguaagccuggugcugguaggugugguuacucuauaucuuggcgccguggugcaagccgauuccggauguguggucagcuggaaaaauaaagagcuaaaauguggcucugguauauuuaucacggacaauguacauaccuggacugagcaauacaaauuucagccagaaucucccucaaaauuagccagcgcuauacagaaagcccaugaggaggguauaugugguauucgcucaguuacucggcuggaaaaccucauguggaaacagauaacuccggagcuaaaucauauccuguccgaaaacgagguuaaauugaccauaaugaccggagauauuaaaggaauaaugcaagcaggcaaaaggagccuucgcccacaaccuaccgagcuaaaguauucguggaaaacaugggguaaagcuaaaaugcuaagcaccggaagucauaaccagacauuuuuaauagaugguccagaaacagccgaauguccaaauacaaaucgagcuuggaacucucuggaggucgaagacuacggauucggcguauuuaccacuaauauauggcuaaaauuacgugaaaaacaagacgucuuuugcgauucaaagcucaugagcgccgcuauaaaagauaauagagccguacaugcugacaugggauacuggauugagagcgcucuuaaugacacuuggaaaauggaaaaagcaaguuucaucgaaguaaagaguugccacuggccuaaaucccauacucuaugguccaauggcguacuagaaucagaaaugauaauaccgaaaaauuuugcaggucccguaagucaacauaacuauagaccgggcuaucauacucagacagcagguccuuggcaucuggguaaauuggaaauggauuuugauuuuugugaagguacgacaguuguaguuaccgaagauugcggaaauagagggccuaguuuacggacuacaacugcaaguggaaaacuuauaaccgaaugguguugcaggucaugcacucuaccaccauuacgauauagaggagaggaugguugcugguacggaauggaaaucaggccauuaaaggaaaaggaagagaauuuaguuaauucauuagucaccgcaggacacggccagauagauaacuuuucacuggggguacugggaauggcauuauucuuagaagagauguuacgaacgcguauuggaacuaaacaugcaauacuguugguggcgguuagcuuuguaaccuugauaacggguaacaugucauuucgcgauuuaggcagaguaaugguuaugguaggagcuacgaugaccgaugacaucgguaugggaguaacguaccuagcauugcuagcggccuucaagguucgaccuacauuugccgcgggcuugcuuuuacgcaaauuaacgucaaaagaacuaaugauggcaaccauagguauugcguuauuaagucaaaguacgauacccgagacaauauuggaacuaacugacgcacuggcucuaggaaugaugguacuaaaaauaguuagaaauauggagaaauaucaacuagcugucaccauaauggcaauaaguuguguuccgaacgcaguuauacuacaaaaugcauggaaagugaguuguacuauauuagcagcgguuaguguaaguccccuuuuacuaacaucaucccaacaaaaagcugacuggauaccgcuggcauuaacaauaaaaggauuaaauccaacagcgauuuucuuaacaacgcuuucucggacaaguaagaaaagaucauggccauuaaaugaagcaauuauggcaguaggaauggucuccaucuuagcuuccucucuacuuaagaaugacauaccaaugacgggacccuugguugcuggcggucuauuaaccguauguuauguccuuaccggacgauccgccgaucuagaauuagaaagggccgcagacgugaagugggaggaucaagcagaaauaucugguaguaguccaauacuaaguauuacuaucagcgaggacggaucgaugaguaucaaaaaugaggaagaagaacaaacauuaacaauccuaauuagaacuggacucuuaguuauuagugggguguuuccuguauccauacccauaacugcagcugccugguaucuaugggaagucaagaaacaaagagccgggguguuaugggacguaccaagucccccuccugucgaaaaagcggaguuagaggacggagcguacagaauuaaacaaaggggcauauuaggauacucacaaauaggagcaggcguauauaaagaaggaacauuccacacaauguggcauguuacuaggggagcuguacucaugcacagagguaaaaggauagaaccaucuugggccgacgucaagaaagauuuaauuucauacgggggcggauggaaacuagagggcgaguggaaagaaggcgaagaaguacaaguguuagcauuagaacccggcaaaaauccgagagcaguacaaacuaaaccugguauauucaaaacaaauacuggcacuauaggugcugucaguuuggauuucagccccgggacaaguggcucacccauaguagacaggaaaggaaaaguaguuggacuauauggcaauggugugguaacgcguuccggagcguauguaagugcuauagcgcaaaccgagaaaagcauagaagauaauccggaaaucgaagaugauaucuuucguaaaaagaggcucacaauaauggaccuacauccuggagcaggaaagaccaaaagauacuugccagcgauaguuagagaagccaucaaacgaggccuaagaacuuugauacuugcaccgacucgcguuguagcagcggaaauggaagaggcuuuacguggucuuccaauccgcuaucaaacuccugcaauuaaaaccgagcauaccggaagggagaucgucgacuuaaugugucacgcaacuuucacaaugagauuauuaucaccuguucgaguuccaaacuauaaccuaauaauaauggacgaagcucauuuuacugauccagcgaguaucgcagcaagagguuauauuuccacaagagucgaaaugggagaggcggcaggaauuuuuaugacagccaccccgccagguaguagagauccauuuccacaaagcaaugcaccaaucauggacgaggaacgugaaauaccugaacguagcuggaacucaggacaugaauggguaacugauuucaaaggaaaaacaguuugguuuguuccgucaauaaaagccggaaaugacauagccgcaugcuugcguaaaaaugguaagaaaguaauccaacuaaguaggaaaacuuucgacucugaauauguuaaaacacgagccaacgacugggauuuuguuguaacaacugauauuucugagaugggcgccaacuucaaagcggagagaguaauagacccacgacgcugcaugaagccuguaauacuaacagauggcgaggagcguguuauacuggcagggccgaugccaguuacacacucuucugcagcucaaagaagaggaaggaucggucgaaauccuaaaaaugaaaacgaucaauacaucuacaugggugaaccauuagaaaacgacgaagauugugcccauuggaaagaagcaaaaaugcuuuuggauaauauaaacacaccugaagguauaauaccuaguauguucgaaccagaaagagaaaaggucgaugcaauagauggggaauaccgacuuagaggggaggcaagaaaaacuuucguagaccugaugaggcggggugaccuaccgguguggcucgcguacaagguggcagcugaagguauaaauuaugcagauaggaaauggugcuucgaugguaucaaaaauaaucaaauacuugaggaaaauauggaagucgaaaucuggaccaaggaaggugagcggaagaaauuaaaacccagaugguuggaugcuaggaucuacucagauccauuggcacuaaaagaguucaaggaauuugcagcaggccgaaaaucauugacuuuaaauuuaauaacugaaauggguaggcuaccaacuuucaugacccaaaaagcacgcaaugcacuagauaauuuggcaguacuacacaccgcagaagcuggaggcagagcauauaaucacgcgcuaagugaacuaccagaaacacuggagacauuacuccugcucacuuuguuggcaaccguuacaggugguauuuuccuauuccuuaugucaggcaaaggaauuggcaagaugacacuaggaauguguuguauuauaacagcaagcauucuacuaugguacgcacagauacaaccccauuggauagcugcaucaaucauauuagaauuuuucuuaauagucuuacuaaucccggagcccgaaaagcagagaacaccccaagacaaucagcugacauacguaguaaucgcaauauuaaccguuguagcggcaacaauggccaacgaaaugggauuuuuggaaaagacaaagaaagauuuaggguuggguucuauuacaacucaagaaucggaaucgaauauacucgacauagaccugaggccagcgucugcauggacuuuauaugcaguggcaacuacauuuguaacgccaaugcuucgucauaguauagaaaauaguucggucaauguuagucucacggcgauagcuaaucaagcaacaguucuaaugggauuagguaaaggauggccucugucgaagauggauaucggcguaccccuuuuagcgauagggugcuauagccaagucaaucccaucaccuuaacagcggcuuuauuguuacucguagcacauuaugcaaucaucggacccggucuacaggcaaaagcaacgcgggaagcacagaaacgggcggcagcuggaauaaugaagaauccuacuguagauggaauuaccguaauagaccuugaaccuauuccauaugauccaaaauuugaaaaacaauuaggacaagugaugcuccuaauuuuaugugucacacaaguacucaugaugagaacuacaugggcuuuaugugaagcucuuacacuagcuacuggcccuauaagcacucucugggaagguaacccgggaagguuuuggaauaccacgauagcagugagcauggcuaauauuuuuagggguucuuaucucgcuggcgcaggcuuacucuuuucaaucaugaaaaacacgacaaguacucggaggggaacgggaaauauuggcgagacacucggcgaaaaauggaaauccagauugaacgcacucggaaaauccgaauuucaaauuuacaagaaaagcgguauccaagaaguugaucguacacuugcaaaagaaggaaucaaaagaggcgaaacugaucaccacgcugucaguagagguucggccaagcuaaggugguuuguggagagaaacaugguuacaccugaaggcaaaguuguggacuuaggauguggaagaggaggguggucuuauuacugugggggacucaaaaaugugagagaaguaaaaggauuaacaaaaggaggaccgggucaugaagaaccgauaccaaugucuacguaugguuggaaucuagugagacuccaaagugguguugacguauucuuuacaccgccagaaaaaugcgauacguuauuaugcgacauaggggaauccucuccuaaccccacaauagaagcagggaggacucuucggguuuuaaaucuaguugaaaacuggcuaaauaauaauacacaauuuuguauuaagguuuugaauccuuauaugccauccguuaucgaaaagauggaagcauuacagagacaauaugggggugcgcuaguuaggaauccuuuaucucgaaacucuacacacgaaauguacuggguaaguaaugcaacagggaacauuguuucgaguguuaacaugauuucacgaauguuaauuaaccgauuuacaaugaaacacaagaaggcaacauaugagccagauguugauuuaggaagugggacuagaaacaucgggauagaaagugagauaccaaacuuggacauuauagggaaaaggauagagaaaauuaaacaagagcaugaaauaaguuggcacuaugaucaagaccauccuuauaaaaccugggcuuaucauggaucauacgaaacaaaacagacaggcuccgccucaaguaugguaaauggugugguacgcuuacuuaccaaaccaugggacguggucccuaugguuacccagauggcaaugacugauacaacccccuuuggucagcagcgggucuucaaagagaaaguagauacgcgaacucaagagccuaaagaggguacuaagaaacuuaugaaaaucacagccgaaugguuauggaaagaauuagguaagaagaaaacaccaaggauguguacacgugaagaguuuacuaaaaagguaagagguaacgcagcccuuggcgcgauauucacagacgaaaacaaguggaaaucagcucgcgaagcugucgaagaugggagauucugggaauuaguggaucgggaacgaaacuuacaccuagaaggaaagugcgaaacauguguauauaauaugaugggcaaaagagaaaagaaauuaggagaguucggaaaagcaaaagguagcagggccauaugguacauguggcuuggagcacguuuccuagaguucgaggcuuuaggauucuuaaaugaggaucacugguucaguagggguaauucgcuaucaggaguagagggugaagggcuccauagauugggauacauucuaagggacgucgguaagaaagaagguggugcaauguacgcagaugauaccgcaggaugggacacaagaauaaccuuagaggaucuaaagaacgaagaaaugguaaccaaucauaugaaaggugagcauaagaaauuggcagaagcaauauuuaaacucaccuaucagaacaagguuguuagaguccagcgaccuacuccuagagggacagucauggauaucaucucgagaagagaccaaaggggcucaggacaggugggaacauacgguuuaaauacuuuuacuaacauggaggcccaauuaauuagacaaauggaaggcgaagguauauuuaaaagcauacagcacuuaacggccacagaagaaauugcaguucaaaauuggcucgcaaggguaggacgggaaagacucucucggauggcuauaucaggggacgauuguguagucaaaccaauagaugaucguuuugcaagugcguuaacugcacugaaugacauggguaaaguucguaaagacauucaacaaugggaacccucucgcgguuggaaugacuggacccagguaccuuuuuguucacaucacuuccaugaauuaguaaugaaggaugguagagugcugguagucccuugccgcaaucaggacgagcuuauaggcagagcaagaauaucacagggcgccgguuggagucugaaggagacggcuuguuugggaaagucauacgcgcagauguggacauugauguacuuucaccgacgggaccucaggcuggcugcuaacgccaucuguucagcagucccuucccauugggucccuacaucgagaacaacauggagcauucacgccaaacaugaauggaugacgacagaagauauguuagcuguauggaauaggguguggauccaggagaacccauggauggaggacaaaacaccaguggaaagcugggaagagguuccuuauuugggaaaacgugaggaucagugguguggaucacugauuggacuaacuucgcgugcuacgugggcuaaaaacauucagacagcaauuaaucagguucgauccuuaauagggaaugaagaauauaccgauuacaugccuuccaugaagagauuucggcgagaagaggaagaggcuggaguucugugguga

SEQ ID NO: 22409 - RNA, 9876 nt, Artificial Sequence
  derived and/or modified CDS sequence (opt6) from DENV-2__FJ744707__SS-prME
acggcugguguuauagucaugcucauuccaacagcgauggcauuucaucuuacuacccguaauggagaaccucacaugaucgugggacgacaagaaaaagguaaaucgcuacuauuuaaaacugaagauggugucaauauguguacccuuauggcaauugauuuaggagaacucugcgaagauaccauuacuuauaaaugucccuuauuaagacaaaaugaacccgaagauauagauugcuggugcaauuccacgucaacauggguaaccuacgggacguguacaaccacgggagaacauagacgugagaaacgaucuguagcucucgucccccauguaggaaugggauuagaaacuagaacugaaacauggaugucgucggagggggcauggaaacauguacaaagaauagagacuuggauuuuacgccaucccggauucacuaucauggcugcaaucuuagcauauacaaucggcacgacucauuuucagcgggcuuuaauauucauacuacuuacugcaguagcgccaucuaugacgaugcguuguauaggaauaaguaaccgagauuuuguagaggguguuaguggaggaagcuggguugacauaguauuagaacaugguaguugcguuacuacaauggccaaaaauaaaccuacccuagacuuugaauuaauaaaaacugaagcaaaacaaccggcgacauuaagaaaauacuguauagaagcaaaauugacaaacaccacaacagaaucgcgaugcccaacacaaggagaacccagucuaaaugaagaacaggacaaaagguucauaugcaaacauucuaugguagacagaggauggggcaacgguugcggucuauucgggaaaggugguauaguaacgugugccauguuuacauguaagaaaaacauggaaggaaaagucgugcagccggaaaauuuagaauacacgauugugaucaccccucauaguggcgaggaacaugcaguaggcaaugauacagguaaacauggaaaagagaucaaaaucacaccccaaaguuccauaacugaagcagaacuuacagguuauggcacaguuaccauggaauguagcccgcguaccggcuuagauuuuaaugaaauggugcuuuuacaaauggaggauaaagcgugguuaguacauagacaaugguuuuuagaucucccauugccauggcugccaggagcugauacucaggguagcaacuggauccaaaaagaaacucucguuacguuuaaaaauccgcacgcuaagaaacaagaugugguuguguuaggaagccaagagggggcaaugcauacagcguuaacgggagcaaccgaaauucaaaugucgucuggaaaucuacuauuuacuggacaucuaaaaugucgacuaagaauggacaaauuacaacucaaagguaugaguuauucgaugugcacaggaaaauuuaaaauagugaaagaaaucgcagagacacaacacggaaccaucguaauccgaguccaguaugaaggagacggcucaccuugcaaaauaccuuuugaaauuacggacuuagaaaaacgacauguauuaggaagacuaauuacgguaaauccuauaguaacagaaaaagacaguccaguaaauauagaggcagaaccaccauuuggugacucauauaucaucaucggcguugaaccuggacaguuaaaacuaaacugguuuaagaaaggcagcagcauagggcagauguucgaaacuaccaugagaggagccaaacgaauggcaauuuuaggagauacagcgugggacuuuggaucacuuggaggagucuuuacaagcauaggaaaagcacuucaucagguauuuggggcuaucuacggugcggcguuuucgggaguaucauggacaaugaaaauauugaucggaguuauuaucacauggauagguaugaacucaagauccacaucguuguccgugagucuaguuuugguaggcguaguaacacuguauuuaggagcggucguacaagcagauagugguugcguggucagcuggaagaauaaggaacuaaaaugugguucaggcaucuuuauaacagauaauguccacacauggacggaacaguauaaauuccagcccgaaagcccgucaaaacucgcuuccgccauucaaaaagcacacgaggaaggaaucugugguauaagaucaguaacacgccucgaaaauuuaauguggaaacaaauaacgccggaauuaaaucauauacuaucagaaaaugaagucaaauugacuaucaugacaggggacaucaaagguauaaugcaagcuggcaagagaucacuaaggccacagccaacagaauuaaaguacucuuggaaaaccugggguaaagccaaaauguuaucaacugaaucgcauaaucaaacauuucucauagaugguccggaaaccgccgaauguccgaauaccaauagggccuggaauaguuuggaaguagaagauuaugguuucggugucuucacgacgaauauaugguuaaaauuacgugaaaaacaagacguauuuugcgauuccaagcuaaugucggcagcuauuaaggauaaccgugccguccacgccgauaugggcuauuggauugaaagugcauuaaaugauacauggaaaauggagaaggcuucauuuaucgaaguuaagucaugccauuggccgaaaucccacacauuaugguccaauggcguacuagaaagugaaaugauaaucccgaaaaacuucgcuggaccuguuagccaacacaauuauagaccaggauaccacacccaaacagccggucccuggcauuuaggaaaguuggaaauggauuuugauuucugugaggguacgacaguuguaguaacugaagauuguggaaauagggggccgaguuuaagaacaacuacugcuucagguaaauuaauaaccgagugguguuguagaucauguacgcuacccccacugagauauagaggugaagacggguguugguacgguauggaaauaagaccgcugaaagagaaagaagagaaccugguaaauuccuuaguuaccgcaggacauggacaaauugacaacuuuaguuugggagucuuagguauggcacuuuuccucgaggaaaugcugagaacgagaaucggaaccaaacaugcuauacugcuaguggcugugucauuuguaacacucauaacgggaaauaugucguuucgagaccuagguagagucauggucaugguaggugcgacuaugacggacgauauuggaaugggaguaaccuaucuggcgcuucuagcagcauucaaagugaggccuacauucgccgccggacuacugcuucggaaauuaacgucgaaagaacuuaugauggcaacuauagggauugcucuacugagucaaucaacaauacccgagacaauauuggaacugacagacgcucuugcucugggaaugaugguccuaaaaauugugcggaauauggaaaaauaucaacuugccguaaccauaauggcaauaaguugcguaccuaacgcugugauauuacaaaaugcauggaaagucagcugcacaauacuagcugcagucucaguaucaccuuuauuacugacaagcucacaacagaaagcugacuggauacccuuagcccuaaccauaaagggacuaaauccaaccgcuauauuuuuaacaacacuaucgcguacuucgaaaaagagaagcuggccgcuuaacgaggcaauaauggccguugguauggugucaauauuggcaucuagccuguugaaaaaugauauaccaaugacgggacccuuaguggcggguggucuccugacuguauguuauguucugacuggaagaucggcagaucuggaacuagaacgagccgcagauguaaaaugggaagaccaagccgaaaucagugggaguucacccauccuaucaauuacuaucucagaagauggguccaugucgauaaagaaugaggaagaagaacaaacauuaacgauauugauacgcacagguuuguuggugauuagcggcguuuuucccgugucgauaccuauuacagcggcugcuugguaucucugggaaguuaaaaagcaacgggcggggguauugugggacguaccaagcccuccaccgguagagaaagcggaacucgaagacggggcguacagaauuaaacaacguggcauacuggguuauucccaaauuggggcaggcguuuacaaagaaggcacguuccauaccauguggcaugugacacgaggugcuguauuaaugcauaggggcaaacggauagaaccaaguugggcugaugugaagaaagaccuaauuucuuacggcggaggauggaaacuugaaggcgaguggaaggaaggagaagaaguucaagugcuggcacuggaaccaggcaaaaauccaagagcugugcaaaccaaaccaggaauuuuuaaaacaaacaccggcaccauaggugcaguaagccuagacuucagucccggaacaagugggucaccaauaguagacaggaaaggaaaggucgugggauuauacggaaauggaguaguuacacguaguggcgcguauguaucugcaauugcucaaaccgaaaagucaauugaagacaaucccgaaauagaagacgacauauuuagaaagaagaggcucacuauuauggaucugcauccgggagcaggaaaaacaaagagauacuuaccagcaauagucagggaagcuauaaaaaggggcuugcguacucuaauacuagcaccaacgagaguaguugcagcagaaauggaagaagcccucagaggacugccgauacguuaucagacuccagcaauuaaaacagaacauacagggcgggaaaucguagacuugaugugccacgcuacauucacaaugaggcuacuuucuccugugaggguaccaaauuauaacuuaauuauaauggaugaagcgcacuuuaccgacccggcgagcaucgcggcucgagguuauaucagcacacgcguagaaaugggcgaagcugcagggauauuuaugacggcgacgccuccuggcaguagagaccccuucccccaaucuaaugcgccaaucauggacgaggaacgggaaauuccggaacguagcuggaacucaggucaugaaugggugacagacuuuaaaggaaaaacggugugguuuguaccaucuaucaaagcagguaacgacaucgcagcuugcuugaggaaaaacgguaagaaagugauccaacuaucacggaagacauucgacagugaauaugugaaaacacgagcaaacgacugggauuuuguaguaaccacugauauaagugaaaugggcgcaaauuucaaagcugaacgaguaaucgauccaagaagaugcaugaaaccagucauccugacugacggugaggaaagggugauucuagcagguccgaugccggucacccauucgagcgcagcacagcguagagguagaauuggacgcaacccgaaaaaugaaaacgaucaguacauuuacaugggagaaccacuagaaaaugaugaagacugugcucacuggaaagaggcaaagauguuacuugacaacauuaacacaccagaaggaauaauuccaucaauguuugagcccgaaagagaaaagguagaugcgauugauggagaguacaggcuucgcggggaagcgcgaaagacauucguagaucucaugagacguggugacuugccaguguggcuugccuacaagguagcagcugaagggauuaacuaugcugauagaaaauggugcuucgacggaaucaaaaauaaccaaauauuagaagaaaauauggaaguagagauauggaccaaggaaggagaacgaaagaaacuaaaaccacguuggcucgaugcaagaauuuauagugacccucuagcccuaaaagaguucaaagaguuugcagcuggucggaagucacucacacuaaaucuaauuacggaaaugggaagauuaccuacuuucaugacucaaaaggcuaggaaugcucuagauaaccuggcgguacuucauacggcagaagcaggagggagagcguacaaucacgcacuaucagagcuaccggagacuuuagaaacccuacucuuguuaacccuguuagcgacugugaccggcgggauauuccucuuccuaauguccggaaaagguauuggaaaaaugacauuagggauguguuguauuauaaccgcaaguauuuuacuuugguacgcucaaauucaaccacacuggauagcagcaucuauaauccucgaauuuuuccugauaguacuacuaauuccggaaccagaaaaacaacgaaccccacaagacaaucaauuaacauacguaguaaucgccauauuaacuguaguagcugccacaauggccaaugaaaugggauuucuagagaaaacuaagaaagaucuagguuuaggaucgauuacaacacaggaaagcgagaguaauauucuagauauagaucuuagaccagcaucagcuuggacauuauacgcaguggcaacaaccuucguaacaccaaugcuuagacacucuauagagaauagcucaguuaaugugagccuuacggcgauagcaaaucaggcaaccgugcuaauggguuuagguaaagguuggccucuuucgaagauggauauagguguuccacucuuagcuauuggauguuauagucaaguaaauccaauaacguuaacagcugcccuauuguuauuaguugcucauuaugcaaucauaggacccggacuacaggcaaaggcaacaagggaagcgcaaaagagggccgcagcagggauuaugaaaaaucccacuguugacggcaucacagucauugacuuagaaccaauacccuacgauccuaaauucgagaagcaguuaggacaagugauguuauuaauacuaugcguuacgcaagugcuaaugaugcgaaccacaugggcacuaugugaagccuuaacacuagccacaggaccaauaucaacguuaugggaagguaauccugggcgcuucuggaauacaacaauagcaguaucaauggcuaacauauuuaggggaagcuauuuagcuggcgcgggacuacuauuuaguauuaugaagaauacuacgaguacucgcagaggaaccgggaauauaggggagaccuuaggugaaaaauggaaaagcagacugaaugcauugggaaaaucagaguuccaaauauauaagaaaagugguauacaagaaguagaucggacauuagcaaaagagggaauaaaaaggggugaaacugaucaccacgcugugucucgcggcagugcaaaauuacgaugguuugucgagcggaauaugguuacaccugagggaaagguagucgaccuuggcuguggucgugggggauggucuuauuacugcgguggacugaaaaauguaagagaaguuaaaggacuuacgaaaggagguccuggucaugaagaaccuauacccaugucuacauauggcuggaaucuaguaagauugcagucaggaguagacguguucuuuacacccccagagaaaugcgauaccuuacuaugcgauauaggagaauccucgccaaacccgacuauagaagccggacggacguuacgaguuuuaaacuuaguggaaaacuggcuuaauaacaacacucaauucuguauaaaaguauuaaacccauacaugccuuccguaauagagaagauggaggcacuacagagacaauauggaggagcauuggugagaaauccacugaguagaaacucgacacacgaaauguauuggguuucaaacgcgacugguaauaucguuucaucuguaaauaugauuucacgaaugcuaauuaaccgcuucacaaugaaacauaagaaggcgacuuaugagcccgacguagaccuaggaucggguacuagaaacauugggauagaaucagaaauccccaacuuggauaucauagguaagcgaaucgagaaaauaaaacaagaacacgaaauauccuggcauuaugaccaggaucacccauauaaaacaugggcauaccaugggagcuacgagaccaaacagaccggauccgcuucuucaauggugaacggaguuguuagacuacuaacaaaaccgugggauguuguccccaugguaacucaaauggcuaugaccgacacaacaccuuucggacaacagcgcguguucaaagagaaaguagacacgagaacucaagagccuaaagaaggaacuaagaaauuaaugaaaauaacugccgaauggcuguggaaagaacuagggaaaaagaaaaccccaagaauguguacacgagaagaauuuaccaagaaaguccggaguaacgcugcgcuuggugcaauauuuacggaugaaaauaaauggaaaucagcuagagaagcgguugaggacgguagguuuugggaguuagucgaccgcgaaaggaaucuccauuuggaggguaagugcgagacaugcguauacaacaugaugggcaagcgggagaagaaacuaggcgaauuugguaaagcuaaaggaucacgcgcuauaugguauauguggcuaggagcaagauuccuugaauuugaggcacucggcuuuuuaaaugaggaccauugguuuucaaggggaaacuccuuaucuggaguagagggagaaggauugcacagauugggauauauccuacgugaugugggcaagaaagagggcggugcaauguacgcagaugacacagccgggugggauacccgaaucaccuuggaggacuugaaaaacgaggagaugguuacaaaucacaugaagggcgaacacaagaaacuagcagaagcuauuuucaaacugacguaccaaaauaaaguuguucgggugcaaagaccuacgccuagagguaccguaauggacaucauuucaagaagagaucaacgaggcagcgggcaaguagguacauacggacuaaauacguucacaaauauggaggcacagcuaaucagacaaauggagggggaagguauuuucaagaguauacaacauuugacugcaacggaagaaauagcgguacagaacuggcuagccagaguagguagggaaagacuaucgaggauggcuauaucaggugacgacuguguuguaaaaccaaucgaugauagauuugcaagugcauugaccgcuuuaaacgauaugggcaaagugagaaaagacauucagcaaugggaaccuucccggggauggaaugacuggacccaaguuccguuuuguucacaccauuuucaugaacuuguuaugaaagacgggcgaguuuugguagcgccaugucgaaaucaagaugaauuaauugggcgagcgagaaucucgcaaggcgcgggauggucuuugaaagaaacggcuugcuuagguaaaucauaugcucaaauguggacauuaauguacuuccauaggagagaucucagacuggcagcgaacgcaauuuguagcgcaguaccaucgcauuggguaccaacaucacgaacuacauggaguauccacgcaaagcaugaauggaugacaacggaggacauguuagcaguguggaaccgaguguggauacaagaaaacccguggauggaagauaaaacaccuguagaaucaugggaagaagucccauacuuagguaaacgcgaagaucaauggugcggcagcuuaauuggauuaacaucaagagcuacuugggcgaagaauauacaaaccgcaauaaaccaaguacguucauuaaucgguaacgaagaguauacagauuacaugccuagcaugaaaagauuuaggcgagaagaagaggaggcaggagucuuaugguaa

SEQ ID NO: 22410 - RNA, 9876 nt, Artificial Sequence
  derived and/or modified CDS sequence (opt6) from DENV-2__FJ744704__SS-prME
acggcaggaguuauaguuauguuaauaccgacagccauggcauuccaucuuacaacccgcaacggugaaccacauaugauuguaggaagacaagaaaaaggaaaaucauuguuauucaaaacugaggauggugugaauauguguacccuaauggccauagaccugggggaauuaugcgaagauaccauuacauacaaauguccccugcuaaggcaaaaugaaccggaagauauugauuguugguguaauucaacaaguacuuggguuacuuacggaaccuguaccacgaccggugagcacagaagagaaaaacgaaguguagcauuaguaccucacguggggaugggcuuagaaacacgcacagaaacauggaugagcucagagggagccuggaaacauguacagagaauagagacauggauauuaaggcauccaggauucacuauuauggccgcaaucuuagccuacacaaucggcacuacucauuuccaaagggcucuaaucuuuauacuacuuacugccgucgcgcccuccaugacuaugaggugcauagguaucagcaaccgagacuucguugaaggugucucaggcgggucauggguugacaucguacuugagcacggcaguugugucaccacaauggccaaaaauaaaccuaccuuagacuuugaauuaauuaaaacugaagcuaaacaaccagcuacuuuaagaaaauauugcauugaagccaaacuuacgaauacgacaaccgaaucccgaugccccacacaaggugaaccgucguugaacgaggagcaagauaaacguuucauuuguaaacacagcaugguugacagaggauggggaaauggcuguggcuuauuugguaaaggaggaaucguaacaugugccauguuuacuuguaagaaaaauauggaaggcaaaguaguacaaccagaaaaucuagaauacacaaucguuauaacuccgcacucaggcgaggaacaugcgguagggaaugacacagggaaacauggaaaagaaauaaaaauaacaccccaaagcaguauaacugaagcagaauuaacuggauacggcacaguuacgauggaauguucucccaggacgggauuagacuuuaacgaaaugguauuacuucaaauggaggacaaagcauggcucguucaucgucaaugguucuuagaucucccauuaccuugguuaccgggagcagacacacaggguaguaauuggauacaaaaagaaacuuuagucacauuuaaaaacccgcacgcaaagaagcaagacguagucguauugggaucccaggaaggggcuaugcacacagcguuaacaggcgcgaccgaaauucaaaugucaucuggaaaucucuuauuuaccggacacuugaaaugcagacuacggauggauaaacugcaacuaaaaggaaugucauacucgaugugcaccgguaaauuuaagauaguuaaagagaucgccgagacucaacauggaacaaucguaauuaggguacaauaugagggggauggcagcccauguaaaauacccuuugaaauaacagaucucgagaaacgccauguccuaggacgacuaauaacaguuaauccaauaguaacagagaaggauuccccaguuaauauugaagcugagccuccauucggugauucuuauauaaucauaggaguggaaccaggccaauuaaaacuaaauugguucaagaaagggaguucaauaggacaaauguucgaaacaaccaugaggggagcuaagagaauggcaauucuuggagacacagcgugggauuucgguagucuagggggagucuuuacuucaaucgggaaggcuuugcaccagguguucggugcaaucuacggagcugcuuuuucggggguuagcuggaccaugaaaauauuaaucggcguuaucauaaccuggauaggcaugaacucaagaagcacaagucuaucgguauccuuaguauuaguaggaguaguuacuuuauauuuaggagcgaugguucaagcagacucagguugugucgucucauggaaaaauaaagaauuaaagugugguucuggaaucuucauuaccgauaauguacacacauggacagaacaguacaaauuucaaccagaauccccauccaagcuagcgucagcgauacaaaaggcgcaugaagaaggaaucuguggaauaagaucgguaacuagauuagaaaacuugauguggaagcaaaucaccccggaauugaaccacauccugagugaaaaugaaguuaaguugacaauuaugacaggggauauaagaggaauaaugcaggccgggaaaagaucgcuucguccccaaccaacugaacucaaguacucauggaaaacuuggggcaaagcuaagaugcuauccacagaaagucauaaccaaacauuucuaauugauggaccugaaacagcagaauguccaaacaccaacagagcauggaauaguuuagaagucgaagauuauggcuucgguguauucacaacaaacauauggcuaaaacuacgagaaaaacaagacguguuuugugacuccaagcuaauguccgcagcaaucaaagauaauagggcaguccaugcagauauggguuacuggauagagagugcguuaaacgauacguggaagauggaaaaagcaucuuucaucgaaguuaaaagcugucacuggccgaagucucacacauuguggucuaaugguguccucgaaagugaaaugauaauaccuaaaaauuucgcugggcccguuucacaacauaacuauaggccuggauaccauacucaaacugcaggucccuggcaucucgguaaacuugaaauggauuucgacuuaugugaaggcacaacugucguaguaacugaagauuguggaaaccgagggccuaguuuaagaacgacaacugcuucugguaagcuaauaacagagugguguuguaggagcugcacuuuaccacccuugagguauaggggagaagacggauguugguaugguauggaaauaagaccccugaaggaaaaggaggaaaaucuggucaacucacuugucacugcaggucauggacaaaucgauaauuuuagucuaggaguacuaggcauggcacuauuucuugaagaaaugcuccgaacaagaauagguacaaaacaugcaauacuauuaguggcaguauccuucgucaccuugauaacugguaacaugaguuuucgagaucuagguagagucaugguaauggucggagcaacaaugacagaugacauaggaauggggguuacguauuuggcacugcuggcagcauucaaaguuaggccuaccuucgcagccggauuauuacuacgaaaacugacaaguaaagaacucaugauggcaacaauaggaaucgcauugcugagucagucaacaauucccgagacuauccuggaacugacugacgcauuagcacuuggaaugaugguucuuaagauugugcgaaacauggaaaaauaucagcuagcuguuacaauuauggcuauaucaugcguuccuaacgcuguaauuuuacagaaugcuuggaaagucaguuguacgauauuggcugcuguaaguguaucuccccuacugcuaacuuccucucaacaaaaagcagacuggaucccauuggcccuuacaauuaaaggucuuaacccuacugcaauauuuuuaacaacacuaucacgaacuagcaagaaacggucauggccccuaaaugaggcuaucauggcuguaggaauggugucuaucuuagcaucaucccuccuaaagaaugacauuccuaugacagguccucuaguggcggguggucugcugacaguguguuauguacuuacugggagaagcgcagaucuagaacucgaacgagcagccgacgugaagugggaggaucaagccgaaauaagcgguaguagcccuauauugucaauaacaaucagcgaagauggaucgaugagcaucaaaaaugaggaagaggaacagacacucacaauucuaauaagaacaggucuauuaguuauaaguggaguauucccggugucaaucccaauaaccgcugcagcaugguaucugugggagguaaagaagcaaagagccggggugcuaugggauguuccaucacccccaccaguugaaaaagcggagcuugaagauggagcauacagaaucaaacaaagagggauccuagguuacagccaaauaggagcgggaguauacaaagaaggcaccuuccauacgauguggcacguuacucgaggggcuguucucaugcaccgagggaagaggaucgagccaucuugggcggaugucaagaaagaccuaaucucguaugguggggguuggaaacucgaaggagaauggaaagagggagaagaagugcaaguacuggcacuagaacccggcaaaaauccacgggcaguucaaacuaaaccagguauguucaaaaccaauacuggaacaauaggagcgguaucccuugacuuuagcccggggacaaguggaucaccaauaguagaucguaaagguaaaguggugggucuuuacgguaaugggguagugacacgaaguggugcguacguuuccgcaaucgcucagacggagaaaagcauugaagacaauccggaaauugaagacgauauauuucguaagaaaagacugaccauaauggaccuucacccaggggcaggcaagaccaaaagauacuugccagcgauaguuagagaagcaauuaaacgaggcuugagaacccuaauauuagcacccacacgaguugucgcagcagaaauggaggaggcauugagaggacuacccauaagauaccaaacuccugcuauuaagaccgaacacaccgguagagagauaguggaucuuaugugccacgcaaccuuuacaaugcgauuauuaaguccugucagaguaccaaauuauaauuuaauaauaauggaugaggcucacuucacugacccagccagcaucgcagcuagaggcuauauaucuacgcgagucgaaaugggagaagcagcuggcauauucaugacugcuacaccaccagggucgagagaccccuuuccacagaguaaugcaccgauaauggaugaagaacgugaaauuccugaaaggucguggaauaguggucaugagugggugacugauuucaaagguaaaacagugugguuuguaccaucaauuaaagcagguaaugauauagcugcaugucuuaggaaaaacggcaaaaagguaauucagcucuccagaaagacauuugacucagaauaugucaaaacgcgagccaaugauugggauuuuguugugacgaccgacaucagcgaaaugggagccaacuucaaagcugagcgagugaucgacccgcgaagauguaugaaaccuguuauacugaccgauggcgaagagagagucauacuggcuggcccaaugccaguaacacacucaagugcagcucaaagaagaggucgcauugguagaaauccgaaaaaugaaaaugaucaguacaucuauaugggagaaccuuuagaaaaugaugaggacugugcccauuggaaggaagcaaagauguuacucgauaauauuaacacaccagaaggaauaauuccaaguauguuugaaccugaacgagaaaaaguugacgcaauagauggagaauacaggcugagaggggaagcaagaaaaacauucguagaucuaaugagacgaggugaucuaccuguauggcucgccuauaaaguugcagcugaaggaauaaacuaugcggaccggaaauggugcuuugacgggauuaagaacaaucagauuuuagaagagaauauggagguugaaauuuggacuaaagagggugaaagaaagaaacuaaaaccgagauggcuagaugcccgaauauauucagacccguuagcacugaaagaauuuaaagaguucgcagcugguagaaaaucuuuaacucucaaucuuauaacagaaauggguagacuuccaacauucaugacucaaaaagcacgcaaugcauuagauaaccuagccguucuacauaccgccgaagccgguggcagagcuuauaaccaugcccuaagcgaacuaccagaaacuuuagagacacuccuucuguuaacucuacuagcaacagugacuggaggaauauuccuauuucugaugagcggaaaaggaauagggaaaaugacgcuuggaauguguugcaucaucacagcgaguauccuuuuaugguaugcccaaauucaaccacacuggaucgcggccucuaucauacuggaauuuuuccuaauaguguuacucauaccugagccagagaaacaacgaaccccacaggauaaucaauuaacuuauguugugauagcuauucuuacgguuguagcagcaacuauggcaaaugaaauggguuuucucgagaaaacaaagaaagauuuggguuuaggaaguauaacgacacaagaauccgaaagcaauauacucgacauagacuuacgaccugcgucagcuuggacuuuguaugcuguagccacaacguucguaacacccauguuacgacacagcauugaaaauagcucagugaauguaucauugacugcuauugcgaaucaggccaccguacuaauggguuuaggaaaaggauggccacucuccaaaauggauauuggaguccccuugcuagccauagguuguuauucgcaaguaaacccuauaacucuuacagcggcacuauugcuccugguagcccacuacgccauuauaggcccaggacugcaggccaaggcaacacgggaagcccagaaaagagcagcagcggguauaaugaagaauccgaccguugaugggauaaccguuaucgaccuagagccaaucccuuaugacccaaaguuugaaaagcaguuaggucaaguuaugcuccuuauccuaugcgucacccaagugcuuaugaugaggaccacuugggcacucugugaagcauuaacauuggcaaccggcccaauaucuacuuugugggaggggaauccagggagauucuggaauacaacaauagcgguuaguauggcuaauauuuuucguggcucuuauuuagcaggagcuggacuccuauuuucaauaaugaagaacacaacaaauacucgacguggaacaggaaauauaggagaaacacuuggcgaaaaauggaaaaguagacuaaacgccuugggcaaaagcgaauuucaaaucuauaaaaagagcgggauucaagaggucgaucgcacacuggcgaaagagggcauuaaacgaggugagacugaucaccacgccgucaguagaggaucagcuaaacuuaggugguucguagagagaaacaugguuacccccgaggggaaaguaguugaucuugguugcggucgcggcggauggucauauuauugcggagggcucaaaaauguaagagaagucaaaggcuuaacuaaagggggaccaggucacgaagaaccaauaccgaugagcacauacggauggaauuuaguaagauuacagagugguguagacguauucuuuacgccucccgaaaaaugugauacauuacuuugugauauaggagaauccagcccgaacccgacaaucgaagcaggcagaacacuacgaguacucaacuugguugaaaauuggcuaaacaauaauacccaauuuuguauuaaaguucugaacccauacaugcccucuguuauagagaaaauggaggcacuccagcgaaaauacgguggugcauuaguaagaaauccuuuaucaagaaauaguacccaugagauguacuggguuucuaaugccacuggcaacaucgucagcaguguaaauaugauaagucgaaugcuaaucaauagauucaccaugaaacacaagaaagcaacuuacgagccggauguugaucuaggaagcgggacucgaaauauuggaauugagagugaaauucccaaucuagauaucauagguaagagaauagagaaaauuaagcaagaacaugaaacguccuggcauuaugaccaagaccacccuuauaaaacaugggcguaucauggaucuuaugaaaccaagcagacgggaucagcgaguuccaugguaaacggaguaguaagacuauuaacuaaaccaugggacguugugcccauggucacccaaauggcaaugacagacacaaccccguucggccaacaaagaguauuuaaagaaaaagucgauacaaggacacaagaaccuaaggaaggcacaaagaaacucaugaaaaucacagcugaaugguuauggaaagaauuagggaagaagaaaacaccaagaauuuguacucgggaagaguuuaccagaaaagucagauccaaugcagcgcuuggagcaauauucacugacgaaaacaaauggaaaagcgccagagaagcaguugaagacggaagauuuugggaauuaguagaccgagagaggaaccuucauuuagaaggaaaaugugaaacuugcguauauaacaugaugggcaaaagggagaaaaaguuaggugaauuugguaaagcgaaggguagucgcgcuauaugguauauguggcuuggagcacgcuuucuagaauuugaggcuuuaggauucuuaaacgaagaccauugguuuucucgcgaaaauucucuaagcggaguugaaggagaaggucuccaucgucucggguauauauuacgagauguugggaaaaaggaaggaggcgcaauguacgcagacgacaccgcggguugggacacaaggauuacauuagaagaccucaaaaaugaagaaauggucacgaaccacaugaaaggggaacauaagaaauuggcugaagcaaucuucaaacuuacuuaccagaacaagguaguacgaguucagagacccacaccuagaggaacaguaauggacauaauaucaagaagagaucagaggggaucuggucaaguugguacguauggacugaacaccuuuacuaauauggaagcucaauugauacgacagauggagggugaaggcauauuuaagucuauacaacaucuuacugcaacagaagaaauugcuguacaaaauugguuagccagaguaggaagagaaagauuaagccggauggcuauaucaggagaugacugcguugugaaaccaauagaugaucguuucgcuagugcccuuacugcccuaaacgacaugggcaaaguuagaaaggacauacaacagugggagccaaguagaggauggaacgauuggacccagguacccuucuguagucaccauuuccacgaauugguaaugaaagacgggaggguacuuguugucccaugcagaaaucaagaugaacuuauugggagagcacggauaucacaaggggcgggauggucgcucaaagaaacugccugccuuggaaagucauacgcacaaauguggacauuaauguacuuccauagacgagaucugagauuagcugcaaacgcuauauguucugcuguuccaccacauuggguaccuacuucacggacaacauggucaauucacgcgaaacacgaguggaugacgacggaagauaugcuagcaguauggaaucgaguguggauacaggaaaauccauggauggaggauaaaacuccaguagaaaguugggaagaaguaccauaccugggcaagagagaagaucaguggugcgggagucuuauaggacucacgucucgcgcuacuugggccaaaaacauucaaacagccauaaaucagguuagaaguuuaaucggaaaugaagaauauacagauuacaugccauccaugaaaagauuuaggagagaagaagaggaagcaggcguacuaugguaa

SEQ ID NO: 22411 - RNA, 9876 nt, Artificial Sequence
  derived and/or modified CDS sequence (opt6) from DENV-2__FJ744745__SS-prME
accgccgggguuauaguaauguuaaucccaaccgccauggccuuucaucuaacaacccguaauggggaaccacauaugaucguaggacgucaagaaaaagguaaaagucuacuuuucaaaacagaagacggaguaaauauguguacacuaauggcuauugauuuaggugaacuaugugaagauacuaucacauauaaauguccacuauuaagacaaaaugaacccgaagacauugacuguuggugcaauaguacuucuacauggguaaccuacggaacaugcacuacuacuggggaacauagaagagagaaaagaucuguugccuuaguuccgcacguaggcaugggacuagaaacacgaacggaaacuuggaugucuucagaaggagcauggaaacauguucaacggaucgaaaccuggauccuaagacacccuggcuuuaccauuauggcagcuauucuugcuuauacaauugggacuacgcauuuccaacgagcucugauauuuauccuacugacagcggucgccccaagcaugacaaugagauguauuggaauuagcaacagagacuuuguugaaggaguuagcgguggaucuuggguagauauaguauuggaacauggcaguuguguaacgacaauggcuaaaaauaaaccaacccucgauuucgaacuaauuaaaacugaagccaaacaacccgcuacucuacgaaaauauugcaucgaagcgaaacuaacuaauacaacuacugagagccguugcccuacgcagggagaaccgaguuuaaacgaggaacaagacaaacgcuuuauauguaaacauucuaugguggaucggggcuggggaaaugggugcggacuuuuugggaaaggcggcauaguaacgugugcuauguuuacuugcaagaaaaauauggaagggaaagucguucaaccggaaaaccuggaauauaccauuguuauuacuccacauucaggagaagaacacgcaguaggcaaugauacuggcaaacacggaaaagaaauaaaaauaacuccacaaucaucgauaacggaagcugagcuaacaggauauggaaccgugaccauggaguguagcccacgaacggguuuggauuucaaugagaugguacuacugcaaauggaagauaaagccuggcuggugcaucgacaaugguuuuuagaccuaccguuaccguggcuacccggagcagauacacaaggcagcaacuggauucagaaagaaacccuaguaacguucaaaaacccgcacgcgaagaaacaagauguaguaguauuaggaucucaagaaggcgcaaugcauacugcauuaacuggagccacggaaauccagaugaguucagguaauuuacuuuuuacuggacacuuaaaaugcagauuaaaaauggauaaacuacaacuuaaaggaaugucauauucaaugugcacaggaaaauuuaaaaucgugaaagagaucgcagagacucaacacggaacuauuguuauucguguacaauaugaaggcgacggaucuccaugcaaaaucccauuugaaauaacagauuuggagaaaagacacguccuaggaagauuaauuacggucaauccuaucguaacggaaaaagacaguccugucaacauagaagcggaaccuccuuucggagauaguuauaucauaaucgguguugaaccaggucaacuaaagcugaacugguucaagaaaggaucgucuaucggccagauguucgaaacaacuaugagaggcgcaaaaagaauggcaauacuaggcgauacagccugggauuucgguucuuuaggcgguguuuuuacuagcaucggaaaagcauuacaccagguuuuuggagcgaucuacggggcagcauucucaggcguaagcuggacaaugaagauucugauaggagucauaauuacauggauaggcaugaacucuagaaguacaucgcuuucggugagucuugugcuagucgguguagucacacuuuaucuuggggcuaugguucaagcagacucuggcuguguagugaguuggaaaaauaaagaacuaaaauguggguccgguauauucauuacugauaauguucauacguggacagagcaauacaaauuccaaccagaaaguccauccaaacucgcaagugccauacagaaagcucacgaagaagguauauguggcauaagaucaguuacaagacuugaaaaccuaauguggaaacaaaucacuccagaauuaaaucauauauuaucugaaaaugaggugaaauuaacaauuaugacaggagauauuagaggaauaaugcaagcagguaagcguucuuugcguccacaaccaacugaauuaaaauauucauggaaaacaugggggaaagcaaagaugcucucuacugaaucacauaaucaaacuuuccugauagacggcccggaaacggccgaauguccaaauacuaauagagcauggaacucacucgagguagaagacuauggauuuggcguuuucacuaccaacauauggcugaaguuaagagagaaacaggauguuuucugcgauaguaagcugaugagcgcugcaauuaaagauaaucgugcuguccacgcagacaugggauauuggaucgaaucagcccuuaacgauacauggaaaauggaaaaagcaaguuuuauugaaguuaaaaguugucauuggccaaaaucucauacauuguggucaaacggagugcuagaaagcgagaugauuauacccaaaaauuucgcgggacccguuucucaacacaacuacagaccgggauaccacacgcaaacugcggggcccuggcaucuuggcaaacuugagauggacuucgaccuaugugaaggcaccacuguaguaguaacagaagauuguggcaauagagguccgucguugagaaccacgacugcgaguggcaagcuaauaacagaguggugcugcagaucauguacguuaccgccauugcgauaucguggugaggauggcuguugguacggaauggagauaagaccucuaaaggaaaaggaagaaaaccuagugaauagccuuguuacugcaggccauggacaaauugauaauuuuagccuaggaguacuggguauggcauuauuuuuagaggaaauguuacgcacacgaauagggacaaaacacgcaauuuuguuggucgcuguuaguuuugugacauuaaucacagguaauaugaguuucagagaucuaggacgcguaaugguaaugguaggugcaacaaugacagaugauauugguaugggaguuacuuaccuagcacuguuggcugccuuuaaagugcgcccaaccuucgccgcaggcuuacuccucagaaaacucacuuccaaagaguugaugauggccacaauaggaaucgcacuccugucacagucaacuaucccagaaacuauccucgaacuuaccgaugcacucgccuugggaaugauggucuugaaaaucguaaggaacauggaaaaauaucaacuagcgguaaccauaauggcaauuucgugcguuccuaaugccguuauccuucaaaaugcauggaaaguaaguuguaccauuuuagccgccgucaguguaaguccguuguugcuuacaucaucacagcaaaaagcugacuggauuccccuagcccuaacuauuaaaggucucaauccgacggcuauauuuuugacuacucucagcagaacaucaaagaaaaggagcuggccccugaacgaagcuauaauggcuguaggaaugguaagcauacuugcuucaucucugcuuaaaaaugauaucccuaugaccgggccauuaguagcgggugguuuauugacgguguguuauguauuaaccgguagaagcgcugaucuggaacucgaacgugcggccgauguaaaaugggaagaccaagcugagauaucagggagcagcccaauuuugagcaucacaaucagugaggauggcucuaugucgaucaaaaacgaagaggaggaacaaacauuaacuauucuaauccguacuggccuauuagugauuaguggcguauuuccagucucaauaccaauaacagccgcagccugguauuuaugggaagucaagaaacagcgcgccgguguucuaugggauguaccuucacccccucccguugaaaaagccgaacuugaagauggagcguaucgaauaaaacaaagaggaauauuggguuauucccagaucggcgccggcguauacaaggaagguacauuccacacgauguggcacguuacccgaggcgcgguucucaugcaccgaggaaaaagaauugaaccaaguugggcagacgucaagaaagaucuuauaucguacggaggcggauggaaacuggaaggagaauggaaagagggcgaagagguacaagugcuugcucuggaaccugguaaaaacccacgagcgguucaaaccaaaccaggcauuuucaagacaaauacggguacaauuggagcuguaaguuuagacuucucacccggaacaaguggaucaccgauaguagacagaaaagggaaaguaguuggacuauacggaaauggugucgugacaagaucaggagcauauguaagugcuauagcucaaacagagaaaagcauagaagauaauccagaaauagaagacgauauauuuagaaagaaacgauuaaccaucauggaucuccaucccggagcuggaaaaacgaaaagauaucuuccagccauaguccgagaagcuauuaagcgaggacucaggacccucauacuagcgccgacaaggguagucgcagccgaaauggaagaagcauugaggggucuaccaauacgauaucaaacacccgcgauaaaaaccgagcauacugguagagagaucguagaccucaugugccaugcaacuuucacuaugagguuacuaucuccagucagaguccccaauuauaaucuuaucauaauggaugaagcacacuucacugauccugccagcauugcggcgagagguuauauuucaacaagaguggagaugggcgaagccgcaggaauauucaugacagccacaccaccuggaaguagagacccauucccgcagucaaacgcgcccauuauggacgaggaacgugaaaucccagagcgaucauggaacuccggucaugaguggguaacagacuucaaaggaaaaacagugugguucguaccaagcauaaaggccggaaaugacaucgcugcuuguuuacguaaaaaugggaaaaagguaauucaacuaagucgcaaaaccuuugauucagaauauguuaaaacgcgagcuaaugauugggauuucgugguaacuaccgauauauccgaaaugggggcaaauuuuaaggcugaacgugucauagaucccagacguuguaugaagcccguaauauuaacagauggagaagaaagaguaauucucgccggaccgaugccaguaacgcauucaucugcagcacaacgucgagggcgaauaggccgaaacccuaaaaacgaaaaugaccaauauauauacaugggcgaaccacuggagaacgacgaagauugcgcacauuggaaggaggccaaaauguuacuagacaacaucaauacaccugaaggcaucauuccgucaauguucgaaccggaaagagagaaaguagaugcgauugauggugaauauagauuaagaggagaagcaaggaaaacauuuguagaucuuaugagacgaggagacuuaccaguaugguuagcguauaaaguagcagcggaggguauaaauuaugcugaccgaaaaugguguuuugaugguaucaagaacaaucagaucuuagaagaaaauauggaagucgagauuuggacuaaagagggugagaggaagaaacuaaaaccccgaugguuggaugcuagaauauauucugacccccuagcuuuaaaggaguucaaagaauuugcggcaggcagaaaguccuuaacccugaacuuaauaacagagauggggaggcuaccgacauucaugacacagaaagcacgcaaugcucuggacaacuuggcaguauuacacaccgcagaagcuggagggagagcuuacaaucaugcgcucagcgaacuaccagaaacacuugaaacguuacuacuacuuacacucuuggcaacuguaaccgguggcauauuuuuauuucuaaugucagguaagggaauuggaaaaaugacucucggaauguguugcaucaucacugcaucuacgcugcuaugguacgcacaaauccagccucauuggauugcagcgaguauuauccucgaguucuuucuaauaguccucuuaaucccagaaccggaaaagcaacgcaccccgcaagacaaucaguuaacauauguuguaauagcgauacuaaccgugguagcagcaacgauggcaaacgaaaugggguuuuuggagaaaacuaagaaagaucugggccuagguucaauaacaacccaggaaucagaaaguaacauccucgauauagauuuacgcccagcuagcgcauggacauuguaugcuguagcaaccacuuuugugacacccaugcuacgccauagcauagaaaauaguagugucaauguuucguuaacagcaauugcaaaucaagcuacaguccuaauggguuugggaaaaggauggccucuauccaaaauggacauaggagugccgcuucuagcaauaggaugcuacucacaaguaaacccaaucacacuaacagcagcuuuauuacuccuaguugcacacuaugcaaucauugguccagguuuacaagcaaaggcaacuagagaagcccagaaaagagcagcugcaggaauuaugaaaaauccaacgguugacggcauaacagugaucgaucuagagccaauaccauaugaccccaaauuugaaaagcaauugggucaaguaaugcuucuuauuuugugcguuacccagguacugaugaugcggaccaccugggccuuaugugaggcacuaacauuagcuacaggaccuauaucuacucucugggaaggaaacccuggccgauuuuggaacacuacaauugccguuaguauggcgaauauuuucagggggagcuauuuggcgggcgcaggauuauuauuuuccauaaugaaaaacacgacaaacaccagaagaggaacggggaauauaggugagacacugggagaaaaauggaaauccagacuaaacgcacuugguaagucagaauuucaaauuuacaagaaaucaggcauucaagaagucgaucgcacauuagcaaaagaaggaaucaaacggggcgagacugaucaucaugcggucuccagagguuccgcuaaacuacgaugguuugucgagcguaauauggugacaccggaaggaaaaguaguggaccuaggaugugggagagguggauggaguuauuauuguggaggccugaagaauguucgagagguuaagggacuuaccaaggguggaccagggcacgaagaaccaauuccuaugaguacauauggauggaacuuaguaaggcuucagagugggguagauguauucuucacaccuccugagaaaugcgauacacuuuuaugcgauauaggcgaaucauccccuaauccaacuaucgaagccgggcgcacgcucaggguguuaaauuugguagaaaauugguugaacaacaacacacaauuuuguauuaagguauuaaauccguacaugccuagcgucauugagaaaauggaagcacuucaaagaaaauaugguggagcccuaguaagaaauccauugaguagaaacuccacgcacgaaauguauuggguauccaaugcgaguggaaacauagugucuaguguuaauaugaucagucgaauguugauaaacagauuuacuaugaaacacaaaaaggcuacuuaugaaccagauguagacuuaggguccggaacuagaaauauaggaauugaaucagagauacccaaucuugauaucauuggaaagcgaaucgagaaaauuaaacaagagcaugagacaucauggcacuaugaucaagaucauccauacaaaacaugggcuuaccacggaaguuacgaaacaaaacaaacaggauccgcuagcucaaugguuaaugggguugugcgucuuuuaacuaaaccuugggacgucgugccaaugguaacacagauggcgaugacggauacaacuccuuuuggacaacaaagagucuuuaaagaaaaaguagauacacgcacccaagaaccgaaagagggcaccaagaaauuaaugaaaaucacugcagaauggcuauggaaagaauugggcaagaagaaaaccccacgaauguguacaagggaagaguucaccagaaaagugagaucgaacgcugcacugggagcaauuuuuacggaugaaaacaaauggaaaucggcgcgcgaagccguagaggacagcagguucugggaauuaguagauagggaacgaaauuuacaucucgaaggaaaaugugaaacauguguguacaacaugaugggaaaaagggagaagaaauuaggugaauuuggaaaggcuaagggaucaagagcaaucugguacauguggcugggugcaagguuucuagaguuugaagcucucgguuuccuaaaugaagaucauugguucucccguggcaauucacuaagcgguguggaaggggaggguuuacauagguuaggguauauauugagggaugucggcaagaaagaaggaggggcuauguaugcagaugauaccgcggggugggauacgagaaucacccuagaggaccuuaaaaaugaagaaauggucaccaaccauaugaaaggugagcauaaaaagcuagccgaagcaauuuucaaguuaacauaucaaaauaaggucguuagaguccaacguccgacgccaagagggaccguuauggauauaaucaguagaagagaccagaggggaucaggccaggugggcacauacggccuuaauacuuucacuaauauggaggcgcaauuaauaagacaaauggagggagaagggaucuucaagaguauucaacaucuaacugcaacagaagagaucgcagugcagaacugguuagcucgaguuggacgggagcgacuuagucgaauggcuauuagcggagaugacuguguaguaaaacccauugaugaucgguuugccagcgcacucacagcauuaaaugauauggguaagguaagaaaagacauccaacagugggagccgucaaggggcuggaaugacuggacacaagucccauuuugcucucaucacuuucacgaauuagucaugaaagauggccguguuuuagucguuccauguagaaaccaggacgaacucaucgggcgagcgagaauaucccaaggugcaggauggucuuuaaaagaaacagcuugcuuaggaaaaaguuacgcacaaauguggacacuuauguauuuccauagaagagaucuuagguuagcugccaacgccauauguucggcggucccuccccauugggucccaacuucucguacuaccuggucuauacaugcaaaacacgaauggaugacgacugaagacaugcuagcaguuuggaaccgaguuuggauacaagaaaauccuuggauggaggacaaaacacccguugaaaguugggaagagguucccuaucuaggaaaaagagaagaccaaugguguggcagcuugauaggucuaacaagucgagccaccugggcuaaaaacauucaaaccgcaauuaaccaaguuaggagcuuaauuggaaaugaagaauacaccgacuacaugcccaguaugaaaagauuuagaagagaagaagaagaagcaggcgucuuaugguag

SEQ ID NO: 22412 - RNA, 9876 nt, Artificial Sequence
  derived and/or modified CDS sequence (opt6) from DENV-2__FJ744705__SS-prME
acagccgggguuauagucaugcuuauaccuacugcgauggcguuucaccuaaccaccaggaauggagaaccacauaugauuguggggcgccaagaaaaagguaaaucauugcuauucaaaacagaagacgggguaaauauguguacucuuauggcgaucgaucuuggagaauuaugcgaagacacgauaacuuacaaaugcccgcuguuacgacaaaacgaaccugaagacauugacuguuggugcaauaguacuagcacuuggguaaccuaugguacuugcaccacuacuggugaacaucgaagagaaaaacgaucaguagcgcuuguaccccauguuggaaugggguuggaaacgcggacugaaacauggaugagcucugaaggggcauggaaacacguacaacgaauugaaaccuggauauuaagacaucccggauuuacaauuauggcagccauauuggcuuauacaauuggcacuacacacuuucaacgugcguuaauuuuuauucuauugacagcaguugcaccuagcaugacaaugagauguauuggaauuucaaaucgagauuuugucgaagggguuaguggcgguaguuggguagacauuguucucgaacacggcagcugugucacaacaauggccaaaaauaaacccacuuuagacuuugaacuaauaaaaacagaagcaaaacaaccggccacacucagaaaauauugcauugaagccaaacuaacuaauaccacaacagaaucuagauguccgacacaaggggaaccuagccucaacgaagaacaggauaaaagguuuauuuguaaacauucaaugguggaccguggauggggcaacgguuguggguuauucgguaaaggagggauuguaaccugcgccauguucacauguaagaaaaacauggaaggaaaaguugugcaacccgaaaauuuagaauacacaauaguuauaacaccacacaguggggaagaacacgcaguaggaaaugauacggggaaacauggaaaagaaauaaaaauuaccccacaaaguagcauaacggaagcagaauuaaccggauacggaacaguuacaauggaauguaguccgcgaacagguuuagacuucaaugaaaugguauuauuacaaauggaagacaaggcuuggcuaguccaucgacaaugguuucuugauuugccucuaccauggcuuccaggcgccgacacgcaaggguccaauuggauucagaaagaaacccuaguuacuuucaagaauccccaugccaaaaagcaagauguagucguccuaggaucacaggaaggcgcaaugcacaccgcgcuaacaggagcgacagagauacaaaugucaucagguaauuuacuauuuacuggacaccuaaaaugucgccugcggauggauaaacuacaacuaaaaggcaugucguacagcaugugcacgggaaaguucaaaauuguuaaggaaaucgcggagacccaacauggaacuaucguaauuaggguccaauaugaaggcgaugacucaccuugcaagauaccauuugaaaucacugaucuagaaaaacgacauguuuuaggacgauugauuaccguuaauccgauugucacagaaaaagauucuccugucaauaucgaagcugaacccccauucggggauaguuacauuauaauuggaguugaaccuggacaacuaaaauugaauugguucaagaaagguucaaguauagggcagauguuugaaacaacuaugaggggagcaaaaagaauggcaauccuuggagauacagcuugggauuucggcagccuaggagguguauucacgucaauuggcaaagccuuacaucagguauucggcgcuauauacggugccgcauuuuccgguguaucauggaccaugaagauacugauuggaguaauuauaacguggauaggaaugaacucacgcagcacaucacuaucugugagcuuaguucucguagguguagugaccuuauaccuuggagcuaugguacaagcggauagcggaugcauuguuucuuggaaaaacaaagaacuaaaaugcggauccgguauauucauaacugacaacguacauacguggacagaacaauauaaauuucaaccggaaucaccuucgaaauuagcaucugccauccaaaaggcacaugaggaagguauauguggcauacguucuguaacacgauuagaaaaucucauguggaagcaaauuacaccugaacuuaaucauauauugucagagaaugaagucaaacugacaauaaugacaggagauauacguggcauaaugcaggcggggaaacgauccuuaagaccucaaccuaccgagcuaaaauacucauggaaaaccugggguaaagcaaaaauguuaaguacggaaagucauaaucagacuuuccuuauugacggaccagagacaguagaguguccgaauacuaacagagccuggaacucacucgaaguugaagacuaugguuucggaguauucacgacgaauauaugguuaaaauuaagagaaaaacaagauguauuuugugacucaaaacuaaugucagcagccauaaaagacaauagagcuguccaugccgauaugggguacuggauagaaagugcccuuaaugauacuuggaaaauggaaaaagcaucguucaucgaaguaaaaagcugucacuggccuaaaagucacaccuuguggaguaacggcguccucgaaucugaaaugauaauaccuaaaaacuucgcggggccgguaucacaacacaauuaucgaccaggcuaucauacgcaaacagcaggaccguggcaccuaggaaaacucgaaauggauuuugauuuaugcgaagguacuacaguaguagucacagaagacuguggaaaucguggaccaucucugaggacaacuacagcaagcggcaaacuaaucaccgaguggugcugcagaagcuguacucuaccaccccuacgauacaggggagaagauggaugcugguacggaauggaaauaagaccacuaaaggaaaaagaagaaaaucugguaaauagcuuaguuaccgcaggacaugggcaaaucgauaacuuuaguuugggaguauuagguauggcguuauuccuagaagagaugcuccggacccgcauagguacuaaacaugcuauucuauugguagcaguuucguuugugaccuuaauaacugggaauaugucuuuucgagaucugggucgugucaugguaauggucggugcaacaaugacugacgauauaggaauggguguuaccuauuuagcacuacuagcugcuuucaagguuaggccaacauuugcagccgggcuauuacuacgaaagcuaacaucgaaggagcuuaugauggcgaccauagguauugcccugcucagccagucaacaauacccgaaacuauacuagaauuaaccgaugcucuagcuuuaggaaugauggugcucaaaauaguacguaauauggaaaaauaucaauuagcagucaccauaauggcuauaucauguguacccaaugcgguaaucuugcaaaaugcguggaagguuucaugcacgauauuagcagccguuaguguauccccauuauuauuaaccucaucucagcagaaagccgauuggauaccacucgcucuaacaauaaaaggauuaaaccccacagcuauauucuugaccacgcugucccggacaagcaagaaacgaaguuggccuuuaaaugaagcaauuauggcgguugggaugguaucaauacuggcaucaagccuuuugaaaaacgauauaccaaugacaggaccauugguagcuggaggacuauuaaccguguguuauguacuuacgggacggucagcggauuuggaauuggaaagggcagccgacguuaaaugggaagaccaagcagaaauuagugguucaaguccaauacuuucuauuaccauuagcgaagacgguucuaugucgauuaagaaugaggaggaagaacaaacauuaaccauucuuauaagaacaggccuauuaguaauaagugguguuuucccaguaucgauaccuauaacagcugcagcuugguaccuaugggaaguuaagaaacaaagggccgguguacuuugggauguaccgaguccaccuccagucgaaaaagcggaacuugaagacggagcuuaucgaauaaaacagagaggaauuuugggauauucacagauaggcgcugguguauacaaagaagguacauuucauacaauguggcacguaaccagaggcgccguguuaaugcaucguggaaaaaggauagaaccuuccugggcggacgucaagaaagaucuaaucuccuauggugguggcuggaaauuagagggggaguggaaagaaggugaagagguccagguacuagcacucgaaccaggcaaaaauccaagagcuguacaaacaaaaccuggcauauucaaaaccaauacagguacuauaggggcaguaucauuagauuuuucgccagguacgagcgguaguccuaucguggauagaaaagguaaaguaguaggauuauacggcaacggaguaguaacgcgauccggugcguauguaagugcgauagcacaaacugagaagucaauugaagauaacccggaaauugaggaugacauauuucgaaagaaacgccuuaccauaauggaucuacaucccggggcaggaaaaacuaaacgauauuuacccgcgaucguaagggaggcaauaaaaagagggcuacguacacuuauacuagcuccaacucgugucgucgcagcugaaauggaagaggcuuugcgaggccuaccuauucgauaucaaacgcccgcuauaaagaccgaacauacugguagggaaauuguugaucuaaugugucacgcgacauucacgaugcgguuacuuuccccuguaagaguuccuaauuauaacuuaauuauuauggaugaagcacauuucacagacccagcaucaauugcagcuagggguuacauaagcacacgaguagaaaugggagaagcagcgggaauuuuuaugacggcuacgccuccagggaguagagacccguucccgcaguccaaugcucccauaauggaugaagagagagaaauccccgagagaagcuggaacucaggucaugaaugggucacagauuuuaaagguaaaacaguaugguuugucccuuccaucaaagcgggaaaugacauagcugcguguuuacgaaagaacggcaagaaaguuauucagcuaucuagaaaaacauuugauucagaauacgugaaaacaagagcaaacgauugggacuucgucgucacaacagauaucucugaaaugggugcaaacuuuaaagcugaaagaguaauagacccucgaagaugcaugaaaccggucauacuaaccgauggcgaagaacggguaauccuugccggcccgaugcccguaacacacuccucggcagcucaacgucgaggaaggauugguaggaacccaaagaaugaaaacgaccaauauauauauaugggugagccgcuagagaacgaugaagauugugcccauuggaaagaagcuaaaauguuauuagacaauauuaauaccccugaaggaaucauaccaucgauguuugaaccggaaagggagaaggucgacgcaauugauggagaauaucguuuaagaggugaagcaaggaaaacguucguggacuugaugagacgcggugaucuacccgucuggcuugcuuauaaaguugccgcggaagguauuaauuacgcggauagaaaaugguguuucgacggaaucaaaaacaaucagauccuugaggaaaauauggaaguagaaauuuggacuaaggaaggagaaagaaagaaauuaaaaccaagaugguuggacgcgagaauuuauuccgauccauuagcauuaaaggaguuuaaagaauuugcugccggacgaaaaagucuaacucuaaaccuaauuacugaaaugggcagacucccuacuuuuaugacacaaaaagcuagaaaugcacucgauaauuuagcgguccuucauacagcagaagcgggaggacgagcguacaaucacgccuugucagagcuuccugagacucuugaaacacuucugcuauuaacacuuuuagcaacggucacugggggcauauucuuauuuuuaaugagugguaaggguauaggaaagaugacuuugggaaugugcugcaucauuacagcuucuauucuuuuaugguacgcacaaauccagccacacuggauagcggcaucuauaauauuagaguucuuccuaauugucuuacucauacccgagccggaaaaacaacguacaccucaggacaaccagcuaacuuauguaguaauagccauacuaaccguaguagcggccacaauggcgaaugaaauggguuucuuagaaaagacuaaaaaggaucuagguuuagguagcauuacaacacaggagucagaaucaaauauacuagauauugauuugcguccugccucggcauggacacuauacgcgguugcaacaacauuuguaacuccuaugcucagacacucaauugaaaauagcucuguaaaugucuccuugacagcuauugcgaaccaagcgacgguauuaaugggguuaggaaaagguuggccgcugucgaaaauggauauaggaguucccuuacuagcaauugguuguuauucucaagucaauccaaucacauugacagccgcguugcuuuuguugguggcgcauuaugcgauuauuggaccagggcugcaagccaaagcaacaagagaagcccagaaaagagcagcagcugguauaaugaaaaacccaacuguagacgggauaaccguaauagacuuggaaccaauaccauaugauccgaaguucgagaaacaguuaggacaagucaugcuacucaucuuauguguaacccaaguucuuaugaugagaacgacuugggcucuaugugaagcucuuacacuagccacagguccgauaagcacccugugggaagguaauccaggaagauuuuggaacacaacgaucgcugugucuauggcaaauauuuucaggggcaguuaccuagccggagcagggcuacuauuuucuaucaugaaaaauacuacuaacacccgcagagguaccgggaauauuggggaaacauuaggagaaaaauggaaaagucgcuuaaacgcuuuaggaaaaagugaguuccagaucuacaagaaauccgggauacaagaaguagaccgaacacuagccaaagaaggaauuaagagaggggaaacugaucaucaugccguaucgagaggauccgccaaacucagaugguuuguugaacgaaauaugguaaccccggaaggcaaaguggucgauuuaggcugcggucgaggaggguggagcuacuauugugggggauugaaaaaugucagagaaguaaaaggguuaacuaaaggagggcccgggcaugaggaaccgauaccuaugucgaccuacggauggaauuuaguaagauugcaaucggguguagauguguuuuucacgccaccagaaaaaugugauacacuuuuaugugacauuggcgagaguagcccuaacccgacuaucgaggcuggaaggacacugagaguauugaaucugguggaaaauugguugaacaauaauacccaauuuuguaucaaaguacuaaauccauauaugccuuccgucaucgagaaaauggaagcgcuacaaaggaaauauggaggagcccuaguaaggaaucccuuaucaagaaauucuacacacgaaauguacugggucucaaaugcaacagguaauauagucuccaguguaaauaugauaucacguaugcuuauaaaucgauucaccaugaagcacaagaaagcuacauaugaaccagacguggauuuagggucagguacacgcaauauaggaaucgagucagaaauacccaaccuagauauaauagggaaaagaauugaaaagauaaagcaagagcaugagacauccuggcauuacgaucaagaucacccuuauaaaacaugggcauaucauggcucuuaugaaacaaaacaaaccggaucggcgucaucgaugguaaauggcguuguuagacuauuaaccaagccaugggauguaguuccaaugguaacacaaauggcuaugaccgauacuacuccguuuggucaacaaagagucuuuaaagaaaaaguagauacgcgcacgcaagaacccaaggaagggacaaagaaauuaaugaaaaucacugcagaaugguuauggaaggaacugggcaagaagaaaacgcccaggaugugcacacgggaggaguucacaaggaaagugagaucuaaugcugcccuuggggcaauauuuacggacgaaaauaaauggaaaagugcucgagaagcuguugaagacgguagauuuugggaauuaguagacagagaacggaaucugcaucuugaaggaaagugugaaacguguguguacaauaugaugggaaaacgagagaagaaauugggagaguucgguaaggcaaaaggaucuagggcgauaugguauaugugguuaggcgcuagauuccuagaguuugaagcacugggguuuuuaaacgaagaccauugguucagcagagguaacagcuuaucuggaguugaaggugaaggacuucauaggcuuggauauauucuccgagauguagggaagaaagaaggaggugcaauguaugcagaugacaccgcuggaugggauacgagaaucacuuuagaagauuuaaagaacgaggaaauggugaccaaucacaugaaaggagaacauaaaaaguuagcagaagccauauuuaaacucacauaucaaaauaaagucguaagagugcaacguccgacuccuagaggaaccguuauggacauuauuaguaggagagaccaacgcggcagcggucaagucggaaccuacggacuaaacacuuuuaccaauauggaagcgcaacuuauuagacaaauggaaggggaagggaucuuuaaaagcauucaacauuugacggcuacagaagaaaucgcaguucagaacuggcuagcccgaguuggacgcgagcgucuuucucguauggcuauaagcggagacgacuguguagucaaacccauugacgauagauucgcuagugccuugacagcguuaaacgauaugggcaaaguaagaaaagauauccaacagugggaacccucuagagguuggaaugacuggacccaaguaccauuuuguucucaccacuuucacgaauuaguaaugaaagaugggcgggucuuagucgugccuugcagaaaccaagacgaauuaauaggcagagcaagaauaucucaaggagcggguuggucucucaaagagacggcaugccucggaaaaucauacgcccaaauguggacucugauguacuuucauagaagagauuuaagacuugcggcuaaugcgauauguucugcuguaccaccacacugggucccgacaucuagaacuacaugguccauacacgcaaaacacgaauggaugacuaccgaggauauguuggccguguggaacaggguauggauucaggaaaauccauggauggaagauaagacgccaguagaaagcugggaagagguaccauaccuaggcaaaagggaggaccagugguguggaucacucauagguuugacgagccgcgcgacaugggcaaagaacauccaaacggccauaaaccaggucagaagccuaauagggaaugaggaauauacagacuacaugccuagcaugaaacgauuucgccgggaagaagaagaggcugggguucucugguga

SEQ ID NO: 22413 - RNA, 9876 nt, Artificial Sequence
  derived and/or modified CDS sequence (opt6) from DENV-2__FJ744744__SS-prME
acagccgguguuauaguaaugcuuauucccacagcgauggcauuucaucugacgacccgaaauggagaaccacacaugauaguaggaaggcaggaaaaagggaaauccuuacuauuuaaaacugaagaugguguuaauauguguacgcuaauggcuauagaccuuggagaacuaugcgaagauacaauaacguauaaaugcccacugcuacgacagaaugaacccgaagauauugacugcugguguaauagcacaucaacgugggucacguauggaacauguacuacuacaggagaacauagaagagagaaaagaaguguggcucuggucccucaugugggcaugggguuagaaacacguacggaaacguggaugucaagcgagggagcauggaaacauguccaacgaauugagacguggauauuaagacauccaggauuuacaauaauggcagcaauacuugcauacaccauuggcacgacgcauuuccagcgagcuuugauauuuauacuacuaacggccguagcucccucaaugacuaugagaugcauagggaucuccaauagagauuucgucgaagggguuaguggcgggucuuggguugauauaguccuugaacacgggaguugugugacaaccauggcuaaaaauaaaccaacauuagauuuugaauuaauaaaaaccgaagcgaaacaacccgcuacauuaaggaaauacuguauagaagcaaaacuaacgaauacgacaaccgaaagcagauguccaacccagggagaacccucacugaaugaggaacaagauaaacgauucauuugcaaacauagcauggucgacagaggguggggcaauggauguggucuauuugguaaaggaggcauaguuacaugugcuauguucacgugcaagaaaaauauggaagggaaaguaguucaaccagaaaaucuggaauauacgaucguuaucaccccacacuccggugaggaacacgcugucggaaacgauacaggaaaacaugguaaagaaauuaaaaucacaccgcaaaguucaauaaccgaagcggaacuaacaggguaugggacugucaccauggagugcucgccacgaacaggacuagauuuuaaugaaaugguacuucuucagauggaagacaaagcauggcuaguccaccgucaaugguuuuuagauuugccacuaccauggcuaccaggagcugacacccaaggcucaaauuggauccaaaaagaaacguugguuacauucaaaaacccccaugcaaagaaacaagauguaguaguacuuggaucucaagaaggagcgaugcacacugcacuuacaggggcaacugaaauucaaaugaguagcggaaaucugcuauucacgggccauuuaaaauguaggcugaaaauggacaaauugcaacucaaaggcaugucuuauucaauguguaccgguaaauuuaaaauaguuaaagaaauugcggaaacacaacauggcacaauuguaauaagaguccaauacgaaggagauggaaguccguguaagauaccauuugaaauaacggaccuugaaaagcggcacgugcuggguagguugauaacuguaaacccuauuguuacagagaaagacucaccugugaauauugaagcagagccuccauuuggagauucguauauaauuauaggugucgaaccugggcaguuaaaacuaaacugguuuaagaaagguucgaguaucggacagauguucgaaacaacgaugagaggagcgaagagaauggcgauacuaggagauacugcuugggacuucgguagcuugggaggcguuuuuacgaguauaggaaaagcgcuccaucaaguauucggagcaauauacggugcagcuuuuaguggagugagcuggacaaugaaaauauugauuggugugaucauuacuuggauuggaaugaauaguagaagcacaucacuuucuguaagucuuguacuuguugguguaguuacacuauauuuaggagcuaugguucaagcagauaguggaugcguaguaagcuggaaaaauaaggagcuaaagugcgggagcggaauauuuauuacggauaauguacauacauggacagaacaguauaaauuucaaccggaaaguccaucuaaacucgccucagccauacaaaaagcacaugaagaagguauauguggaauacgaaguguuacucgacuugaaaacuugauguggaaacagauuacucccgaacuaaaucacauccuaucagaaaaugaaguuaaacuuacaauaaugacaggggauauuagggguauaaugcaagcggggaaaaggagucuaagaccacaacccacagaacugaaauacucauggaagacuugggguaaggccaaaaugcuuucgacagaaagucauaaccaaaccuuucuaauugacgguccagagacggcugaaugucccaacacuaacagggcauggaacucauuggaagucgaagacuauggguuuggaguauucacgacaaauauaugguuaaaacucagagaaaaacaagauguauuuugcgauucaaaacuaaugucugcggcaauaaaagauaaucgcgcgguccaugcggacauggguuacuggauagaaucagcacucaacgacaccuggaaaauggaaaaagcaaguuucauugaaguaaagucgugucacuggcccaaaagucacacucuuuggaguaauggaguacuugaaucugaaaugaucauaccgaagaacuuugcgggaccugugucacaacacaauuaucguccaggcuaccauacucagacugcaggaccuuggcauuuaggaaaacuugaaauggauuucgaccugugugaaggcacaacugucgugguuacagaagacuguggaaauagagguccuagcuugagaacuacaacagcgucgggaaaauuaauuacggaauggugcuguagaucgugcacuuuaccacccuuacgcuaucgaggcgaagauggguguugguauggaauggaaauaagaccacuaaaagagaaagaagaaaaucucguaaacagccugguaaccgcagggcacggacaaauugacaacuucaguuuggguguuuuaggaauggcauuauuucuugaagaaaugcuucguaccagaauaggaacuaaacaugcaaucuuacucguggccguaucuuucgucacauuaauaacugguaauaugucuuuccgagaucuuggacgggucaugguaaugguaggggcaacgaugaccgaugacauugguauggggguaacuuaucuggcacuacuagcagcuuucaaaguucgaccgacauuugccguaggccuacugcuuagaaaauugacguccaaagaauugaugauggcaacuauugguauugcgcucuuaucacaaaguacaauuccugaaacuauacuagaauugacugacgcgcuagcucucggaaugaugguacuaaaaauaguucguaauauggaaaaauaucaacuagcugugacaauaauggcgauaucaugcguaccuaaugcagugauacugcagaaugcuuggaaaguaucuugcacuauacucgccgucgugucagucagccccuuguuacugaccucgucgcaacagaaagcagauuggaucccauuagcauugacgaucaaaggucugaauccaacagccauauuucucacuacauuaagucguacuucuaaaaagagaagcuggccauuaaaugaagcuaucauggcuguuggaaugguaucaauccuggcaucuucucuccuaaagaacgauauaccuaugacuggcccuuuaguggccggaggcuuauuaacgguuuguuauguccuaacuggacgaagcgcggaccuagaauuggaacgagcggcugauguuaaaugggaggaccaagcggagauauccgguucaucgccgauuuuaucaauaaccaucucagaagauggaucaaugucgauuaagaaugaagaggaagaacaaacuuugaccauccuuauacgaacgggacuguuagucaucuccggaguuuuuccugucaguauaccuaucacugccgcagccugguaccuaugggagguuaaaaagcaaagagccgguguauuaugggauguaccgagucccccgccagucgaaaaggcggaacucgaggauggggcauauagaauaaagcagcgagguauauuaggauauagccaaauaggcgccggaguauauaaggaaggaacauuucauacgauguggcauguaacacgcggagcuguacugaugcauagaggaaaaagaauugaacccuccugggcagacguuaagaaagauuugauuaguuacggugggggauggaaguuagaaggagaauggaaagaaggugaagaaguacaaguauuagcucuugagccagggaaaaacccacgugcgguacaaacgaaaccagguauauucaaaacaaauacugggacaauaggggcuguaagccuagacuuuaguccaggcacaagcgguucuccuauaguggauagaaaagguaaaguuguaggcuuauacggaaacggugugguuacaagaucaggugccuacguauccgcaaucgcacaaacagagaaaaguauagaggauaauccugaaauagaagaugauauauuccgaaagaaaagguuaacaaucauggauuugcaucccggagccgggaaaacaaagagauaccuuccagcgauuguccgggaagcgauuaaacgaggucuccguacguugauacuugcuccuacgagaguaguugcugcagaaauggaagaagcacuaagagguuuaccaauccgauaucaaacuccagccauaaaaacagagcauacaggcagagaaauagucgaccuuaugugccaugcuacauuuacaaugagacucuugucuccaguuagaguaccaaauuauaauuuaauaauaauggacgaagcacacuucacagacccggcgagcauagcggcaagggguuauauuucgacaaggguggaaaugggcgaagccgccgguauauuuaugacagcgacucccccaggcucccgagauccuuucccacaaaguaaugcgccaauuauggaugaagaacgagaaaucccugaaagaaguuggaacagcggacaugaauggguaacagacuuuaaagggaagacagucugguuugucccaucaaucaaagccggaaacgauauagcugcgugccuaaggaaaaaugguaagaaaguaauacaguuauccagaaaaacuuucgacagugaauauguaaaaacgagagcgaacgacugggauuuuguugucacaacggacauaagcgaaaugggugcuaauuucaaagccgaaagaguaauugacccaaggagauguaugaagccagucauacucacagacggugaagaaagaguaauccuugcggggccuaugcccguaacgcauucaagcgcugcccaacgaagaggacgaauuggcagaaauccuaagaaugaaaaugaccaauauauauacaugggagaaccguuggaaaaugaugagaauugugcacauuggaaagaagcgaaaauguuauuagacaacauuaacacucccgaagguaucauacccucuauguucgaacccgaaagggagaagguagaugccauagauggagaguacagauuaagaggcgaggcccgaaagacguuugucgacuuaaugagacgaggagaccuaccuguauggcuagcguauaaggucgcagccgaaggaauuaauuaugccgaccgaaaaugguguuuugauggaauaaagaauaaccaaaucuuagaagaaaauauggaaguagaaauauggacuaaagaaggagagagaaagaaacuuaaaccaagguggcuggaugcaaggaucuauagcgauccacuagcauugaaagaauuuaaagaauuugcagcugguagaaagucauuaacacugaaccuaauaacagaaaugggcagauugccaacauuuaugacccagaaagcuagaaacgcucuugacaacuuagcaguauugcacacugcggaagcgggaggcagagcauauaaucacgcucucagcgagcuaccugaaacauuggaaacacuacugcuacuuacacuccucgcaaccguuacaggagguauauuccucuucuugaugucaggcaagggaauugguaagaugacucugggaaugugcugcauaauaacagcuagcauccuacucugguacgcacagauacagccacacuggauagcugcaagcaucauacucgaguuuuuccuaaucguucuuuuaauaccagaaccagaaaaacagagaacaccucaggacaaccaauugacguaugucguaauagcaauuuuaaccguaguagcugcaacaauggccaacgagaugggauuucuugaaaagacaaagaaagaucuaggauuagguagcauaacuacgcaagagucggaaucaaauauauuggauauugauuuaaggccggcaucugcauggacacuuuaugcggucgcgacaacauucguuacaccgaugcuuagacauagcauugaaaauuccucuguaaacgucaguuuaacggcaauagcaaaccaagcaacaguuuuaauggguuuaggaaaaggcuggcccuugucuaaaauggacaucggagugccuuuguuagcuauuggauguuauagucaaguaaauccgaucacauuaacugcagcgcuauuauugcuuguagcucacuaugccaucaucgggcccggucuacaggcuaaagcgacacgagaggcgcagaaaagggcagcggcggggaucaugaagaacccgacuguagaugguauaacaguaauagaucuugagcccauaccauacgauccaaaauuugaaaaacaacuaggacaaguuauguuacuaauacucugugugacacagguacuaaugaugagaaccacuugggcgcuaugcgaagccuuaacucuagcaacaggaccaauauccacguuaugggaagggaacccaggccguuuuuggaauacaacaauugcaguaagcauggcaaacauuuuuagagguaguuaccuggcaggagcugggcucuuauucucuaucaugaaaaauacuaccaauacuaggcggggaaccgguaacaucggggaaacguuaggagaaaaauggaagucaagguuaaacgcacuagggaaauccgaauuucaaauauacaagaaaaguggcauucaagaagucgacaggacauuagcuaaagagggcaucaaacguggagagacggaccaccacgcugucucacguggaucagccaaguugcgcugguuuguagaaagaaauauggugaccccugaggguaaagugguagaccuaggauguggccgggguggauggaguuauuacugcggcgggcucaaaaaugucagagaagugaaaggguuaacaaaaggcggacccggacaugaagaaccuaucccaaugagcacauacggauggaauuuaguccgacuucagagcgggguggaugucuucuuuacgccgccugaaaaaugugacacuuuacugugugauauuggugaaagcucacccaauccaaccauugaagcaggaagaacauuaaggguacuaaaucuuguugaaaauuggcuuaacaacaacacccaauucugcauuaaaguuuuaaauccuuauaugccgucugugauagagaaaauggaggcguuacaacgaaaauauggaggugcccucguaaggaauccccucucucgaaacucuacccaugagauguauugggucucuaaugcuucggggaauaucguaucaagcguaaauaugauaucuagaauguuaauaaacagauucaccaugaaacacaagaaagccacguaugagccugauguagacuuagggaguggcaccagaaauauaggaaucgagagugaaaucccaaaccucgacaucauaggaaaacgaauugagaagaucaaacaagaacacgaaaccagcuggcauuacgaucaggaucaccccuauaaaaccugggcguaucauggcucauacgagacaaaacagacggguagcgccucaucgaugguaaauggaguaguccgucuguuaacuaaaccaugggauguaguaccgaugguuacucaaauggcgaugacagauacgacaccauuuggacagcagagaguauuuaaagaaaagguugacacucguacacaagagccaaaagaaggcacgaagaaacuuaugaaaauuacugcagagugguuguggaaagaauugggcaagaaaaagaccccaagaauguguacgagggaggaguucacacguaagguacgcucuaacgccgcacuaggggcuauauuuacagacgagaacaaguggaagagugcaagagaggcaguggaagacucucgauuuugggagcuaguagaucgagaaaggaauuugcaucucgaaggcaaaugcgagacgugcgucuauaauaugauggguaagagagagaagaaauuaggagaguucgggaaggccaagggaucccgcgcaauaugguacauguggcuaggagcacgcuuucucgaguucgaagcccucggauucuuaaaugaagaccauugguuuucccggggcaauagccuuucuggaguagaaggugaagggcuccacagacugggguacauucuaagggauguugguaagaaggaagggggagcuauguacgccgaugauacagcagguugggacacaaggauuacauuagaagauuugaaaaaugaagaaaugguaacaaaucacaugaagggagaacauaaaaagcuggcagaagcgauauuuaaacucacauaucagaauaaaguaguaagagugcaaagaccaacaccuagggguacaguaauggauauuaucucacguagggaucaaagagggagcggucaaguugggacguaugggcucaacacguuuacaaauauggaagcgcaacuaauucgucaaauggaaggagaaggaauuuuuaagucaauccagcaccuuacagcaacggaggaaauagcgguucaaaacugguuggcaagaguuggacgcgaaagacuaucuagaauggcuauuuccggugaugacugcguaguuaaaccuauagacgacagauucgcuucggcgcuaacugcauugaacgacauggguaaaguaagaaaggauauucagcaaugggaaccgaguaggggauggaaugacuggacgcaaguucccuucugcucacaucauuuccacgagcuaguaaugaaggacgguagaguauuaguuguaccauguaggaaucaggaugagcucauaggacgugcacguaucagucagggugcugguuggucauugaaagagacugccugucuagguaaaucguacgcucaaauguggacauuaauguauuuccauaggcgcgaucuaagauuagccgcuaaugcaauuuguagcgccguuccuccccacugggugccaaccucucgaacaacuuggucaauacaugcaaaacaugaauggaugacaacagaggacaugcuagcuguauggaauaggguuuggauacaagagaacccguggauggaagauaaaacgccaguugagucaugggaggaaguuccauauuuagggaaaagagaggaucaaugguguggaagucuaauugguuuaaccucacgagcaacaugggccaagaauauucaaacugcaaucaaucaagugagaucguuaauagggaaugaagaauacacagacuacaugccaucaaugaaaagauuuagaagggaggaagaagaagccgguguguuaugguag

SEQ ID NO: 22414 - RNA, 9876 nt, Artificial Sequence
  derived and/or modified CDS sequence (opt6) from DENV-2__GQ868646__SS-prME
acagcggguguuauuguaauguugauaccaacagcaauggccuuucacuuaacaacgcgaaauggugaaccacacaugauuguaggaagacaagaaaaaggaaaauccuuacuauuuaaaacggaagacgguguaaauauguguacccuaauggcaauagacuuaggagaacuaugcgaagauacgauuacauauaaauguccauuacuuagacaaaaugaaccagaagauaucgauuguuggugcaacucaacuucuacauggguaacguauggaacaugcacgacaacaggagaacaucggagagaaaaacguagcguagccuuaguaccgcaugucggaaugggacuggaaacaagaaccgagacauggaugagcagcgaaggagcauggaaacaugugcaacggauagaaaccuggauucugcgucacccaggauucacuauuauggcagcaauacuagcauacacuaucggaacaacucacuuucaacgagcauuaauauuuauccuucuaaccgcuguugcgccaucgaugacaaugaggugcauugguauuaguaauagggacuucguagagggaguuucaggggguucauggguggauauaguuuuagagcacggaaguuguguuacaacaauggcgaaaaauaaaccgaccuuagauuuugaacuaauaaaaaccgaagcaaaacagccagcuacauugcgcaaauauuguauagaagcuaaacuaacaaauacuacuaccgaaucaagauguccgacucagggugaacccagccuaaaugaagaacaagacaaacgguucauuugcaaacacaguaugguagauagaggauggggaaaugguuguggcuuauucggaaaagggggaauaguaacaugugcuaaauucacauguaagaaaaacauggaaggaaaaguuguucagccagaaaauuuagaauauaccaucguuauuacuccccauucaggugaggaacaugcggucggaaacgauacgggaaaacauggcaaagaaaucaaaauaacuccgcagucuucaauuacggaagcagaauuaacaggcuacgggacaguaacaauggagugcagucccagaacaggacuagauuucaaugaaaugguacuauugcagauggaagacaaagcauggcuaguccaucgacagugguucuuagaucuaccuuuacccuggcuaccaggugccgacacccaaggaucuaacuggauucaaaaagaaacuuuagucacguuuaaaaauccacaugccaagaaacaagacguaguagugcuaggaagucaagaaggagcaaugcacacugcgcuaacuggggcgaccgagauucagauguccuccggaaauuuauuauuuaccggucaccuuaagugccgauuaagaauggacaagcugcaacuuaaggguaugucauauagcaugugcacaggaaaauucaaaauuguuaaagaaauagcagaaacgcaacauggaacuaucgucauaagaguacaauaugagggcgacggaagcccaugcaagauaccguucgaaauaacagaucuagaaaagaggcauguacugggacgccuaaucacuguaaacccaaucgucaccgaaaaagauucacccguaaacauagaggcagaaccaccuuucggagacucauacauuaucauugggguggagcccggucagcugaaacuuaacugguucaagaaagggagcuccaucggucaaauguucgaaacaacaaugagaggcgcuaagagaauggcaauucugggggauacugcaugggacuuuggcucauuagguggugucuuuaccaguaucgguaaagcucuacaucagguauuuggugcgauuuacggagccgcauuuucaggcguaucguggacuaugaaaauacuaauuggaguaauuauuacauggauagguaugaacucaaggaguacuucauugucagucagcuuagugcugguagguguaguaacccuauauuugggagccaugguucaagcugauucaggaugcguugugucauggaaaaacaaagaacugaaauguggcuccgggauauucauuaccgauaacguucauacguggacugaacaauauaaauuucaaccagaauccccgucaaagcuggcaucagcuauacagaaagcccaugaagaaggcauuuguggaauccgaucaguuacaagacuagagaauuugauguggaagcaaauuacgccagaacugaaucacauucugucagaaaaugaagugaaauuaaccauaaugacuggagauauccggggaauaaugcaagcggggaagcgaagccuacgaccccaacccaccgaauuaaaauauucauggaaaacauggggaaaggcuaaaauguuaucaacggaaagccacaaccaaacuuucuuaaucgacggcccagagacagcagaaugcccaaauacgaauagagcuuggaacucacuugaaguagaagauuaugguuuugguguauuuaccacuaauauuuggcuaaaauuacgagacaagcaagaugucuucugugacucaaaauuaaugucagccgccauuaaggacaaucgugcaguucaugcugacaugggcuauuggauagaaagugcgcugaacgauacauggaaaauggagaaagcgucguucauugaagugaaaucuugccacuggccgaagucucacacauuguggucaaacgguguacuugaguccgaaaugaucauacccaaaaauuucgcaggacccguaucucaacauaauuauaggccgggcuaucacacacagacagcuggaccauggcaccuugguaaguuagaaauggacuucgaccuaugcgaggguaccacagugguaguaacagaggauuguggaaauagaggaccgucacuacguaccacaacagcgaguggaaaacuaaucacagaaugguguuguagaucauguacauugccuccgcucagauaccguggagaagauggcuguugguacgggauggagauucgaccucuaaaagagaaggaagaaaauuuagugaacucucuagucacagccggacauggacagauugauaacuuuagcuuaggcguacuggggauggcccuucucuuagaagaaauguuaagaaccagaaucggaacuaaacaugcuauucuccuaguagcuguuagcuuugucacacuaauaacuggaaacaugaguuuuagagacuuaggccgaguaauggucaugguuggugcuacgaugacagaugacauaggaaugggagucacuuacuuagcacuuuuagcagcauucaaaguccggccuacuuucgcggccggucuccuauuaagaaaauuaacaucuaaagagcuaaugauggcaacgauugguauugcauuacuaucccagagcacaauuccggagaccauucucgaacuaacagaugcuuuagcgcuugguaugaugguacugaaaauugucagaaauauggagaaauaccagcuagcaguaacuguaauggcgauaucaugugucccuaaugcugucaucuuacagaaugcguggaaaguaucuugcacgauccuggcugcaguaaguguaagcccucuacuauugacuucuagucaacagaaagcagacuggauaccauuggcacuuacuauuaaaggauuaaauccuacagcaaucuuuuugacuacucuuaguagaacuagcaagaaacguucauggccuuuaaacgaggcuauuauggccguuggaauggugaguauccuagcaaguucccuguuaaagaaugacauaccaaugacaggcccucuaguagcggguggauuauuaacagucuguuauguauuaacaggucguuccgcagaccucgaguuagaacgcgcugcugauguaaaaugggaagaucaagcggaaauaaguggaaguucaccgauacuguccaucacaauaagcgaagacgggucaaugucaauaaagaaugaagaagaggaacagacacugacgauauuaauccgaacaggacuuuuaguaaucucggggguuuucccugugaguauuccaaucacggcagcagcgugguauuuaugggaagucaagaaacaaagggccgguguccuaugggacguacccucuccacccccaguggaaaaagcggaauuggaagacggagcauacagaauaaaacagaggggaauauugggauacucacagaucggcgcuggaguauacaaagaggggacguuucacaccauguggcauguaacaagaggagcaguccuaaugcaucggggcaagagaaucgaaccgucaugggcggaugugaaaaaggaucuaauaaguuauggcgggggauggaaauuagagggcgaauggaaagaaggugaagaagugcagguacuagcauuagaaccaggaaagaauccacgagcugugcaaacuaaaccgggcauauucaagacgaacaccggaacaauaggugcgguaagucuugauuuuucgccagguacaucagguuccccaaucguagaucggaaaggaaaaguugucgggcuuuacgggaacggaguagucacuagguccggagcuuacgugagcgcaaucgcucaaacggaaaagaguauagaggacaaucccgagauugaagaugauauuuucaggaagaaacgauuaacaaucauggaccuacauccaggagcugguaaaacuaaacgcuacuugccugcaauuguacgugaggcuauaaaaagaggguuacgaacucucauacuagcuccaaccagagugguugcugccgaaauggaagaggcauuaagagggcuaccaauucgcuaucaaacaacagcgauaaaaacagagcacacaggacgugaaauaguagaucuaaugugccaugcuacuuucacaaugagacuucugagcccgguuagaguaccuaauuauaauuuaauaauuauggaugaagcgcauuuuacagauccagccagcaucgcagcacgggguuauauauccaccagagucgaaaugggagaagcugcagguauuuuuaugacggcgacuccacccggaagccgugaucccuuuccucaaucgaacgcgccaauaauggacgaagaaagagaaauaccugaacgguccuggaacucuggccaugaauggguaacagauuucaaagguaaaacgguaugguucguaccaucgauaaaagcugggaaugacauagcagcaugucuuaggaaaaauggcaagaaaguaauacaauugagcaggaagacauuugacagcgaauauguaaaaacacgugcaaaugauugggauuuuguaguaacuacugacauaagugaaaugggggcaaauuuuaaagcggaaagagucauagacccuagacgauguaugaaaccaguaauacuaacugauggagaagagaggguaauacuugcagguccaaugccuguuacccauucuagugcagcucagaggcguggacgcauugggcgaaaccccaaaaaugaaaaugaccaauacauauauaugggggaaccgcuggaaaaugacgaagacugcgcccauuggaaagaagcaaagauguuacuagauaacaucaauaccccagaaggaauaauuccuuccauguuugaaccagagagagagaaaguugacgcaaucgauggggaguauagacugagaggggaagcccgaaaaacauuuguggaucuuaugcgacggggagaucuaccugucugguuggcuuauaagguugcagcagaggggauuaauuaugcagauagaaaaugguguuucgacggaauuaaaaauaaccaaauauuggaagaaaacauggaggucgaaauauggaccaaagaaggagaaaggaagaaacuuaaaccuaggugguuagaugcuagaauauacucagacccacuagcacuuaaagaguucaaagaauuugcugcaggacguaaaucguuaacuuugaaucuaauuacagagauggggagguuaccuacauucaugacgcaaaaagcucggaaugcucuagauaauuuggcuguccuucauaccgcagaagcagggggccgugccuacaaccacgcgcucucagaacuaccugaaacacuggaaacgcuucuucuuuuaacauuacuagcuacgguaacaggagguauauuuuuguuuuuaaugagugggaagggcauuggaaaaaugacuuuaggaaugugcugcauuauuacugcaucuauauuauugugguaugcccaaauacaaccccauuggaucgcagcgucaauaauccucgaguucuuuuuaauagucuugcugauaccagaaccagaaaaacagagaacuccucaagacaaucaacuaacauauguuguaaucgcgauacugacugugguagccgccaccauggcuaaugaaaugggauuuuuagagaaaaccaagaaagacuuaggccugggaagcauaacaacucaagaaagcgaaaguaacauauuagacauugaucuuaggccagccucagcauggacauuguacgcugucgccacaaccuucguaaccccaaugcuacgacacucaaucgaaaauucaucagucaauguaucauuaacagcuauagcaaaccaagcaacaguacuaauggguuugggaaaagguuggccauugaguaaaauggacaucggaguccccuuauuagcaauaggguguuauucacaagucaacccaauuacgcuaaccgcagcgcuauugcuccuaguugcccacuacgcaauuauagggccaggacuacaagcuaaggcaacaagagaagcacagaagagagcagcggcuggaauaaugaaaaacccgacaguagauggaauaaccgugauagaucuugagcccauacccuaugacccuaaauuugaaaaacaacuuggucaagugauguuauuaauauuauguguaacgcagguacuaaugaugcggacaacaugggcguuaugugaagcccuaacauuagcuacaggcccaauaucaacacucugggaagggaacccaggaagauuuuggaacacuacaauagcuguauccauggcgaauaucuuucgcggaaguuaccuugccggugcaggauuacuauuuaguauaaugaaaaacacuacaaauacuagacgcgguacaggaaauaucggagagacccucggagaaaaguggaaaagccgauuaaacgcucuagguaagucggaguuccagauauauaaaaagucuggcauucaagaaguugaucguacacuggcaaaagaaggaauaaaaagaggggaaacugaccaucaugcuguuucuaggggcucugcuaaauuaagaugguuuguagaaagaaauaugguuacaccggaagguaagguuguagaucuagguuguggacgugguggauggagcuauuacugugggggccucaaaaauguucgugagguaaaaggguuaacuaaagggggaccuggucaugaggagccaauucccaugagcacauauggguggaaucuuguccgacugcaaucgggaguagauguauuuuucaccccgccggagaaaugcgauacauuauugugugauauaggugaaaguuccccaaauccaacaauugaagcagggcgaacccuccgaguccuaaaucuuguagagaacuggcuaaauaacaauacacaauuuuguauaaaggugcuuaacccauauaugccaagcguuauagagaaaauggaggcuuugcaaagaaaauauggaggagcauuagugaggaauccguuaaguagaaacaguacacaugaaauguauugggugagcaacgccacagggaauaucguuucaucuguuaacaugauuaguagaauguuaauuaaucgguuuacgaugaagcauaagaaagcgacuuacgagccugacguagacuuggguucgggaacaaggaauauuggaauagaaucagaaaucccuaaucuggacauaauuggaaagagaaucgagaaaauaaaacaagagcaugagacuucauggcacuaugaccaagaccaucccuacaaaacaugggcguaucacggcuccuaugagacuaaacaaacaggaagugcuucuucaaugguaaacggagucguucgucucuuaacgaagccgugggauguagucccaaugguaacacagauggcgaugacggacaccacaccguucggacaacaaagaguauuuaaagagaaaguagauacaagaacacaagaacccaaggagggaacgaaaaaguuaaugaaaaucacagcggaaugguuauggaaggaacuagguaaagagaaaacaccaagaauguguacgagagaagaguucacaagaaaggugaggaguaaugccgcguuaggggccaucuucacggaugagaacaaauggaaaagcgcacgugaggcagucgaggauggaagguucugggaauugguagauagagaacgaaacuuacaccuugaaggaaaaugcgaaacuuguguuuauaauaugaugggaaagagagagaagaaauugggugaguuuggaaaagcaaagggcucacgagccauaugguauauguggcuaggugcaagauuucuggaguucgaggcauugggauuucuaaaugaagaucauugguuuagcaggggcaauucacuaucuggagucgaaggcgaaggcuugcauagauugggauacauuuuacgcgauguagggaaaaaggaagggggugcuauguacgcagacgacaccgcuggcugggacacacgaauaacucuagaagaccugaagaaugaagagaugguaacgaaccauaugaaaggugaacauaagaaacuugcggaggcaaucuuuaaguugacguaucagaacaaagugguuagaguacaaagaccaacuccccgaggaacagucauggauauaauaucgcggcgagaucagcgcgggaguggucaagucggaacauauggcuugaacacauucacuaacauggaagcacaguuaauccgccaaauggagggugaaggaauuuucaagucaauucaacaccugacggcgacagaggaaaucgccguacaaaauugguuagcucgagucggacgagaaagauugagucgcauggcaaucaguggggacgauugcgucguuaaacccauagaugacagauuugccucagcauugacugcccuuaacgacauggguaaagugaggaaggauauucaacagugggaaccgaguagaggcuggaaugacuggacucaaguaccauucuguucacaccacuuccaugaauugguaaugaaggaugggaggguauuggugguuccaugucguaaucaagacgaacugauaggacgagcuagaauaagccaaggagccggauggucacuuaaagaaacugcuugucuuggcaaaagcuacgcucagauguggacauuaauguauuuucauagaagagacuuacgacuagcagcgaaugcgauaugcucagcuguuccuucacauuggguaccaacgucacgaacgaccuggaguauccaugcgaaacacgaauggaugacaacagaagacauguuagcaguuuggaaucguguuuggauucaagaaaacccuuggauggaagauaagacuccuguugaaucgugggaggaaguuccuuauuuagguaaaagagaagaucaauggugcggcagccucauugguuuaacaucgagagcaacgugggccaagaacauacaaacugcaaucaaucaaguacgcagcuuaauaggaaaugaagaauacacagauuauaugccuaguaugaaacguuucaggagagaagaagaggaagcuggaguucuaugguga

SEQ ID NO: 22415 - RNA, 9876 nt, Artificial Sequence
  derived and/or modified CDS sequence (opt6) from DENV-2__FJ906961__SS-prME
accgcgggcguuauaguuaugcuaauccccaccgcuauggcauuucaccugacaacaagaaauggggaaccccacaugauaguuggaagacaagaaaaaggaaagagcuuauuguuuaaaacagaagacgggguuaauaugugcacccuuauggcgaucgaucuuggagaacugugugaagauacgauaacauauaaauguccuuuacugagacaaaaugaaccugaagacauugacugcuggugcaacagcacaucaacguggguaaccuaugguacuuguacuacgacaggugagcaccgcagagaaaagagaagcgucgcgcuaguaccacacgucggaaugggccuagaaacaaggaccgaaacauggaugucauccgaaggugcauggaaacacguacagcggaucgaaacguggauuuugagacacccuggauucacaauaauggcagcgauacuagcuuauacgauuggaacaacacauuuucaacgugcauugauauuuauccugcuuacagcggucgcgcccucaaugacaaugagauguaucggaauaucgaaccgagauuuuguagaaggcguaucagguggcucuuggguagauauaguacuagaacauggcaguugcguuacaacaauggccaaaaauaaaccuacacuugauuucgaauuaauaaaaacagaagcaaaacaaccugcaacuuuacguaaauauuguaucgaagcuaaacuaaccaacacaacuacagagucaagaugcccuacacaaggggaaccaucuuugaaugaggaacaggacaaaagauucauauguaaacacucgaugguggaccggggauggggcaacgguuguggauuauuugggaaaggaggaaucguaacaugugcaauguucacuuguaagaaaaauauggaaggaaaagucguucaaccagagaaccuugaauacacaaucguuauaacgccacacucaggugaagaacacgcagugggaaacgauacaggaaaacauggaaaagagauaaaaauaaccccacaaagcagcauuaccgaagcugaauugacugguuaugggacuguaaccauggaauguaguccaagaaccggucuagauuuuaacgaaaugguguuacugcaaauggaagauaaagcauggcuaguucaucgacaaugguuuuuagacuugccguuaccguggcuuccaggcgccgauacucaaggauccaauuggauacaaaaagaaacauuaguaacauuuaaaaauccgcaugcgaagaaacaagacgugguaguccucggcagucaagaaggugcuaugcauacugcguuaacaggagcaacugaaauacaaaugaguaguggcaacuuacuuuucacagggcaucuaaaauguagguuaagaauggauaaacuccaacugaaagggauguccuacaguauguguacaggcaaguuuaagauagucaaagaaauagcagaaacucagcacggaacgauaguuauucggguucaguacgagggagauggcucaccguguaaaauaccauucgaaauuacugauuuagaaaaacgacauguuuugggucgacuaauaaccgucaauccuauugugacagagaaagauaguccagucaauauugaagcagagccaccuuucggagauucguauauuaucauugguguugaaccaggucaauuaaaguugaauugguuuaagaaaggcuccuccaucggacaaauguuugagacaacaaugcggggugcuaaaagaauggcgauauuaggugauacagcaugggacuucggaucacuaggagguguuuuuaccucuauuggcaaagcacuucaucagguauuuggagcaauauauggagcagcguuuaguggaguaaguuggacgaugaaaauacuaaucggcguaauaauuacauggauagggaugaacaguagaucuacgagcuuaagcguuaguuuaguuuuagucggaguagucacccuuuaccugggugcaaugguacaggcggauucaggauguguugugagcuggaaaaacaaggaacuuaaauguggaucaggcauuuuuauuacggacaacguucauacuuggacagaacaauacaaguuucagccagaaucaccaaguaaguuagcaagugcaauccagaaagcucaugaagaaggaauuugugggauuagaucuguuacuagacuugaaaaucuaauguggaaacagauaacaccugagcuaaaccauauccuaagugagaacgaaguaaaacugacuauaaugacuggugauauucgaggaauuaugcaggcaggcaaacgaucauuaagaccacaaccaaccgaacuuaaguauagcuggaaaacauggggaaaagccaaaauguuaaguacagaaccucauaaccaaacauuuuugauagauggucccgagacugcugagugcccaaacacaaauagggcauggaacucucuggaaguugaagauuauggauucggcgucuucacuacaaauauuugguuaaaacugcgagaaaaacaagaaguauuuugugauucaaaauuaaugagugcagcuauuaaagacaauagagcuguacaugcggauaugggauacuggauagaaagugcccucaacgacacguggaagauggagaaagcuagcuuuauugagguaaagagcugucauuggcccaagucccacaccuuauggaguaacggagucuuagaaucugaaaugaucauuccuaaaaacuuugcggguccaguaucacaacacaacuaucgaccuggauaccauacccagacugcuggaccuuggcacuuaggaaagcucgagauggacuucgacuuaugugaagggacaacuguuguagugaccgaagauuguggaaacagaggucccucauuaagaacuacuacagcaagcgggaaguuaauuaccgaaugguguugucguagcugcacguugcccccguuaagauauagaggugaagacggguguugguacggcauggagaucagaccgcuaaaggaaaaagaagaaaauuuaguaaauucucuaguaacggcaggucacggacaaaucgauaacuucagucuaggaguuuuagggauggcacuuuuucuggaagaaaugcuaagaacacggauagguacaaaacacgccauccuuuuaguagcugugucauucguaacccuuaucacaggaaauaugaguuucagagaucuagguagaguaauggugauggucggugcaacuaugacagacgauaucggaauggguguuacauauuuagcauuacuagcugcuuucaaaguuagaccgacuuucgcggcgggacuacuacuuagaaaauuaacguccaaagaauuaaugauggcgacaauaggaauagcuuuacuaagccagucgacuaucccagaaacgauauuagaauuaacagaugcauuggcacuugggaugaugguacuaaagauagugaggaauauggaaaaauaucaacucgcuguuacuauaauggcgaucuccuguguaccuaacgcagucauacuucagaaugcauggaaaguaaguuguacuauacuugcagcuguaucuguaucuccucuuuuauugacauccagucagcaaaaggcugacuggauaccauuagcacuaacuauuaaaggacuaaaucccacagcgaucuucuuaacuacgcuaaguagaacuucgaaaaagagauccuggccacuaaaugaagcgauaauggcaguuggaaugguguccauauuagccagcucccuauuaaagaacgauaucccuaugacuggaccauugguggcuggagggcuauugacugucugcuacguucuaacuggacgaucggcggaccuagaguuggaaagggcugcagauguaaagugggaagaucaagcagagauuucaggaucaucgccgauucuaucaauaacaauuucagaagacggcucaauguccaucaaaaaugaagaagaagaacaaacuuuaacaauucuaaucaggacagguuuacucgucaucucuggaguauuuccagugaguauaccuauuacagccgccgcgugguaccuaugggaagucaagaaacagagagcagggguucuuugggacguuccuaguccaccacccguugaaaaagcagaauuagaagacggagcguaucguauaaaacaacgaggaauacugggauacucucaaauaggugcaggaguauauaaagaaggaacuuuucauacuauguggcauguuacacggggcgcgguucuaaugcacagaggcaaacgcaucgagccaaguugggcugaugucaagaaggaucugauauccuauggugguggauggaaacucgaaggugaguggaaggaaggagaagaaguccaagugcuugcauuagagccugguaagaacccucgagccguacagacaaaaccaggaauauuuaaaaccaacacuggcacaaucggagcuguaucauuggauuucucacccggaacuucuggaaguccaauaguugacagaaaggggaaaguagugggacucuacggcaacggugucguaacaaggucuggggcauauguaagugcaauagcacaaacagaaaagucgaucgaggauaauccggagauagaagacgauauauucagaaagaaacgauuaacaauuauggaucuacaucccggagcugggaaaacgaaaagauaucuaccagcaauaguacgcgaagccauaaaaaggggacuuagaacauuaauacuggcaccaacacgaguagucgccgccgaaauggaagaagcacuaagaggauuaccgaucagauaucaaacaacugcaauaaaaacagaacauaccggaagagaaauuguugaucuaaugugccacgcgaccuuuacuaugagguuguuaucgccgguccgcgugccuaauuacaauuuaauaaucauggacgaggcucauuuuacugauccagcguccauagccgccagaggauauauaucgacacgaguagagaugggagaagcggcugggauauuuaugacugcaacuccgcccggaucaagagacccauuuccacaaaguaacgcaccgauaauggacgaggaacgggaaaucccagagcguagcuggaauagcggacaugaauggguuacagauuuuaagggaaaaacaguuugguuugugccgucaauuaaagcagguaaugacaucgcugcaugucuuaggaaaaacgguaagaaagugauacaacugucuagaaagacauucgauucggaauaugucaaaaccagagcaaacgauugggacuuuguaguaacaacagacauaucggaaaugggagcaaacuucaaagcggaaagggugauagauccacgacgauguaugaaacccgugauucuuacggacggggaagaaaggguaauuuuagcagggccaaugccugucacccauucaagugcagcccaaagacgugguaggauuggucgcaauccgaaaaacgaaaacgaucaguauauauauaugggagagcccuuggaaaacgacgaagacugcgcgcauuggaaagaagcuaaaaugcugcuugauaacaucaauacuccugaagguauaauaccgucgauguucgaaccagaacgggaaaaagucgaugcuauagacggugaauacagacugaggggcgaggcacgcaaaacguuuguugaccucaugcgaagaggcgacuugcccguauggcuagcauauaaaguagcugcugaagggauuaauuaugcugauaggaaaugguguuucgacgggaucaaaaacaaucaaauucucgaggaaaacauggaaguagaaauauggacaaaagagggugagagaaagaaauuaaaaccgcgcuggcuagaugcuagaauauacuccgacccacuagcccucaaagaauuuaaagaguucgcagcaggaagaaaaucguuaacauuaaaucuaauaaccgaaaugggcagauuaccuacguuuaugacacaaaaagccagaaacgccuuagauaaccuugcaguguuacauacugcggaggcuggugggcgagcguauaaccaugcauuauccgaauugccagaaacucuugaaacacuacuacuauugacucuccucgcuacugugacaggaggaauuuuucucuucuugaugagugggaaaggaauaggaaagaugacauugggaauguguuguaucauaacagcaucuauacuguugugguacgcacagauccaaccccacuggauagcggcgucuauaauauuagaguucuuucuaauaguauugcugauaccggagccggaaaaacaaagaacaccucaagauaaucaguuaacauauguaguuaucgcaauccuaacugugguagcagccacgauggcgaacgaaaugggauuuuuagagaaaacgaagaaagaucuggggcuaggaucaauuaccacacaagaaagcgaaucaaacauucuugauaucgaucuacguccagcgagcgcguggacacuauacgcgguagcgacuacauuuguaaccccaaugcuucgacauaguauagaaaauucgucggugaaugucucguuaacagcuauugcaaaccaagcaacagucuuaaugggauuaggaaaaggauggccccuauccaaaauggauauuggggugccuuugcuagccauaggaugcuauucccaagucaauccaauuacacugacagccgcacuauugcuauuaguugcgcauuacgcaauaauaggaccaggguuacaagcgaaagcaacaagggaggcgcaaaagagagcagcugcagguauaaugaaaaauccaacaguagacggaauaacgguuauagaccuagaaccuauuccauacgauccaaaauuugaaaaacaacucggacaaguaauguuguugauauuguguguaacccaaguacuuaugaugagaacuacuugggcuuuaugcgaggcucucacucuugcgacaggacccauaucuacguuaugggagggaaauccuggcagguuuuggaauacuacaaucgcaguuucaauggcaaacaucuucagaggcucauacuuagccggugcugguuuguuauucaguauaaugaaaaacacaacuaauacucgucgaggcacuggcaauauaggugaaacucuaggugaaaaauggaagagucgguuaaacgcuuuaggaaagucagaguuucaaauauacaagaaaucggggauacaggagguagacagaacgcucgcuaaagaggggauuaagagaggugaaacagaccaucaugcgguuaguagaggaucugcaaagcuaagaugguuugucgaacgcaauaugguaacacccgaaggcaaagugguugaccuaggauguggccguggaggauggaguuauuauugcggaggacucaaaaauguacgugaaguuaagggguuaacaaaagggggacccgggcaugaggagccgauuccaaugaguacauauggguggaaucuaguacgucuccagucugggguagauguguucuuuacaccacccgaaaagugugacacauuauuaugcgauauaggagagucaaguccaaacccgacgaucgaagcuggucgcacccuaagaguccucaacuuagucgagaauugguuaaauaacaacacccaauucuguauaaaaguccucaacccauauaugccaucagucauugaaaagauggaagcacuccaaagaaaguacgguggagcccuagugcggaaucccuuaucgaggaacaguacccacgaaauguauuggguuucaaaugcaacugggaauauuguauccucuguuaauaugauuaguagaauguuaauuaaccgcuucaccaugaaacacaagaaagcaacguaugaaccagacguggaccuaggauccggcacccgcaauauagguauugaaagugaaauaccaaauuuagauauaauuggaaaacgaaucgagaagauuaaacaggaacacgaaacauccuggcacuaugaucaagaucauccguacaaaacaugggcguaccaugguucauaugaaacaaaacagacaggaagcgccagcuccauggugaauggaguuguucggcuuuugacuaaaccuugggacguaguaccgaugguuacacagauggccaugacagacaccacaccauuuggccaacaaaggguuuucaaggaaaaagucgacacucgaacacaagagccuaaagaaggaaccaagaaauuaaugaaaauuacugcagaauggcucuggaaagaguugggcaagaagaaaacuccuagaauguguaccagagaagaauuuacuaggaaaguacguagcaaugccgcgcucggcgcaauauuuacugacgaaaauaaauggaaaucugcacgagaagcaguagaggacggccgcuuuugggaguuaguagaucgggagcgcaauuugcauuuggaagggaagugugaaacauguguauauaacaugaugggaaaacgagagaagaaacugggagaguucgggaaagcgaaaggaucucgggcaauuugguauauguggcuuggggcucguuuucuugaguucgaagccuuaggauuccuuaacgaagaucacugguucucuagggguaacucauuaaguggcguagaaggggagggacuucaccgccuagguuauauuuugagagacguaggcaagaaagaaggaggggcaauguaugccgacgauacugcaggaugggauacaaggaucacguuggaggaucugaaaaaugaggaaaugguuacaaaccacaugaaaggagaacauaaaaaguuggcagaggcaauuuuuaaacugacguaccaaaauaaagugguacgaguucaacgaccuacuccacgugggacagucauggauaucauaagccgcagggaccaaagaggaucagggcaagucggaacguacggacucaacaccuucaccaacauggaagcacaauugauccgucaaauggaaggagaaggcauuuucaaaucaauacaacauuuaacggcgacugaagaaaucgcuguacaaaauuggcuugcacguguagguagagagagauugucgagaauggcuauaucaggggaugauuguguagucaaaccaauugacgaccgauucgcaagugccuugaccgcucucaaugauauggguaaaguaagaaaggauauccaacagugggaaccuucgagggguuggaacgacuggacgcaagugccauuuugcucacaucauuuccacgagcuaguuaugaaagacggucgcgugcuuguggucccguguagaaaccaagaugaacuuaucggcagagcaagaauaucacaaggugccggguggucgcuaaaagaaacugcuugucuagggaagucauacgcacaaauguggacucuaauguauuuucaucguagagauuuaagguuagcagcaaacgccauauguagugcugugccaagccauugggugccaacuucacgaacuacuugguccauucaugcaaaacacgaauggaugacaacagaagauaugcucgccguauggaaucgaguguggauucaagaaaaccccuggauggaagacaaaacuccuguagaaucaugggaagaaguaccuuaucuaggaaaaagagaagaccaaugguguggaucacucauaggucuaaccaguagagccaccugggccaaaaacauucaaaccgcuauaaaucagguacguagccuaauuggaaacgaagaauauaccgauuauaugccauccaugaaaagauuuaggagagaagaagaagaagccggugugcuaugguaa

SEQ ID NO: 22416 - RNA, 9876 nt, Artificial Sequence
  derived and/or modified CDS sequence (opt6) from DENV-2__FJ906962__SS-prME
accgcuggcguuauuguaaugcuaauaccuacggcuauggcuuuccaucugacuacacgaaauggugaaccacacaugaucgugggccgucaagaaaaaggaaaaucucucuuauucaaaacagaagacgguguuaauaugugcacccugauggcaauugauuugggagaacugugugaagauacaaucacauauaaaugcccuuuguuacgccagaaugaaccagaagacaucgauuguugguguaacaguacuagcacauggguaacauaugguacuuguacgacaacaggggaacauagacgggaaaaacgaucuguggcguuaguaccacaugucgggaugggacucgaaacucgaacggaaacuuggaugaguucagaaggugcauggaaacacgugcaaaggauagaaacauggauuuuaagacauccaggauucaccauaauggcagcuauuuuggcauauaccauaggaacuacucauuuccagcgugcacuaaucuucaucuuauuaacugcuguggcaccuagcaugacgaugagauguauagguauauccaaucgugacuuuguggaaggaguuaguggagggucuugggucgacauuguacuagaacauggcucauguguaacuacuauggccaaaaacaaaccgacucuggauuuugaacugaucaaaacagaagcaaaacaaccagcaacuuugcgaaaauauuguauagaagcuaaauuaacuaauacuacgacggaaagcagauguccaacgcaaggcgaaccuucauuaaaugaggaacaggauaaaagauucauuuguaaacacucaaugguggacagagggugggguaauggaugcggauuguucgggaaagggggaaucguuaccugugcuauguuuacauguaagaaaaauauggaagguaaaguaguucaaccggagaaccuagaauauacaaucgugauaacaccacauaguggagaagaacaugcggucggcaaugauacaggaaaacaugguaaagaaauaaaaauuacaccacaaaguucaauuacagaggcagagcucacuggauacggaaccguaacuauggaguguaguccaagaacuggauuagauuucaaugaaauggugcuccuacagauggaagauaaagcauggcuugugcauaggcaaugguuucuagaucugcccuuaccaugguugccaggugcugauacccaggguuccaauuggauccagaaagaaacacuuguaaccuucaaaaacccucaugcgaagaaacaagacguaguaguacucggaucucaagaaggcgcuaugcauaccgcguuaacuggggcuacugagauucaaaugagcucaggaaauuuacuuuuuaccggacaucuaaaaugucgacugcgaauggauaaauuacaguuaaaagggaugaguuacagcaugugcacaggaaaauucaaaauaguuaaagagauugcggaaacacaacauggcacgaucguuaucagaguacaauaugagggugacggaagucccuguaaaauacccuuugaaauaacggaccuagagaaacgacauguuuugggacgucuaauaacggucaauccaaucguuacagaaaaagauucuccuguuaauaucgaggccgagccuccauuuggugauagcuauauaaucaucggaguggaaccaggacaacuaaaauuaaauugguuuaagaaaggcucgucaauuggucaaauguucgagacgaccaugcgcggagccaaacguauggcaauauuaggggauacggcuugggauuucggaucguuaggagguguuuuuacauccauugguaaagcucuacaccaaguauucggagcaaucuauggugcagccuucucuggagucaguuggacaaugaaaauacugauuggcgucauuaucacauggauaggcaugaacucacgcucaacaagucugagcgucuccuugguguuaguuggcguaguaaccuuguaucuaggagcuaugguucaagcugauucaggcugugugguaucauggaaaaacaaggaacucaagugcggaucaggaauuuuuauaacggauaauguucacacauggaccgaacaauauaaguuucagcccgagucuccaaguaaauuagcaagcgcaauccaaaaagcacaugaagaagguauaugcgggauaagaucggugacacgacuugaaaaucuuauguggaaacaaauuacaccagaauuaaaucauauacucagugaaaacgagauuaaguugacgauaaugacuggagacauuaggggaaucaugcaagccggcaaaagaucuuugagaccacagccaacggaauuaaaauacagcuggaaaaccugggguaaagcuaagauguugaguacagaaagucauaaccaaacguuucuuaucgacggaccugaaacugcagaaugcccgaauacaaacagggcuuggaauagucuagagguagaggauuauggauuuggggucuuuacaacuaacauuugguuaaaguuacgagagaaacaagauguauuuugugacuccaaauuaaugucugcagcaaucaaagauaacagagcuguucaugcugacaugggauauuggauagaaucagcuuuaaacgacacauggaaaauggaaaaagcgaguuucaucgaaguaaaaucgugccauuggcccaaaucucauacacucuggagcaacggcguacucgagagugaaaugaucauucccaaaaacuuugcuggcccaguuagccaacacaauuauaggccgggauaccacacacaaacagccggaccuuggcauuugggcaaguuagaaauggacuuugauuugugugaggggacaacagugguaguaacagaggacugcgguaacagagguccuagucuuagaacaacgaccgcuucugggaaacuuauaaccgaaugguguuguaggaguuguacccuucccccgcuacgauaucguggagaagauggaugcugguaugggauggaaauucggcccuuaaaggaaaaagaagaaaauuugguaaauagucuggucacagcaggccacgggcaaauagauaacuucucauuaggcguacuagggauggcucuuuuucuggaggaaaugcuaagaacgcguauagggacgaaacaugccauacuauuaguugcaguauccuuugucacucugaucacagggaacaugagcuuucgagauuugggcaggguaaugguaaugguuggugcuacaaugaccgaugauauagguauggguguaacuuauuuggcacugcucgccgcauuuaaggugcgcccaacuuucgcagcuggccuauugcugagaaagcuaaccaguaaagaacucaugauggcaacuauagggauagcuuugcuaucacagaguaccauaccggagaauauauuggagcuaacggaugcauuagcauuggguaugaugguuuuaaaaauaguacgaaacauggaaaaauaccaauuggcaguaacaauuauggcaauuucuugcguuccaaaugcaguaauuuugcaaaaugcauggaaaguaucauguacaauuuuagcagcaguaagcguuucuccacuauugcuuacuucgagucaacagaaggcagacuggauaccucuagcgcuaacgauaaaaggucugaauccaacggcaauauuccuaacgacucuuuccagaacgagcaagaaacgcuccuggccacuaaacgaagccauuauggcuguugguaugguaagcauuuuagcauccucucuacuaaagaaugauauaccaaugaccggaccguuaguagcaggaggguuauugacuguaugcuauguacuaacuggaagaucugccgaccuagaacucgaaagagccgcggauguaaagugggaagaucaagcagagauaucgggaucuucgcccauacuaucaauaacaauaucggaagacgguuccaugagcauuaaaaaugaagaagaagaacaaacgcuaacuauccuuauacgaacaggcuuauuaguuaucagugggguauuuccgguuagcauucccauuacggcagcugcuugguauuuaugggaagucaagaaacagcgggcaggaguauuaugggauguuccaucuccaccaccaguggaaaaagcggaauuagaagauggagccuauaggauaaaacaaagaggaauauugggcuauucacagauuggagcgggaguguauaaagaagguacauuucacacaauguggcacguaacucgcggugccguuuuaaugcaucgggguaagcgaauugaacccucgugggcugaugucaagaaagauuuaauaagcuaugggggcggcuggaaauuagaaggagaauggaaagaaggugaggaagugcaggucuuggcucuagaaccagguaaaaauccuagggccguccagacaaaaccaggaauuuuuaaaaccaacacgggcaccauaggcgcaguaagccuagauuuuaguccaggaacuucagggucuccuaucguugaucggaaggggaaggugguaggucuauaugggaauggcguagugaccagaaguggagccuauguaagcgcgauugcacaaacugaaaaauccauagaagacaauccagaaauagaagacgauauuuuuaggaaaaagcgacuuacaauaauggaccugcaccccggugcuggaaaaacgaaacgauaucuuccugcuaucguaagggaagcuauaaaacgaggacuaaggacacugauacuugcaccuacaagagucguugcggcagagauggaagaggcuuuacguggauuaccaauacguuaccagacuacugcuauaaaaacugaacacaccgggagagaaauaguagacuuaaugugucacgcuacauucacaaugagacuuuugucucccguaagagucccuaacuauaaucuuaucauaauggaugaagcccauuuuacagauccugccuccaucgcggcaagaggcuacauuaguacccguguagagaugggcgaggcugccggcauauucaugacagccacacccccaggaucgcgugacccauuuccacaaucgaacgcuccaauaauggaugaagaaagagagauaccagaaagaucauggaacucugggcaugaauggguaaccgauuucaaagguaaaacuguuugguucguacccuccaucaaagcagggaaugauauugcugcauguuuacgcaaaaauggcaagaaagucauccaauuaucgagaaagacguuugacagcgaauauguuaaaacgagggcgaaugauugggauuucguagugacaacagauauaagugaaaugggagcaaauuucaaagcagaaagaguuauagauccaagaagauguaugaagccaguaauccuaacagauggcgaagaaagaguaauauuagcgggaccaaugccugugacucauuccagugcugcucagcgcagagguagaauaggccggaaucccaaaaaugaaaaugaccaauacauuuacaugggcgagccauuagaaaaugacgaagacugugcucacuggaaggaagcuaaaaugcuccuugauaauaucaacacaccagaaggcaucaucccaucuauguuugagccagagagagagaagguugacgcaauagacggagaauaucgacuacguggagaggcucguaaaacauucguugaucugaugagaagaggcgaccugccuguauggcuggccuacaagguugccgcggaagggauaaauuacgcagauagaaaauggugcuucgaugguaucaaaaauaaccaaauacuagaagaaaauauggaaguugaaauuuggaccaaagaaggcgaacguaaaaaguugaagcccagaugguuggacgcaaggaucuacucagacccacuugcguuaaaagaauuuaaagaauuugcugcagguaggaaaucauuaacacuaaaucucaucacugaaaugggaagauuaccaaccuucaugacccagaaagcuagaaaugcucuugauaaccuagcagucuuacacacagcugaagcaggcggaagggccuacaaucacgcuuuaucugaacuaccagaaacacuggaaacucuacuucuguuaacauugcuagcgacagucaccgggggaaucuucuuauuucuaaugaguggaaagggaauuggaaaaaugacacucggcauguguuguauuauaacggcaaguauauuauugugguaugcacaaauacagccucacuggauagcagcuucgauuauacucgaguucuuuuuaauuguacuccuaauucccgagccagagaagcaaagaacaccacaggacaaucaacuaacauauguuguuauugcaauuuuaaccguuguggcagccaccauggcuaaugaaaugggauuuuuagagaaaaccaagaaagacuuagggcuagguaguauaaccacccaggaaucugaaagcaauauacuggauaucgacuuaagacccgcaagugcuuggacacuguaugcaguggcaacaacauucguaacaccaauguuaaggcacaguauagaaaacucgagcgucaauguuagcuugacagcaauagcaaaccaagcuaccguacuaaugggauuaggaaaaggguggccucuuagcaagauggauaucggcgucccguugcucgcgauuggguguuauagucaggugaauccaauaacacuuacagccgccuuacuucugcucguugcacauuaugcaauuauuggaccagggcuccaggcuaaagcaacgcgagaagcccagaaaagagcggcagcaggcauaaugaaaaauccaacaguagacggaaucacaguuaucgacuuagaaccaauacccuacgacccaaaauuugagaaacaauugggacaagucaugcuuuuaauacuuugcguaacacaggugcuuaugaugcguacaacaugggcacuaugcgaagcucuuacucucgccacaggccccauaaguacuuugugggaaggaaauccggggcguuucuggaauacaacgauagccguuaguauggccaacauuuuccgaggaucguaccucgcgggugcaggauuguuauuuucgauuaugaagaauacaacgaacacacgacgagguacaggaaauauaggugaaacacuuggugaaaaauggaaaucacgacugaacgcucuggguaaaucagaauuucaaauuuacaagaaaucaggaauacaagaaguagaccgaacacuagcgaaagaggggauaaagcguggagaaacagaccaucaugcgguuucuagagggucugcgaagcuaaggugguuuguagaacgaaauauggucacaccugaaggaaagguaguagaucugggcuguggcagagguggauggucauacuauugcgguggcuuaaagaacgugagagaagucaaaggucuaaccaaaggagguccgggccacgaggaaccgauaccuaugagcacauacggcuggaaccucguacggcugcaaucaggcguggaugucuucuuuacaccgccggaaaaaugcgacacccucuuaugcgauauaggggaaucuucaccuaauccaacaauugaggccggacgaacguugagaguccuuaauuugguagaaaauuggcugaacaauaacacacaauuuuguaucaaaguacucaauccauauaugccgucaguaauagaaaagauggaggcacuacaacggaaauaugggggcgcacucgugaggaacccgcugagcagaaauaguacgcacgagauguauugggucucaaaugcuacuggaaacaucguaucuucgguaaacaugauaucaaggaugcugauaaaccgauucacuaugaaacauaagaaagcaacauacgaaccugaugucgauuuagguagugggacgcgcaacaucgggauugagucagaaauuccgaaucuagacauaauaggaaaacggaucgagaaaauuaaacaagagcacgaaacaaguuggcauuaugaucaagaucauccauauaaaacaugggcauaucaugguuccuaugaaaccaaacaaacgggaucugcaaguaguaugguaaauggaguugugcgccuuuugacuaaacccugggaugucguaccaaugguaacgcaaauggcaaugacagauaccacaccauucggccaacaaaggguauuuaaagaaaagguugacacacgcacacaagaaccuaaagaagggaccaaaaaguuaaugaagauuacggccgaguggcuauggaaagagcuagguaagaagaaaacacccaggauguguacuagagaggaauuuacaagaaaaguucgaagcaaugcugcuuuaggagcaaucuuuacagacgaaaauaaauggaaaagugcaagagaagcaguagaagaugguagauuuugggaacuuguagacagggaaagaaauuuacacuuagaagggaaaugugaaacuuguguuuacaacaugauggguaaaagagagaagaaacugggugaguuugggaaggcgaaagguucgcgugccauuugguacauguggcuuggugcuagauuucuggaguucgaggcacuaggauuucuaaaugaagaucauugguuuagucgaggaaauagucucucagggguugagggcgaaggguuacaccgucuaggauauauauuaagagauguagggaagaaagaaggcggagccauguacgccgacgacacagccgguugggacacacguaucacucucgaagacuugaaaaaugaagaaaugguaaccaaccacaugaaaggagaacauaagaaauuagccgaggcaauuuucaaauuaacuuaccagaacaaggucguuagagugcaaaggcccacaccacgagguaccguaauggacauaaucucuagaagggaccaaagagguucaggacagguugguaccuauggccuaaauaccuucaccaauauagaagcacaauugaucaggcaaauggagggcgaagguauauucaaaagcauacagcaccuaacagcaacagaagaaaucgcgguccaaaacuggcuagcacgcguuggacgcgaacgcuuaucuagaauggcaauuaguggugaugacuguguugugaaaccgauagacgauagguucgcaagugcuuuaacugcucucaaugacaugggaaagguucguaaagauauacagcaaugggaaccaucacgagguuggaacgauuggacucaaguuccauucuguagccaccauuuucaugaacuugugaugaaagacggaaggguauuaguugucccuuguaggaaucaagaugaauuaauaggucgagcucgaaucagccaaggugcaggauggucacuuaaagagacugcaugccuuggaaaaucauaugcacaaauguggacgcugauguacuuccacaggagagacuugcgguuagcagcaaaugcaauauguucagcagucccuagccauuggguaccgacuagcaggacaacauggucaauccaugcaaaacacgaauggaugacaaccgaagacauguuagcaguauggaacagagucuggauacaagaaaaucccuggauggaggacaagacucccguugagucgugggaagaaguaccauaucuugguaagcgagaagaucaauggugugggucucuaauaggacuaacaucgagggcgacgugggccaaaaauauccaaacagcuauaaaccagguccggucacuuauuggaaaugaagaauauacggacuauaugccaaguaugaaaagauuucguagggaagaggaggaagccggcguucuaugguaa

SEQ ID NO: 22417 - RNA, 9876 nt, Artificial Sequence
  derived and/or modified CDS sequence (opt6) from DENV-2__FJ850053__SS-prME
acagcuggaguuauaguaaugcugauaccuacagcuauggcguuccauuugacaacaagaaauggggaaccucauaugauagugggaagacaagaaaaagggaaaucauuauuauuuaaaacugaagacgggguaaacaugugcacucugauggcuauagaucugggagaauuaugugaagacacaauuacauauaaauguccauuacugagacaaaaugaaccagaagacauagacugcugguguaacuccacaagcacguggguuacauacgggacaugcacuaccacuggagaacauagacgagaaaaacggagcguagcccuaguuccgcacguuggaaugggauuagaaacaagaacugaaaccuggaugucaucagaaggugcauggaaacauguacaaagaauugaaacauggauacuaaggcauccaggguuuacaauuauggcagcaauuuuagcuuauaccauaggaacuacgcauuuucaaagagcucugauauuuauacuucuaacggcagucgcaccuagcaugacuaugcgaugcauaggaauaaguaauagggauuucgucgaagguguaaguggagggucguggguugacauagugcucgaacauggcaguuguguaacaacaauggccaaaaacaaaccgacacuggacuuugaauuaauaaaaacugaagcuaaacagccugcaacauuaagaaaauacuguauagaagcaaaacuaaccaacacuaccacagagagccguugcccgacucaaggcgaaccaagccuaaacgaagaacaggauaaaagguuuaucugcaaacauaguaugguagacagaggcuggggcaaugguugcggucuauuuggcaaaggagguauuguaacgugugcuauguucaccuguaagaaaaacauggaaggaaaagucguacaaccagaaaaccucgaguauacaauuguaauaacaccgcauucuggagaagaacaugcuguagguaaugauacgggcaaacauggaaaagaaauuaaaauaacaccacaauccaguauaacugaagcagaacuaacugguuacgguacagugacaauggaaugcucaccacgaacuggccuugacuuuaaugaaaugguacuacuacaaauggaagauaaagcaugguuggugcauagacagugguuuuuagaccucccccuacccugguuaccaggggcagacacacaaggaucaaauuggauacaaaaggaaacauugguuacauucaagaauccccaugcuaagaaacaagacguaguaguacuuggaucgcaagaaggagcuaugcacacagcacugacaggugcaacagagauacagaugaguagcgguaaccuccuauuuacaggacaccucaaauguagacuuagaauggacaaacuucaguuaaaggggauguccuauucaaugugcacuggaaaauucaaaauaguaaaggaaaucgcugagacccaacaugggacuauaguuauucgaguacaauacgaaggggauggaucaccuuguaaaauaccuuuugagaucacagacuuagaaaaacggcaugucuuaggacgccugauuacagucaacccaaucgucaccgagaaggacucucccguaaacauugaagcggagccaccuuucggcgauaguuacauaaucauagggguagaaccuggucaacuaaaacuuaacugguucaagaaaggaucuucuauaggacaaauguuugaaaccacaaugaggggcgcaaaaagaauggcaauuuugggcgauacugcaugggauuuuggaagccuugggggagucuucacaucgauugggaaagcucuacaccaaguauucggcgcaauauacggggcagcauuuucagguguuucuuggacaaugaaaauccuaaucggagucauaauuacguggauaggcaugaacucuaggucaacaaguuuaucgguuucauuaguucuaguaggaguuguaacacuauaucucggagcaaugguccaagcagauagugggugcgucguaucauggaaaaauaaagaauugaaaugcgggagcggcaucuucauaaccgauaauguacauacuuggacagagcaauauaaauuucagccugaaucucccagcaaauuagcaucugcuauacaaaaagcccaugaagaaggaauuuguggcauucgauccgugacccgacuggaaaauuuaauguggaagcaaauuaccccugaacuaaaucauauacucagcgaaaaugaagugaaauuaacuauaaugacgggagacauaagaggaauaaugcaagcugguaaaagaucccuucgcccacagccaacagaacuuaaauauucauggaaaacuuggggaaaagcaaaaaugcuuucuacagaaccccacaaucagaccuuuuuaaucgauggaccagagacugcagaauguccaaauacgaaucgugcauggaacucacuagagguggaagacuaugguuuuggaguguucaccacaaauauaugguuaaaguuacgagagaaacaagauguguuuugugauaguaaacuuaugucagccgcaauaaaagauaaucgugcaguccaugcugacaugggguacuggauugaauccgcguugaaugauacauggaaaauggagaaagcuaguuuuaucgaaguuaagucuugucacuggccaaaaucccacacuuuauggaguaauggaguuuuagaaagugaaaugauuauacccaaaaauuucgccggacccguaagccaacauaauuaccguccugguuaccacacgcagacggcaggucccuggcacuuggggaaacucgaaauggacuuugacuuaugugaaggaacuacugugguaguaacugaagauugugguaacaggggacccagcuuaagaacuacaacggcaucuggcaaacucaucacagaaugguguugccgcucuuguacgcugccuccccuaagauauaggggagaagacggguguugguauggaauggaaauucgaccccuaaaagaaaaagaagagaacuuaguuaauuccuuaguaaccgcuggccacggucaaauagacaacuucagucuugguguauuagguauggcacuauucuuagaagaaauguuaagaacaagaauuggaacaaaacacgcaauauuauuagucgcgguuucguuuguuacucuaauaaccgguaacauguccuuucgagaucuaggacggguaaugguaaugguaggugcaacuaugacugacgacaucggaaugggcguaacuuaucuagcacuacucgcagcguuuaaaguccggcccacguucgccgcaggccuccuuuugagaaaauugacaucuaaggaacugaugauggcuacuauuggaauagcauuacugucacagucaacaauuccagaaacuauuuuagaauuaacugaugcguuggcacuaggaaugaugguauuaaaaauaguucgaaacauggaaaaauaucaacuugcuguuacaauaauggcgauuucaugcguacccaaugccgugaucuuacaaaacgccuggaaagugagcuguacgauauuggccgcaguaagugucaguccuuuguugcuaacaucuagccaacaaaaagcagacuggauuccguuagcgcuaaccauaaaaggacugaauccaacggcaauauuucucacgacccuaagccgaacaaguaagaaacggucguggccucuaaacgaggcaaucauggccguugguaugguaucaauccucgcaagcucuuuacuuaaaaacgauauaccuaugaccggaccacuugucgccgguggacuccucaccguauguuacguauuaacaggccgcagugcagacuuagaauuggaaagagcagccgacguaaaaugggaagaucaagcagaaauaaguggcucgaguccgauauuaucaauaaccauuuccgaagauggcagcaugaguaucaaaaacgaagaagaagaacagacauugacaauuuuaauuagaacgggccuauuagugauaagugguguuuuuccuguaucaauaccuaucacggcggcagcaugguaucugugggaagugaagaaacaacgugcaggcguucuaugggauguaccuuccccuccuccaguugagaaagcagaacuggaggacggggcuuacagaauaaaacagcgugguauccuuggcuauagccaaauaggagcaggcguguauaaggaaggcaccuuucacaccauguggcacguaacuagaggugcaguauuaaugcauagaggaaaacguauagaaccuucuugggcagaugucaagaaagauuuaaucuccuacgguggaggguggaaacuugagggagaauggaaagaaggagaagaaguucagguauuagcauuggaaccaggcaaaaauccacgcgcaguccaaacuaaaccugggauauuuaaaacgaauaccggcacgauaggagcaguaagccucgauuucucgccgggcacuucuggauccccuauaguggacagaaaaggaaaagucguaggauuauacggaaauggggugguuacucgcaguggagcguauguuucugcgauagcacaaacagaaaaguccauagaagauaauccagaaaucgaagacgauauauuuagaaagaaacgucucacuaucauggaccuccauccgggugccggaaaaacuaaacgguacuuaccugcuauuguuagagaagcaauaaaacgaggauuacgaacccucauauuagcgccuacuaggguaguggccgcagagauggaggaagccuuacgggguuuaccaauaagauaucaaacgacagcaauaaaaaccgaacauacggggagagagauugucgaccuuaugugccaugcaacuuucacaaugagacuacuaaguccagugaggguuccaaacuauaauuuaauuauaauggaugaagcucauuuuacagaucccgcgucaauagcugcacgaggauacaucaguacccgaguugaaaugggagaagcagcuggcauauuuaugacugcuacuccgccaggaucccgagaucccuuuccucaaucuaaugccccgaucauggaugaagaaagagagauuccagaacgaagcuggaacucagggcaugaaugggugacugacuucaaaggaaaaacuguaugguuugugccaaguauuaaagcaggaaaugacauugccgcaugccuaaggaaaaauggcaagaaagucauucagcucagucguaaaacauuugauagcgaguauguuaaaacacgagcaaaugacugggacuucguuguuacuaccgauauuucggaaaugggagcuaauuuuaaagcagagcgugucauagaucccagaagaugcaugaaaccuguaauauuaaccgauggcgaggaaagagucaucuuggccggaccaaugcccgucacccacaguucagcagcucaacggcgaggaagaauaggucgaaaccccaaaaaugaaaaugaucaguauaucuacaugggagaaccccuagaaaaugaugaagauugugcucauuggaaagaagcaaaaaugcuauuggauaacauaaacaccccagaagguauaauucccucaauguuugaaccugagagggaaaaagucgaugcaauugauggggaguacagacugagaggagaagcaagaaaaacauucgucgaucuaaugagacgaggugauuuaccaguaugguuggcuuauaaaguugcggcugaaggcaucaauuacgccgacaggaaauggugcuuugaugguaucaaaaacaaccaaaucuuggaagaaaauauggaagucgaaaucuggacaaaagagggagaaaggaagaaacuuaaacccaggugguuggaugcucggauauauucagauccucuagcucuuaaagaguucaaagaguuugcagcagguagaaaaucacucacuuuaaaucuaauaacugagaugggacguuuaccgacauuuaugacucaaaaagccaggaaugcucuagacaaucuugcuguauuacauacagcggaggccggugggcgagccuauaaucaugcuuuaucagagcucccugagacacuagaaacgcuccuacuucuuacauuauuagcgacagucacaggcggcauuuuccuauuucuaaugucagggaaaggaauaggaaagaugacccucggaaugugcugcaucaucaccgcaucaauacucuugugguaugcacaaauacagccucauuggauagcagcaaguaucauauuagaguucuuuuuaauuguccugcugauacccgaaccagaaaaacaacgcaccccgcaagauaaccagcuuacauacgucgucauugccauuuuaacaguuguggcagcgacaauggcaaaugaaaugggcuuucuugaaaagaccaagaaagaccuaggguuagggucuauaacaacccaggaaucugaaucuaacauacuugauauagaucuuaggccggccagugcauggaccuuguacgcaguggcaacgacguucguuaccccaauguuacgacacucuauugagaacagcagcguaaauguguccuugacagcaauugcaaaucaagcuacuguauuaaugggacuuggaaaaggcuggccuuugaguaaaauggauauagguguaccacuacuagcuauaggaugcuacagucaagugaaccccauaacacucacagcugcguugcugcuuuuaguggcccacuacgcgauuauaggcccgggucuucaagcgaaagcaaccagggaagcccaaaaacgugccgccgcugggauaaugaaaaacccaacugucgaugguauaacugucauagaccuugaaccaauaccauaugauccuaaauuugaaaagcaacugggucagguuauguuacugauucuauguguaacccagguauuaaugaugagaacgacaugggcauuaugugaggcuuuaaccuuagcuacaggaccaauaucuacacuaugggaaggaaaucccggaagauuuuggaacacuacgauugcuguaaguauggcaaacauauuuaggggcagcuacuuagcgggagcaggacugcuguuuaguaucaugaagaacacuacuaacacacgaagagggaccggcaauauuggagaaacacucggcgaaaaguggaagucucgauuaaacgcccucggaaagagugaauuucaaauauacaaaaaguccggcauucaggaaguagaucguacauuggcaaaagaaggaauaaagagaggagaaaccgaccaucaugcagucuccagaggaucagccaaguuacgaugguuuguggaaaggaacauggucacucccgaaggcaaaguuguugaucuagggugugguagggguggguggaguuacuacuguggcggacucaaaaauguaagggaggucaaaggucucacuaagggugggccaggccaugaagaaccgauuccgaugucuaccuacgguuggaaucuaguacgguuacaaagcggaguagacguauucuuuacgccucccgaaaaaugugacacauuacuaugcgauauuggggaauccucaccgaauccaacuauagaagcugguaggacauuacgcguacuuaaucuggucgaaaauugguuaaauaauaacacgcaauuuuguauaaaagugcugaauccauauaugccgucgguaauagagaaaauggaagcauugcaacggaaauaugggggagcauuaguucguaacccauuaucucgaaauaguacacaugaaauguauuggguuaguaacgcgacaggaaacauuguuuccaguguaaacaugauaagcaggaugcuuauuaacagauuuacaaugaaacacaagaaagcgacauaugaaccggauguugacuugggguccggaacgagaaacauaggaauagaaagcgaaauaccaaauuuagacaucaucggaaaacggauagagaaaauuaagcaagaacaugaaacaucguggcacuaugaccaggaucaucccuauaaaaccugggcauaucauggaucguaugaaaccaaacagacaggaucugcuaguagcauggucaacggggucguccggcuacucaccaaaccaugggaugugguaccuaugguaacccaaauggccaugacugauacaacuccauuuggacaacagaggguguucaaggaaaaaguggauacaagaacacaagagccuaaagagggcaccaagaaacuaaugaaaauaacugcggaauggcucuggaaagaauuggguaagaaaaagacaccucgaauguguacgagagaagaguuuacgagaaaagucagaucaaacgcagcuuuaggggcaauauuuacggacgaaaauaaguggaagagugcucgagaagcuguagaagauggacguuucugggaacuuguagauagggaacgaaaccuacaucuugaaggaaagugugagacgugcguauauaacaugaugggcaagagagagaagaaacuaggagaauuugggaaagcaaaagguucaagggcaauaugguacauguggcugggugcacgauuucuugaguuugaggcacuagguuucuuaaaugaagaccauugguuuucacguggaaauucucuuaguggcguugagggagaaggacuacaccgcuugggauauauacugagggauguugggaagaaagaagguggggcaauguaugcugacgauaccgcaggaugggauacgcguauuaccuuagaagaucucaaaaaugaagaaaugguaacaaaucauaugaaaggagagcauaagaaauuagcugaagcuauuuuuaaguuaacguaucaaaauaaaguugucagaguacagcguccuacuccucgcgguacuguuauggauauaauaucucggagagaccaacgggguaguggacaaguaggaaccuauggauugaacacuuuuaccaauauggaggcgcaacuaauucgccagauggagggagaggguaucuucaaaucaauucaacacuuaacagcuaccgaagaaauagcuguucagaauugguuagcccggguagggagagaacgucucaguaggauggcaauaagcggggaugauuguguuguuaaaccaaucgaugaucgauuugcgagcgcuuuaacagcuuuaaacgauauggggaagguccguaaagauauacaacaaugggaaccuucuagaggauggaacgauuggacacaaguaccuuucuguagccaccauuuucaugaacuuguuaugaaagauggacgcguucugguaguuccuuguaggaaucaggaugaacuuaucggcagagcaagaauaucacaaggugcuggcuggucucuaaaagaaacagcguguuuaggaaaaucguacgcacaaauguggacguuaauguauuuucaucggcgggacuugagguuagcagcaaaugcaaucuguagcgcgguaccaucacauuggguuccaacaagcagaacaacguggucaauacacgcaaaacaugaguggaugacaaccgaagauaugcucgcugucuggaaucgagucuggauacaagaaaauccauggauggaagauaaaacgcccgucgaauccugggaagagguaccauauuugggaaaaagagaagaucaaugguguggaucccugauaggcuuaacauccagagcgacaugggcuaaaaauauacaaacagcgauaaaucaaguacgaagccucauaggaaacgaagaguauacagacuauaugccaucuaugaaacgauuccgaagggaagaagaggaagcuggcgugcuuugguaa

SEQ ID NO: 22418 - RNA, 9876 nt, Artificial Sequence
  derived and/or modified CDS sequence (opt6) from DENV-2__JN819420__SS-prME
acagcggguguuauaguuaugcuuauuccuacggcaauggcauuucacuuaacuacaagaaauggugaaccccauaugauuguugguagacaagaaaaagguaaaucacuacucuucaaaaccgaagauggaguuaauauguguacauugauggcaauagaucugggagaacucugcgaagauacuauuacauauaagugcccccuauuaagacaaaacgaacccgaagacauagacuguuggugcaauaguaccucaacuuggguaacauauggcacuuguacaacaacaggcgaacauagacgagagaaaagaucaguagcacuuguuccucacgucgguauggguuuagaaacucguaccgaaaccuggaugaguucagagggggcguggaaacacguccaaagaauagaaacauggauucuacggcaccccggguuuacaauaauggcagcaauauuagcuuauacuauugguacgacucauuuucaaagagcacuuaucuuuauucuccuaacagcggucgcuccaaguaugacaaugagguguaucggaauaucgaaucgagauuucguugaaggaguauccgguggaucguggguagauauaguucucgaacacggcucauguguaacaaccauggcuaaaaauaaaccaacguuggacuuugaguuaaucaaaaccgaagcgaagcaaccugcaaccuuaagaaaauauugcauagaagcaaaauuaacuaacaccacaacagaaucuagaugcccuacucaaggagaaccuagcuugaaugaagaacaagauaaacgcuucaucuguaagcauaguaugguagacaggggaugggguaaugguugcggucucuucgguaaaggcgggauugugacuugugcaauguuuacauguaagaaaaauauggaaggcaaaguugugcaacccgaaaaucuagaguacacaauagugauaacuccgcauucgggugaggaacaugcaguuggcaaugacacaggaaaacaugggaaagaaaucaaaaucacaccucaaaguucuauuaccgaagcagaacuuaccggguaugguacaguaacgauggaaugcucaccaaggacaggacuugauuuuaaugaaaugguuuuacuacaaauggaggacaaagcguggcugguucaucggcaaugguuucucgaucucccgcuaccguggcugccuggggcggauacccaagguucuaauuggauacagaaagaaaccuugguaacauuuaaaaacccacacgccaagaaacaagaugucguagugcuugguucacaagagggcgcaaugcauacugcacucaccggcgcuacugaaauucagaugucuucagggaacuugcuguuuaccggacauuugaaauguagauugagaauggacaaacuacaacuaaaaggaaugucauacucgaugugcacuggaaaauuuaaaauaguuaaggagauagcugaaacacaacauggaacaauaguaauacggguccaguaugaaggagauggauccccaugcaagauuccuuuugaaauaacugaucuugagaaaagacauguacuaggaagacuaauaacuguaaaccccauaguaacagaaaaagacucaccuguaaauauagaagcagaaccaccauucggagacucuuacaucauaauagggguagaaccuggacaauuaaaacuaaacugguuuaagaaaggaagcagcauuggucaaauguucgagacuacuaugagaggagcuaaaagaauggcuauauuaggagacacagcaugggauuuuggaucacuaggagguguguuuacaaguauagguaaagcucuccaucaagucuucggugcgauauacggugcagcguuuucaggagucucuuggaccaugaaaaucuugauuggcguuauuauuaccuggauaggcaugaauagcagaucaacuagccuaagugugaguuuaguuuuagugggaguaguaacucuauacuuaggagcgguaguucaagcugauucuggauguguaguaucauggaagaacaaagaauugaagugcggaagugggauuuuuauuacugacaauguacacacauggacagagcaauauaaauuccagcccgaaaguccauccaaacuugcaagugcaauacaaaaagcacacgaagaaggaauaugcggaauuagauccgucacgagguuagaaaauuuaauguggaaacagauaacacccgaacuaaaucacauauuaagcgaaaaugaagugaaacuaacuaucaugacgggagauauuaaagguauuaugcaggcaggaaaaagaucgcuacgaccucaaccaacugaacuuaaauacucauggaaaaccuggggaaaagcuaagaugcuuucaacagaaucccacaaccaaacauuuuuaaucgaugggcccgaaacugccgaaugcccaaacacuaacagagcuuggaacuccuuagaagucgaggauuaugguuuuggagucuucaccacuaauauuugguuaaaguugagagaaaagcaagauguauuuugcgacaguaaguuaauguccgcggcaauaaaagauaaccgagcagugcacgccgacaugggguauuggauugaaagcgcccuaaaugacacuuggaaaauggaaagagccagcuuuauagaagugaaaucuugucacuggccgaaaucucacacacuauggucaaauggaguucuugaaucugaaaugaucauucccaaaaauuuugcagguccuguuucucaacauaauuaucggcccggcuaucauacgcaaacggcuggaccguggcaucuggggaaauuggagauggauuucgacuucugcgaagguacgaccguuguagucacggaagacugugguaacaggggaccuucauuaagaaccacaacagcaucaggaaaauugauaacugagugguguuguaggucuugcaccuuacccccucuccguuaucguggagaagacgguuguugguacggaauggagauuaggccucuuaaagaaaaagaagaaaaucuaguuaauaguuuaguuacugccggccauggacaaauugauaauuuuaguuugggaguucuggggauggcguuauuucuugaagaaaugcuacgaacucgcauaggaaccaaacaugcaauccuacucguugcaguaucauuuguuacccuaauuaccggaaauaugucuuuucgugacuugggaagagucaugguaaugguaggagcgacuaugacugaugacauagggaugggcguuacauaccuugcguugcuugcagcuuucaaggugaggcccaccuuugcagcuggauuacuguuacguaaauuaaccucuaaagaguuaaugauggcgacgauugguauagcacuauuaagucaaucaacaaucccagaaaccauucuugaacuuacagaugcuuuagcuuugggaaugaugguauuaaaaauaguaagaaauauggaaaaauaccaguuggcuguuacgauuauggccaucucgugugugccaaacgcggugauacuacagaaugcauggaaagugucguguacuauucuagcugcaguaagcguaucacccuuacuacucacuucuagucaacaaaaagcugacuggauacccuuagcacuaacaauaaaaggacucaacccaacugcuauauuucuaaccacauuaucacguaccuccaagaaaagaucuuggccccugaacgaagcaauaauggcagucgguauggugagcauauuagccucuucucuguuaaagaaugauauaccuaugacaggaccccuaguagcggguggccuucuuaccguauguuaugugcuaacuggacgaucugcagauuuagaauuagagcgcgccgccgacguaaaaugggaagaucaagcugagaucagugguagcagcccaauuuugaguaucacaauaucagaagacggcucaauguccauaaagaacgaagaagaggaacagacucucacaauacuuauaagaacagguuugcucguaauauccggagucuuucccgucuccauaccaaucaccgccgcagcgugguaucuuugggaggugaaaaagcaacgagccgguguuuuaugggauguuccuagcccaccacccguugaaaaagcagagcuugaagauggagcguaccguauaaaacaaagagggauacugggauacagccagauaggagccgguguauacaaagaaggcacguuccauacgauguggcacgucacaagaggcgcaguuuugaugcauaggggaaaaagaauagaaccaucuugggcagacguaaagaaagacuuaauaucauacgggggcggauggaaacuugaaggggaguggaaagaaggugaagaaguucaaguauuagcacuagaaccagguaaaaauccaagggcaguacagacgaagccugggauauucaagacuaacacaggaacuauuggcgcgguaagucucgacuuuucaccuggaacgagcggcucuccaauuguggaccgaaaaggaaaaguaguugguuuguaugguaacgggguugugacuaggaguggggcguacguauccgccauagcccaaacagaaaaauccaucgaagauaauccugagauagaagacgacauauuuaggaagaaacggcuuacaauuauggauuugcacccuggagcggggaaaaccaaaagauacuuaccagcuaucgugagggaagcaauaaaaagaggcuugcgcacauuaauauuagcacccacuagaguaguugcggcagagauggaagaagcguuaagaggacuaccaauacgguaucagacgccagcaauuaagaccgaacauaccggcagagaaauaguugaucucaugugccacgcaacauuuacaaugcgacuauugucaccgguucguguaccuaauuauaaucugauaauaauggaugaagcgcacuuuaccgauccagcaaguauugcagcaagggguuacauuaguacgagaguggagaugggagaggcugccggcaucuuuaugacugcuaccccgccuggaucucgggacccuuuuccucaaagcaaugccccaauuauggacgaggaaagagagaucccagaacguucauggaauaguggccacgaauggguaacugauuuuaaaggaaaaacaguaugguuuguuccuucaauaaaagcaggcaaugacauagcagcuugcuuacggaaaaauggcaagaaaguuauacaguugucacgaaaaacauuugauucugaguauguaaaaacaagagcgaaugauugggauuucguuguaacaacagauauaucagaaaugggagcuaauuuuaaagccgaaaggguuaucgauccaagaagauguaugaaaccaguaauccuuacggacagcgaggagcgaguaauacuagccgguccaaugcccgugacccacucuuccgcagcucaacgucgcgggcggauuggacgaaacccuaaaaaugagaaugaucaauacauauauaugggugaaccgcuugagaaugaugaggacugugcucauuggaaagaagcaaaaauguuauuagauaauaucaauacaccagaaggaaucauaccaagcauguucgagccagaacgugaaaaaguagacgcgauagauggggaguauagauuacggggcgaagcaaggaaaaccuuuguagaccucaugcgccggggagauuugccgguauggcuagcauacaaaguagcggcggaagguauuaauuaugcagauagaaaauggugcuuugacgggaucaaaaauaaucaaauacuggaagaaaauauggaaguagaaaucuggaccaaggaaggggaaaggaagaaacuaaaaccuagaugguuggacgcacguauauauagugauccucuagcgcuaaaagaguucaaggaauuugcagccggucgcaagucacucacccuaaaccucauaacagaaaugggaagacuaccaacuuuuaugacgcagaaagcaagaaacgcacuugacaaucuugcaguuuuacacaccgccgaagcgggcgguagggcguacaaccaugcacuuucagaacugccagaaacacuagaaacccuauugcuauuaaccuuauuagcaacugucacgggugggauauuuuuauuucuaaugucgggaaagggaauaggcaaaaugacacuagguauguguugcauuaucacagcaucaauccuacucugguacgcacaaauacaaccgcacuggauagcagcgagcauaauccucgaauuuuucuuaauaguauugcuuauccccgaaccugaaaagcaacgaacaccacaggacaaucaguuaacuuaugucgucauagcaauuuuaacgguuguagcagccacaauggcaaacgagaugggguucuuggaaaagacgaagaaagauuuaggguuaggaaguaucacuacacaggaaagcgaaaguaauauacuagauaucgauuuaaggccugcguccgcauggacauuauaugcaguggccacaacauuuguaaccccaaugcucagacauagcauagaaaacuccagcguaaaugugucacuaacugcaauugcgaaucaagcaacaguauuaaugggucuaggcaaaggauggccauuaucuaagauggauauaggcguaccucuccuugcuaugggaugcuauagucaauuuaagccaauaacucuuacggcagcucuccuacuauuaguggcacauuaugcaauuaucggccccggacuucaagccaaggccacgagagaagcacagaaaagagcagcagcgggcauaaugaaaaauccuacaguggauggaauaaccguaaucgaucuagaacccauaccguacgacccuaaauuugaaaaacaacucggacagguuaugcuguuaauuuuguguguaacgcaaguacuaaugaugagaacaacgugggcuuuaugugaagcauuaacauuggcgacaggaccaauaucgacauugugggaagguaauccuggucgcuucuggaauacaaccauagcaguaaguauggccaauaucuuccgggggucuuauuuagcuggggcgggauuacuuuucuccaucaugaaaaacacaacaaguacaagaagggguacaggcaauauaggagagacauuaggcgaaaaauggaagagucgccucaaugcccuagguaaaucugaauuucagauuuacaagaaaaguggaauccaggaaguagacaggaccuuagcuaaagaagguauaaaacgaggugaaacagaucaccacgccguaucacguggauccgcaaaacuucgaugguuuguugagagaaacaugguaaccccggaaggaaaaguuguagaucuuggguguggacgugggggauggucauacuauugugggggucucaaaaacguucgcgaagucaaaggccuaacaaagggcgguccgggucaugaggagccaauaccgaugucaacuuauggauggaaucucgugagguugcagaguggcguagaugucuuuuucacaccaccggaaaaaugugauacguuguugugugacauaggagaauccuccccuaacccgacaauagaagcaggcagaaccuuaagagugcuuaaucuaguugaaaauuggcucaacaauaauacucaauucugcauaaagguguuaaaccccuauaugccgucaguuauagaaaagauggaagcauuacaacggcaauauggaggagccuuaguaagaaauccguuaaguagaaacagcacccacgaaauguauugggucaguaacgcaacagguaacauaguaaguucaguuaauaugauuucucgcaugcuaauaaacagauucacgaugaaacauaagaaagcuacuuacgaaccagacguugacuuaggauccgguacucgaaauauaggaauugaaagcgaaauaccuaaccuugacauaauaggaaaaagaauugaaaagaucaagcaggaacacgagaucaguuggcauuaugaucaagaccaucccuacaaaacgugggcauaucauggaucuuaugaaacuaagcagacaggaagcgcuucuuccauggugaauggaguagugcgcuuacuuacaaaacccugggaugucgugccgaugguuacucaaauggcuaugacggacacgacaccuuuuggucaacaacgggucuucaaagaaaaaguagauacccggacacaggaaccaaaagaaggaacuaagaaacuaaugaagauuacugcggaguggcuuuggaaggaauuagggaagaagaaaaccccaagaauguguacuagagaagaguucacuaagaaaguuagaagcaaugcagcuuuaggggcaaucuuuacagaugaaaacaaauggaaaagugcaagagaggcagucgaagauggacguuuuugggaauuggucgaccgcgaacgcaauuuacaucuugaaggaaagugugaaacaugcguauauaauaugaugggaaagagagagaagaaacugggagaauuuggaaaggcaaaaggaucacgagcaaucugguauauguggcuaggcgcacguuuucuagaauuugaagcccugggauuuuugaaugaagaccacugguuuucuaggggaaacucacucucaggaguagaaggggagggguugcacagacuggguuacauuuuaagagacguagguaagaaagaaggaggggcgauguaugcugaugacacagcaggaugggacacgaggauaacuuuagaagaucuaaagaaugaggagauggucacgaaccacaugaaaggugaacacaaaaaguuagcagaagcaaucuucaaauugacauaccagaauaaaguagucagaguacaacgacccacucccagagggacaguuauggacauaaucagucgcagggaucaacguggaucgggccaggucggcaccuacggacuuaauacauucacaaacauggaagcgcaauugauucggcagauggagggcgaaggaauuuuuaaaucaauucaacauuuaaccgcaacugaagaaauugcgguucagaauuggcuugccagagugggacgagagcgacucagccgaauggccauuagcggugaugauugcguaguaaaacccaucgaugaucgauucgccuccgcccuuacugcuuugaacgacauggggaaagugagaaaagacauucaacaaugggaaccaucaagaggguggaacgacuggacacaagugccguuuugcagccaucauuuucacgagcuuguaaugaaagaugguagagucuuaguaguaccuugucgaaaccaagaugaacuaauuggaagggcacgcauuucacaaggagcaggauggucucuaaaagaaacggcguguuuagguaaaucauaugcucaaauguggacgcuuauguauuuccauagaagagacuuaagacuagcugccaacgcuaucuguucugcuguuccgucacauugggugccuacuucgcgaacaacuuggaguauucacgcuaaacacgaauggaugaccacagaagacaugcuagcgguauggaacagaguauggauacaagaaaaucccuggauggaagauaaaaccccuguagaaucgugggaagaaguccccuaucuagguaagagggaagaucaauggugcgggagccucaucggguuaacaaguagggcaacgugggcgaaaaacauacaaacagcuauaaaucaagugagaagucuuauaggaaaugaagaauacaccgacuauaugccaucuaugaaacguuuuaggcgagaagaagaggaagccgguguguuaugguaa

SEQ ID NO: 22419 - RNA, 9876 nt, Artificial Sequence
  derived and/or modified CDS sequence (opt6) from DENV-2__FJ850118__SS-prME
acagcagggguaauaguaaugcucauaccaacagcaauggcauuccaccuuacaacgcgcaacggagaaccacacaugauaguuggacggcaagaaaaagguaaaaguuuauuauucaaaacugaagacgggguaaauauguguacacuaauggcuauagaccuaggagaauuaugcgaagacacaauuacguacaaaugcccacuauuacgacagaaugaaccagaagacauagauugcugguguaauuccaccaguaccuggguaacauacgguacuugcaccaccacuggagaacaucgucgagaaaaacguuccguagcguugguaccccacgucgggaugggucuugagacaagaacugagaccuggaugagcucagaaggugcuuggaaacauguucaaaggauugaaacuuggaucuugcggcauccuggauuuacuauuauggcggcuauuuuggcuuauacgauagggacaacccacuuucagagggcguugauauucauacuacucaccgcaguugcaccuaguaugacaaugagauguauuggaauauccaaucgcgauuucguggaaggagucucagguggaucaugggucgauauugucuuagaacacggaaguugugugaccacuauggccaaaaauaaaccaacacucgauuuugaacuaauuaaaacugaagcaaaacagcccgcuacacuacgaaaauacugcauugaggcaaaacucacgaauacaacaacagagucccguuguccaacucaaggcgaaccauccuuaaaugaggaacaagacaaacgguucauaugcaaacauagcaugguugauagaggcuggggcaaugggugcggacuauuuggaaaagggggcauaguuacuugugcaauguucacuugcaagaaaaacauggagggaaaaguaguacagcccgaaaauuuggaauacacaauaguaauuacaccccacagcggugaagaacaugcgguagguaaugauacagguaaacacgggaaagagauuaaaaucaccccacaaaguaguauuacagaggccgaauugacaggauauggaacgguuacuauggaaugcaguccaagaacgggucuugacuuuaaugaaauggugcuacuacaaauggaagacaaagccugguuagugcaccgacagugguuuuuggacuuaccauuaccauggcuaccgggagcagacacacaaggaaguaacuggauacaaaaagagaccuuaguuacauuuaaaaacccucaugcgaagaaacaagauguuguaguuuugggaagucaagaaggcgcaaugcauacugcucucaccggagcaacugagauacaaaugaguagcggcaauuuacuuuucaccggucauuuaaaaugccgacuacgcauggauaaacugcaauuaaaaggaaugagcuauaguauguguacggguaaauucaagaucguaaaagaaaucgcagaaacacaacauggcacuauuguuauacgcgugcaauaugagggcgacggauccccauguaaaauucccuucgaaauuacugaucuugagaagcgacacguacuaggacgacuaauuacaguuaaucccauugugacagagaaagauagcccagucaacauagaggcugaaccuccguucggcgauucuuacauaaucauaggugucgaaccugggcaacuuaaacuuaauugguuuaagaaagggucaagcaucggacaaauguucgaaacaacgaugcgaggagcuaaacgaauggcaauacuaggugauacggcaugggacuuuggaucauuggguggagucuuuaccucuauaggcaaggcuuuacaccaaguauucggagcuaucuacggugcugcauucaguggcgucagcuggacgaugaagaucuuaauaggagugauaauuaccuggauagguaugaacucccgcucaaccagucucucagugagucugguucuagugggagugguaacauuauaccuaggagcaaugguucaagcugauucaggcuguguggugucauggaaaaauaaagaguuaaaauguggaucaggaauauuuauaaccgauaaugugcauacuuggacagagcaauacaaguuucaaccugaaucgcccagcaaauuagccuccgcgauacaaaaagcacacgaagaaggaauaugcggaauccguagcgucacgagauuagagaaucucauguggaaacagauaacccccgaauugaaucacauccuaagugaaaaugagguaaaacuaacgauaaugacaggcgacauuagagggauaaugcaggcuggaaaaagaucccuucggccacaacccacggaauugaaguauucguggaaaacuugggguaaagcgaaaauguuauccacugaaagucauaaccaaaccuuuuuaaucgauggcccagaaacagcagagugucccaauacuaacagagcguggaacucguuagagguggaggauuaugguuuugguguauuuacaacuaauauaugguuaaaacuaagggagaaacaggaugucuucugugauucaaaguuaaugucugcagcgaucaaagauaacagagcaguucaugcugacaugggauacuggauugaaucagcacuaaacgacacauggaaaauggagaaagccucauuuauagaagucaaaagcugucacuggccaaaaucucacacacuauggagcaacgggguucucgaauccgagaugauaauaccgaagaauuucgcagggccaguuucacagcacaacuacagaccagguuaucacacacagacagcaggcccauggcaucuaggaaaacuagagauggacuuugaucugugugaaggcacaacaguaguugucaccgaagacuguggaaacagagguccaagucuacgaacaacgacagccucugguaaguuaauuacagaaugguguugucgaaguugcacccuacccccuuugcgcuaucgaggggaagacgguuguugguauggaauggagauacgccccuuaaaagaaaaggaagaaaaccuagugaacucauuagugacagccggauauggucaaauagauaacuuuagccuaggcguacuaggaauggcuuuauucuuggaagaaaugcucagaacacgcaucgguaccaaacacgcaauuuuauuagucgcaguuucauucguaacauugauuacaggcaauaugucguuuagagaucucggccgaguaaugguaauggucggagcgacaaugaccgacgacauugguauggguguaacauaucuagcacuacuggcagcguuuaaaguucggcccacuuucgccgcaggauuacuuuugagaaaacuaacaucaaaagagcuaaugauggcgacaauagggauugcauuacuaucccaaagcacaauaccagagacgauacuagaauugaccgaugccuuagcacuuggcaugaugguauuaaaaauagugagaaauauggaaaaauaccaacuagcaguaacuauaauggcuauuagcugcguuccuaaugcugucauacuacagaaugcguggaaagucaguugcacgauuuuggcggccguuucaguuucuccgcuauugcuaaccagcucacaacaaaaagcagacuggaucccauuagcucuaacaauuaaaggacuaaauccuaccgcaaucuuuuuaacaacuuugagcagaacaaguaagaaaagaucauggccauuaaaugaagcgauuauggcaguuggaaugguuucuauccuagcuuccucucuucucaaaaacgacauaccaaugacuggaccauugguggcgggcgggcucuuaacaguaugcuauguacuuacaggacgaucugcagaccuagaguuagaaagagcggcugacguuaaaugggaagaucaagcagaaauuuccggauccaguccuauccuauccauaaccaucagcgaggacgguucgaugucaauuaaaaaugaggaagaagaacaaacgcuaacuauacucauucguacgggacuucuuguaauaucgggaguauuuccuguaucaauaccaaucacugcggccgcgugguacuuaugggaggugaaaaagcaaagagcuggaguucuaugggaugugccuucucccccuccgguagaaaaagccgaguuagaagauggcgccuaucgcauaaaacaaagaggaaucuuagguuacagccaaauaggagcgggaguuuacaaagagggaacuuuccacacuauguggcacgugacacggggugcuguauuaaugcaucgagguaaacguaucgagccaucaugggcggacgucaagaaagaccuaauaaguuaugguggaggguggaaguuggaaggcgaauggaaagaaggagaagaaguacaaguacuagcacuggaaccaggcaaaaauccaagagcugugcaaacgaaacccgggauuuuuaaaacaaauacuggaacgaucggagccguaucacuugacuuuucaccagguaccucaggaaguccgauagucgauagaaaagguaaagugguggggcuuuauggaaauggaguaguuacaaggaguggggcauauguaagcgcgauagcacaaacggaaaaaucuauagaggauaacccugaaaucgaggaugacaucuuucgaaagaaaagguuaacaauaauggaccuucaucccggugcugggaaaacaaagagguaccuuccugccaucguaagagaagccauuaagagagguuuacgaacauuaauuuuagcaccaacacgcguuguagcagcagaaauggaagaagcacuucgcggccuucccauaagguaucaaacgccagccauaaagaccgaacacacaggaagagagaucgucgaucuaaugugccaugcaacguuuacuaugagacuguuaucgccaguccgaguucccaauuauaaccuaauuauaauggaugaggcacauuuuacggauccagccaguauugcagcgaggggauacauuagcacacgaguugaaaugggagaagcagcggggauauuuaugaccgcaacacccccaggaagcagggauccauucccacaaucaaacgcaccuauaauggaugaagagagagagauaccagaacgaucguggaacucgggucacgaauggguuacggacuucaaagggaaaaccguaugguuuguuccgucuauaaaagcaggaaaugauaucgcagcaugucuuaggaaaaacgguaagaaagugauucagcucucaagaaaaacauuugacagcgaauauguaaaaacccgugccaacgauugggauuucgugguuaccacagauauuagugaaaugggugcgaauuucaaagcugagagagugauagacccaagaagauguaugaaaccggugauuuugacagauggcgaagaacgugucaucuuggcaggcccgaugccaguuacgcacagcagugcagcucagagaagagguaggauugggaggaacccgaaaaaugaaaaugaucaauacauuuacaugggugaaccauuagaaaacgacgaagauugugcucauuggaaggaagcaaaaaugcuuuuagacaacauuaauacgccugaagguauaauuccgucaauguuugaaccggaaagagaaaaaguugaugcuauagauggggaauauaggcuaagaggcgaggcgaggaaaacguuuguagacuugaugcguagaggggacuuacccgucugguuagcguacaagguagcugcugagggaaucaauuaugcugaccgaaagugguguuuugaugggaucaaaaauaaccagauauuagaagaaaacauggagguugagauauggaccaaagaaggagaacguaaaaaguuaaagccacgauggcuugaugcacgaauuuauuccgauccauuagcauuaaaagaauuuaaagaguucgcugcaggucgaaagagcuugacccuaaaucuaauaacagaaaugggucgguugcccacguucaugacgcaaaaagcaaggaacgcacuagacaaccuagccguauugcauacagcagaagcuggugggcgagcuuacaaccacgcccucucagaguugccggaaaccuuagagacucuacuacuucugacgcuccucgcaacgguaacuggagguauauuccuauucuugaugucaggaaaagguauaggaaaaaugacacuuggaauguguuguauaauaacggcaucaauacuacuuugguacgcacaaauucaaccacauuggauagcagcaagcaucauccuagaguucuucuuaaucguauuacuaauacccgagccagagaaacaaagaacaccacaagacaaucaacuuacauauguaguaauagcaauacuuacaguaguugccgcuaccauggcaaacgagaugggauuccuagagaaaaccaagaaagaccuuggacuaggaagcauaacaacacaagaaucggagagcaacauacuugauauagacuuaagaccugcaucugcauggaccuuguaugccguggcgacgacguucguaacuccaaugcuucgacauaguauugaaaauucgucaguuaaugucagcuuaaccgcuauagcgaaccaggcuacuguacuaauggguuuagggaaaggcuggccacuaucaaaaauggacauaggcgucccuuuauuggcaauagguuguuauucccaagugaauccgauuacucuaacagcagcucuacuauuauuaguagcucauuaugcaauuauuggaccugggcugcaagccaaagcaaccagggaagcccaaaaacgugcagcagcuggaauaaugaaaaauccaacaguagacggaauuacaguuauagaccuugaaccaaucccauacgacccaaaauucgaaaaacaacuaggccaagugauguugcucauauuaugugucacacaaguacuaaugaugagaacaacaugggcccugugcgaagcucugacucuagcaacaggaccaaucucaaccuuaugggaaggaaaucccggucgguucuggaauacaacaaucgcugugaguauggcaaauaucuuuagagguaguuacuuagcaggagcuggauuauuauuuagcauuaugaaaaauaccaccaacacccgaagaggaacgggcaacauaggggaaacuuuaggcgaaaaauggaaaucuagacuaaacgcacuagguaaaagcgaguuccaaauauacaagaaaagcggcauucaagaaguugacaggaccuuggcuaaagaaggaauaaagcguggagaaacggaccaucacgcgguaucaagaggaagugcaaagcugcguugguucguugaaagaaacauggucacacccgaagguaaaguuguagauuuggguugcggaagaggcggauggagcuacuauuguggaggacuuaaaaauguaagagaaguuaaaggacuaacuaaaggaggcccuggucaugaagaaccaauaccuaugaguacauacgguuggaaucuuguucggcuucaaaguggagucgaugucuucuuuacgccuccagagaaaugugauacccuguuaugugacauuggugagaguagcccgaacccaacaauagaagcagguagaacuuuaagagucuugaauuuaguagagaauugguugaauaauaauacgcaguucugcaucaaaguuuuaaacccauacaugccaagcguaauagaaaagauggaagccuuacaacgaaaauacgggggugcauuagugaggaacccccugaguaggaacuccacacaugaaauguacuggguauccaaugcaacgggaaacauaguuaguagcgucaauaugauauccagaaugcugauaaaccgauuuaccaugaaacacaagaaagcuaccuaugagcccgacguugacuuaggaucagguacuagaaauauaggaauagaaagugaaaucccuaaucuugauauuauaggaaagagaauagagaaaauaaaacaagaacacgaaacaaguuggcauuacgaccaggaccauccauauaaaacaugggcauaccauggaucauaugaaacuaagcaaacuggaagugccaguuccaugguuaacggggugguaaggcuacuuacaaaaccgugggauguagucccgauggugacgcaaauggcgaugacagauaccacuccuuuuggucagcaaagaguguuuaaggaaaaaguggauacacgaacucaagaaccaaaagaaggaacuaagaaacuuaugaaaaucacagccgaaugguuauggaaagaauuaggcaagaagaaaacaccacgcaugugcacucgagaagaauuuacuagaaaaguuagaaguaaugcagcccuaggagcuauauucacagaugaaaauaaauggaaaucagccagagaagcagucgaagacgguagauuuugggagcuaguugacagggaacgcaaccuucacuuggagggcaaaugugagacauguguauacaauaugaugggcaaaagagagaagaaauugggugaauuugguaaagcaaaggguucuagggccauuugguauauguggcuuggggcaagauuccuugaauuugaagcgcugggauuuuuaaaugaagaccauugguucaguagagguaacaguuuaaguggcgucgaaggcgagggcuuacaucgacuuggauauauuuuaagagaugugggcaagaaagaggguggggccauguacgcagaugacaccgcagggugggauacucguauuacuuuggaagaccuaaagaacgaagaaaugguuaccaaccacaugaaaggugaacacaagaaacuagcagaggcaauauuuaaacuuacauaccaaaauaagguaguacgaguucagcggccuaccccuagaggaacaguuauggacauuauaucaagaagagaccaaaggggaucaggucaaguugguacuuacggauuaaacaccuucacuaauauggaggcgcaacuaauccgacaaauggaaggagagggaaucuuuaaaucaauucaacaccuaacagccacggaagaaauagcuguccaaaauugguuggcgagagugggacgcgagagacuaucaaggauggcaauuagcggagacgauugcguugucaaaccaauagaugauagguuugcgucagccuuaacagcacucaacgauauggguaaagugagaaaggacauucaacaaugggaaccuagcagaggauggaaugacuggacacaagucccuuucuguucccaccauuuccacgaauuaguaaugaaagaugggagaguccuaguagugcccugcagaaaucaagacgaacugauaggacgcgcaagaaucagucaaggggcuggcuggucacuaaaagaaacggcgugucugggaaaaucauacgcucagauguggacacuaauguacuuucaucgacgggauuuacgauuagcggcaaaugcuauuuguagugcaguuccuccacauuggguaccuacaagcaggacaacuuggaguauacaugcaaagcaugaauggaugacaacugaggacauguuagccguauggaaucgcguauggauacaagaaaaccccuggauggaagauaagacuccggucgaauccugggaagagguuccauacuuaggcaaaagggaggaccaauggugcggaucauuaaucggacuuacaaguagagccacaugggccaaaaacauacaaacagcgauaaaucaaguaagaucuuuaauaggcaaugaggaauauacagacuauaugccgucaaugaaaagauuccgacgugaagaagaggaggcaggaguacuaugguaa

SEQ ID NO: 22420 - RNA, 9876 nt, Artificial Sequence
  derived and/or modified CDS sequence (opt6) from DENV-2__JN819416__SS-prME
acugcaggaguaauagugaugcugaucccaacggcaauggcuuuccaucuaaccacaagaaauggugaaccacauaugauaguuggacgacaggaaaaagguaaaagucuguuguucaaaacugaagaugguguuaauauguguacacugauggcuauugaucuaggugaauuaugcgaagacacuaucacguauaaaugcccacuauuacgacaaaaugaaccagaagauauugacuguugguguaacagcacaucaaccuggguuacuuacggaacuuguacuacuaccggagaacacagaagagaaaaacggucaguagccuuaguuccucauguggguaugggguuagaaacaaggaccgaaacauggaugaguagugaaggcgcuuggaaacaugugcagcgcaucgaaacauggauccuuagacaucccgguuuuacaaucauggcagcuaucuuagcauacacgauaggcacaacucauuuccaacgugcuuuaauuuuuaucuuauuaacggcgguagcaccaaguaugacaaugcgauguaucggcauuagcaauagagacuuuguagaagggguaagcggugguucauggguugacauaguucuugaacaugggagcuguguaacaacgauggcuaaaaacaaaccuacgcucgauuuugaacuuauuaaaacggaagcuaaacaacccgcuacguuaagaaaauauuguaucgaagcaaaacucaccaacacaaccacugaaucaaggugcccgacccaaggcgaacccucacucaacgaagaacaagacaaaagguucauuuguaaacauucuaugguugacagaggaugggggaacgguugugguuuauucgguaaaggcggaauuguaacaugcgcaauguuuacauguaagaaaaauauggaaggaaaaguaguccaaccagaaaaucucgaauacacgauaguuauaaccccacauucaggcgaagaacaugcgguaggcaaugauacgggaaaacacggcaaagaaauaaaaauaacaccccaaagcucaaucacugaagcagaacucacaggauauggcacgguuacuauggaaugcucgccucgaacaggacuugacuucaaugaaaugguccuccuccaaauggaagauaaagcaugguuagugcaccgucaaugguuucuagaccucccauuacccuggcuaccgggugcugacacucaaggcucaaacuggauacaaaaagaaacauuaguaacuuucaaaaauccacacgccaagaaacaagauguaguaguucuuggaagccaagaaggagcuaugcauacagcgcuuacaggggcaacugaaauucagaugucuagcggaaaucuuuuguuuacuggacaucuaaaaugcagacuacguauggacaaacuucaauuaaaggguaugucauacaguaugugcaccggaaaauuuaaaauaguaaaagagauugcagaaacacaacacggcacaauagucaucaggguucaguacgaaggggacgguucaccaugcaaaauuccauuugaaauaacugauuuggaaaagcgucacgucuuaggucgguugauaacaguaaacccaauuguuacugagaaagacaguccaguaaauauagaggcagaaccaccuuuuggagacucuuacauaaucaucgguguugaaccugggcaacuuaaguuaaauugguucaagaaaggaucuuccauugggcagauguuugaaacgacgaugagaggcgccaaacgaauggcaauuuuaggggauacugcaugggauuuuggaucucuaggugggguuuucaccucaauugggaaggcacugcaccaaguauuuggugcuauauauggagccgccuucaguggcguaagcuggacaaugaaaauacucauaggaguaauuauaaccuggauagggaugaacucuaggaguaccagucuaagcgucucucucguacuuguuggggucguaacacuuuaccugggagcaaugguucaagccgauuccgguugcguggucaguuggaagaauaaagaauuaaaaugcggcaguggaauauucauuacugauaacguccacacguggacagagcaguacaaauuucaacccgaaagccccucaaaacuagcaucagcaauccaaaaagcgcaugaagagggcauuuguggaauccgauccguuacaaggcuagaaaaucuaauguggaaacagaucacuccggaauugaaucacauacuaucggaaaaugaaguaaaauugaccauuaugacaggagauauaaaaggcauaaugcaagcuggcaaaaggucauuaaggccccagccaaccgaacugaaauauaguuggaaaacaugggguaaagcgaagauguuaucaaccgaaagucauaaucaaacauuucuaauagauggcccugagacggcagaauguccuaauacaaauagagcauggaacuccuuagagguugaagauuacggcuucggaguauucacaacgaauauuugguugaaacuucgagaaaaacaagacguguucugugauagcaaacuaaugucugcugcuauaaaagauaauagggcuguacaugcugauaugggguauuggauagaaagugcguuaaaugauacuuggaaaauggaaaaggcaucguuuauagagguaaaaucaugccacuggccuaagagccauacauuauggucuaauggaguauuagaaucugaaaugauaauacccaaaaauuucgcgggaccuguaagucagcacaacuaccguccgggcuaccauacacaaacagcgggcccauggcaucuugguaaguuagagauggauuuugaccuuugugaaggaacuacaguuguugucacugaagauugcgggaauaggggacccuccuugaggacaacaacugcgucaggcaagcucaucacugaaugguguugucgcaguugcacacuuccaccacuacguuaucgaggcgaagaugguugcugguauggaauggagaucagaccacuaaaggaaaaagaagaaaaccuuguaaacucguuggucacagcaggacacgggcaaauagauaacuuuucgcuaggaguucuaggcauggcauuauuuuuggaggaaauguuacguacaaggauugguacgaaacaugcaauuuuacuuguggcugugucauucguuacuuuaauaaccggaaacaugaguuuccgugauuuggguaggguuaugguaaugguaggagcaacuaugaccgaugacauuggaauggguguaaccuacuuagcacuucuagcagccuucaaagugcguccgacuuucgcagcaggacuucuuuuaagaaaacuuacuagcaaagaacuuaugauggcaacuaucggaauagcuuugcugagucaaaguacuauuccagaaacuaucuuagaauuaacagaugcuuuagcauuaggcaugauggugcuaaaaauaguaagaaacauggaaaaauaccaacuagcaguaacgauaauggcgaucaguugcguaccuaacgcaguaauauugcaaaacgcauggaaaguaagcugcacuauccuagcagcagugagugugucgccacuauugcuuaccucgucacaacagaaagcagacuggaucccuuuagcauuaacgauaaaaggauuaaacccuacagcaauauuuuuaacaacgcucucacguacaucgaagaaacgcucguggcccuuaaaugaagcaauaauggcugugggaaugguuucaauacuugcaaguucucuacuuaaaaacgacauuccgaugacaggacccuuaguggcgggaggacuauuaacgguuugcuacgugcucacuggaagguccgcagauuuagaguuggaacgagccgcagacguaaaaugggaagaucaggcugaaauauccgggucuaguccaauauuaucaaucacgaucucagaggauggcucuaugaguaucaaaaaugaagaagaggaacaaacacucacaauucucauacgcaccggucuucuagugauaucggggguauucccgguaucuauaccuauuacagcagcagcuugguaucuaugggaggucaagaaacagagagcagggguauuaugggauguaccuagcccaccaccaguugaaaaagcugaacuagaagacggugcuuaucggauaaagcaaagaggaauccucggcuacagucaaauuggagcuggaguuuauaaagagggaacauuucacacaauguggcaugucacucgaggagccguauuaaugcaccgaggcaaacgaauagaaccuagcugggcagacgucaagaaagaucuaaucagcuauggagguggauggaaacucgaaggagaauggaaagaaggagaggaaguacaaguguuagcacuagagcccggcaaaaauccaagagccguacaaacaaagccagguauuuuuaaaacuaacacaggcacgaucggagccguuagucuagacuuuucgccaggaaccagcgguucgcccauagucgauagaaaagggaagguugucggucuauauggaaaugggguugugacaaggagcggugcauacguaagugcuauagcacaaaccgagaaaaguauagaggacaacccugaaauagaagaugauauuuuuagaaagaaacgacuuacgauaauggaucuacauccuggugcugguaaaacuaaaagguaucucccagcaauaguacgagaggccauaaaacgaggcuuacgaacacugauccucgcaccuacacgaguaguugcggcagaaauggaggaagcccuuagaggucuuccaaucagauaccaaaccccagccauuaaaacggaacacacaggaagagaaaucguagaucuaaugugucaugcaacauuuacaaugagauuacuuucucccguacguguuccuaacuauaaccuaauaauuauggacgaagcccauuucacagaccccgcuucgauagcagcccggggauauaucuccacacgaguagaaaugggagaggcagccgguaucuucaugacggcgacgccaccggggaguagagauccuuuuccacaaucaaaugcucccauaauggacgaagaacgagagaucccagagaggagcuggaacucugggcaugaauggguaacggauuuuaagggcaaaacaguaugguuuguuccaagcauaaaggccgguaaugacaucgccgccugucuaaggaaaaauggaaagaaaguaauacaguugucgagaaaaacauuugacuccgaguaugucaaaacucgagcuaaugauugggauuuuguugucacaaccgauauuagugaaaugggugcaaauuuuaaagcugaaagaguaauagauccaagaagauguaugaagccuguaauacugacugauggagaagaacgaguuauuuuagccgggccuaugccggugacccauaguucagcggcacagagacguggccggaucgggcgaaauccaaagaaugagaacgaccaguacauauacaugggggaaccucuugaaaaugaugaagauugcgcgcauuggaaagaagccaagauguuguuagauaauauuaacacuccugagggaauaauuccgucuauguucgagccagaaagagagaaaguugaugcaauagacggagaauacagauuaaggggagaagcgcgaaaaacuuuuguagaccucaugagaagaggagauuuaccuguuuggcuagcauauaaaguagcugccgaagggauaaacuaugcggacaggaaauggugcuuugauggaauaaagaacaaucaaauacuagaggagaacauggaaguugagauauggacgaaagaaggagagcggaagaagcuaaagccaagaugguuagacgcaaggaucuacagcgacccacucgcacuuaaagaauuuaaagaguucgcggcagguagaaaaucacuuacuuugaacuuaauuaccgaaauggguagacuucccaccuuuaugacacagaaagcgagaaaugcucuggacaaccucgcaguucuccacacugcagaggcuggaggucgagcguacaaccacgcacucucugaacuaccggaaacuuuagaaacuuuacuuuuacuaacccugcuggcaacaguaacggguggaaucuuccuauuuuuaaugucagguaaaggcauuggcaaaaugacgcuagggauguguuguauuauaacagcuagcaucuuacuuugguaugcacaaauacaaccucacuggauagcugcaagcauaauauuagaguucuuccucauaguuuuacuaauccccgaaccugaaaaacagagaacaccacaggauaaccaacuuacguaugugguaauagcuauauuaacugugguagcagcaacgauggcaaaugagaugggauuccuagagaagacuaagaaagaccuugggcuaggaaguauaaccacccaagaaucagaaagcaacauacucgauauagaucuacggccugcuuccgccuggacauuguacgcagucgcaacuaccuucguuacuccuauguuacgacacagcauagaaaauuccagcguaaauguuucauuaaccgcuauagcaaaucaggcgacgguauugaugggauugggcaaaggcuggccauuaucgaaaauggauauugguguuccgcuauuagcaaucgguugcuauucccaaguaaauccuaucacauuaacugcugcauuauuauuauuaguugcccacuaugcgauuauaggcccgggucugcaggcuaaagcuacccgagaggcccagaaaagggcugcggcagggauaaugaaaaacccaacuguggauggaauaacagucaucgaccuagaaccaaucccguacgacccaaaauuugaaaagcagcuaggacaaguuauguuacuuauucuauguguaacacaaguauuaaugaugagaacgacaugggcauuaugugaggcacuaacacuggcuacgggaccaauaucuacguuaugggaaggaaauccgggacgguuuuggaauacaacuauagcagucucaauggcaaacauauuuagagggucauauuuggcuggggcugggcuauuguucaguauaaugaaaaacacgacuaauacucgucgagggacuggcaauaucggagagacccuaggugaaaaauggaaaagucgcuuaaaugcacuaggcaaaagugaauuucaaauauacaagaaaucggggauucaagaaguggaccgcacacuggcgaaagaaggaauuaaacgcggcgagacagaucaucaugcagugagucgcggaucagcgaaauuaagaugguucguggaacguaauauggugacgccggaaggaaaaguaguggauuuggguugcgguagggguggcugguccuauuacugugguggauuaaagaauguccgagaagucaagggacuaacaaaagguggaccgggucaugaagaacccauuccaaugaguaccuacggguggaacuuagucagauuacaaagcgguguagacguguuuuucacuccgccagaaaaaugcgacacucuacuaugugauauaggagagagcucaccuaauccgacuauagaggcugguagaacuuuaaggguguugaaccuugucgaaaauugguugaauaauaauacacaauucugcauuaaaguuuuaaacccauacaugccgucagucaucgagaaaauggaggcuuugcaaagaaaauacggaggagcuuuaguucgcaauccacuaaguagaaauaguacucacgaaauguauuggguaaguaaugcaacgggcaacauuguaagcaguguaaauaugauaucucggauguuaauaaauagauuuaccaugaagcauaagaaggcaacuuacgaaccagauguggacuugggauccggaacucguaauauagguaucgaaagugaaauacccaaucucgacaucauaggaaaaagaauagagaaaaucaaacaagaacaugaaacaagcuggcauuaugaucaggaccacccuuauaagacaugggccuaccacggaaguuacgagacgaaacaaacuggaucagcaagcuccauggucaauggcguagucagacuuuugacuaaaccgugggauguagucccgauggucacucagauggcuaugacagacaccacgccguuuggacaacaaaggguuuucaaggaaaaggucgauaccagaacucaagaaccaaaagaagguacaaagaaauuaaugaaaauaacugcggaaugguuauggaaagaacuggggaagaagaaaaccccuagaaugugcacucgggaagaguucacucguaaaguccguucgaacgcagcacuuggagcaauauuuacggaugaaaauaaauggaaauccgccagagaggcaguagaggacagcagguuuugggagcuagucgaccgggaaaggaauuugcaucucgaagguaaaugugaaaccuguguguauaacaugaugggaaagagagagaagaaauugggugaguucggcaaggcgaagggaucaagagcaauuugguauaugugguuaggagcaagauuccuugaguuugaagcacuaggauuucuaaaugaagaccacugguucucacgugggaacagcuugagugguguagagggugaagguuuacacagauugggauauauauuaagagacguggggaagaaagaaggaggcgccauguaugcggaugauacagcggguugggacacuagaauuacacuagaagaucuuaaaaaugaagaaaugguuacaaaccacaugaagggagaacauaagaaacuagccgaagcuauauuuaagcugacauaucaaaacaaaguaguaagaguacaacguccaacaccgcgaggaaccgugauggauaucauaucucgcagagaccagagaggcagugggcaaguaggaacuuauggccuuaauacguuuacgaacauggaagcucaacuaauacggcaaauggaaggggaaggcauauucaagaguauacagcauuuaacagcuacagaagaaauagccguucaaaacuggcuagcaagaguaggcagggagcgccugagucggauggccaucagcggagaugauuguguaguaaaaccgauugaugauagauuugcaagcgcacucacagcgcuuaaugauauggggaaagugcggaaagauauccaacaaugggaacccucccguggauggaaugacuggacacagguaccuuucuguagccaucauuuucacgaauugguaaugaaagacggcagagucuuagugguuccuuguagaaaucaggaugagcuaaucgguagagcaagaauuagccaaggagccgguuggagucuaaaagaaacagcgugucuggguaaaaguuaugcgcaaauguggacacuaauguacuuccaccggagagaccugcgguuggcugcaaaugccauuuguucugcaguaccgccacacuggguacccacuucacgaacgacguggucaauccaugcaaaacacgaauggaugacaacugaagacaugcuagcugucuggaaucgaguauggauccaagaaaauccuuggauggaagacaagacgccuguagagucaugggaggaaguaccauaccugggcaagcgagaggaccaauggugugguucguuaauaggccuuacaucacgcgcaacaugggccaaaaauauccagacagccauaaaucaaguaagaaguuuaauuggaaaugaagaauacacagacuacaugccuucgaugaaaagguucagaagagaagaagaagaggcaggcguacugugguga

SEQ ID NO: 22421 - RNA, 9876 nt, Artificial Sequence
  derived and/or modified CDS sequence (opt6) from DENV-2__FJ850119__SS-prME
acagcuggugucauaguuaugcucauuccaaccgcaauggcauuucauuuaacuacuaggaacggugaaccacacaugaucgucgggagacaagaaaaaggaaagucacuacuguuuaaaacugaagauggaauaaauauguguacucuaauggcaauagauuugggagaauugugugaagacacaaucacauacaaauguccauuacuucgucaaaaugaaccagaagacauagacuguuggugcaauaguacaaguaccuggguaacauaugggacuuguacaacgacgggagaacacagacgcgagaaaaggucugucgcacuuguaccacacguggguaugggucuagaaacgcgaacugaaacuuggaugucuagcgaaggagcauggaaacaugugcaaaggauugaaacuuggauauuaagacaccccggauuuacaaucauggcagcaauacuagcuuacacuauagguacgacacacuuucaaagggcgcuaauauucauauuauuaacagcuguugcgccaucuaugacuaugcgaugcauuggaauaucaaaucgugacuuugucgaagguguaucagggggcucguggguagacaucguguuagaacacgguucuugcguaacgacaauggcaaagaacaaaccgacacuagacuucgaauugauaaagacggaggcaaaacaaccagcuacauuaaggaaguauuguauagaagcuaagcuaacuaauacaacgacagaaucaagaugcccaacacagggggaaccaucauuaaaugaagaacaagauaagagauuuauuugcaagcacaguauggucgaccguggcuggggaaauggcugcggucuauuuggaaaaggaggcauuguuacuugcgcaauguucaccuguaaaaagaauauggagggaaaaguggugcaaccggaaaaucuagaauauacuaucguaauaacuccacauaguggagaggagcaugccguaggcaacgauaccggaaaacaugggaaagaaauaaaaauuacaccccagucgucaaucacggaggccgagcugacuggguauggaaccgugacgauggaauguucuccucggaccggauuggauuuuaaugaaauggucuuacuucaaauggaagacaaagcguggcuaguacauagacaaugguuuuuagacuuaccacuuccauggcuccccggcgccgacacgcaaggaucuaauuggauccaaaaagaaacccuagugaccuuuaaaaauccacaugccaagaaacaagauguggugguguuagggagccaggaaggagcaaugcauacagcuuuaacuggggcaacagaaauacaaaugaguagcgguaauuuacuguuuacaggacaucugaaguguagacuccgcauggauaaauuacagcugaaaggaaugucauacucaauguguaccgguaaguuuaagauaguaaaggaaauagcagaaacacaacaugggacuauaguaauuaggguacaauacgagggcgauggaucaccauguaaaauaccauucgaaauuacagauuuagaaaaacgucacgucuuaggacgucucaucacuguuaacccaaucguaacggagaaagauagcccgguuaauaucgaagcugagccgccauuuggcgauucauauauaauaauaggugucgaaccgggacaacuaaaacucaacugguuuaagaaaggguccaguaucggacaaauguuugaaacaaccaugagaggggcaaaaagaauggccauacugggcgauaccgcaugggacuuuggguccuuagggggaguguuuacaagcauugguaaggcccuucaucaaguguuuggagcgauauauggagccgcauuuucggguguauccuggaccaugaaaaucuuaauugggguaauuauuacauggauagguaugaauagcagaaguacgucucuaucgguuucauuaguccuaguaggaguaguuaccuuauauuuaggagcuauggugcaagcugauagcgguuguguaguaucauggaaaaacaaagaacuaaaaugcgggagugguauuuuuauuacagacaacguucauacguggacugagcaguauaaauuucaaccagagucuccaaguaaacuugcgucagcaauacaaaaagcacacgaggagggaaucugcggaauaagaucagugacgagacuugaaaacuuaauguggaaacaaauaacacccgagcuuaaucauauuuuaucagaaaaugaaguuaaacugacgaucaugacaggugacauuaaagggauaaugcaagcggguaaaagguccuugagaccccaaccuacugaauuaaaauauaguuggaaaacaugggguaaagcaaaaauguuaaguacugaaucacacaaucaaacuuucuuaaucgacgguccugagacagcagaaugcccgaacacaaauagagcuuggaacucauuggaaguagaagacuauggauuugguguuuucacaaccaacauuuggcuuaaacuucgagagaaacaagacguauucugcgauucaaaacuuaugagugccgcuauuaaggacaauagagcugugcaugcagacaugggauauuggaucgaaagugcucuuaacgacacguggaaaauggagaaggcgagcuucauugaagucaaauccugucacuggccaaaaucgcauacucuauggucaaacggcguuuuagaaagugaaaugauaauaccuaaaaauuuugccggccccguaucccaacacaacuaucgaccuggcuaccacacccaaacagcuggcccauggcaucuagguaaacuugagauggauuucgaucuuugcgaaggaacuacuguugucguaacugaagacuguggaaaucgcggucccagcuuaagaacuacaacagcuaguggaaagcuaauaacagaauggugcuguaggagcuguacucucccaccguuaagauauagaggagaagaugguugcugguauggaauggaaauaaggccuuuaaaggaaaaagaagaaaaucuagugaacagccuagugaccgcaggucauggccagauugauaauuuuaguuuaggagucuugggcauggcucucuuuuuagaggaaaugcuaagaacccggauaggaacgaagcaugccaucuuguuaguagcagucagcuuugucacauuaauuacuggcaauaugaguuuccgcgauuuaggcagagucauggucaugguaggagccacaaugacugaugacauuggaaugggcgucacauauuuagcacuccuagcagcauucaaaguuaggcccacauucgcagcuggccuuuuauuaagaaaacucacaucgaaggaguugaugauggcaacuauaggaauagcucuauugucccagucgacuauaccggaaacaauacuagaauuaaccgaugcacucgcucuaggaaugauggugcuaaaaauagucaggaauauggaaaaauaucaacucgcagucacgaucauggcaauuuccuguguaccuaaugcaguaauuuuacaaaacgcuuggaaagucucauguacaauccuagcggcagucaguguaucaccucuacugcucacgucgucacaacaaaaagcggacuggaucccuuuagcgcucacaauaaaagguuuaaacccaaccgcuaucuucuuaacgacccucaguaggacaucuaaaaagcgauccuggccuuuaaacgaagcaaucauggcuguaggcaugguaucgauauuggcaaguucguuguuaaagaaugauaucccaaugacagggccacugguugcaggagggcuauuaacuguuugcuacguacuuacgggaagaagcgcagacuuggaguuggaaagagcagcagauguaaaaugggaggaccaagcugagauuucaggcaguucgccaauacuaaguauaacaauaucagaagacggauccaugaguauaaagaaugaggaagaagaacaaacucuaaccauacugauccgcacaggguugcucgucauaucagguguuuuccccguguccauacccauuacggcagcagcgugguaucuaugggagguuaagaaacaacgagcuggugucuugugggacguuccuucaccaccucccguggaaaaggcggagcuagaagauggugcguacagaauaaaacaacgcggcauacuaggcuauagucaaauuggcgccggaguauauaaagaagggacuuuucacacaauguggcauguuacgagaggagcuguuuuaaugcauagaggcaagaggaucgaaccuaguugggcggauguuaagaaagaucuaauaucguauggaggaggcuggaagcuagagggugaguggaaggaaggagaggaaguacaaguccuagcauuagaaccaggcaaaaauccaagagccguacaaacuaaaccaggaauauucaaaaccaauacggguacuaucggcgcaguaagucuugacuucucgccaggaacuucaggauccccgauuguugaucgcaagggaaaaguuguuggauuguauggcaacggcguaguaacuagaucuggcgcuuauguguccgcaauagcgcagacagagaaaucaauugaggacaaucccgaaauugaggacgauauauuucgaaagaaacgguuaacaaucauggauuuacacccgggggcgggcaaaacaaaaagauauuuaccagcaauuguccgcgaagcaauaaagaggggccucagaacacuuauauuagccccuacccggguaguagcagcugaaauggaagaggcgcugagaggauuaccgauaagguaccaaacgccugcaaucaagacugagcauacaggccgagaaauaguugaccuaaugugccacgcaacguuuacuaugcgucuuuuaucuccuguccgagucccuaauuacaauuugauaaucauggacgaagcucauuucacugauccggccaguauagccgcucguggguacauaucaacuagagucgaaaugggagaagcagcaggaauuuuuaugacugcaacgccaccugguagucgagauccauucccacaaucuaaugcuccaauaauggaugaggaacgagagauaccagagagaagcuggaacucaggacaugagugggugacggauuucaaaggaaaaaccgugugguuuguaccaucaauaaaggcggguaacgauauagcagcaugucuucgcaagaacgggaagaaaguaauacaacuauccagaaagacauuugauagugaauacguuaagacgcgagcuaacgauugggauuuugugguaacuaccgauauuagcgaaaugggagcuaacuuuaaagcagaaagaguaaucgauccuagacgauguaugaaacccguuauucucacugauggagaagaaaggguaauauuagcagguccuaugcccguaacacacucgagcgcggcgcagaggagagggagaauaggaagaaaucccaaaaaugaaaacgaccaguacauauauaugggagaaccauuagaaaacgacgaggauugugcgcauuggaaagaagcgaaaauguuauuggacaauauuaauacaccggaaggaauaauaccaucaauguuugaacccgaacgagaaaaaguggacgccauagacggggaauaccgacugcgaggugaagcuaggaagacauucguugaucugaugcggagaggagauuuaccgguguggcuggcguacaaaguagcugcggaaggcauaaauuacgcugacagaaaaugguguuucgaugggauuaaaaauaaucaaauauuagaagagaauauggaagucgaaauuuggacgaaagaaggagaaagaaagaaauugaaaccgcggugguuagacgcacgcauauacagugauccccucgcauuaaaagaauuuaaggaguuugccgcgggaagaaaaucgcuuacacugaaucuuauaacagaaaugggucgguuaccaacuuuuaugacacaaaaagcaagaaaugcgcuugacaauuuagcuguguuacacaccgcagaggccgguggcagagcauauaaccaugcacuaagugaguuaccugagacgcuggagacucucuugcuucuuaccuuacuagcaaccgucacuggggguauuuucuuauuucuaaugagcgguaaagggauuggaaagaugacuuuggggauguguuguauuauaacagcaucuauauugcuuugguacgcgcaaauucaaccgcauuggaucgcugcuuccauaauacuagaguucuuuuuaauuguuuugcuuauaccugaaccugaaaaacaaagaaccccgcaagauaaccaguuaacuuauguggucauagccauauuaaccguuguagcggcaacaauggcaaaugaaauggguuuucuggagaaaacgaagaaagaccuaggucuggguagcauuacaacacaagaaucagaaucaaacauauuagauauagauuuaagaccagcuagugcguggacacucuaugcaguugcuacgacuuuugucaccccaauguugagacauagcauugaaaacucgucagugaauguuucauugacagcaauagcaaaucaagcgacaguacuaaugggacuuggcaaagguuggccauuaaguaaaauggauauaggagucccacuauuagcuauuggaugcuacagucaggucaacccaauaacacuuacugcagcuuuauuacuuuuaguagcgcacuacgcaauuauugggccaggacuacaagcaaaggcgaccagagaagcucagaaaagagccgcggcagguauuaugaaaaauccaacaguggaugggauaacaguuauagauuuggaaccgaucccauaugauccaaaauucgaaaagcagcuaggucagguaaugcuuuuaauacuuuguguaacccaaguuuuaaugaugaggaccacgugggcucuaugcgaagcucugacucuggccacuggcccaaucucgacacuaugggaaggaaauccuggucgguuuuggaauacuacaaucgccgucucuauggcaaauauauuuagggguucauaucuggcaggagcaggcuuacucuucagcauaaugaaaaacacgacuaauacucgcaggggaacaggaaacauuggugagacacuuggugagaaauggaaauccagguugaacgcauuagguaaaagugaauuucagauauauaaaaagagcgggauccaagaaguagacagaacacuagcuaaagaaggaauaaaaaggggagaaacugaucaucacgcaguuucacgggggagugcgaaacuccgaugguucguugaaagaaauauggucacgccugaagguaaagucguagaucuaggauguggcagaggaggguggucauacuauuguggaggauuaaagaacgugcgagaggucaaaggauuaacaaaaggcggaccuggacacgaggaaccuaucccaauguccacuuacggguggaacuugguaagacuccaaagcgggguugaugucuucuuuacgccucccgaaaaaugcgauacucuguuaugugacauaggggaaucgucgccgaacccuacuauugaagcgggucgaacgcuucgaguuuuaaauuuaguggagaacuggcuuaauaauaacacucaauuuuguauaaaaguauugaacccauacaugccuagcguaauugagaaaauggaagcucuacaaaggaaauaugguggcgcauuggugagaaacccccuaagccgaaauucaacacacgagauguauuggguaucuaaugccacaggaaauaucgugagcucaguaaauaugauuuccagaaugcuaauaaauagauuuacuaugaaacauaagaaggcaacauaugaaccagauguagacuuaggaucggggacuagaaacauagguauugaaucagagauaccaaaccuugauauaauuggaaaacgaauugaaaagauuaaacaagagcaugaaacuucauggcauuaugaucaagaucaccccuauaaaacgugggcauaccauggaucuuaugaaacaaagcaaacaggauccgcgucuucuauggucaacggagugguacgcuuguuaacuaaaccaugggauguaguaccaaugguuacccagauggcuaugacagacacaacaccauuugggcaacagagaguuuucaaagagaaaguggacacuagaacucaagagccaaaagaggguaccaagaaacuuaugaagauuacagcggaauggcuauggaaagaacuggguaagaaaaagacaccgagaauguguacaagggaagaguucacacgaaagguaagaucaaacgcagcauuaggugccaucuuuaccgaugaaaacaaauggaaaagugcaagagaagcaguagaagauggccgauuuugggagcuaguggauagggaacgaaauuugcacuuggagggaaagugugaaaccugcguuuacaauaugaugggaaaacgagaaaagaaauuaggugaguucggcaaagccaaaggcaguagagcaauuugguauaugugguuaggcgcaagauuccuagaguucgaggcauuaggguucuuaaaugaggaccauugguuuucaagagggaauaguuuaucaggaguagagggagaaggauugcauagauugggguauauacuuagggacguggguaaaaaggaagguggagcgauguacgccgaugauacagcggggugggauacacgaauaaccuuagaagauuugaaaaacgaggaaaugguaaccaaucacaugaagggcgaacauaaaaaguuggcggaagcaaucuucaaacuuacauaccaaaauaaaguaguaagaguacaaagaccaacaccaaggggaacuguuauggauauuauaaguagacgagaucagagagggucaggacagguggggacauaugggcuuaauacuuucacaaacauggaagcgcaauugauucgucaaauggaaggggaagguauuuuuaaguccauccaacauuuaacagcaagcgaggagacggcaguacaaaauugguuagcaagagucggucgggaaagauuaaguagaauggcgaucucaggagaugauugcguaguaaaaccaauagaugauagguuugcauccgcucucacagcgcuaaaugacaugggcaaagugcguaaagacauacaacaaugggaaccaucacgcggcuggaaugauuggacgcaagugcccuuuuguagccaccauuuucaugaacuuguaaugaaagacggacguguucucguaguuccuugucgaaaucaagaugaauuaauagggcgagcuagaauaucacaaggcgcagguuggagccuaaaagagacagcaugcuuggguaaaaguuaugcucagauguggacacuuauguauuuucaccggagagauuuacggcuagcugcgaacgcaauaugcucagcaguaccuccacacuggguaccaacaucccgaacaacuuggagcauacaugcaaaacacgaauggaugaccacugaagauauguuagcagucuggaaucggguguggauacaagaaaaucccuggauggaagauaaaacacccguugaaucaugggaggaaguaccguaccuaggaaaacgcgaagaccaauggugcgguagccuuauaggauugacuucacgagccaccugggccaaaaacauacagaccgcaauuaaucaaguccgaagucuuauagggaacgaggaguacaccgauuacaugcccucgaugaaaagauuucgccgcgaggaagaagaagcaggaguucuaugguaa

SEQ ID NO: 22422 - RNA, 9876 nt, Artificial Sequence
  derived and/or modified CDS sequence (opt6) from DENV-2__FJ850064__SS-prME
acugcaggaguaauuguuauguuaauuccuacugcuauggcauuucaccuaacuacgcguaauggagaaccacacaugauaguaggacggcaagaaaaaggaaagagcuuguuauuuaaaacagaagacgguguaaauauguguaccuugauggcgauagaccuuggugaacucugcgaagacacaauaacguacaaaugcccguugcuuaggcaaaaugaacccgaagauaucgauuguuggugcaacucgacaucaacguggguaacauacgguacauguacaacgacuggagaacauagaagagaaaaacgaaguguugcauuaguaccacacgugggaaugggucuggaaacgcgcaccgaaacguggaugagcucagaaggggcauggaaacauguucaacguauugaaacauggauuuuaagacauccgggauuuacuauuauggcugcgauccuugcauauacuauugggacaacucauuuccagcgagcucugaucuucauauuauuaacagcaguagcuccaucaaugacgaugcgauguauugguaucaguaaccgcgauuuuguggaagggguauccgguggaaguuggguggacauaguacuugaacauggauccugcgugaccacuauggcuaaaaauaaacccacguuggauuucgaacuaauaaaaacagaagccaaacagccagcaacacugaggaaauauugcaucgaagcaaaauuaacuaacacaacaaccgaaaguagauguccgacacaaggugaaccaucauuaaaugaagaacaagacaaacgauuuauauguaaacauucuaugguagauaggggauggggaaauggaugcggacuguuuggcaaaggaggaauaguaacuugcgcuauguucacauguaagaaaaauauggaaggaaaaguaguacagcccgaaaaucuugaauauacaauuguuauuacaccgcacagcggagaagaacaugcaguaggaaacgacacgggaaaacacggaaaagaaaucaaaauaacaccucagucuaguauaacagaagcagaacuaacggguuaugggacgguaacgauggaaugcucgccaaggacaggucuagauuuuaaugagaugguacuauugcaaauggaagacaaagccugguuaguccauagacagugguuuuuagauuuaccgcuccccugguugccaggagcugacacgcagggaucaaacuggauccagaaagaaaccuuaguaacauucaaaaauccccaugcaaagaaacaggaugugguaguuuuaggcucacaggagggugcaaugcacacagccuuaacgggugcuacggaaauacaaaugucauccgguaaccucuuauucacuggacaucuaaaaugcagauuaagaauggauaaacuacaacugaaagguaugaguuauucaauguguacgggaaaauuuaaaauuguuaaagaaauugcagaaacucaacacgggacuaucgugauaagagugcaauaugaaggugauggauccccaugcaaaauaccguucgaaauuacugacuuagagaaaagacaugugcuuggcagacuaauaacuguaaaccccauaguuacugaaaaagauucuccagucaauauagaagcggaacccccguucggugauucauacauaaucauuggaguagagccaggacaauugaaauuaaacugguucaagaaagggucuucuauaggacaaauguucgccaccaccaugagaggagcaaaaaggauggcgaucuuaggagacacagccugggauuuuggcaguuuagguggcgucuuuacgucaauaggcaaagcgcuucaucaaguuuuuggugccaucuacggggcagcuuucagugguguaucuuggaccaugaaaauacuaauugguguaaucauaacauggauagggaugaauagucgaaguaccucacucaguguaucuuuagugcugguagguguaguaacccuauacuugggagcaaugguacaagcggauagcgguuguguaguaucauggaagaauaaggaacucaagugugguucaggaauuuucauuacagauaacguccacacauggacagagcaauacaaauuucaaccagaaucacccagcaaguuggcuagcgcaauacagaaagcgcaugaagagggaauaugcggcauaagaucaguuacccgacucgaaaacuugauguggaaacaaauaacacccgaauugaaucacauccuaucagaaaacgaggugaagcucaccaucaugacuggugauauaaaagguauuaugcaagccgguaaacguucucuuaggccgcaaccuaccgagcuaaaauauucauggaaaaccuggggcaaagcaaaaaugcugagcacagaaagucauaaucaaacuuucuugauagacggaccagaaacugccgaauguccaaauacgaaccgcgcuuggaacucgcuagaaguggaagacuauggauuugguguauucacaacuaauauauggcuaaaacuccgagagaaacaagauguguuuugugauaguaaacuaaugucugcggcuauaaaagacaaucgggcaguccaugcagauaugggguauuggauagaaagugcguuaaacgacacguggaaaauggagaaagccagcuuuauugaaguaaaaucaugccauuggcccaaaagucauacgcuuuggucuaacggcguauuggaaagugaaaugauaauaccgaagaacuucgcuggaccagucagccaacauaauuauagaccaggcuaccauacacaaacugcaggcccauggcaccucgguaaacuggagauggauuucgacuuaugugaagggacaaccgugguaguuacugaagauugcggaaaucgagguccaagucuuagaaccaccacugccucggggaaauugauuacugaaugguguugcagguccugcacauuaccgccucucagauaucguggagaggauggcugcugguaugguauggaaauucgaccuuugaaagaaaaagaagagaauuuagugaacucuuuaguaacagcggggcauggacagauugauaauuuuaguuugggcguccucggaauggcacuauuuuuagaggaaaugcucagaacccguauaggcacaaagcacgcaauacugcuaguagcuguaaguuuuguaacgcucauaacgggaaauaugucuuuccgcgaucugggaagaguuauggucaugguuggcgcaaccaugaccgaugauauuggcaugggaguaacuuauuuggcacuacuugcagcauuuaaaguaagaccaacauuugcagcaggguuguuacugcgaaaacuuacuucaaaagaacuaaugauggcaacaauaggaauugcauuauugucucaaagcacgauaccggaaaccauucucgaacuaacugaugcguuagccuuaggaaugaugguucugaaaauaguaagaaauauggaaaaauaucagcuugcaguuaccauaauggcaauuucauguguccccaaugcuguaauccuccaaaaugcauggaaagugucaugcacaauauuggcugcaguguccgucagcccucuauuacuaacaucaucucaacagaaggcagauuggauaccucuggcccugaccauaaaaggucuuaauccuacagcaauauuucuaacaacgcuuucuaggaccagcaagaaaagguccuggcccuugaaugaagccauaauggccgugggaauggucagcauucuagcaagcucacuauugaaaaaugauauacccaugacaggaccccucgucgcaggagggcuauuaacaguauguuauguuuugacugguagaucugcggauuuagaauuagaaagagcagcugauguaaaaugggaagaccaagcagaaauauccgguucgucaccuauauuaaguauaacgauaucagaggaugggucaaugucuauuaaaaaugaagaggaagaacaaaccuugacuauccuaauacgcacgggauugcuuguaauuucaggggucuuuccuguaucuauccccauaacagcugccgcaugguauuugugggaagucaagaaacaacgcgcugguguauuaugggauguaccuaguccaccaccaguagagaaagcagaauuggaagauggugcauauaggauaaaacaacgagggauucuagguuacagucaaauuggugcuggaguguauaaagaaggcacauuucauacaauguggcaugucacaagaggugcaguucuuaugcauagagggaaaagaauugaaccuuccugggccgacgugaagaaagauuugauuucauacggaggcggguggaagcuggaaggagaguggaaggaaggggaggagguucaaguauuagcgcuggaaccagguaaaaauccacgggcuguacaaacaaaaccuggaauuuuuaaaacaaacacagguaccauaggugcaguaaguuuagauuuuagccccggaacgagugggucccccauuguugaccggaaaggcaaagucguaggcuuauacgguaauggaguaguuacgagaucgggagccuaugugucagcuauugcucagacggaaaaaucaauugaagauaacccagaaauagaagacgacauauuucguaagaaacguuuaaccauaauggaucuccaucccggagcuggcaaaacgaaaagguaccugcccgcaauaguuagagaagcgaucaaaagaggauuaaggacauuaauccuugccccgacacggguaguugcugcugaaauggaagaagcgcuuaggggguuaccuauacgauaccaaacaccagcuauuaaaacggaacacaccggaagagaaaucguagaucuaaugugccacgcaacauucaccaugaggcuuuuaucaccaguucgaguaccgaauuacaaucugaucauaauggacgaagcacacuucacagacccugcaaguauagccgcuaggggcuauauaucgacaaggguggaaaugggcgaagcugcagguauauuuaugacagccaccccucccgggagucgugauccauucccacaaaguaaugcaccgauuauggacgaagaacgugaaauaccugaaagaucauggaauaguggucaugaauggguaacggacuuuaaagguaagacaguaugguuugugcccucuauuaaggcagguaaugacauagcagcuugcuuacgcaaaaauggcaagaaaguaauacaauuaagcagaaaaacauucgauucagaauacguaaaaacgagagccaacgauugggauuucguagugacaacagacauuucggaaaugggagcuaacuuuaaagcagagcgagucauagaccccagaagaugcaugaaaccaguaauacuuacagauggagaagaacggguuauacucgcugggccaaugccuguuacccauagcagugcugcacaaagacggggacguauuggccgaaaccccaaaaacgaaaacgaucaguauaucuauaugggggagccccuggagaacgacgaggacugugcucauuggaaagaagcaaaaaugcuucucgauaauauaaacacuccagaagguauaauaccauccauguuugaaccggagcgugaaaaaguagaugcuauugacggggaguauagguugcgaggagaggcaagaaaaacuuucguagacuuaaugaggaggggcgauuugccgguuuggcuagcguauaaaguagcggcagaagguaucaauuacgcugauagaaaauggugcuuugauggaaucaagaauaaucaaauacuagaagaaaacauggagguagaaauauggacuaaggaaggugaaaggaagaaacuuaagccaagauggcuugacgcaaggaucuacagugacccgcuugcacuaaaagaguucaaagaauuugcggcaggaagaaaaaguuuaacguuaaacuuaaucacugaaauggggcguuuaccaacguucaugacacagaaagcgaggaaugcacuagauaaucuggcaguucuacauacggcagaagcaggaggcagagcauauaaccaugcgcuguccgaacuuccugaaacacuagaaacucucuuacuucuuacccugcuagccacaguuacagguggcauauuucuauuucuaaugucuggcaaaggaauugguaaaaugacauuaggaaugugcuguauaauaacggcgagcauauuacugugguacgcccaaauucagccucacuggaucgcagcaucaaucauacuugaguucuuucuuauuguucuucuuaucccggaaccagagaagcaacgaacaccacaagauaaccaauugacauauguagugauagcaauauugacaguaguagccgccaccauggcgaaugaaauggguuuucucgagaaaacuaagaaagaccuagguuuagguucaauaacaacacaagaaagcgaaucaaacauucucgauaucgauuuacguccagcgucggcguggacacuauacgcaguagcgacgacauuugugacaccaaugcuacgucauagcaucgaaaauucauccguaaaugucucgcuuacugccauagcuaaucaagcaacgguauuaaugggauugggaaagggauggccucugucuaaaauggauaucggugugccgcuauuagccauugguugcuauucucaagucaauccaaucacgcuaacagcugcccuacugcuguuaguugcucauuaugcaaucauaggacccggccugcaagcgaaagcaaccagagaagcccagaaaagagcugcagcgggaaucaugaagaacccuacugucgauggaaucacugugauagauuuggaacccauuccuuaugauccaaaauuugaaaagcaauugggacaaguuaugcuucuaaucuuaugcguaacucaagucuugaugaugaggacaacaugggcuuuaugugaagcacucacccuugcaacagguccgauaucgacucuaugggaagguaaucccggacgguuuuggaauacuacaauagcuguaucaauggcaaacauauuuagaggaucauacuuggcgggugcaggauuacuauuuaguauaaugaagaacacaacuaauacuagaagagguacggguaacauuggcgaaacccucggggaaaaguggaaaucuagauuaaaugcacuuggaaaaagugaguuucaaauauacaagaaaucagggauucaggaaguagaucggacuuuagcuaaagaagggauaaagcggggagaaacagaccaucacgcaguaaguagggguucugcaaaacuucgaugguuugucgaacguaacaugguuacacccgagggcaaagucguagaccucggaugcggaagggguggcugguccuauuauuguggaggacugaaaaacgucagagaagucaaagggcuaacaaagggaggcccuggacaugaagaaccuauaccuaugaguacauauggcuggaaucucguucgccuacaauccggaguagacgucuucuuuacuccaccugagaaaugugauacguuauuaugcgauaucggagagucgagcccaaacccuaccauugaagcugggcgcacacuccgcguauugaaucuaguugaaaacuggcuaaauaacaacacgcaguuuuguauuaaaguucuaaauccguauaugcccucaguuauugaaaagauggaggcuuuacaaaggaaauacggcggugcacugguuaggaauccauuaucgagaaacucgacccaugaaauguauuggguaucaaacgcuacaggaaauauagugaguucugucaauaugauuucuaggauguugauaaaucgauuuacuaugaagcacaagaaagcaacauaugaaccagacguagauuugggaagugguacgcgcaauauaggaaucgaaagugagguaccaaauuuagacauaauaggaaaacgaauugagaaaauaaaacaggagcaugagacaaguuggcauuaugaccaagaccauccauauaaaacaugggccuaccacgguucauacgaaacaaaacaaacggggagugcgucuaguaugguaaacgggguggucagacuguuaacaaaaccuugggacguggucccaaugguaacacaaauggcgaugacagauacaacgccguucgggcagcaaagaguguuuaaagagaagguggauacacguacccaagaaccaaaggaggguacaaagaagcucaugaagauaacugcugaauggcuauggaaagagcuuggcaagaagaaaaccccuaggauguguacacgcgaggaguucacucggaaaguccgaucgaaugcggcucugggugcuauauuuacugaugaaaauaaauggaaaucagccagagaagcaguagaagauggaagauucugggaacucguugacagagaaagaaauuugcauuuggaggguaagugcgagaccuguguauauaauaugaugggaaagcgcgagaagaaauuaggagaguucgguaaagcaaagggaucucgggcaauuugguauauguggcuuggugcacgcuuccuagaguucgaagcgcuaggguuucuuaaugaagaucacugguucucaagagggaauaguuuaagugguguggaaggugaaggguugcaucgauugggauacauacucagagacgugggcaagaaagaaggaggagcaauguacgcagacgauacggcagguugggauacgcguaucacccuugaagaucugaaaaacgaagagaugguaacgaaucauaugaaaggagagcauaagaaacuagcugaggcuaucuucaaauuaacuuaucaaaacaagguaguaaggguacaaaggccuacaccgagagguacuguaauggauaucauaucaaggcgugaccagagaggaaguggccagguugggacauauggccucaauacauuuacaaauauggaagcucaauugauuagacagauggaaggggaagguaucuucaaaagcauucaacacuuaacggccacugaggagaucgcaguacaaaauuggcucgcaaggguuggaagggagaggcuaucaagaauggcaaucagcggagacgauugcguuguuaagccuauagacgacagguuugcaucugcuuuaacugcgcuaaacgauauggguaaggucagaaaagauauacaacaaugggaaccaucaaggggguggaaugauuggacacaaguccccuuuugcucucaccauuuccaugaacugguaaugaaagauggacgaguauuagugguuccauguagaaaucaagaugaauugauagggcgagccaggauaagucaaggagcaggauggagucuaaaagagacugcgugcuugggcaaaaguuaugcacaaauguggacguuaauguauuuccauagacgagaucuacgacuagcagcuaaugcaauuuguagugccgucccgccacauuggguaccaaccucuaggacgacauggaguauucaugcaaagcaugaauggaugacaacagaagacaugcuagcaguauggaaucggguuuggauccaagagaaucccuggauggaagauaaaacaccaguggagucuugggaagagguaccauacuugggaaaacgugaggaccaaugguguggaucauugaucggauugacgagcagggcaacaugggcuaaaaauauacagaccgcaauaaaccaaguacguucauuaaucggaaaugaagaauauaccgauuauaugccgaguaugaaaagauuccgaagggaagaagaggaggcaggcgugcuuugguag

SEQ ID NO: 22423 - RNA, 9876 nt, Artificial Sequence
  derived and/or modified CDS sequence (opt6) from DENV-2__FJ850065__SS-prME
acagccggugucauagucauguuaauuccuacagcuauggcuuuucacuuaaccacgagaaacggggaaccacacaugauaguuggacgacaagaaaaagggaaaucauuacuuuucaaaacugaagauggugugaauauguguacauuaauggcaauagacuugggagaacugugugaagauacaauaacguacaaauguccuuuacuacgucagaaugaaccagaagauauagacuguugguguaauaguacgagcacguggguuacguaugguacguguacuacaacgggagaacaccgaagagaaaaacgcuccguugccuuaguaccccaugucgguaugggucuagaaacacgaacugaaacauggaugaguucagaaggggcguggaaacacguccaaagaauagaaacuuggauuuuaagacacccaggguuuacgauaauggcagccauauuggcauacacgauuggaaccacgcauuuccaacgagcucuuauuuucauauuauugacagcaguugcacccaguaugacaaugcguugcauaggaaucucaaacagagacuuuguagaaggcguaucagguggaagcuggguugauauaguauuagaacacggcaguugcgugacaacaauggcuaaaaauaaaccaaccuuagauuuugaacuuauaaaaacagaagcaaaacaaccagcaacgcuacguaaauauugcacugaagcaaaacuaacaaauacaacuacagaaagucgaugcccgacacaaggggaaccaagucuuaacgaagaacaagauaaaagauuuaucuguaaacacagcauggucgaccgagggugggggaacgguugcggccuauucggaaaagguggcauaguaacuugugcuauguuuacauguaagaaaaacauggaagggaaaguaguacaacccgaaaaucuagaauauacuauuguuauaacaccacauucaggcgaagaacacgccgugggcaacgauacagguaaacacggaaaagaaauuaaaauuacuccacaaagcaguauaacggaagcugaauuaacagguuauggaaccgugacaauggaauguucgccacguacaggucuagauuucaaugaaauggugcuacuucaaauggaggacaaagcauggcuaguacauagacaaugguuuuuggacuuaccacugccuuggcugccuggagcugauacucaagggaguaauuggauucaaaaagaaacacucguaacuuuuaaaaauccgcaugcuaagaaacaagacguggugguucuaggaucacaagaaggugcaaugcauaccgcuuuaacgggcgcaacggaaauccagaugucaaguggaaaccugcuauucacuggucauuuaaaauguagauugagaauggauaaauuacagcuaaaaggaaugucauauucaaugugcacgggaaaauucaaaaucguuaaagagaucgcagaaacacaacauggcacaauagucauaagaguacaauaugaaggagauggcaguccaugcaaaauaccauucgaaauuacagaccuagaaaaacgucauguuuuaggccguuuaauuacuguuaacccaauugucaccgaaaaagauagcccgguaaacauugaagccgaacccccguuuggugacucuuauauaauaaucgguguugaaccgggucaguuaaaacuuaauugguucaagaaaggaucuucuauaggucaaauguuugaaacgaccaugaggggagcaaaacgaauggcgaucuuaggugauacggcuugggacuuuggaagucuaggaggaguauucacgagcaucggcaaagcauuacaccaaguauuuggagccauuuauggugccgcauuuagugguguuucuuggacgaugaaaauacuuaucgguguuauaauaacuuggauagguaugaacucgaggaguacuucacuuagugucucauuagugcuaguugggguuguaacacuguaccuuggcgcaaugguacaagcagacucuggcuguguggucaguuggaaaaacaaagaguuaaaaugugggaguggaauauuuauuacugauaacguacauacauggacagagcaauauaaauuucagccggaaaguccaaguaaauuggcaucagcaauacaaaaagcucacgaagaggggauaugcgguauacggucagucacacgauuagaaaaucucauguggaaacagauaacucccgaauugaaucauauuuuaagcgaaaacgaaguaaaauuaacuauuaugacuggagauauaaagggaaucaugcaagcaggaaaacgaucuuuaagaccacagccaacagaguuaaaguauagcuggaaaacguggggaaaggccaagauguuaaguacugagagccauaaucaaacuuucuugauugacggacccgagacagcagaauguccaaacacuaaucgagccuggaacucuuuagaaguggaagauuacgguuuuggcgucuucacaaccaauauaugguugaaacuucgugaaaaacaagauguauuuugcgacaguaaauugaugagcgccgcaauaaaggauaaucgggccgugcaugccgacaugggauacuggaucgagucggcguuaaaugauaccuggaaaauggaaaaagccucauuuauagaagugaaaucaugucauuggccaaaaucucacacccuauggaguaauggaguucuugaaucugagaugauuauccccaaaaauuuugcagguccaguaucacaacauaauuaucgaccaggguaucacacccagacggcagguccuuggcaucuagguaaauuagaaauggauuuugaucugugcgaggggaccaccguuguaguuacagaggacugugguaaccgaggcccaaguuuacguacaacaacagcgucgggcaaacucauuaccgaauggugcugucggucuuguacgcucccgccacuaagauaccgaggugaagauggaugcugguauggcauggaaauacgaccacuuaaggaaaaagaagaaaauuuagucaacucauuagucacugcaggacauggccaaauagauaauuucucauuaggagugcuggguauggcuuuauuucuggaagaaaugcuuaggacccgaauuggaacaaagcaugcaauucuauuaguagcagugagcuuuguaacccugauuacugggaauaugagcuuuagagacuuaggucgaguaaugguaauggucggagcaacuaugacugacgacaucgguaugggagugacuuauuuagcauugcucgcggcuuuuaaggugaggccuacguuugcugcaggauuguuauuaagaaaguuaacgucaaaagaacucaugauggcuacuauaggaaucgcacuucuaagccaaaguacuauaccagagacuauucuggaauugacagaugcccuugcuuuagggaugauggugcugaaaauagucagaaauauggaaaaauaucaguuagccguaacuauuauggccaucaguuguguccccaaugcaguaauucuucagaacgcauggaagguguccuguacaauauuagcagccguaagcguaucgccguuacuccuaacaaguucacaacaaaaagcagauuggauaccacuagcguugacaauuaaagguuuaaacccgacggccaucuuccucacuacgcuuagucgcacaaguaagaaaagaagcuggccacuaaaugaagcgaucauggcugugggcaugguaucgauucuagcuucaucauuacugaagaacgauauaccaaugacugguccguuagucgcaggcgggcuucuuaccguaugcuauguauuaacaggaagaucggccgacuuggaacucgaaagggcugcagacgucaaaugggaagaucaagccgaaauuagcgguaguaguccaauacuaucgaucacgaucucagaagacgguuccaugaguaucaaaaaugaagaagaggaacaaacccuaacaauacuaauuagaacaggauuauugguaauaagcggaguuuuucccguuuccauuccuauuacggccgccgcgugguaucuaugggaaguuaagaaacaaagagcaggcguucugugggacgugccaucaccaccaccaguugaaaaagcggagcuggaagauggagcguacagaauaaaacagagaggaauacuuggauacucucaaaucggugcaggaguuuauaaagaagguacuuuccauacaauguggcacguuacaaggggagcuguccucaugcacagaggcaaacguauugagccgucaugggcggauguuaagaaagauuugauuucauacggaggaggauggaaauuagaaggugaguggaaagaaggugaggaaguucaaguucuugcacuggaaccuggcaaaaacccacgugcaguccagacaaaaccagguauauuuaaaaccaacacagggacaauuggagcggugucauuagauuucuccccagguacaaguggaaguccuaucguagauagaaaagguaaagucgugggucuauauggaaauggaguaguaacacgcucaggagcauauguauccgcaauagcacaaacagaaaaaucaaucgaagauaacccggagaucgaagaggacaucuuuaggaagaaaagacucaccauaauggauuuacacccaggggccgguaagacuaaaagauaccucccagccauaguacgcgaagcaauaaaacgcggauuaaggacgcuaauauuggcacccacaagaguugucgcagcagagauggaagaagcucuaaggggacuuccuauaagauaucagacgccagcgauuaaaacagaacauacuggacgggagaucgucgauuugaugugucaugccacuuuuacaaugcgucuccuaucacccgugcgugugccaaauuacaacuuaauuauaauggacgaagcucauuuuacugaucccgcuuccauagcggcgagaggguauauuuccacucgagucgaaaugggagaagcagcgggcauuuuuaugacagcgacaccuccuggaucccgagacccguucccccagaguaacgcaccuauaauggacgaggaaagagagaucccugaacggaguuggaacucagggcaugagugggucacagauuucaaaggcaaaacagugugguuuguuccaucuauaaaagcagguaaugauauugcggcuugcuuacguaagaacgggaagaaagugauucaguuaucacgaaaaacauuugauagugaguauguaaaaacaagggcaaacgacugggacuuuguugugacgacagauauuagugaaaugggugccaauuucaaagcagagagaguuauagacccgagacguugcaugaaaccaguaauucuuacugacggagaagaaaggguaauacucgcagggcccaugccuguuacucacaguagugcggcacaaagacgagggcgcauuggucgaaacccgaaaaacgagaacgaucaauauaucuauaugggcgaaccucucgaaaaugaugaagauugugcacacuggaaagaagcaaaaaugcuccuagacaacauuaauacgccugaggggauuauucccucaauguuugaaccggaacgugaaaaagucgaugcuaucgauggugaauaccgacuacguggagaagcuagaaaaacauucguugaucuaaugagaagaggggaccuaccuguuuggcuggccuauaaaguagcugcagaaggcaucaacuacgcagacagaaaaugguguuucgauggcauuaaaaauaaccagaucuuagaagaaaauauggaaguugaaaucuggacuaaagagggggaaaggaagaaacuaaaaccaagauggcuugacgcacgcauauauucugacccucuagcacuuaaagaauuuaaggaauuugccgcuggucgaaaaucacucacauuaaaucuuaucacugaaaugggaagguuaccaacuuucaugacacaaaaagccagaaaugcauuggauaacuuagcaguuuuacauacagcugaagccggagggagagcauauaaccaugcucucagcgaacuuccagaaacuuuggagacauugcuucugcuuacuuuacucgcuacuguaacgggaggaauauuucuauuuuuaaugucuggaaaagguauaggaaaaaugacucuagguauguguugcauuauuacagccaguauccuuuuaugguacgcacaaauacaaccucauuggauagcugcuagcauaauauuagaguucuuucuaaucguucuucuaauaccagaaccagaaaaacaaagaacgccccaggauaaccaauugacuuauguagugauugcaauacuuacuguugucgcugcaacuauggcaaacgaaaugggcuuuuuagaaaagacuaagaaagaccuaggacucggaucgauaaccacccaagagagugaaucaaauauacuagauauagaucugaggccagcauccgcuuggacacuauaugccguugcaaccacuuucguaaccccgaugcuuagacauaguaucgagaauaguucagucaaugucucucuuacagcaauagcaaaucaagcuaccguucuaaugggucugggaaaagguuggccccucucuaaaauggauaucgguguuccucugcuggccauagguugcuauucacagguaaaccccauaacacucacagcggcucuacuauuacuugucgcacacuaugcuaucauugguccuggguuacaagcgaaagcgacccgugaagcacaaaagagagcugccgcuggaauuaugaagaauccaacaguggacggaaucacuguuauugaucuugaaccaauuccauaugauccuaaguuugaaaagcaguuaggacaaguuaugcuccugauauuaugcgucacacaaguucuaaugaugcguacuaccugggcgcugugugaagcacuaaccuuggcaacagguccuauaucaacacuaugggaagggaauccaggacgguuuuggaauacuacaauugcaguuagcauggcaaauauauuucgaggcaguuaccuagcuggcgcuggucucuuauuuucaauaaugaaaaacacaacaaauacucgccgcggcacuggaaauaucggagaaacgcuaggagaaaaguggaagucaaggcuaaaugcauuggggaaguccgaauuucagauauauaagaaaagugguauacaagaaguagauaggacauuagcaaaagaggggaucaaaagaggggaaacagaucaccacgcagucucgagggggucugcaaagcuaaggugguuuguagaaagaaauaugguaacaccagaagguaagguugucgacuuaggguguggaaggggugguuggaguuauuacuguggaggauugaaaaacgucagagagguaaagggauugacuaaaggaggaccaggccaugaggaaccaauacccaugucuacauacgguuggaaccugguucgucuccaaaguggcguggauguauuuuucacuccuccagaaaaaugcgauacguuacucugcgacauaggagaaucaaguccuaacccaacuauugaggcuggacguacauugcguguauugaaucuuguggaaaauuggcugaauaacaauacacaauuuugcauaaaaguacuaaaccccuauaugccaagcguuauugaaaagauggaggcacuucagcgaaaacaugguggcgcgcuaguucggaauccucuaagccgaaacucaacgcaugaaauguauuggguuucuaaugcaacaggcaacaucguaucaucgguaaauaugauuagccgaaugcuuauaaaucgcuuuacaaugaaacauaagaaagcuaccuaugaaccagacguagauuuaggcaguggaacacgaaauauagggaucgaauccgaaauaccuaacuuagauauaauuggaaaacgcauagagaaaauuaagcaagaacaugaaacgucauggcacuacgaucaagaccacccauacaaaacuugggcauaucauggaucauacgaaaccaagcagacgggcagugcuucuagcaugguaaauggagucguacgcuugcuaacuaaacccugggauguaguuccgaugguaacacaaauggcuaugacagauacaacaccauuuggacaacaacgaguuuucaaagaaaaaguagacacacgaacacaagaaccuaaagaaggaaccaagaaacuaaugaaaauaacagcagaauggcuauggaaagaauuaggcaaaaagaaaaccccaaggauguguacaagggaagaauuuacccgaaaagugagaaguaacgcagcucuaggagcgaucuuuacagacgaaaacaaauggaaauccgcaagggaagcgguugaagauggaagauuuugggagcuagucgaucgcgagagaaaucuucaucuagaagggaagugcgaaacauguguauauaauaugaugggaaagcgcgagaagaaauuaggggaguucggaaaggcaaaaggcaguagagccauaugguacaugugguuaggugcaagauuucuagaguucgaagcguuggguuuucugaacgaggaucacugguuuucccggggaaauuccuuguccgguguggaaggcgagggcuugcaccguuuaggauacauucuaagagacguaggcaagaaagaaggcggcgcaauguacgcugaugauacugcgggcugggauacccguauaacucuagaggaucucaaaaaugaggaaaugguuacaaaccacaugaaaggugagcauaaaaagcuagccgaagccauuuuuaaguuaacguaucaaaacaagguaguacgaguacaaagaccaaccccaagaggaacaguaauggacauaauaucccggcgcgaucaacggggcaguggacagguggguacauacggacuuaauacauucaccaacauggaggcucaguuaauuagacaaauggaaggggaagggauauuuaaaucuauacaacaccucacugcuacugaagaaauagcaguacaaaauugguuagcgagaguaggucgcgaaagacucucacgaauggccaucucuggggaugacugcguuguaaaaccuaucgacgauagauuugccagugcccucacugcacuaaacgauaugggaaaaguccgaaaagauauacaacaaugggaaccuaguagaggauggaacgauuggacccaaguaccguuuuguucacaccauuuccacgaauugguuaugaaggaugggaggguuuuaguagugccaugcagaaaucaagaugaacucauugguagagcccgaaucucucaaggagcugguuggucacucaaagaaaccgcaugccugggaaagucguacgcgcaaauguggacuuugauguauuuccaccgacgugaucuaagacuagcagcuaacgcgauaugcucugcgguaccgccacacuggguaccaacaucgagaacaacauggucaauccaugcuaagcacgaauggaugacuaccgaggauaugcuggcuguauggaauagagucuggauacaggaaaauccauggauggaagacaaaacgccaguggaauccugggaagaaguacccuauuuagggaaaagagaagaucaauggugugguagccuaaucggucuuacgucgagggcaacuugggcgaaaaauauucaaacagcaauaaaucaagucagaucucucauaggaaaugaggaauauacagauuacaugcccucgaugaaaagauucaggagagaagaagaagaggcugggguccuuugguag

SEQ ID NO: 22424 - RNA, 9876 nt, Artificial Sequence
  derived and/or modified CDS sequence (opt6) from DENV-2__FJ873808__SS-prME
acagcuggggugauaguuaugcuaauuccgacagcuauggcuuuucaccugacaacuagaaacggagaaccccacaugauaguaggaagacaggaaaaagggaaaagccuucuauuuaaaacugaagauggagugaacauguguacguuaauggcaauugauuugggggaacuaugcgaagauacgauaacuuacaaaugcccacugcugcgccagaaugaacccgaagauauagauuguuggugcaacaguacuucaacauggguuacuuacggaacuugcacaacaaccggcgaacauagacgagagaaaaggagcguggcacucguaccccauguaggcaugggucuugaaacgagaacggaaacuuggauguccucggaaggagcauggaaacauguacaaaggauagaaacguggauucuaagacauccgggauuuaccauuauggcagcuauucuagccuauacuauagggacaacacacuuccaaagggcacugauauucauuuuauugacugcuguagcaccaagcaugacaaugagguguauugggauaucuaaccgagacuuuguagaaggugugucuggcggguccuggguagauauaguacuagaacauggaagcugcguaacuacuauggccaaaaauaaaccaacccuggauuucgaacuuauaaaaaccgaagcaaaacagccugcaacauuaagaaaauacugcauagaggcaaaauuaacuaauacaacuacugaaagccggugcccaacgcagggugagcccagcuuaaacgaggaacaagauaaacgauucauauguaaacacaguauggucgaucguggauggggaaacggcugcggccuuuuugggaaaggagggauuguuacuugugcaauguucacauguaaaaagaauauggaagggaagguaguucaaccagaaaacuuggaauauacaauugucauaacaccccacucaggugaagaacacgcgguugguaaugacacaggcaaacacggcaaagagauaaaaauaacaccacaguccuccauuacagaagcugaauuaacaggauauggcacagucacuauggaaugcucaccaagaaccggacuagauuucaaugaaaugguuuugcugcaaauggaagauaaagcguggcuagugcacagacaaugguuuuuagaccuaccacuaccuugguugcccggugcagauacacagggcagcaauuggauccaaaaagaaacguuaguaacauucaaaaacccucaugcuaagaaacaagauguggucgugcuagggagucaagaaggugcuaugcacacagcauuaaccggggcgacugagauucagaugagcucaggaaaccuauuauuuaccggacauuuaaaauguagguuaagaauggauaaauugcaguuaaaaggaaugucauauucuaugugcacagguaaauuuaaaauagucaaggaaauugccgaaacgcagcaugguacaaucgucauaagaguucaauaugaaggcgaugguucuccuugcaagauaccauuugaaauaacagacuuggaaaagcgccacguauuaggucgccuaaucaccgucaaucccauaguuacagaaaaagauucacccguaaacauagaggcagaacccccuuucggugauuccuacauaauuauugggguagaaccuggccaacuuaaguugaauugguucaagaaagguucuuccauaggacagauguucgaaaccacaaugcgaggggcgaaaaggauggcaaucuuaggagacacugcaugggauuucgggagcuuaggcggcgucuuuacgucuauagggaaggcacuucaccaaguguucggugcaauauacggagcagcuuuuucuggcguuucuuggacaaugaaaauacuuauuggcguaaucauaacuuggauugggaugaacagucggagcacaagucuaucuguaucguuggucuuggucggaguaguuacacuauaccuaggggcaauggugcaggcagacucaggauguguaguuaguuggaaaaacaaagaauuaaagugcggaagugggauauuuauaacugauaacguacacaccuggacagaacaguauaaauuccagccggaaucaccuaguaaauuggcaucagccauacaaaaggcccaugaggaggguauuugugggauuagguccguuacgcgcuuagaaaaccuuauguggaaacagauaacgccugaacuuaaucacaucuuaagugagaaugaaguuaagcuaacaauaaugaccggugauauuaaagguauuaugcaagcuggcaaaagauccuuaagaccucaacccacugaacuaaaauauagcuggaagacgugggggaaggcaaagaugcuaucuacagaaucacauaaccagaccuuccuaauagauggaccggaaacugcggaaugucccaauacuaaccgcgcauggaacucuuuagaaguugaagauuaugguuucggagucuucacaacaaacaucuggcuaaaacuuagagaaaagcaagacguauuuugugauagcaaauuaauguccgcagcuauuaaggauaauagagcagugcaugccgauaugggauauuggaucgaaagugccuuaaacgacacguggaaaauggaaaaagcauccuuuauagaaguaaagucgugucacuggcccaaaagucauacuuuauggucaaauggcguauuagaaucggaaaugauaauacccaagaauuucgcuggacccguuucacagcacaauuaucgaccaggcuaucauacgcagaccgcggggccuuggcauuugggaaaauuggaaauggauuucgauuugugugagggaacgaccguuguugucacagaagauugugguaacaggggaccaucauuacguacaacaacggcgagcgguaaguuaauaacagaaugguguugcagaaguugcacccugccaccgcuucgcuaucgcggugaggacggauguugguauggaauggaaauaagaccacuaaaagaaaaagaggaaaacuuaguaaacagucuggucacagccggacacggccagaucgauaauuuuucacuaggaguuuuaggaauggcauuauuucuagaagaaauguuaagaacacgaauuggaacuaaacaugcaauacuacugguggcugucagcuuuguuacauuaauuacugguaauaugaguuuucgagaccuaggcagaguaaugguaauggucggagcaacaaugaccgacgauauagguaugggugugacuuacuuagcgcuucuagccgcauucaaaauuaggccaacauucgcugccggucuauugcuaagaaaguuaacaagcaaagaacuaaugauggcaaccauaggaauagcgcuguugucccaaucgacaauaccugagacaauucuugagcuaacagaugcacuggcauuagggaugaugguguuaaaaauugugcgaaauauggaaaaauaccagcuagcuguaaccaucauggcaauaagcugugucccgaacgcggucauucuccaaaaugcauggaaagucucuugcgcaauucucgcagcggugagcgucucuccauuacuacuuacuucaucaaaacaaaaagcagacuggauaccccuagcacuuaccauuaaaggucuaaauccaacggcaauauuuuuaacuacccucucgagaaccucaaagaaaagaaguuggccacuaaacgaagcaguaauggcaguagguaugguuuccauuuuggccucuucucugcucaaaaaugacauaccgaugacaggaccuuuaguagcaggaggacuguugacagucugcuacguacuaacuggaagaagcgccgaucuagaacuagaaagagcggcagauguaaaaugggaggaucaggcagaaauuagcggaucaucaccgauucuuaguauaaccauaagcgaagaugguagcaugucuaucaaaaacgaagaagaagaacagacacucacaauacucauaagaacugggcuccuaguuaucucaggaguauuuccaguaucaaucccaaucacagcagcugcaugguaucugugggaggucaagaaacagagagcaggaguuuuaugggaugucccaaguccaccacccguagaaaaagcagaguuggaagauggagcauacagaauaaaacagcgugggaucuuaggauacucgcaaauuggugccgguguauacaaagaaggaacuuuucacaccauguggcacgugacuaggggcgcagucuuaaugcacaggggcaaaagaauagaaccgaguugggcagaugucaagaaagaucugauuucauacggaggaggcuggaaauuggagggagaauggaaagaaggagaagaaguacaggucuuggcucuggaaccggguaaaaacccccgugcgguucaaacuaaaccgggaauauucaaaacaaacaccgggacaauaggcgcaguaucucuugauuuuucucccggaacgagugguucaccaauuguggaccguaaaggaaaaguaguaggccuauacggaaacggagucgucacgcgaucuggcgcuuauguuucggcgauagcacaaacugaaaaaucuaucgaagacaacccggagauagaagaugauauauuucgaaagaaaaggcucacgauaauggaucuacauccgggggccgguaaaacaaagcguuaucuaccggcuaucguaagggaagcaauaaagagaggguuaagaacacucauacuagcaccaacgagaguuguugcggccgaaauggaagaggcauuacggggauugccaaucagauaccagacaccagcuauaaagaccgagcacaccggaagggagauuguggauuuaaugugucaugcgacauucacuaugagacuucuuucuccaguuaggguaccaaacuacaauuugauaaucauggaugaagcccauuucacugacccugcuaguaucgcagcuagagguuacaucucaacgcguguagagaugggugaagcggcaggaaucuuuaugaccgcaacucccccggguucacgagauccguuuccacaaucgaaugcuccaauaauggaugaagaacgugagauucccgaaagaagcuggaauagcggccaugagugggucacagauuuuaaaggaaaaaccguuugguuuguaccgucaaucaaagcggguaaugauaucgcagcuugucuaaggaaaaauggcaagaaaguuauucaacuaagccgaaaaacauuugauagugaauaugugaaaacccgugcgaacgacugggauuucguuguaacuaccgauauuagugaaaugggugcaaacuuuaaagccgaaagggucauagauccucgcagauguaugaaaccagucauacuaacugauggugaagaaagaguaauucuagcaggacccaugccaguaacacauaguucugcagcgcaaagacgugguaggaucgggcggaauccuaaaaaugagaaugaucaguauauauacaugggugaaccccucgaaaacgaugaagacugugcccauuggaaagaagcuaaaauguuguuggacaacaucaauacacccgaaggcauuauuccaucaauguuugaaccagagcgagagaaagucgaugcuauagacggggaguacagauuaaggggagaagccaggaaaacauuuguugaccuaaugagacgaggugaccuacccgucuggcuagcauauaaaguggcugcagaaggcaucaacuaugcggaucggaaauggugcuuugaugguauaaggaauaaccaaaucuuagaagaaaacauggaaguagaaauuuggaccaaagaaggagaaagaaagaaacuuaagccccgguggcuugaugcaagaaucuacagcgacccauuggcccuuaaagaguuuaaggaguucgcugcgggcagaaagucauuaaccuugaauuuaaucaccgaaaugggaaagcuaccaacguuuaugacacaaaaagcaaggaacgcacuggauaacuuggccguacuacauacggcggaggcaggagggagagccuacaaucaugcgcucagcgaauugccagaaacauuagaaacguuauuacuauuaacucuacuagcaacagugacagguggaauauuuuuguuccuuaugucgggaaaagggauuggcaagaugacucugggcaugugcugcauuaucacugcuucuauacuucuuugguaugcacaaauacagccccacuggauugcugccagcaucauacucgaguucuuuuugauaguccuauuaaucccagaaccagaaaaacagagaaccccacaagauaaccaacugaccuaugucguuaucgcaauucuuacggugguugcugcaacaauggcaaacgaaaugggcuucuuagagaagaccaagaaagaccugggucuugguucaaucacuacccaagaaucagagucaaacauacuagauauugaucuacguccugcaucggcuuggacacuuuacgcaguagcuacaacuuuuguaacaccuaugcucaggcacaguauagaaaauagcagcgucaaugucagucuuacggccauugccaaucaagcaacaguauuaauggguuuaggaaaaggauggccccuaagcaaaauggacaucgguguaccacuucuagcgauuggcugcuacucccaagugaauccaaucacccucaccgcggcccuccuauuguuaguugcacauuaugcaauaauaggcccaggccuacaagccaaagcaacaagagaagcacaaaaacgagcugcagcaggaauaaugaagaauccaacuguugauggaauuacgguuauugaucucgaaccuauuccauacgauccgaaauuugaaaaacaauuggggcaaguaaugcuccuaauucucugcguuacucaagugcuuaugaugcguacgacaugggcauuaugcgaggcuuuaacgcucgcaacuggaccuauaucuacauuaugggagggaaauccaggacgauuuuggaacacaacaaucgcggucucaauggccaacauauucagaggcagcuauuuagcuggugcaggauuauuguuuuccauaaugaaaaauacuacaaauaccagacgugguacaggaaauaucggugaaacccugggcgaaaaauggaaaucucgccugaaugcccugggaaaaucagaauuucaaauuuacaagaaauccggcauccaagaaguagaucggacauuagccaaagaagguauuaaaagaggagaaacagaucaccacgcaguaagucgcggaucagcuaaauuacgaugguucguggagaggaacauggucacgccugaagguaagguagucgauuugggcugugggagaggaggauggucuuauuauuguggaggauuaaagaacguacgugagguaaagggucuaacgaaagguggaccgggacaugaagaaccaaucccaaugucaacauauggguggaaucuggugagauuacaaucuggaguagauguuuucuuuacgccuccagagaagugcgacacacuauuaugugauauaggagaauccucuccuaauccgacuaucgaagcuggccgcacacucagaguucuaaaucuuguggaaaacuggcuaaauaauaacacccaauucuguauuaaaguucuaaauccuuauaugccaucggucaucgaaaagauggaggcccuacaaaggaaguauggaggggcgcugguuagaaauccacucaguagaaacaguacacacgagauguauugggucuccaaugcaacuggaaacauagucucaagcguaaacaugauaucccggaugcuaauaaauagauuuaccaugaaacauaagaaagcaacauacgaaccugaugucgaccucggaaguggcacaagaaauauaggcaucgaaagugaaauuccaaacuuagauauuauaggaaaacgcauagagaaaauuaaacaagaacaugagaccaguuggcauuaugaucaagaucaucccuacaagacuugggcuuaucauggaucuuaugaaacuaaacaaacggguagcgcaucaucaauggugaauggaguaguaaggcuuuuaacuaaacccugggacguaguuccuaugguuacacaaauggccaugacugauacgacgccauucggucagcaaagaguuuuuaaggaaaaaguagauacaaggacccaagaaccaaaagaagguacuaagaaacucaugaagauaacagccgaauggcuauggaaagaauugggaaagaaaaagacgccaagaauguguacaagagaagaguucacaagaaaggucagaaguaaugcagcuuugggcgcaaucuucacagaugaaaauaaauggaaaagugcuagagaagcaguggaagacggaagauucugggaacuuguagauagagaacgcaaccuucaccuagagggaaagugcgagacuugcguauacaacaugaugggaaaaagagagaaaaagcuaggcgaguucggcaaagcaaagggaucacgugcuauaugguacaugugguugggcgcaagauuuuuagaauuugaagcacuggguuucuugaacgaggaccacugguuuucgaggggaaacucgcuuucuggaguagaaggagaaggacuucacagacuggguuacauacugcgggauguugguaagaaagaaggaggggccauguaugcugacgauacggcugguugggacacacgcauaacacuagaggaccucaaaaacgaagagaugguuaccaaucauaugaaaggagaacacaagaaauuggccgaagcaauauuuaaacuaacauaucaaaacaaaguaguaagaguacaaagaccgaccccucgggguacuguaauggacauaauuagccgucgagaccagcggggaaguggacaagugggaacguacggacuaaauacauuuacgaauauggaagcucaacuaauaaggcaaauggaaggggaagguauuuucaaaucuauucaacaccucaccgcuacagaagagaucgcagugcaaaacugguuggcaaggguuggcagagaacgacucagccgaauggcaauuucuggagaugauugcguaguaaaacccauagaugaccguuucgcguccgcgcuaacggcacucaaugacaugggaaaggugagaaaagauauccagcaaugggaaccaucacggggauggaacgauuggacacaggucccguuuuguucucaccacuuucacgagcuagugaugaaggacggacgcguccuaguagucccuugucgaaaucaggaugaauuaauaggccgagcaagaaucucacaaggagcaggcuggagccuuaaagaaacugcuugcuuaggaaaauccuacgcacagauguggacauuaauguacuuucauaggcgagauuugcgccuagcugcaaaugcaauaugcucugcgguacccccgcauuggguaccaaccuccagaacuacauggaguauacaugcaaaacaugaauggaugacgacugaagauauguuggccguauggaauagaguauggauacagggcaauccuuggauggaagacaagacgccuguugaaucuugggaagaaguuccuuauuuagggaaaagagaagaucaauggugugguaguuuaauaggccuaacgucuagggcaaccugggccaagaauauacaaacagcgauaaaccagguucggucacuaauagguaaugaagaguauacugauuacaugccuaguaugaaaagauuccgacgugaagaggaagaagcgggaguuuuaugguag

SEQ ID NO: 22425 - RNA, 9876 nt, Artificial Sequence
  derived and/or modified CDS sequence (opt6) from DENV-2__FJ850120__SS-prME
acagcugggguuauuguaaugcuaauaccuacggcuauggcguuccaucuuacuacaagaaauggagaaccacauaugaucguugguagacaagagaaagggaagucuuuauuguuuaaaacugaagauggagugaauauguguacauugauggccauagaucuuggugaacugugugaagauacaauaacuuacaagugccccuuauuaagacagaaugaaccagaagacauugauugcugguguaauaguaccucuacauggguaaccuauggcaccuguacaacaaccggagaacauaggagagaaaagcgaucaguagccuuaguaccacauguugguauggguuuagagacccgcacagaaacauggaugagcuccgaaggcgcauggaagcaugugcaacgcauagaaacauggauacucagacacccugguuucacuauaauggcagccauuuuagcuuacacaauaggaacuacucacuuucaaagagcacuaauauuuauucuacuuacggcaguagcgccuucgaugacgaugagguguauaggaaucucaaacagagauuucgucgaagggguauccggggguucaugggucgauauagugcuagagcauggaaguuguguuacgacaauggcaaagaauaaaccuaccuuggacuucgaacugauuaaaacggaagcaaaacaaccagcuacacuucgaaaauauuguaucgaggcuaaauuaacaaauacaaccacggaauccagauguccaacucaaggagagccgucauuaaaugaagaacaggauaagagauuuauaugcaaacauuccaugguagauaggggcugggggaacggauguggucuauuuggaaaaggaggaauaguuacaugcgcuauguucacuuguaaaaaaaacauggaaggcaagguuguucaaccagaaaaucuugaauacacaauugucauaacaccucauaguggugaagagcacgcgguagggaacgauacggguaaacacggaaaagaaauaaaaauuacuccucaaucaaguguaacggaagcggaauuaacagguuacgggacuguaaccauggaauguaguccacgaacuggauuagacuuuaacgaaaugguacuucuacaaauggaagacaaagcauggcuaguccaccgucaaugguucuuggaccuaccacuaccuugguuaccgggugcggacacucaaggaaguaauuggauccaaaaagaaacgcuaguaacauuuaaaaauccccacgcuaagaaacaagacgugguuguguuagguagccaagaaggagcgaugcauaccgcacucacgggagcaacugaaauacagaugagcucgggaaaucuacuauuuacgggccauuuaaaauguaggcuaaggauggacaaauuacagcugaaagggaugucuuacagcauguguaccgggaaauucaaaaucguaaaagagaucgcagaaacgcagcauggaacuauuguuauaagaguccaguaugaaggagauggaagcccuugcaagauuccauuugaaauuaccgaccuggaaaaaagacacguucuugguagacuaaucacgguuaauccgauuguaaccgaaaaagauucgccagugaauaucgaagccgagccaccauucggggacaguuauauuauuauuggggucgaacccggacaauuaaaacugaacugguucaagaaagguucuaguauaggucaaauguucgaaaccaccaugaggggggcaaaaagaauggcgauucuaggugauacagcaugggacuuuggcucguuagguggaguuuucacgucuauagggaaggcgcuucaccagguauucggcgcaauuuauggagcugcuuucucaggagucagcuggacgaugaaaauauuaauaggaguaauaauuacuuggauugggaugaacagcagaagcacaucucuaagugucagcuuagucuuagucggaguuguaacacuguauuuaggggcuaugguacaagcugauucgggguguguagucagcuggaagaauaaagaguugaagugcggcuccgggauauuuauaacagacaauguucauacguggaccgaacaguauaaguuucagccugaaucaccuucaaaacuagccucagcaauacaaaaagcccaugaggaaggaauauguggaauuagauccguaacgagauuagaaaaucuaauguggaaacaaauaacaccggaauuaaaucauauauuaagugaaaaugaagugaaauuaacgauuaugacaggggacauucgaggcaucaugcaagcaggaaagagaucacucagaccacaaccaacagaacuaaaauacucauggaaaacauggggcaaggcuaagaugcugagcacagaaagucauaaucagacguuucugaucgaugguccagaaacagcugagugcccaaacacaaauagagcauggaacucacucgagguagaagauuauggauucggcgucuucacuacaaacaucugguuaaaacuaagagaaaaacaagacguauucugugacaguaagcuaaugagcgcugcaauuaaagacaacagggcuguucacgcugauaugggcuacuggauagaaucggcacuaaacgauacauggaaaauggaaaaagcaucguucauagagguuaaaagcugccauuggccaaagucucauacacucuggucaaauggcguccucgaaagugaaaugauaaucccaaaaaauuuugcuggaccgguaucccaacauaacuaucguccaggcuaccacacccaaacugcgggacccuggcaucuagguaaacuagaaauggauuucgacuugugcgaaggcacuaccgucguaguaaccgaagauugugggaauaggggacccucucuacguacaaccacugcgucggguaaacugauaacugaaugguguugucgaucaugcacauuaccaccacucagauacagaggugaagauggcuguugguauggaauggaaauucggccacuaaaagaaaaagaggaaaaccuugucaauucgcuaguaacggcaggacauggacaaauugacaacuuuagccuaggagugcuuggaauggcacuuuuccuagaggaaaugcuaagaacuaggauuggcacgaagcaugcgauauugcuugucgcgguuaguuucguuacgcucauaacaggaaauaugucuuuuagagauuuaggucggguuaugguuaugguuggagcuaccaugacagacgacauaggaauggggguaaccuaucuugccuuguuagcagcauuuaagguuaggccaacauuugccgcagguuuacucuuaagaaaauugaccuccaaggaauugaugauggcgacgauaggaauugcauuauugagucaaucaacaauaccggaaacaauauuagaacuaacugacgcacuagcauuaggaaugaugguuuuaaagauaguacgaaacauggaaaaauaucaacuagcuguuacuauaauggcgauuucaugcguaccaaacgcgguuauucuacaaaaugcuuggaagguaagcuguacgauucuagcggccguaucggugagcccuuuacuccuaaccucuagccaacagaaagcggauuggauaccauuagccuugacaauaaaaggccugaacccuacagcgauauuucuuacaacucuuagccgcacaagcaagaagcgaucauggccacuaaaugaagcaauuauggcaguagggauggugagcauacuagcuagcaguuuguuaaaaaaugacauaccuaugacugguccauuagucgcaggaggguuacuaacgguuugcuauguacucacagguagaucagcagauuuagagcuugaaagggcugcugacguaaaaugggaagaccaggccgaaauuucagguucaucuccaauucuaucuauaacgauuucggaggauggcuccaugucaauaaaaaaugaagaggaagaacaaacacucacaauacucauacgcacuggacuucucguaauaaguggcguuuuucccguaagcaucccaauaaccgcggcagccugguaucuaugggaaguaaaaaagcaacgagcaggaguauuaugggacguaccaucgccaccaccuguagagaaggcuaaacuugaagauggcgcuuauaggauuaaacaaagaggaauuuuaggguacucacaaauuggagcuggcgucuauaaagaaggaacauuucauacaauguggcacguaacaagaggggcuguauuaaugcacagaggaaaaagaauagaaccaucaugggcagauguaaaaaaagaucuaauaucuuacggaggggguuggaagcuagaaggagaguggaaggaaggagaagaaguccaaguccucgcauuagaaccgggaaagaauccgcgcgcuguucaaacuaaacccggaauauuuaagacuaauacagggacaaucggcgcgguaucacucgacuucucaccugggacaaguggaucgccgaucgucgaccgaaaagguaaaguggugggcuuauacgggaacgguguuguaacccguucuggggcauacguuagugcaauagcucaaaccgaaaaaaacauugaagauaacccggaaauugaggaugacaucuuccguaagaaaagacucacaauaauggacuugcacccuggugcaggaaaaacaaagcgguaucuaccggcaauagugcgagaagcgaucaagagagguuuacgaacucuaauauuagcccccacacgagugguagcugcagaaauggaagaagccuugcgaggcuuacccauccgcuaucaaacacccgcaauaaaaacugaacacacaggucgggaaauuguggauuuaaugugccacgcgacauucacgaugcgacuacuauccccaguaagagugccuaacuauaauuuaauaaucauggaugaagcacacuucaccgacccagcaucaauagcggccagaggauauauuucaacgaggguggagaugggugaggccgcagggauuuuuaugacagcuacuccgccaggaagcagggaccccuucccucaaucaaacgcuccuauuauggaugaagaacgugaaauccccgagagaagcuggaauaguggucaugaauggguaaccgauuucaaagguaaaaccgugugguuuguccccucaauaaaagcugguaacgauauagcggccuguuugcguaaaaacggcaaaaaggucauucaauuaagucggaagaccuuugacagcgaauacguuaaaacuagggcaaaugauugggauuucguugugacaacagauauuucugaaaugggugcuaauuucaaggcggaaagagucauagacccaagacgguguaugaaaccaguuaucuugaccgacggcgaagaaagaguuauccucgcgggaccaaugccgguaacgcacucgucagcagcucaacgaagaggccgaauugggagaaaccccaaaaaugagaacgaccaauauauauauaugggagagccccuggaaaaugacgaagacugugcacauuggaaagaagcuaaaauguuauuagacaacauuaauacucccgaagggauaauacccucgauguucgaaccugagcgagaaaagguagaugcaaucgacggcgaguauagacuucgaggcgaagccaggaagacauuuguggaccuaaugagaaggggagauuuaccuguuuggcucgcguacaaaguugcugcggagggaauaaacuaugccgacagaaagugguguuuugaugguauaaagaauaaccaaauacuggaagaaaacauggaaguagagaucuggacuaaagaaggagagagaaaaaaacuaaaacccagaugguuagaugcaagaauuuauucagauccccuggcauuaaaggaauuuaaggaauuugcagccggacguaagucauuaaccuuaaauuuaaucacagaaaugggacgucucccuacguucaugacccaaaaagccagaaaugcgcuagacaauuuagcugucuuacauacggcugaagccggaggaagagccuauaaccaugcauugagcgaauuaccugagacacuagagacccugcugcuuuuaaccuuacuagcaacugugacaggagguaucuuuuuauuuuuaaugucuggaaagggaaucggaaaaaugacucuuggaauguguuguauuauaacagccagcauucuacuaugguacgcccaaauacaaccacauuggauagcugcaaguauuauccuugaauucuuuuugauaguucuucuuauaccagaaccggaaaagcagcgaacgccacaggacaaucaacugacauacguaguuaucgcgaucuuaaccguagucgcagcaacgauggccaacgaaaugggauuccuggaaaaaacgaagaaggaccuaggacuuggcuccauuacgacacaagagucagaaucgaauauuuuggauauugauuugagaccggcuucagcauggacucuauaugcuguggcaaccaccuuuguuaccccuauguugagacacaguauugaaaacucaucaguaaauguuagccuuacagccaucgcaaaccaagcaacuguucuaaugggauugggaaaaggcuggccacuuagcaaaauggauauugguguaccuuuacuagcuauagguugcuacagccaaguuaauccaauaacacugacagcagcucuguuacuccuaguagcacacuaugccauaauaggacccgggcuccaagcaaaggcaacgagggaagcucaaaagagagcagcugcagguauaaugaaaaauccaacgguagacggaauaacgguaauugaccucgaaccuaucccauacgauccaaaauucgaaaaacaauuaggacaagugauguuacuaauucuaugcgucacacagguguugaugaugcgaaccacaugggcuuugugugaggcacucacacuugcuacagguccuauaaguacucuaugggaagguaauccggggcgauucuggaacaccacgauagcagucucaauggcgaacauauucagagguucguauuuagccggagcggggcuguuauuuucgauuaugaaaaauacgacaaauacgaggagaggaacagguucuauuggcgagacgcuuggugaaaaauggaagagcagauugaaugcguugggaaaaagcgaauuccaaauauacaagaaaucaggaauacaggaagucgaccggacuuuggccaaagaagguaucaaaaggggagagaccgaucaucacgcgguguccagggguagcgcaaagcuaagaugguuuguugaacgaaauaugguuaccccugaagguaagguuguagacuuagguugugguagggguggguggucauauuacugcgguggauugaaaaacguaagagaaguuaaaggguuaacuaaggggggaccaggucaugaagagccgaucccaaugaguacauauggauggaacuuaguucgacuccagaguggagucgauguauuuuuuaccccaccugagaagugugacacuuuauuaugugacauuggagaaagcucgccgaaucccacaauagaagccgggcgaaccuuacgaguccucaauuuaguugaaaauuggcuuaauaauaacacacaauuuuguaucaaaguucuaaacccuuauaugccaucaguaauagaaaagauggaagcucugcagagaaaauacgggggagcacuaguaagaaauccuuuaagucguaacagcacccacgaaauguacugggugucgaacgcgacaggaaacauaguauccuccgugaacaugauuagucgaaugcuaauaaacagguuuacuaugaaacauaaaaaagcuaccuaugaaccagacguagacuuagguucaggaacacgaaauauagguauagaaaaugagauaccuaacuuagacauuauaggaaaaagaauagaaaaaauuaaacaagaacacgagaccucuuggcauuacgaccaagaucaucccuauaaaacuugggcuuaccacgguaguuacgaaacaaaacaaaccggaagcgcaagcucuaugguaaacggaguuguccgacuuuuaacaaaaccgugggauguagugccaaugguaacacaaauggcaaugacggauacaaccccauuuggucagcagagagucuucaaggagaaaguagauacacguacccaagaaccaaaagaggguaccaaaaaauuaaugaagauaacagcagaauggcucuggaaagagcuaggcaagaaaaaaacuccaagaauguguaccagagaagaauucacucguaaggucaggucgaacgccgcacuuggcgcaauuuucacugaugaaaauaaauggaaaucugcccgcgaggcuguggaggacucgagauuuugggaacuaguagauagggaacguaaucuucacuuagaaggcaaaugugaaacguguguuuauaauaugauggguaaaagagaaaagaaauuaggagaauuugguaaggccaaagguucgcgugccauaugguauaugugguuaggagcucguuuuuuggaauuugaggcauugggcuuucuaaaugaagaucauugguucucgcguggaaauagucuuucuggcgucgaaggugaaggauugcaucgacuuggauacauacuccgagacguaggcaaaaaagaaggaggggcaauguaugccgacgauacagcagguugggacacucgcauaacuuuggaggauuuaaaaaaugaagaaauggucaccaaucauaugaaaggagaacauaagaaacuagcagaggcgauuuucaaauuaaccuaucaaaauaagguaguacgaguacaaagaccaacgccuagagguaccguaauggacauaaucucgagacgugaucaacguggaucgggccaagugggaacauacggauuaaacacauuuacgaacauggaagcucaacuuauacggcaaauggaaggcgagggaaucuuuaaaaguauucagcauuuaaccgcaacugaagaaauagcaguacaaaacuggcuagcucguguaggucgagaaagacuaucucguauggcuauaagcggagacgacuguguaguaaaaccaauugaugaucgauuugccagcgcgcuaaccgcacuaaaugauauggggaaagucagaaaggacauacaacaaugggaaccuucgcgaggauggaacgacuggacucaaguuccuuuuuguagucaucauuuccaugaacuaguaaugaaagaugggcgggugcucgugguaccaugucgaaaucaagaugaacuuauugggagagcgcgaauaagucaaggagcaggauggucauuaaaagaaacggcgugcuuaggaaaaagcuaugcgcaaauguggacacuuauguacuuucauagacgcgauuuaagacuagcagcuaaugcgauauguucggcaguaccgucccauuggguucccaccuccagaaccaccuggagcauacacgccaagcaugaauggaugacuacggaagacaugcuggcaguauggaacagaguuuggauacaagaaaacccauggauggaagauaagacaccaguagaaagcugggaagagguaccuuaucucgguaaaagagaagaucaaugguguggcuccuugaucggguuaacauccagagcuacaugggccaaaaacauacagacggcuauaaaucagguaagaucccucaucggcaaugaagaguacacugauuauaugcccucuaugaagagguuucgccgagaagaagaagaagcaggcguacucugguaa

SEQ ID NO: 22426 - RNA, 9876 nt, Artificial Sequence
  derived and/or modified CDS sequence (opt6) from DENV-2__FJ850121__SS-prME
acagcgggaguuauuguaauguugauaccaaccgcuauggcguuucaccucaccacaagaaauggagaaccacauaugauaguaggaaggcaagaaaaaggaaaaagucuucuguucaaaacagaagauggcguuaauaugugcacacuaauggcaauagaucuuggugaacuaugcgaagauaccauaacuuacaaauguccuuuguuacgccaaaacgaaccggaagacauugauugcugguguaauucaacaucuaccuggguuacauauggaacauguacaacaacaggcgaacauaggagggaaaaacguaguguugccuuaguaccucauguggguaugggacuugaaacaagaacagaaacauggaugagcagugaaggagcuuggaaacacguacaacgaauagaaacauggauauugagacauccgggauuuacuaucauggcagcuauacuagcuuauacuauuggaacaacacauuuucaacgugcauuaauauuuauacuacuaacugcaguugcucccucaaugaccaugcguuguaucggaauuucuaauagagauuucguagaaggagucucugguggauccuggguagauaucguacucgaacacggaucauguguaaccacaauggcuaaaaacaaacccacguuagauuucgaauuaaucaaaacagaagcgaaacaacccgcaacccuuagaaaauauuguauugaagcgaaacuaaccaacacgacgaccgaaaguagauguccaacgcagggagaaccaucuuugaaugaagaacaagacaaaagauuuauauguaaacacaguauggucgaucgaggcuggggaaauggauguggacucuuugggaaaggggguaucguaacuugcgcuauguuuacaugcaagaaaaauauggaaggaaaaaucgugcagccagaaaaccuagaauauacgaucgucauuaccccacacagcggggaggagcacgcaguuggaaacgacacugguaaacauggcaaagaaauaaaaauaacaccucaaucuagcauaacugaagccgaauuaacggguuacggaacuguaacaauggaauguucgccaagaaccggacuagauuuuaaugaaaugguucuacuccaaauggaagacaaggcuuggcuaguacaccgacaaugguuccuagaccuuccccugccauggcugccuggggcagauacacaagguucuaauuggauacaaaaagaaacuuuaguaacauucaaaaacccucaugccaagaaacaggacguuguaguacuagggucgcaagaaggagcaaugcauacugcucugacuggagccacggaaauccagaugucaagcgggaaccuacuauuuacaggacaucuaaaaugucgacucaggauggauaaacuucaacuuaaagguaugucauacucuauguguacuggcaaauucaaaaucguaaaagaaauugcggaaacucaacacggaacaauuguaauuagaguucaauaugaaggcgaugggaguccguguaaaauuccauucgaaauaaccgaccuagagaaaagacauguuuuagggcgauuaauaacagugaauccaaucguaacagaaaaagauucaccuguaaacauugaagccgaaccacccuucggagauaguuacauaauaaucggaguagaaccaggacaacuaaaauuaaacugguuuaaaaaggguucaagcauaggccaaauguuugaaacgacgaugcgcggagcgaaacguauggcuauacuaggagauacugcuugggauuuuggcaguuuaggagguguauuuacaaguaucgggaaggcuuuacaccaaguauuuggagcuauauauggggcggcauuuaguggaguaucuuggacuaugaaaauacucauuggagugauaauuacauggauuggaaugaacaguagaucgacaucauuaagugugagccuagucuuagugggcguaguuacacucuauuuaggagcuauggugcaagcagacucagguuguguaguaagcuggaaaaauaaagaacuuaaaugcggaucagggauauuuauaacagauaauguacauacauggacugagcaguauaaauuucaaccugagucaccgagcaagcuagcgucagcgauacagaaagcccaugaggaaggaauuugugguaucagaagcgugacaagauuagaaaaucugauguggaaacagauuacgcccgaauugaaccacauuuuaucagagaaugaaguaaaauuaaccaucaugacuggcgauaucaaagguauuaugcaggccggcaaacguucucucagaccccaaccgacagaauuaaaauauucauggaagaccuggggaaaagccaagaugcucagcaccgaaagucacaaccaaacauuccucauagauggaccagaaacggcagagugucccaacaccaaucgugcauggaacucacuagagguagaggauuauggauucgggguguuuacuacgaacauauggcuuaaguuaagagaaaagcaagaugucuucugugauucaaaacuaaugucagcugccaucaaagauaaccgagcagugcaugcagauaugggguauuggauagaaucagcccuuaacgacaccuggaaaauggagaaagcaucauucauagaaguuaaauccugucauuggccgaaaagucacacacuguggucuaacgguguauuagagucagagaugauaauuccuaaaaauuuugcggggcccguaucacaacacaacuauagacccggauaccauacacaaaccgcaggacccuggcacuuagguaaauuagagauggauuucgaccucugcgaaggcacaacaguaguugucacugaagacugcgguaacaggggcccaagccucagaacgacaacugcaagugggaaacuaauaacagaauggugcuguagaucuugcacacuaccaccacuaagauaucggggagaagauggaugcugguaugguauggaaauucgcccacugaaagaaaaagaagaaaacuuaguaaauagccuaguuacggcgggucacgggcagauugauaauuucucauugggaguauuagggauggcacuauuuuuagaagaaauguuaaggacgcguauaggaacaaaacacgugacucuguugguagcagucucauuuguaacguuaauaacagguaacaugaguuuucgggaccucgggagagucaugguuauggucggggcuacaaugaccgacgauauaggaaugggaguaacauauuuggcauuauuagccgcauucaaaguaagaccgacauucgcagcaggguuguuauuaagaaaacuaacaaguaaagagcucaugauggcaacuaucgguauagcauugcuaagucagucuacaaucccggagaccauccuugaauugaccgacgcauuagccuuagguaugaugguauuaaagauaguacgcaacauggagaaauaucaauuggcaguaacaauuauggcaauaaguuguguaccuaaugccguuauauuacaaaacgccuggaaaguuagcuguacaauccuagcagccgucucagucagcccucuauuacuuacaagcagccagcaaaaagcagauuggauuccacuugccuugacuauaaagggucucaaucccaccgcuauauuucuaacaacguugagucgaaccaguaagaaaagaagcuggccucucaacgaagcaauaauggcagucgguauggugaguauauuagcuagcucacuacugaaaaaugauauaccuaugacuggcccgcuaguagcgggaggucuacucacaguuugcuacguacuuacugggagaagcgcagaucuggagcuagaaagagcagccgaugucaaaugggaagaucaagcggagauaagcgguucaucaccaauacuaucaaucacgauaagcgaagauggaagcaugucaaucaaaaaugaggaagaggaacagacccucacuauuuuaaucagaacgggacucuuagucaucaguggggucuuuccaguaucaauaccuauuacugccgcugcgugguaucugugggagguaaagaaacaaagggcugguguguugugggacguaccaagucccccuccaguagaaaaagcagaacuagaggauggugcauauagaauuaagcaaaggggcauacuaggauacucccaaauaggcgcuggcgucuauaaggaaggaacuuuucauacaauguggcauguaacaagaggugcagucuugaugcacagaggaaaacgaauagaaccuaguugggcugaugucaagaaagacuuaauaucauauggcggagguuggaaacuagaaggagaguggaaagaaggcgaagaaguucagguccucgcauuagaaccgggaaagaauccuagggcuguccaaacuaaaccaggaauuuucaaaacgaacacaggcacuauaggagcugucucgcuagauuuuucuccaggaacaagcggaucuccuauaguggacagaaaaggaaaaguggugggacuuuauggcaacgggguugucacacgcuccggagcguacguuuccgcgauugcacaaacagaaaagucuauagaagauaacccggaaaucgaggacgacauuuucaggaaaaagagacuuacuaucauggacuuacauccaggcgcaggaaagacgaaaagauacuugcccgcaauagugagagaagcaauuaaacguggauuacgcacacuuauccuagcaccgaccagagucguagcugcggaaauggaagaggcgcuaagggggcuuccaauuagauaucaaacuccggcaauaaagacagaacacaccggaagagaaauuguagaucuaaugugucacgcaaccuucacaaugcgauuauuaagcccuguacgaguacccaauuauaaccuuauaauuauggacgaagcgcacuucacagaucccgcuucuauagcagcaaggggauacaucucaacccgcguagaaaugggagaagccgcaggcaucuuuaugacagcaaccccaccuggaagcagagauccauuuccccaaucgaaugcuccuaucauggacgaagaacgugaaauuccagaacgaaguuggaacucuggucacgaguggguaacggauuucaaggguaaaacaguaugguuuguaccauccauuaaagccgggaaugacauagcagcgugucuacgaaagaauggaaagaaaguuauacaacuaucgcguaaaaccuuugauagugaauaugugaaaacucgugcuaaugacugggacuucgucguuacaaccgacauaagugaaaugggugcaaacuuuaaagcagagcguguuauagaucccagaagauguaugaagccugugauacuuaccgauggugaagaacguguuauucuagccggaccuaugccaguaacccauaguagugcugcccagcgaagaggcaggauuggacguaacccuaaaaacgaaaaugaccaauauaucuacaugggcgagccuuuagaaaaugaugaagacugugcacauuggaaagaagcgaaaaugcuguuagauaauaucaauacgccagaaggaauuauacccaguauguuugaaccugagcgugagaaaguagacgcaaucgacggugaauauagauugaggggagaagcucgaaaaacuuucguggauuuaaugcguagaggggaccuaccgguuuggcucgcauauaaaguggcagcugaaggaauuaacuaugccgaucgaaaaugguguuucgauggaauaaagaauaaucaaauccuagaggagaauauggaaguggaaauauggaccaaagaaggcgaaaggaagaaauugaaaccuagaugguuagaugcaagaaucuacucagacccauuggcauuaaaagaauuuaaagaauuugcagcgggccggaaaucucugacacuaaauuugaucacggaaaugggcaggcugccaacauuuaugacacaaaaagcaagaaaugcauuagacaaccuugcaguccuucacacagcagaagcagggggaagggcuuauaaucaugcacuaucagaauuacccgaaacucuugaaacgcuacuucugcuaacucuucuagcaacugucaccggcgguauuuucuuauuuuuaaugucagggaaaggaauagguaaaaugacuuugggcauguguugcauuauaacagcaaguauauugcuuugguacgcucaaauacagccccauuggauagccgcuaguauuauacucgaauuuuucuuaauaguauugcucauccccgaaccagaaaaacaaagaacaccgcaggauaaucaauugacauauguugucauagcgaucuugacuguaguagcagcuacaauggcaaacgaaaugggauuuuuagagaaaacaaagaaagauuugggccuagguagcaucacgacucaagaguccgaauccaacauacuagauauagaccuuagaccagcgucggcauggacguuauacgcaguugcgacgaccuuuguaaccccgaugcuccgacauaguauugaaaauucaucugucaaugucucauugacagcaauagcaaaucaggcaacggugcuaauggggcugggcaagggauggccucugucuaaaauggauaucggagucccacuauuagcaauuggaugcuauucccaggucaauccaaucacauuaacagcagcauuauuacugcucguagcacacuaugccauuauuggucccggacuccaagcgaaagccacacgagaagcacaaaaacgagcggcggcugguauaaugaaaaaucccacaguggaugguauaaccgugauagaccuagagcccauuccuuacgacccaaaauuugaaaagcaacuagggcaaguaaugcuguuaaucuuaugcguaacucagguucuuaugaugagaaccacaugggcuuuaugugaagcgcuaacccuugcuacagggccgauuucaacuuugugggaaggaaacccaggacgauuuuggaacacaacuauagcagugucuauggcuaacauuuuccgagguucauacuuagcuggugcaggcuuauuauucaguaucaugaaaaauacgacaaauacacguagagguacaggaaauauaggugagacacuaggggaaaaauggaaaaguagguuaaacgcauuaggcaaaucagaauuucaaauauauaagaaaucaggcauccaggaaguagauagaacacuagcaaaagaaggaaucaaaagaggcgagacagaccaccaugccguaagucgagguucggcaaaauuaagaugguucguagaaaggaauaugguaacaccagaagguaaagucgucgauuuggguugcggcaggggcggcuggaguuauuacugugguggacuaaagaauguccgggagguuaaaggacuuacaaaaggugggcccgggcacgaagaaccgauuccuaugaguacauauggauggaaccucguacgucugcaaucgggaguugacguguucuuuacaccacccgagaaaugcgacacacucuugugugauauuggcgagucuaguccaaauccuacgaucgaggccgguaggacauuaaggguauuaaaccuaguagagaauuggcuuaacaacaacacacaauuuugcaucaagguacucaaccccuauaugccauccguuaucgagaaaauggaagcauuacagcgaaaguaugguggugcacucguaaggaauccauuauccaggaauaguacucaugaaauguauuggguuucaaaugcuacugguaauauuguuucaucaguaaauaugaucucgagaaugcuaauuaacagguucacaaugaaacacaagaaagcaaccuacgaaccggauguagauuuggguucaggaacgaggaauaucgguauugaaagugaaauaccaaaucuagauauaauaggaaaaaggauugaaaagaucaagcaagaacacgaaacaucauggcacuacgaccaggaccacccuuacaagacuugggcuuaccacggaucguaugaaacuaaacaaacugguucagcaucaagcauggugaacgguguagugaggcuccucacgaaaccaugggacguaguccccaugguaacacaaauggccaugacagacaccacaccauuuggucaacaacguguauucaaagaaaaaguagacacuaggacacaagaaccaaaggaaggaaccaagaaauuaaugaaaaucacugccgaauggcuuuggaaagaguugggaaagaagaaaacuccgagaauguguacgcgcgaagaauuuacuagaaaaguaagaucuaacgcggcacugggugcgaucuucacugacgagaacaaauggaaaagugcaagagaagccguggaagacggcagguuuugggagcucguggauagggaaaggaaccuacaucuugaggguaagugugaaacauguguuuacaauaugaugggaaaaagggaaaagaaacuuggagaguucgggaaggccaaaggcucccgagcgaucugguauauguggcuaggugcuagguucuuagaguuugaagcucuuggcuucuuaaaugaagaucauugguucaguagagguaauagccucagcgggguugaaggagagggucuacaccgguuaggguacauauugcgcgacgucggcaagaaagaggguggggcgauguacgcugacgauacggcaggaugggacacuagaaucacacuagaagaccugaaaaacgaagaaaugguuaccaaucauaugaagggagaacauaagaaauuagccgaagcaauuuuuaaacucacauaucaaaacaagguagugcguguacagcgcccgaccccgcgagguacuguaauggauauaauaaguagaagagaccaacggggaagcggacaagucggaacauacggguuaaacacguucaccaacauggaggcacaauuaaucagacaaauggagggggaagggauuuuuaaauccauucaacaccuaacagcgaccgaagagauagccguacaaaacugguuggcaagaguaggaagagaaagguuaucacgcauggcaauuagcggagaugauugcguuguaaaaccaauagacgaccgauuugcaucagcuuuaacagccuugaacgauaugggaaagguaaggaaagacauacaacaaugggaaccaucuaggggauggaaugacuggacacaagugccuuucuguagucaucauuuccacgaacuuguaaugaaagauggacgaguacuugucgugccuuguaggaaucaggaugaauuaauugggagggcacggauaagccagggagcaggcuggucauuaaaagaaacagcguguuuaggcaagucguaugcacaaauguggacauuaauguacuuucauaggagggaccuccgacuagcugcaaaugccauaugcuccgcaguaccaccccacugggugccgacaucacggacaacuuggucgauccacgcaaaacaugaauggaugaccacugaagauaugcuugcaguuuggaacagaguuuggauccaagagaacccguggauggaagacaaaacgcccguggaaucuugggaagaaguaccauauuuaggcaagagagaagaucaguggugcgguucacuuaucggauuaaccucacgagcgacaugggcuaaaaauauacagacggcaauaaaucaggucagaucauugaucgggaaugaggaauauaccgauuauaugccaucuaugaaacgguuucgucgagaggaggaggaagcuggcguuuuaugguag

SEQ ID NO: 22427 - RNA, 9876 nt, Artificial Sequence
  derived and/or modified CDS sequence (opt6) from DENV-2__GQ199897__SS-prME
acagcaggaguaauaguuaugcuuauucccaccgcuauggcuuuucacuuaacgacacgaaacggagaaccucauaugauuguggggcgccaagaaaaaggcaaaagucuuuuguuuaaaacagaagacggaguaaacauguguacucuaauggcaauugaucugggugaauuaugugaagacacuauuaccuacaaauguccauuguuaagacaaaacgaaccagaagacauagauugcugguguaacucuacaucuacguggguuacauaugguacuuguacuaccacaggcgaacacagacgagaaaaacgaucaguagcgcuuguaccucauguaggaaugggacucgaaacgcgcacagaaacguggaugaguagugaaggugcauggaaacacguacaacgcauagaaacauggauacuaagacacccuggguucacuauaauggcagcaauacuggcguauacaauagggaccacccacuuccaaagagcauuaauauuuauacuguuaacagcuguagcaccuuccaugacaaugcgguguauuggaauaaguaaucgagauuuuguagaaggaguaucuggaggaaguuggguagacauugucuuagaacaugggaguugugugacaacaauggccaaaaacaaaccuacacucgauuuugaacuuauaaaaacugaagcuaaacaaccugcgacuuugcgaaaauauuguauugaagcaaaacuuacaaauacuacgacggaaucucguuguccaacacagggagaaccuaguuuaaacgaagaacaagauaaacgauucauauguaaacacucaaugguagaccgcggauggggcaauggaugcggauuguuugguaaaggagguauuguaaccugcgcaauguuuaccuguaagaaaaacauggaagggaaagucgugcaaccagaaaauuuggaauacacaauuguaauaaccccgcacucaggugaagaacaugcaguuggaaacgacacaggaaaacacggaaaagaaaucaaaauuaccccacaaucaucaauaacagaagcagaacuaaccggcuacggaacaguaacuauggaaugcucaccacgaacuggacucgacuuuaacgaaaugguacuuuuacaaauggaagauaaagccuggcuuguacaccgacaaugguuccucgaccuuccucucccguggcuucccggagcugauacccaaggaaguaacuggauacaaaaagaaacuuuaguaaccuucaaaaacccacacgcaaagaaacaggauguaguaguacuaggaagccaagaaggcgcaaugcauacggcacuuacaggugcuacagaaauucaaaugucaucuggaaauuuguuauucacuggacauuuaaaauguaggcuaagaauggacaaacuacaacuaaaaggaaugucauauucaaugugcacgggcaaauucaaaauagugaaagaaauagcugaaacgcaacauggaaccauagucauaaggguacaauaugaaggagaugggucccccugcaaaauaccguuugagauaaccgacuuagagaaaagacaugugcuuggaagguuaauuacggucaacccuauagugaccgaaaaagauucaccagugaacaucgaggcggaaccucccuucggagauuccuauauaaucauugggguagagccuggacagcuaaaauuaaauugguuuaagaaagguagcucaauaggacagauguuugaaacuacaaugcgcggagcaaaacgaauggcuauacucggcgauacggcuugggacuuugggagucuaggcgguguuuucacuucaauagguaaggcuuuacaccaaguauuuggugcaaucuauggggccgcuuuuucaggagugucuuggacuaugaaaauacuaauaggcguaauaauaacauggauuggaaugaauagucgaagcacaagucuguccguuucguugguacuggucgggguagugacauuauauuuaggugcuaugguacaagccgauucaggauguguugucucauggaaaaauaaggaauugaaauguggaucugggauauuuauaacagacaacguccacaccuggacugaacaauauaaauuucaaccggaaucucccucuaaauuggcaagugccauacaaaaagcgcacgaggaaggaauuuguggaauaagaagcgucacucgucuagaaaaucuaauguggaaacaaauuaccccugaacuuaaucacauacucucagagaacgaaguaaaacugacaauuaugacgggagacauaaaaggaaucaugcaggcaggaaagcguucucuucggccacagcccacggagcuuaaauacaguuggaaaacgugggggaaagcgaaaaugcuaagcacagagucucauaaccagacuuucuuaauagauggcccggaaacagccgaaugcccuaacacaaaucgugcuuggaacucacuggagguugaagacuacggcuuuggcguauuuacgacuaauaucuggcuaaaacuaagggaaaaacaagauguauuuugugauaguaaacuaaugucugccgccauuaaggauaauagggccguacaugcugacaugggguacuggauugagagugcacuuaacgauaccuggaaaauggaaaaagcaucauuuauagaaguaaaaaguugucacuggcccaaaucucacacucucuggagcaacggcguuuuggaauccgaaaugaucauccccaaaaacuuugcagguccggugagccaacacaauuauaggcccggguaucauacucaaacagcaggcccuuggcauuuagggaaacuugagauggacuucgaucucugugaaggaaccaccguugugguuacagaggauugcggcaaccgggggccuucguuaaggacuacaacugcuucaggcaagcuaaucacugaaugguguugccguagcuguacauuacccccacucagauacagaggugaagauggauguugguaugguauggaaauucgaccauuaaaagaaaaagaagaaaaccugguaaauagcuuaguaacugcuggacacggacagauugauaauuuuuccuuaggaguucuugggauggcuuuguuuuuagaggaaauguuaagaacaaggaucggaacgaaacacgcuaucuugcuagucgcggucaguuuuguuacucuuauuacaggcaacaugucauuccgagauuuaggcagaguaaugguaaugguuggagcaacaaugacagacgauauagguauggguguuacguaucuugcccuucuagcagccuuuaaaguccguccaaccuuugcagccggauugcuucucagaaaacucacuagcaaggagcuaaugauggcgaccauaggaauagcacuacuaucucaaucaacuauacccgagacgauacuggaauugacugaugcgcuagcgcuaggcaugauggucuugaaaaucguaaggaauauggaaaaauaccaauuagcaguaacuauaauggcuauuaguugcguaccaaacgcagucaucuuacagaacgcuuggaaggugaguuguacuauacuggcagcuguuuccgugagucccuuauuauuaacuucuagucagcagaaagcugauuggauaccgcucgccuuaacuaucaaaggauuaaacccgacagcaauuuucuugacaacacucucaagaacuagcaagaaaagaaguuggcccuugaaugaagccauuauggccguugguaugguuucaaucuuagcgucgagccuguugaaaaacgauauacccaugacgggaccccuaguagcgggaggguuacuaaccguauguuacguauugacaggaagaucagcagaucuggaauuagagcgcgcagcggauguaaaaugggaagaccaagcagagauaagcggaucaaguccuauacuaucaauaacuauuagugaagacgguagcaugagcaucaaaaaugaggaggaggaacaaacccucacuauauuaauuagaacaggcuugcuggugguaucuggagucuuuccaguguccauaccuauaacggcagcggcuugguacuuaugggaagucaagaaacaaagagcaggaguacucugggaugucccgagcccaccaccuguugaaaaagccgaguuagaggacggugcauacagaauaaaacaaagaggaauccuaggauauagucaaaucggugcuggaguuuauaaagaggguacuuuucacacgauguggcauguaacacgaggagcugucuuaaugcauagaggcaagaggauagaaccuucaugggccgacguaaagaaagaucugauuucauauggcggaggcuggaaacuagaaggcgaauggaaagaaggagaagaaguacaggucuuagcacuagaaccaggcaaaaauccuagagcugugcaaacgaaaccagguauauucaaaacaaacacagguacgaucggugccguuagcuuggacuuuaguccuggaaccuccggaucaccgauaguggacaggaaagguaaaguuguuggauuauauggaaaugguguuguuacuagauccggagcguacgugagugcaaucgcacaaaccgaaaaaucaauagaagacaaucccgaaaucgaagaugauauauuucggaagaagagauuaacaauaauggaucuucacccgggcgcugggaagacaaagagguaccuaccagcgauaguaagggaagcuaucaaaaggggccugagaacacugauauuagcccccacacguguaguugcagcagaaauggaggaagcauuacgggguuuaccgauccgauaucagaccccagcaauaaaaaccgaacacacuggacgagagaucguagaccuaaugugccacgcuacauuuacgaugcgucuucugucuccaguaagaguaccuaauuacaaucucauuauaauggaugaagcacacuucacagaucccgcuaguauagcugcucgaggguacauaucaacaagagucgaaaugggggaggccgccggcauauuuaugacagcuacuccuccuggcagcagagauccauuuccucaaucaaacgccccuaucauggaugaagaaagagaaauuccugaacgcucuuggaacuccggacacgaauggguaacugacuuuaaaggaaaaaccgugugguuuguaccuucgaucaaagcugguaaugauauugcggcgugucuaaggaaaaauggaaagaaaguuauccaauugucucgaaaaacauuugauagcgaauaugucaaaacucgggccaacgauugggacuuuguuguaacaacagauauaagugaaaugggagcaaauuucaaggcugaacguguaauugauccgagacgcuguaugaagccaguaauucuuacugacggugaggaaagggugauauuagcugggcccaugcccguaacgcacaguagugccgcccaaagaagaggaagaaucggacguaauccuaaaaaugaaaaugaccaguauauauacaugggagaaccauuggagaaugaugaggacugugcacacuggaaagaagcaaaaaugcuucucgauaacauaaauacuccagaagggauuauaccaucaauguucgaaccugaaagggaaaaagucgaugcuauagauggugaauacagauuaagaggagaagcucggaaaacauuugucgaucuaaugagaaggggagaucuaccuguuugguuggcguauaaagucgcugcagaggggauuaacuacgccgauagaaagugguguuuugaugguaucaaaaauaaucaaauacuagaagaaaauauggaaguagaaauauggaccaaagaaggggaaaggaagaaacuaaaaccaagauggcuugaugccagaauuuauagcgauccacuagcgcuuaaagaauuuaaagaguucgcggcaggacgcaagucgcuuacucugaaucuuaucacggaaaugggcagauuaccaacauucaugacacaaaaagcacgaaacgcacuggauaacuuagccguucuacauacagcggaagcaggaggacgagcauauaaucaugcccuuucagagcucccggaaacacuugagacacuauuacuauugacacugcuggcgacagugacaggcggcauauuccuauuucucaugaguggaaaaggaauugguaaaaugacacuugguauguguugcauuauaacggcaucgauauuacuuugguacgcgcaaauacaaccacauuggauagcugcgucaauaauuuuagaguucuuucuaauaguacugcugauuccggaaccagaaaaacaaaggacaccccaggacaaccaacucacuuacguagucauagcaauacugacggucguagccgcaacgauggcaaacgaaaugggauuccuggagaaaaccaagaaagaucuaggccuaggaaguauuaccacacaagaaucugaaucaaauauacucgauaucgaucuacgaccggcgagugcauggaccuuguaugcagucgcgacuacguuugucacaccgauguugagacacucaauugaaaacucaagcguaaacguuaguuuaacagcgauugcaaaccaagcuacaguuuuaaugggacuuggcaagggcuggccucucagcaaaauggauauugguguccccuuacuagcaaucggcugcuauagucaggucaauccgauuacguuaacagcggcuuugcucuuacuggucgcgcauuacgcgauaauuggaccagggcuccaagcaaaggcuacgagagaagcgcagaaaagagcugccgccggaauaaugaagaauccaacggucgacggaauuacgguaauugauuuggaaccuauaccauacgauccuaaauuugagaaacaauuaggucaaguuauguuauuaauauuauguguaacucagguguugaugaugcguacaacaugggcauugugugaggcucuaacacuugcaaccggacccauuaguacacuaugggaaggcaaccccggacguuucuggaauacaacgaucgccgucagcauggcuaacauuuuuagagggucguaucuagcuggcgcgggauuacuauuuucuauaaugaaaaauacaacuaacaccagaagagguacaggcaacauuggagaaacacuuggagaaaaauggaaaucaagguuaaacgcauuaggaaagucagaauuucaaauauauaagaaaagugguauucaagaaguagauagaacacuugcuaaggaagguauaaagagaggcgaaacagaccaucacgccguuagccgagggucagcuaaacuaagaugguuuguagagagaaauaugguaacaccagaaggaaaagugguagauuugggauguggcaggggaggauggaguuauuauugcgguggucuaaagaacguccgggaaguuaaaggccuaacgaaaggggguccaggacacgaagaaccaauaccaaugagcaccuauggauggaaucuugucagacuucagagcgggguagacguguucuucacaccaccagaaaaaugcgacacacugcucugugacauaggagaauccagcccuaacccaacuauugaagcggggagaacccugagaguguuaaaccuaguagagaauuggcucaauaauaacacacaauucuguauuaaaguacuuaauccauauaugccgagugugauagagaaaauggaagcacuacaacguaaauauggcggagcacuuguacgaaacccacuaucaaggaauaguacucacgaaauguauuggguaucuaacgcuacaggaaauauuguaaguagugucaauaugauaaguagaauguuaauaaacagauuuacaaugaaacauaaaaaggcaacuuacgaaccagacgucgaucuagguaguggaacuagaaacaucggcauagaaucagaaauacccaaucuagauauaauugggaaacgaauagagaaaauaaaacaagagcaugaaacaucauggcacuacgaccaagaccacccuuacaaaacaugggcguaucacgguucauaugaaacaaagcaaacggggucagcuuccucgaugguaaauggcguagugcgguugcuaacaaaaccaugggauguaguaccaaugguuacacaaauggcuaugacagacacuacuccuuucggacaacagaggguuuucaaagaaaaaguagacacacggacucaggaaccuaaagaaggaacgaagaaacuaaugaagauuacagcagaauggcuauggaaagaauuagguaagaagaaaacaccccggauguguacacgugaggaauuuacacgcaaagugcguuccaaugcugcacucggugcaauauuuaccgacgagaacaaauggaaaucagcuagagaagcaguagaagauggaagguuuugggaauuaguagauagggaacggaaucuacaccucgaagggaagugcgaaacuuguguuuauaacaugaugggcaaacgugagaagaaauugggagaguucgggaaggcaaagggaucaagagcgauaugguacauguggcuuggggcucgguuuuuggaguucgaagcccuuggguuucuaaacgaagaccacugguuuagucgggguaauaguuuaucagguguagaaggcgaaggucuucauagacuaggauauauauugagagauguagguaaaaaggaaggaggugcuauguaugcggaugauacagcaggaugggacacucgaauuacacuagaggaccucaaaaaugaagaaaugguuacaaaccauaugaagggugaacacaaaaaguuagcugaagcaaucuucaaauuaaccuaccagaacaaagucguuagaguucaacgaccgacaccucgugguacagucauggauauuauaucaagacgagaucaaagaggcaguggacagguagguacguauggucuaaauacuuucacaaacauggaagcucagcucaucagacaaauggaaggugagggaauuuuuaaauccauucaacaucuaacggcgacagaagaaauugccguucagaauugguuggcuagaguaggaagagaaagauuaaguaggauggcuauaucuggagaugacugcgugguuaaacccauugacgaucguuuugcgucagcuuuaaccgcacuuaaugauaugggaaaggugcgcaaagauauccagcagugggaaccuuccagaggauggaaugacuggacccaagugccauuuuguucucaccauuuccacgaauuagugaugaaggacgguaggguucuaguagucccuugucgaaaucaagaugagcugauuggucgugcacgaauuucacaaggggcaggauggucuuuaaaagaaacugccuguuuaggaaaaucauaugcucaaauguggacacuaauguacuuucacagacgagaucuacgcuuggcagccaacgcaauuuguucggccguuccuccgcauuggguucccaccagucggacaacuuggaguauccacgcuaaacaugaguggaugacgaccgaggauauguuagccguuuggaaucgcguguggauacaagagaacccauggauggaagauaaaaccccaguugagucuugggaagaaguaccauaccuagggaagcgagaagaucaaugguguggaucuuugauuggacucacaagucgagccacaugggccaaaaauauucaaacugcaauuaaccaaguaagaaguuuaauuggcaaugaagaauacacagauuacaugccaagcaugaaacgauuucgacgcgaagaagaggaggcaggaguuuugugguga

SEQ ID NO: 22428 - RNA, 9876 nt, Artificial Sequence
  derived and/or modified CDS sequence (opt6) from DENV-2__GQ199895__SS-prME
acugcgggaguaauugugauguuaauaccaacagcgauggcuuuccaucuaaccaccaggaacggugaaccucauaugauuguaggucgacaagaaaaaggcaaaucgcuuuuauucaaaaccgaagacggagugaauauguguacuuuaauggcaauugaccuaggggaacuuugugaagauacgauaaccuauaaaugucccuuacuacgucagaacgaaccagaagacauagauuguugguguaauucaacaucaacaugggugacuuacggaaccuguacaacaacgggggaacaccgaagagaaaaacgcagcguagcauuaguuccucacguuggaaugggauuagaaacgcguacagaaaccuggaugaguucugagggugcauggaaacacgugcaaagaauugagacauggauccuucgacauccugguuucacaauaauggcagccauauuggcauauacaauagguacaacacacuuucaacgagcucuaauauuuauccugcuaacagcgguagccccuaguaugacaaugcguuguaucggcauuucaaauagggauuucguagaaggaguuucgggcggaaguuggguugacaucguccuagaacacgggucuugcgucacaacaauggcuaaaaauaaaccuacuuuagauuuugaauuaauaaaaacagaggccaaacaaccagcaacacuccgaaaauauuguauugaagccaaacuaacaaauacaacaacagaaucccguugcccuacccaaggcgaaccaucuuugaacgaggagcaagauaaacgauucaucuguaaacacaguaugguagaccgcgguuggggaaauggauguggucuauuuggcaaaggugguaucgugaccugugccauguuuacauguaagaaaaauauggaagggaaaguaguucaaccagaaaaucucgaguauacuauaguuauuacuccccacucuggcgaggaacaugcgguugggaaugauacuggcaaacacggcaaagagauaaaaauuacaccgcaauccucaaucacagaagcggagcuuaccggauacggcacagucacuauggaauguucuccaagaacaggacuugacuucaacgaaaugguauuacuccagauggaagauaaagcauggcucguucaucgacaaugguuucucgaucuaccacugcccuggcucccaggugcugauacgcaagguucaaacuggauccaaaaagaaacuuuaguaacuuuuaaaaauccgcacgcuaagaaacaggauguuguaguccuuggaucacaggaaggagcaaugcacacugcauugacgggagcuacugagauccagaugaguucuggaaacuuauuauuuacaggccaucuaaaauguagacuuaggauggacaaacuucagcuuaaagguaugucauauaguauguguaccggcaaauucaaaauaguaaaagagauagcugaaacacaacaugggacaauuguuauuagaguucaauacgagggagacgguucgccuugcaaaauuccguuugaaauuacugaccuagagaaaaggcauguacuaggacgauuaauaaccguuaacccuauaguuaccgaaaaagacaguccuguaaauauagaagcugagcccccuuuuggugauagcuauauuauuaucggaguggagccgggacaguuaaaacuaaauugguuuaagaaagguaguucaauaggccaaauguuugaaaccacgaugagaggggcuaaaaggauggcuauacucggugauacagcaugggauuucgguagcuuaggaggaguuuucacgagcaucggcaaagcacuucaccagguauucggagcuauauacggcgcugcauuuagcggcguaucauggacuaugaaaauacugauaggugucauuauuaccuggaucggcaugaacuccagaaguaccucacucucaguaucguuaguccuaguaggagucguuacauuguauuuaggagcgaugguccaagcugauuccggaugugucgucaguuggaaaaacaaagaauuaaaaugcggaucagggauuuucaucacagauaacguucauacauggacggagcaauacaaauuucaaccggaauccccuucaaaacuugcaagugcgauccaaaaagcgcaugaagaaggaauaugcggaauacgcucuguuaccaggcuugagaaucuaauguggaaacaaauaacaccggaacugaaccacauuuuaucugagaaugaggugaaacuaacuauuaugacuggugauaucaaaggcauuaugcaagcgggcaaaaggucuuugcgcccgcaacccacagaacuaaaguacuccuggaaaaccugggguaaggcuaagaugcucaguacugaaucucacaaucaaaccuucuuaauagaugggcccgaaacugcagaauguccaaauacgaauagagcuuggaacucacuagaagucgaagacuacgguuucgggguguuuaccacgaacauuugguuaaagcuaagagaaaagcaagacgucuuuugugauucuaagcuaaugagcgcggcuauuaaagauaaccgagcaguccaugcagauaugggauauuggauagagagugcgcuaaaugacacuuggaaaauggaaaaagccucuuuuauagagguuaaaucuugucauuggccaaagagucauacccuguggaguaaugggguuuuggaaucagagaugauuauacccaagaauuucgcagggcccguuagucagcauaauuacagaccaggauaccauacgcaaacagcgggaccguggcaccugggaaaacuugaaauggacuucgauuuaugugaagguacgacgguaguugucacagaagauugcgggaaccgaggaccgagccuuaggaccaccacugcaucagguaaacugauuaccgaauggugcugcaggagcugcacacuuccaccauugcgauaucguggagaagaugguugcugguaugguauggaaauucguccuuuaaaagagaaggaggagaacuuaguuaauagccuaguuacagcgggccauggacaaauagauaacuucagccuaggggugcuugggauggcguuauuucuagaagagaugcuuaggacacgaauagguacgaagcaugcuauuuuguuaguagcgguuucuuuuguaacacuaauuacagguaacaugucauuccgugauuuagggagaguuauggucauggucggugcaacaaugacagaugauauagguauggguguaaccuacuuggcuuuguuagcggccuuuaagguucgcccaacguuugccgcuggacuucuauuacguaaauuaacaaguaaagaauugaugauggcgaccaucggaauagcauuacuuagucaaucgacgauaccugaaacaauucuggaauuaacagacgcacuagcacugggaaugaugguauuaaaaauaguacguaacauggaaaaauaucaacuagcggugacuauuauggcaauuucuuguguaccaaacgccgugauauuacagaaugcguggaaagucagcuguacuaucuuagcagcgguauccguauccccauugcuacugacaucuucucaacaaaaggccgacuggauaccguuagcguugacgauaaaaggacuaaauccaaccgcaauauuuuuaacaacuuuaaguagaacguccaagaaacggucguggccguuaaaugaagcaaucauggcuguaggaaugguauccauacuagcaucuucauuauuaaagaaugacauaccuaugacagguccauuaguagcgggugggcuacuaaccguauguuacguauugaccgguaggagugcagaucuagaauuggaaagagcagcagacgugaagugggaggaucaagccgagauaucaggaaguucuccuauauuauccauaacaauuagugaagauggaaguaugucuaucaaaaacgaagaagaggaacagacucuaacuauacucauuagaacuggacuauuaguaauuaguggaguauuuccagucucaauaccuauaacggcugcagcaugguaccuuugggaggucaagaaacaaagggcuggcgucuuaugggaugugcccuccccaccucccguugaaaaggcugaauuagaagauggagcauaucguauuaaacagcgaggcauacugggauauagucagauuggggcugguguauauaaagaggguacguuccacaccauguggcacgucacgcgcggugccguacuaaugcacagaggaaaaagaaucgaaccaucaugggcugaugucaagaaagaucuuauuucauauggugguggcuggaaacuagaaggugaauggaaggaaggcgaagagguacaagugcuagcucucgaaccaggcaaaaauccaagagcaguccaaaccaaaccggguauauucaaaacaaacaccggaaccauaggagcuguaucccuugauuucuccccaggaacaaguggaucaccgauuguagaccgaaagggaaaaguaguuggacuauauggcaauggggucguuacaagaagcggggcguauguauccgcaaucgcgcaaacagagaaaaguauagaggauaacccugagauagaagaggauauauuccguaagaaaagacuuacuaucauggacuuacacccuggagcuggaaagaccaagcgauacuugccugcuauaguucgugaagccauaaaaagaggguuacggacgcucauucuggccccuacucggguaguagcugcagagauggaagaggcauuacgaggguuaccaauacgauaccaaaccccagcgaucaaaacagagcacacaggacgcgagaucguagauuuaaugugccacgcaacuuucacgaugcgucuacuaaguccaguaaggguuccuaacuauaaccuaaucauaauggaugaagcucacuucacggauccagcaucaauagccgcgcgcggcuauaucaguacgagggucgagaugggagaagccgcaggaauauucaugacggcaacaccaccugguucgagagacccauuuccucagaguaaugcaccgauaauggacgaagaaagagagauaccagagcgaucguggaacagcggacacgagugggucacugauuuuaaggggaaaacaguuugguuuguaccuucgauaaaagccggaaacgauauagccgcuugucuucgcaaaaaugggaagaaagugauccaacuuagcagaaaaacuuucgacucagaauaugugaaaacacgggcaaacgauugggacuuuguaguaaccacggacaucagcgaaaugggagcuaacuucaaagcugagagagucauugacccaagacgcugcaugaaaccaguaauucuuacugacggagaggaacguguuauuuuagcagggccaaugccgguaacacauucaagugcagcacaaaggagaggacguauuggccgaaacccuaaaaaugaaaacgaccaauauauuuacaugggagaaccacuagaaaacgaugaagauugugcucauuggaaagaagcgaaaaugcuacuugacaauauaaauacuccagaaggcauaauaccgagcauguucgaaccggaacgggaaaagguagaugcuauagacggugaauaucgucuaaggggugaagcuaggaaaacguuuguagaccuaaugcgaagaggcgaucuuccgguauggcuagcauacaagguugccgccgagggaauuaauuaugcagauagaaaaugguguuucgauggaauuaaaaacaaucagauacuugaagaaaauauggaaguagagauauggacaaaggaaggcgagaggaagaaacugaaaccuagguggcucgaugcacgcauuuacagugacccacuugcacugaaggaguucaaagaauuugcugcuggcagaaaaucuuuaacgcuuaauuugauuacagaaauggggagauuaccuacuuucaugacucagaaggcacguaacgcacuagauaacuuggcugugcuucauacggcagaggcaggagggcgggcuuacaaucacgcauugucagaacuuccugaaacauuagaaacauuacuuuuacuuacgcuucuugcuacuguuacaggaggaauauuuuuauuucuuaugaguggcaaagguauuggaaaaaugacucuuggaauguguuguauaauuacagccucaauauuacuaugguaugcgcaaauccaaccucacuggaucgccgccuccauaauauuggaauuuuuccuaauuguauuauuaauaccggaaccggaaaaacaacguacaccccaggauaaucaauuaacuuacguugugaucgccaucuuaaccgucguagcggcaacuauggccaacgagaugggguuucuugaaaagaccaagaaagaucucgggcuuggcucgauaacaacccaagaaagcgagaguaauauacuagacauugauuuaaggcccgcguccgcuuggacauuauacgccgucgcuacgacuuuuguaacaccuauguuaaggcacagcauagaaaauuccuccguaaacguaagucuuacugcaauagcaaaccaagcaacaguuuuaaugggacuaggaaaaggauggccguuauccaagauggacauuggugugccacuauuagcuauagguuguuauagucaggugaacccgauaacccuuacggcagccuuguuauuacuugucgcacauuacgcaauaaucggaccaggccuacaagcuaaagcaacacgcgaagcucagaaacgugcggcagcuggaauuaugaaaaaccccacuguagacggaauaacaguaauagaucuugaaccgauuccauaugauccuaaauuugagaaacaguuagggcaaguuaugcuccucauccucugugucacgcagguauuaaugaugcgaacgaccugggcacuuugugaagcgcuaacucuagcaacaggaccaauuucaacuuuaugggaaggcaauccaggucgauucuggaauacuaccauagcaguaagcauggcaaacauauuucgaggaucauaccuagccggugcaggcuuacucuuuuccauaaugaaaaacacaacaaacacgagaaggggaacaggaaacauaggggaaaccuugggagagaaauggaaaucacgauuaaaugcacuaggaaaguccgaauuucaaauauauaagaaaagugguauccaggagguggacagaacacuagcaaaagaaggaauaaaaagaggagagacugaccaucacgcaguaagcagagguagugcgaaauugaggugguuuguugagaggaauaugguaacaccagaaggcaaaguaguugaccuugguuguggucgagguggcuggaguuauuacugcggcgggcucaaaaacgugcgagaaguaaagggucugacaaaaggaggaccuggacacgaggaacccauaccaaugucaacauauggauggaauuuaguuagacugcaaucaggugucgacguauucuuuacuccacccgagaagugugauacacuacucugugauauaggugaaagcuccccgaauccaacaauagaagcugguaggacauuacgaguauuaaacuuaguagaaaacugguugaauaauaauacucaauuuugcauuaaaguacuuaaucccuauaugccuucagugaucgagaaaauggaggcuuuacaaagaaaauauggcggugcauuaguccgaaauccuuuauccagaaauucaacacacgaaauguacugggugaguaacgcaacuggaaauaucgugucaagugucaauaugauuucaaggaugcucauuaaucgcuucacaaugaagcauaaaaaggcuacuuaugagcccgacgucgaccucggaaguggaacuagaaauauagguauagaaucagaaauucccaacuuagauauaauagggaaaagaauagagaaaauuaaacaagaacaugagacaagcuggcacuacgaccaagaccauccauauaaaaccugggcauaucaugguagcuacgaaacuaaacagacaggcagugcuagcaguaugguuaacgguguagugcgccuauuaacaaaaccaugggauguuguaccgaugguaacccaaauggcaaugacagauacaacaccuuucggacaacaaagaguuuuuaaagagaaagucgacaccagaacacaggaaccaaaagaaggaacuaagaaauugaugaaaaucacggcggaauggcuauggaaagaacugggaaagaagaaaacuccccgaauguguacaagagaagaguucacccguaaaguaagaaguaaugcggcgcuaggggccauauuuacagacgagaacaaauggaaaucagccagagaagcuguagaagauggaagauuuugggaacucguugauagggaaagaaaccuucauuuagaaggaaagugugaaaccuguguguauaauaugaugggcaaacgagagaagaaauuaggugaauuuggaaaagccaaaggaucucgugcgaucugguacauguggcuaggggcccguuuucuugaauuugaagcgcuaggauuuuuaaaugaagaucauugguucucuagaggaaauucacuaagcgggguugaaggugaaggcuuacauagacuugguuacauccuacgugaugucggaaagaaggaaggcggcgcuauguaugcggaugauaccgcugguugggacacaagaauaacauuagaagacuugaaaaaugaagaaaugguuacuaaucacaugaagggagagcacaagaaauuagcagaagcaauauucaagcugacauaccaaaauaagguaguccgaguucaaagaccaacaccacgaggaacggucauggauaucauaucaagacgggaccaacgaggcagcggccaggucggaacauaugguuuaaauacuuuuacgaacauggaagcccaacuuauaagacaaauggaaggcgaagguauauucaaaucgauccaacaccuaacugcuacugaagaaauagcugugcaaaacuggcuagcgaggguaggcagggaaagguugucuaggauggcgauuucaggagacgacugcguugugaaacccauagaugaucguuuugcaucugcacuuacagcccugaaugauauggguaaagugcggaaggauauucaacaaugggagccgagcagagguuggaacgauuggacgcaagucccauuuuguucacaucacuuucaugaacuuguaaugaaggacggucgaguguuaguuguuccuugucguaaucaagaugaauugauaggcagagcccgaauuucacagggagcagguuggagcuuaaaagagacugcaugucuggggaagucauaugcacaaauguggacauuaauguacuuucaccgucgugaucucagacuugcagcgaacgccauauguagugcaguaccaccccauuggguaccaacgucacguacaacuuggucaauacacgcgaaacacgaauggaugacaacugaagauauguuggcagucuggaauagaguauggauacaggagaaucccuggauggaagacaaaacgcccguagagagcugggaagaaguaccauauuuggggaaacgagaggaucaauggugcgguucucuuauuggacuuacgucccgagcuacaugggccaaaaacauacaaacagcaauaaaucaaguucggucuuuaaucgggaaugaagaauacaccgauuauaugccaagcaugaagagguucagacgcgaagaggaagaagcaggaguacuaugguaa

SEQ ID NO: 22429 - RNA, 9876 nt, Artificial Sequence
  derived and/or modified CDS sequence (opt6) from DENV-2__FJ898478__SS-prME
acugcaggggugauuguaauguuaauuccgacugcaauggccuuccauuuaaccacgaggaauggggaaccgcacaugaucgugggaagacaagaaaaaggaaaaucucuucuguucaaaacagaagauggagugaauauguguacacuuauggcuaucgaccuuggcgaauugugcgaagauaccauaaccuacaaaugcccuuuacuucggcaaaaugaacccgaagacauagauuguuggugcaauagcaccucaacuuggguaacuuaugggacuuguacaacaacaggagaacaccgaagggaaaaacgcaguguagcuuuaguaccccauguggggaugggauuggaaacgcguacugaaacuuggaugucgucugaaggagcauggaaacacgugcaaaggaucgaaacuuggauacuaaggcauccaggguuuacgaucauggcagcaaucuuagcauacacaauuggcacuacacacuuucaacgagccuuaauauucauacuacuuacagcaguagcgccaucaaugacaaugagauguaucgguauaucuaauagggacuucguugaaggcgugaguggaggaaguuggguagacauaguacucgaacaugguaguuguguaacgacuauggccaaaaauaaaccuacacuagauuucgaauuaauaaaaacugaagcaaaacaaccagcaacguuacgaaaauauugcauugaagcaaaacugacaaacacaaccaccgaaaguagguguccgacccaaggagaaccauccuuaaacgaagaacaagauaaaagguuuaucugcaaacacucaaugguugacagaggaugggggaaugguugcggccuauuugguaaaggaggaauagucacgugugcuauguucacauguaagaaaaacauggaaggaaaaguaguccagccagagaauuuagaguauacaauugucaucaccccgcauagcggugaagaacaugccguagggaacgauacuggaaaacacggaaaagaaauaaaaauaacuccacaaucaaguauaacagaagcagaacugacuggguauggaacagugacgauggaauguaguccaagaaccggauuagacuuuaaugaaaugguacuccuacagauggaggacaaagccuggcuugugcaucgacaaugguucuuggauuuaccguuaccuugguugccaggugcggauacucaaggaagcaauuggauccaaaaagagacauuaguuacauuuaaaaauccucaugcuaagaaacaggacguaguagugcuaggaucacaagaaggagcaaugcacaccgccuuaacgggcgcuacugaaauacaaaugucuucugguaauuuauuauuuacgggacacuuaaaaugcagacucagaauggauaaacugcaauuaaaaggcauguccuacuccauguguacagguaaauuuaaaauagucaaagaaauagcagaaacgcaacacggaacaauagugauacguguacaauacgaaggugauggcaguccguguaaaauacccuuugaaauuacugacuuagagaaaagacauguauugggcagauugauaacaguaaauccgauuguaacugagaaggacucaccugucaacauagaggcugaaccuccguuuggggauaguuauauaauaauuggaguagagccgggacaacuaaaacuaaauugguuuaagaaagguagcucgauaggacagauguuugaaacaacaaugagaggggcuaagcgaauggcuauuuugggugauaccgccugggauuucggcucccuaggugguguguuuacuagcauaggaaaggccuuacaucaaguauuuggagccauuuauggagcagcauuuucaggcguaagcuggacaaugaaaauccuuauugguguaaucaucacguggauugguaugaacucacgcaguacgagucuaucuguaaguuuaguucuaguaggugucgugacgcuauaucucggcgcgaugguucaagcggacucgggcuguguugugucuuggaagaauaaggaauuaaaauguggcagcgggauuuuuauuacggauaacguccacacuuggaccgagcaauacaaauuccaaccugagagcccaucaaaguuagcaucagcaauucaaaaagcgcaugaagaaggaauaugcgguauacgaucggugacuagacuagaaaauuuaauguggaagcaaauaacucccgaauuaaaccauauauuaagugaaaacgaaguaaaauuaacgaucaugaccggugauauaaaaggcauaaugcaagcgggcaagagaucacuaagaccacaaccuacugaauugaaauacaguuggaaaaccugggggaaagcaaagauguuauccacggaaagccauaaccagacuuuccuuaucgacggaccugagacggccgaauguccaaauacuaacagagcuuggaauagccuagaaguggaggauuacggauuuggaguauucacaacaaacauauggcuuaaauuaagagaaaaacaagacguguuuugugauaguaaacuuaugagugccgcaauaaaagauaauagagcggugcaugccgauauggguuacuggauugaaagugcucuuaaugauaccuggaaaauggagaaagccucuuucauagagguaaaaaguugucacuggccaaaaagucauacucuguggucuaauggaguucuagaaucagaaaugauaauacccaaaaauuucgcgggaccuguuucacagcauaauuacagacccggauaccacacccaaaccgcugguccuuggcauuuaggaaaacuugaaauggauuucgacuuaugcgaaggaacaacugucguuguuacagaggauugcgguaauagaggcccaagccuccgaacuacaacagcuagcggcaaacuuauaaccgaaugguguugccggucgugcacucucccacccuuaagguauagaggagaggauggcuguugguacggaauggagaucagaccccuuaaagaaaaggaagaaaacuuaguaaauucuuugguuacugccggucacggacaaauagauaacuuuagucucggaguacuaggaauggccuuauuccuggaagagauguugcgaacccguauagguacaaaacacgcaauauugcugguggcuguuaguuuugugacacuaauaacagggaauaugucguuuagagauuuaggucguguaauggugaugguuggagcaaccaugacugacgauauuggcaugggcguaaccuaccuugcuuuguuggccgcguuuaaagugaggccaacguuugcagcugguuuauuauugcgcaaguugaccaguaaggagcuuaugauggcaacgauagguauagcacuccuaucucaaaguacuauaccagaaacuauucuggaacuaacagaugcccuugcauuagggaugaugguuuugaaaauuguaagaaauauggaaaaauaccaauuagcagugaccauuauggcaauaucauguguaccaaacgccgucauacuacaaaaugccuggaaggugucguguacuauucuagcugcaguguccgugucaccauuauuacucacgucuagucaacagaaggcggacuggauaccauuagcccuuacaaucaagggcuugaauccuacggcaaucuucuuaacuacauuaaguagaacaaguaagaaaagaagcuggccauugaaugaagccauuauggcggugggaaugguaagcauccuagccagcucuuuacuaaagaaugacauuccaaugacagguccacuuguagcuggaggguuacuuacaguuuguuauguucuaacagggagaucagcugauuuagaauuagaaagagcugcagauguaaaaugggaggaucaagcugagauaagugguagcagcccuauacuuaguauaacaauuagugaagaugguagcaugaguaucaaaaacgaagaggaagaacagacacucaccauccugauacgcacgggucuccuugugauuagcggaguauuuccagucaguauuccgauaacggcagcagcgugguauuuaugggaagucaaaaagcaaagagcaggaguauuaugggauguuccuagcccaccaccugucgagaaagcugaauuggaggacggggcauacagaauaaaacaaagaggaauauuggguuacucgcaaauaggggcugggguguauaaggagggaacguuucacacgauguggcauguuacacggggagcaguucuaaugcauagagggaaaaggauagaacccucgugggcggaugucaagaaagauuuaauaucuuauggagguggauggaaauuagaaggugaauggaaagaaggagaagaaguucaaguacuggccuuggagccggguaaaaacccccgagcaguacaaaccaaaccaggaauauuuaaaaccaacacugguacaauaggagcaguuucgcuagauuuuucuccaggaacaagcggaucaccaauuguagaucgaaaaggcaaaguugucggguuauauggaaauggagucguaacacgcagcggagcauacguguccgcaaucgcgcaaacggaaaaauccauugaagauaauccugaaaucgaagacgauauauuuaggaagaaaagacucaccauuauggaucuacauccaggugcaggcaaaacuaaaagauaccuaccugccauagugagagaagcgauaaaaagaggauugcggacucuaauccuagcuccuacgagagugguugcugcagaaauggaagaggcguuacggggacugccaauacgauaccagacucccgcuauuaaaacugaacacaccggcagagaaauuguugauuuaaugugucaugcuacuuuuacaaugcgguugcuuucuccuguaagaguaccgaacuauaaucucauaaucauggaugaagcucauuuuacugacccugcauccauagcugcccgaggguauauuucuacaaggguugaaaugggagaagcugcuggaauuuucaugacagcgacaccuccgggcagcagagauccauucccucagaguaaugcaccaauaauggaugaggaacgagaaauuccggagaggaguuggaacucuggucaugaauggguuacagauuuuaagggaaaaacuguaugguuuguaccgucuaucaaagcugggaaugauaucgcugcuugucuuaggaagaauggaaagaaaguaauacaauugagucguaaaacuuuugacagcgaguaugucaaaacgagagcaaaugacugggacuuuguaguaacaacagauauuagugaaaugggagcaaauuucaaggcggaaagaguaauagacccaagaagauguaugaaaccaguuauauuaacagauggugaagagagagugauccuagcaggucccaugccgguuacccauucaucugcggcacaaaggcgggguaggauuggacgaaauccgaaaaaugaaaacgaccaauauauauacaugggugaaccauuagaaaaugaugaagauugugcucauuggaaagaagcuaagauguuauuggauaacauaaacacacccgaaggaauuauuccauccauguucgagcccgaaagggaaaaaguugaugcuaucgauggggaauauagacuccguggagaagcuaggaaaaccuuuguagauuugaugagacgaggugacuuaccaguguggcuagcuuauaaaguugcagcagaaggaaucaauuaugcugauagaaaauggugcuuugauggaauuaaaaacaaucagauauuggaagaaaauauggaaguugaaauauggacaaaagaaggugaacgaaagaagcuaaaaccacgaugguuagaugcgaggauauacucugauccauuagcgcuuaaagaauuuaaagaauuugcagcugggagaaaaucuuugaccuuaaaccucaucacagaaauggggcgccucccaacauuuaugacccaaaaagcacggaaugcgcuagauaaccuggcaguucuacauaccgcggaagcagggggcagagcauauaaccacgcucuaagugaauuaccugaaacauuggagacuuuacuauuacuaacauuauuggcuacgguuaccggagggauauuccucuuccugaugucgggaaagggcauaggcaaaaugacuuuagggauguguuguauuaucacggcaagcauauuacugugguaugcacagauucaaccucauuggaucgcugcuagcauuauacuugaguucuucuuaauaguacuauuaauaccagagccggaaaaacagcgaaccccacaagauaaccagcuuacuuauguaguuaucgccauauugacugucguagcagccacuauggcgaaugaaaugggauuuuuagagaaaacgaagaaagaccuagggcucggaucgauaacaacacaggagucugaaagcaauauauuagacauagaucugcgcccugcgagugcuuggacuuuguacgcuguagcuacuacuuuuguuacuccaaugcucaggcauucaaucgaaaauuccucagucaaugugaguuugaccgcaauugcaaaucaagcaacaguucuaaugggguuagguaaaggauggccauuaucgaaaauggacauugguguaccccuuuuagcgauagguuguuauagccagguuaauccaauaacacuuacagcugcauuacuccuacugguagcacauuaugcaaucauaggaccaggucuacaagcuaaagcaacaagggaggcacagaagcgggcagccgcuggaauaaugaaaaauccgacugucgauggaaucaccguaauagaucuugaaccuauaccauaugauccuaaauucgagaagcaguugggacaggugaugcuuuuaauucucugcguaacacaagucuuaaugaugcggaccaccugggcguuaugugaagcucucacacucgcuacuggaccaauaagcacuuuaugggaggggaacccagggagauucuggaauaccacuauugccguuucgauggcaaauauuuuccgaggaaguuaucucgcuggagcaggucuacucuucagcauaaugaagaacacaacaagcacgagacgaggaacagguaauauaggagaaaccuuaggcgaaaaauggaaaucuagguuaaaugcacuugguaaaucagaguuccaaaucuauaagaaaaguggaauacaagaaguugaccguacauuagccaaggaagggauaaaaagaggagaaacagaccaccaugcgguaucgagagguucagcaaaacucagaugguuuguggagcgaaacaugguaacaccagaagguaaagucguagacuuagguugcggacggggaggauggaguuacuauugugggggacuuaaaaauguaagagaagugaaaggucucacaaaaggugggccaggccacgaggaaccaaucccaaugucaacauacgguuggaaucuuguaaggcuucaaaguggagucgauguguucuuuacuccacccgaaaaaugcgacacgcucuuaugugauauuggugaaucaucuccgaauccuacaauugaagccggacgaacccuuagaguacucaaucuugucgagaacuggcuuaauaauaauacacaauucugcauuaaaguuuuaaacccguacaugccuucuguaauagagaaaauggaagcguuacaacgcaaauacgguggcgcacucguacgaaauccgcuuagcaggaacuccacacacgagauguacuggguuaguaaugcgaccggaaauaucguaucgucgguaaauaugauaucucgaaugcuaaucaaucguuucacuaugaaacauaagaaagcuaccuacgaaccggauguugaucucgguuccggaaccagaaacauaggaauugaaagugaaauuccuaacuuagauaucaucgguaaaagaauugagaaaauuaaacaagaacacgaaacaagcuggcauuacgaccaagaucauccuuauaagacaugggcauaucauggaucauaugaaacuaagcaaacagggagugccaguuccauggugaauggaguagugcgauuacuaacuaaacccugggauguaguaccuaugguuacgcagauggccaugaccgauacaaccccguucggacaacaacguguauuuaaagagaaaguagacacacguacacaagagccaaaagaggguacgaagaaauuaaugaaaaucacugcagagugguuauggaaagaacuaggcaaaaagaaaacgccacgcauguguacuagagaagaguucacuagaaaagucaggaguaaugcagcgcuuggggcgauuuucacagacgaaaacaaauggaaaagugcucgagaagcgguagaagacggucguuuuugggaauuggucgauagggaacguaaucuccauuuagaagggaaaugcgagacuugcguauacaauaugaugggaaaaagggagaagaaacuaggagaauuugguaaagcaaaagggucaagagcaauaugguacauguggcuuggcgcuagguuccuagaguucgaagcucuaggauucuuaaacgaagaucacugguucucacgaggaaauaguuuaucagguguagaaggagaaggacuccaccggcuggguuauauacuccgcgacguaggcaaaaaggaaggaggagcuauguaugcagaugauacagcaggaugggacacgcgaauaacgcuagaagaucuaaagaaugaagaaaugguaacaaaccauaugaaaggugaacauaagaaauuagcagaagccaucuuuaaacuuaccuaucaaaauaaaguaguaagaguucaacgaccgacacccaggggaaccguaauggauaucauaucuagaagagaccagcguggauccggccaagucggaacauacggauuaaauacuuuuacaaacauggaagcacagcugauacgacagauggaaggagaagguaucuuuaaaaguauacaacaccuaacugccacagaggaaaucgcuguccagaauuggcuagcacgaguugguagagaaagguuaucuagaauggcuauuucgggugaugacugcguagugaaaccaauugaugaccgcuuugcuagugcauugaccgcacucaacgauaugggaaaaguaagaaaggauauucaacaaugggaaccgagccguggauggaaugacuggacacagguacccuucugcucucaucauuuucacgaauuggucaugaaagauggaagaguccuaguaguacccugcaggaaucaagacgaauuaauuggacgagccagaauaagucaaggagcaggauggucucugaaggagacagcuugucucggaaagucuuaugcccaaauguggacauuaauguauuuccacagaagggaucuacggcuggcggccaacgcaauuugcuccgcgguaccaucgcauuggguuccuacaucucguacaacaugguccauacaugccaaacaugaguggaugacgacagaagauauguuagccguauggaaucgaguauggauacaagaaaacccauggauggaagauaagacaccagucgagucuugggaggaaguaccguaucucggcaaaagggaggaccaaugguguggaagucucaucgguuuaacaagccgggcaacuugggccaagaacauccaaacagcgauuaaucaaguaagaucacuaauuggaaacgaagaguacacugacuacaugccuucgaugaaacgauuccgaagagaagaagaagaagcuggcguguuaugguag

SEQ ID NO: 22430 - RNA, 9876 nt, Artificial Sequence
  derived and/or modified CDS sequence (opt6) from DENV-2__GQ199869__SS-prME
acugcaggggugauaguaauguuaauaccaacugcaauggcauuucacuuaacgacaagaaauggugaaccccacaugauuguuggaagacaagaaaaaggaaaaucacuucuauuuaaaacagaagauggugucaacaugugcacgcuaauggcaauagacuuaggagaauugugugaagauacgauuacguauaaaugcccuuugcuucgacaaaaugaacccgaagauauagauuguugguguaauucaacaaguaccuggguuaccuaugguaccuguacuacaaccggugaacaccggagagagaaaaggucaguggcucuggucccgcauguuggaaugggauuagaaacuaggacggaaacauggaugaguucagaaggcgcguggaaacacgugcaacguauugaaacauggauacuacgucaccccggguuuacaauaauggcagcaauacuggcauacacaauaggaacaacgcauuuucaacgagcauuaauuuuuauccuuuuaacugcaguagcgccgucuaugacaaugagaugcauaggaauaucaaauagagauuucguagaaggagugucuggaggaucauggguagacauuguauuggaacaugguucaugcguuaccaccauggcgaaaaacaaaccgacuuuagauuuugaauuaauuaaaacagaagccaaacagccggcaacuuuaagaaaauauuguauagaagccaaacugacaaauacaaccacagaaagccgaugccccacacaaggugaaccgucauuaaacgaagaacaagauaaaagauuuauauguaaacacucaauggucgaccgcgggugggguaauggaugugggcuguuugguaaaggagggauaguaacgugugcaauguuuacauguaagaaaaacauggaggggaaaguagugcaaccugaaaauuuggaauacacuauagucauuacgccucauaguggugaagaacaugcagucgguaacgauacaggaaaacacgggaaagagauuaaaauaacgccacagaguucaaucaccgaggcagaguugaccggauauggcacagucacgauggaaugcaguccaagaacaggacuagacuucaaugaaaugguauuauuacagauggaggauaaggcguggcuuguccauagacaaugguuuuuggaucugccacuaccauggcuaccaggcgcugauauccaaggaucaaauuggauacaaaaagaaacauuaguaacuuuuaaaaacccgcacgccaagaaacaggauguaguaguacugggcucacaagaaggggcaaugcauaccgcguuaacgggagcuacugagauccaaauguccaguggaaaucuguuauucacaggccauuuaaaauguagacuaagaauggauaaauuacaauugaaagguauguccuauucgauguguacuggaaaauuuaaaauugucaaagagauugcagaaacucaacacggcacuauuguaauacgcgugcaguacgaaggugacggaagcccauguaagauuccauuugaaauaacugaccuggagaaaagacacguccugggaagauugauaacuguuaacccuauaguaacagaaaaagauaguccagucaacauugaagccgagccuccuuucggcgacagcuauauuaucauaggaguugaacccggacaauugaaacuaaauugguuuaagaaagggucaucuauaggacaaauguucgagacaacaaugagaggagcgaagcguauggcaauccuaggagauacagcuugggauuucggcagcuuaggcggaguauucacaagcauuggaaaagcacuucaucaaguauuuggagcuaucuacggagcugcauuuucuggggugucauggaccaugaagauucugauaggaguaauaauaacguggauugguaugaacucgcguucuacuagccuuaguguuucauuaguuuuaguaggaguaguuacccuuuacuugggagcaguaguucaggcagacucaggaugcguaguaaguuggaaaaacaaagaacuuaaaugugguagcgguauauuuauuacggacaauguacacacauggacagaacaguauaaauuucaaccggaaucaccaucaaaacuugcaagugcaauacaaaaagcgcaugaggagggaauaugcggaauaaggagcguuacuagauuggaaaaucuaauguggaagcaaauuaccccagaacuaaaccacauauuaagcgagaacgaggucaagcugacaauaaugacaggugacauuaaaggaauaaugcaggccgguaaacggucacuaaggccccaaccaacagaauuaaaguacagcuggaagaccugggguaaggccaagaugcuuucaacugaaucacacaaccaaacuuuucucaucgacggaccggaaacagcugaauguccaaauacgaauagggccuggaacucucuggaagucgaggacuaugguuuugguguauucaccacgaacaucuggcuaaaacugagagaaaaacaagacgucuuuugugacaguaaauuaaugucggccgcuauaaaggacaaucgagcaguccacgcggauauggguuauuggauugagagcgcguugaacgacaccuggaagauggaaaaggccagcuuuauagaaguaaaaaguugucauuggccuaaaagucauacguuauggucuaacgggguucuagagagcgaaaugauaauaccaaagaauuucgccgguccuguaagucagcauaacuacagaccuggauaccauacucaaacugcaggcccauggcauuuaggaaaauuagaaauggauuuugauuuuugcgaagggacgacuguuguggucacggaggauugugggaacagaggaccuagccuaaggacaacgacagcaucuggaaaguuaaucacugaaugguguugccggagcugcacucuaccaccacuaagguaccgaggcgaggauggaugcugguacggaauggaaauaagaccacucaaggaaaaagaagaaaaucuaguuaacaguuuaguuaccgcaggacacggccaaaucgauaauuuuagccuaggcguuuuagguauggcguuauuucuugaggaaaugcuccgaacacgcauaggaacaaaacaugcaauacuauuaguggcuguaaguuucguuacguuaauuacggggaauaugucauuuagagacuugggacggguuaugguaaugguaggagccacuaugaccgaugacauugguaugggugugaccuaccuugcucuuuuagcugcuuuuaaaguucgaccaacuuucgcagcaggauuacucuuacguaaauuaacaaguaaggaguuaaugauggcgacuauaggaauugcauuauugucccagucaacaauucccgagacaaucuuagaauugacagacgcauuagcccuggguaugaugguacuaaagaucguacguaacauggagaaauaccaguuagcuguaacgaucauggccaucucguguguaccaaaugcaguaauccuacagaaugccuggaagguuucaugcacaauccuugcggccguaucagucaguccgcuacuauuaaccuccucacaacaaaaggcagacuggauaccccuggcacucacuaucaagggauuaaacccaacagcuauuuucuuaacuacacuuucaagaacgaguaagaaacguaguuggccuuuaaaugaagcuauaauggcaguuggcauggugagcauccuugcuucuucacuauugaaaaaugauauuccuaugacagggccucuaguagcagggggacuauuaaccguauguuauguuuugaccggacguuccgcggacuuagaacucgaaagagcugcagacgugaaaugggaagaucaagcagaaaucagugguucaagcccaauacugucaauaacaauuucagaggacgguucaauguccaucaaaaaugaagaggaagaacagacguuaaccauucucauacggacaggccuauuaguaauuagcggaguauuuccugugucgauuccuauaacggcagcugcgugguaucuuugggaagucaagaaacagcgggcuggugugcuaugggauguaccaagcccaccucccgucgaaaaggcagaacuagaagacggugcguaccgaaucaagcaaagggguauacuuggauauucucaaauuggagccggggucuauaaggaaggaaccuuccauacaauguggcaugugaccagaggagcagugcuuaugcaucguggaaagagaaucgagccauccugggcagaugucaaaaaggacuuaauaaguuacggcgguggguggaaacuugaaggagaauggaaagaaggggaagaaguccaagucuuagcacucgaaccagggaaaaacccuagagccguacaaacaaagccaggcauauucaaaacaaacacggggacuauaggugcaguaaguuuagacuucagcccaggaacaucaggaucaccgauaguagauagaaaagguaaagugguaggacuauauggaaauggcguaguaacuaggucaggugcauacguauccgcaauagcucaaacggaaaagucuauugaggacaauccggaaauugaggacgauauauuccguaagaaacggcuaacaauaauggaccuacacccaggugcagguaaaacgaagcgauauuugcccgcuauuguaagagaagcaauaaaacgaggacuuagaacccuuauacuagcucccacucgaguaguagcagcggaaauggaagaagcacuaagaggauuaccuauaagauaccaaacaccggccauaaaaacagaacauacuggucgagaaauaguagaucuaaugugccaugcuaccuuuacaaugaggcuacuaucccccguaagaguaccgaacuauaauuuaauuauaauggacgaggcacacuuuacggauccagccaguauugccgcaagaggcuacauaagcacgaggguugagaugggggaagcugcggggauuuuuaugacugcaacucccccaggaucaagggauccguuuccucaaucgaaugccccuauuauggaugaagaacgugaaauaccggaacgcucauggaacucaggacaugaaugggugacggacuuuaaaggaaaaacagugugguucguuccuaguauuaaagcuggaaaugauauagcagcuuguuuaaggaaaaaugggaagaaaguaauacaguuaagucgaaaaacauucgacucugaguacguuaagacaagagcaaaugauugggauuucguuguaacaacagacauuucagaaaugggugcaaauuuuaaagcagagagagugauugauccccgucgauguaugaaaccaguaauucugaccgauggagaagaaagaguaauucuugcugguccaaugccaguaacacacucaagugcugcucagcgaagaggacgaaucggcagaaacccuaaaaacgaaaacgaccaauauauauauaugggggaaccuuuagaaaacgacgaagauugugcacacuggaaagaagcuaaaaugcuauuagauaauaucaauacaccggaaggaauuauccccucaauguuugaaccugaacgcgagaaagucgaugcaauugacggagaauaucgcuuaaggggugaagcacgcaaaacguucgucgacuuaaugcggaggggugacuuaccaguuuggcuugcuuauaaaguugcggcagaaggcauuaauuacgcggauaggaaauggugcuucgacgguauaaagaacaaucaaauccuggaggagaauauggagguggaaauauggaccaaggagggagaaaggaagaaauuaaaaccucgcuggcuagaugcccguauauauucugauccauuagcguugaaagaauuuaaagaauuugcagcaggacgaaaaucccuuacguuaaaucuuaucacggaaaugggaagguuaccgacuuuuaugacacaaaaggccagaaaugcgcuugauaauuuagcaguucuucauacagcugaagcugguggucgugcauacaaucaugcguuauccgaacuuccagagacauuagaaacuuuacugcuacucacucugcuagcgaccguuacaggugguauuuuccucuuucucaugucuggaaaaggcauaggcaaaaugacucuaggcauguguuguaucauaacggccucgauacuucuaugguacgcccaaauccaaccucacuggaucgcugccucaauaauacuagaguuuuuccuaaucguauuauuaauaccugagccagagaaacagagaacaccccaagauaaucaacucacauacguuguuauugcuauacuaacuguuguugcggcuaccauggcaaacgaaauggguuucuuagagaaaacaaagaaagauuuggguuugggaaguauaacgacacaggagagcgaaaguaacauucuggauaucgauuuaagaccagcgucagcauggacuuuauaugcaguggcuacuacauuuguuacaccaaugcuacgacauucaauagagaacucaucgguaaauguuucacuaacagcaauagcuaaucaagccacaguucuuaugggacugggaaaaggguggccucuaagcaagauggacauaggaguaccucuauuagccauaggcuguuauagccaggucaauccaauaacuuuaacagcugcuuugcuacuacucguggcccacuaugcaaucauaggaccgggguuacaggcuaaggcaacuagagaagcccagaaaagagcugcggccgguaucaugaagaauccuaccguagaugggauaacuguaauagaucuagaaccaauaccguacgauccaaaauuugaaaaacaacuuggacagguaauguuacuaauucuuuguguaacgcaaguguugaugaugaggacaacuugggcgcucugcgaggcacucacucuugcaacugguccgaucucgacacuuugggaggguaauccuggaagguuuuggaauacuacgauugcaguuaguauggcuaacauauuuagagggucauaucuugcuggggccggacuacuauuuucgaucaugaaaaauacaacaagcacacguagagguaccggcaacaucggagaaacucuaggcgaaaaauggaaaucaagauugaaugcauuaggcaaaagcgaauuucaaauauacaagaaaagcgguauccaagaaguggacagaacucuugccaaagaaggaauuaaaagaggggaaacagaucaccaugcaguaucaagaggaagugcaaaguuaagaugguucgucgaacguaauaugguaacaccagagggaaaagucguggaucuugguugcgggagaggcggauggaguuacuauuguggaggucucaaaaauguuagagaaguaaaggguuugacuaagggaggacccggacaugaagaaccaauaccaaugucaaccuauggguggaaccuuguuagacuacaauccgguguugauguauucuuuaccccacccgagaaaugugauacuuuacucugcgacauaggggaaagcucaccaaaucccaccauagaagcgggacguacucuacgaguacuaaaucucguagaaaacugguugaacaauaauacucaguuuugcaucaaagugcuaaacccuuacaugccaaguguuauagagaagauggaagcacuucagagacaauauggcggagcacucgugcgcaacccauuaaguaggaacuccacacaugaaauguacuggguaagcaaugccacuggcaauauuguaucuagcgucaauaugaucagccgcauguuaauaaauagauucacuaugaaacacaaaaaggcuacauacgaaccagauguugacuuaggaucaggaacaagaaauauaggcauagagucagaaauucccaaucuugauaucauaggcaaacgaaucgaaaagauaaaacaagaacaugaaauuuccuggcacuaugaccaggaucauccauauaaaacuugggcuuaucacgguucuuaugaaacgaagcaaacuggcucugccaguagcaugguaaauggugucgucagguuauugacaaaaccaugggacguagucccaaugguaacccaaauggcuaugacagacaccaccccguucggucaacaaagagucuucaaagaaaaaguugauacaaggacacaagagccgaaagaaggaacaaagaaauugaugaaaaucacggcggaaugguuauggaaagaacucgguaagaagaaaacuccccggauguguacaagagaggaguucacuaagaaaguucgaucaaaugcggcacuaggugccauuuucaccgacgaaaauaaauggaaaucagcuagagaagccgucgaagaugggcgguucugggaacucguggauagagaaagaaaucuacauuuggagggcaaaugcgaaacauguguauacaauaugauggguaaacgcgagaagaaacuuggcgaauuuggcaaagcgaaaggaucccgugcuauaugguauauguggcuuggcgcaagauuuuuagaguucgaagcguuaggauuuuuaaaugaagaucauugguucaguagaggcaacucacucucaggcguugaaggggaaggcuugcauagacuaggcuauauucuccgcgauguaggcaagaaagaagguggagcaauguaugcugaugacacugcaggaugggauacacgaauuacgcuagaggaccuuaaaaaugaagagaugguaacaaaucauaugaagggcgaacacaagaaauuagcugaagcuauuuuuaagcucaccuaucagaauaaaguaguucgagugcaacgacccacaccuaggggcacaguaauggacauaauuucuaggagggaucaacgcgguaguggacaggugggcacguacggguuaaacacguucacuaacauggaagcucaacucauucgucagauggagggggaaggaauuuucaaaucgauacaacaccuuacggccacagaagagauugcaguucaaaauugguuggcgaggguagguagagaaagguuaucaagaauggccauaucuggagaugauugcguaguuaaacccauugaugaccgcuuugccagcgcauuaacagcucucaacgacaugggcaaaguccgcaaggauauacaacaaugggaaccaagucguggauggaacgacuggacacagguaccguuuugcucacaccauuuccaugaguuggugaugaaagauggcagaguauugguaguaccauguagaaaccaagaugaacuaauagggcgagcacgcauuagccaaggagcaggauggucacuaaaagaaacagcgugccuuggcaaaucauaugcacagauguggacacuuauguauuuucauaggagagauuugagacuagcagcaaacgccauuuguagugcagugccgucccauuggguuccgacuucuagaacuaccuggaguauucaugcaaagcaugaauggaugaccaccgaggauauguuagcuguuuggaacagaguuuggauacaggaaaauccuuggauggaggacaaaacaccaguagagucaugggaagaagugccuuaucucgguaaacgagaagaucaauggugcggcagucuuauuggacuaacgagccgggcgaccugggccaaaaacauccaaacagccauaaaccaaguaagaucacucauuggcaacgaagaauauacugacuauaugccaaguaugaagagauuucguagagaagaagaagaagcgggcguucuaugguaa

SEQ ID NO: 22431 - RNA, 9876 nt, Artificial Sequence
  derived and/or modified CDS sequence (opt6) from DENV-2__JX079688__SS-prME
acagcuggaguaauaguaauguuaauaccaacagcaauggcuuuccaccugacaacuaggaacggcgaaccucacaugaucguuggacgacaagaaaaagguaaaagucuacuauuuaaaacagaagacggcguaaacaugugcacguuaauggcaauugaccucggagaacuuugcgaagacacaaucacguacaaaugcccguuacugcgccagaacgaaccagaagacauugacuguuggugcaacucgacaaguaccuggguuaccuacgguacguguacaacuacuggagagcacaggcgagagaaaagaaguguugcauuagucccucauguggggauggggcuagaaaccagaacagaaacauggaugagcuccgaaggugcauggaaacauguacaaagaauagaaacuuggauauuaagacacccagguuuuacgaucauggcagcaauccuugcuuacacaaucgguacaacucauuuucagcgcgcguugauauuuaucuuguuaacggcaguugcaccguccaugacaaugagauguaucggaauaagcaacagagacuuuguagaaggaguaagugggggaaguuggguugacaucguacucgagcacggaucauguguuacaacaauggccaaaaauaaaccaacuuuagacuuugaauugauaaaaacagaagcgaaacaaccagcaacacuaagaaaauauugcauagaagcgaaauuaacuaacacuacgacggagucacguuguccaacucagggugaaccaucacugaacgaggaacaagacaaaagguucauauguaaacauucgaugguugaccgaggcuggggaaauggaugcggucuauucggcaaaggugggauaguuaccugugcuauguuuaccuguaagaagaacauggaaggaaaaguagugcaaccagaaaaccuagaauacacaauuguaauuaccccacacucuggagaggaacaugcaguaggaaacgacacaggaaaacacggaaaagagauaaaaauaacgccgcaaagcucaauuacagaggcagaauuaacaggguaugggacugugaccauggaauguaguccgaggacaggguuagacuucaaugaaaugguucuuuuacaaauggaagacaaggcauggcuaguacaccgacaaugguuucuggauuugccacuuccguggcuaccaggagcggacacucaaggcagcaacuggauccaaaaagaaacucuugucacuuuuaaaaauccacacgcgaagaaacaggaugucguagugcuaggcagucaagaaggcgcuaugcauacggcacuuaccggggccacagaaauccagaugaguucaggcaaccugcuuuucacaggacauuuaaagugucguuuacguauggacaaacuucaauuaaaaggaaugucguauaguaugugcacaggaaaauucaagauugucaaagaaauugccgaaacucagcaugguaccauagucauacgcguacaauaugaaggagacgggaguccauguaaaaucccauuugaaauuacagaccuagaaaaacgacacguauuaggucgacuuauuacaguuaauccaauugucacagagaaagacucaccaguuaauauagaagcagaacccccuuucggagauagcuacaucauaaucgggguugaacccggacaacugaaacuaaauugguuuaagaaaggaucaucaauuggucagauguucgaaacgacaaugcguggagcgaaacgaauggcaaucuuaggagacacagcaugggauuucgggucuuuaggugggguauuuacaucaauaggaaaggcacuacaucaaguguuuggagccauauauggagcagcauuuucgggcgucucuuggacaaugaagauucuaauaggagugauaaucacuuggauuggaaugaacucccguagcaccagccuaagcguuucguugguauuagucggagucgugacauuguauuuaggugcuguaguucaagcugauucuggaugcguaguaagcuggaaaaauaaagaguuaaaauguggaucuggaauuuuuauaacugauaauguucacacuuggacugaacaauacaaauuccagccggaaucuccaucgaaacuagcaagcgcuauacaaaaagcccacgaagagggcauaugugguauacgaucaguuacgagacuugaaaaucugauguggaaacaaauuacaccagaguuaaaucauauauugagcgagaaugaaguuaaacuaacgauuaugacgggagacauuaaagguauuaugcaagccggcaaaagaagccuccguccccaaccaacugaauuaaaguauucuuggaagaccuggggcaaagcgaaaauguuaaguacagaaagucauaaucagaccuuuuuaauagaugguccagagacagccgagugcccgaacacuaauagagcauggaauagccuagaaguugaagauuaugguuuuggggucuucaccaccaauauaugguuaaaacuaagggaaaaacaagacgucuuuugugacucuaagcugaugagugcagccauaaaggauaauagagcuguccaugcugauaugggauacuggaucgaaucagcguugaacgauaccuggaaaauggaaaaagcaucuuucaucgaaguaaaaucuugucauuggccgaaaagccacacauuauggaguaauggggucuuagagagugaaaugauaauuccuaaaaauuucgcuggaccgguaagucaacacaauuauagaccuggguaucacacacagaccgcuggcccuuggcaccuuggaaaacuagagauggauuucgauuucugcgaaggcacaacuguagugguaacggaggauugcggaaaccguggaccuagucuuagaaccaccaccgcaagcgguaaacuuaucacagaaugguguuguagaucauguaccuuaccaccccugcguuaucggggugaagauggcuguugguacggaauggagauaaggccccuaaaagagaaggaagaaaaccuugugaacucucuuguaaccgccggacacggucaaauugauaauuuuucguuggguguucugggaauggcccuguuccuggaagagaugcucagaacaaggauagguacaaaacaugcaauauuacucguagcaguaaguuuuguaacacuuauaacugguaauaugucauuucgggacuuaggacgcgucaugguuauggugggggcaaccaugacagacgauaucgguaugggaguaacauauuuagcuuuguuggcagcauucaagguacggccaacauucgcugcggguuuauuacuaagaaaguuaaccaguaaagaauugaugauggcaacuauuggaauugccuuauugagucagaguacaauuccugaaaccauacucgaacuaacagacgccuuagcacuaggaaugauggugcuaaaaaucgucagaaacauggaaaaguaucaauuagccgugacgauuauggcuauaagcuguguaccuaaugcaguaauauugcagaacgcauggaaagucaguuguacgauacuggcggcaguauccgugucuccguuauuacuaacaucgucccaacaaaaagcagacuggauaccccuugccuuaaccauaaaaggucucaauccuacggcaauauuuuuaacgacuuuaucaagaacaucuaagaaacgcaguuggccauuaaaugaagcaauaauggcagucggaauggugucgauauuagcaaguucacuacucaaaaacgacauaccuaugacagguccucuagucgcaggaggacuacucacuguaugcuacguauugaccggccgcucagcggaucuugaacucgagagagcagcagacguuaagugggaggaucaagcagaaauaaguggaucgagccccauauuaucaauaacaauuagugaggauggauccauguccaucaaaaaugaagaagaagaacaaacacucacuauacuuauaagaacagguuuauuagugauuagcggcguauucccgguaucgauucccauaacugccgcagcgugguaccuaugggaaguaaagaaacaaagagccgguguccuuugggacgucccaucucccccucccguggaaaaggcagagcuugaagacggcgcauauagaaucaaacaaagagguauacuggguuauagucaaauaggagcaggaguauacaaagaagggacguuccacacgauguggcauguaaccagaggcgcgguucugaugcauagaggaaaacggauugaaccuucaugggcggaugugaagaaagaucuuauaagcuacggggguggguggaagcuagaaggagaguggaaggaaggcgaagagguucaagucuuggcuuuagagcccggcaaaaauccgagagcgguacaaacaaaaccaggaauuuucaaaacuaauaccggaacuaucggugcugucaguuuagacuuuuccccugguacgagugggagcccuauuguagauaggaaagggaaagugguugguuuguaugguaauggagucgugacaagaagcggagcauacguaagcgcgauagcccagacugagaagucuauagaagacaacccagaaauagaagaugauauauuccgcaagaaaagacuuacaauuauggauuuacauccaggggcagguaaaacuaagagauacuuaccagcuaucgugcgagaagcaauaaagagagguuuacgaacucuaauacuagcaccuacccgcguuguagcagcagagauggaagaggcgcuaagaggauuaccaauaagauaucaaaccccagcaaucaaaacugaacauaccggucgggagaucguagaucuuaugugccacgcuaccuucacaaugagauuguuaaguccaguacgaguuccaaauuacaacuuaauuauaauggacgaagcccacuucaccgaucccgcuucuauagcggcucguggauacauuagcacaagaguagaaaugggagaagcagcagguauuuuuaugaccgccaccccaccagggucaagagacccguucccucaaaguaaugcuccaauuauggaugaagaaagagagauaccagaacgaucauggaacuccggucaugagugggucaccgauuucaaaggaaaaacaguaugguucguaccgaguaucaaggcaggcaaugauauugcagcaugccuaaggaaaaaugggaagaaagugauacaacuaucuagaaaaacauuugauucggaauauguuaaaacgagagcaaaugauugggauuucguaguaacuacagacauaucagaaaugggagcgaauuuuaaggcugaacgcguuauagauccacgacgauguaugaaaccaguaauauuaacggauggugaagaaagaguaauauuagcuggaccuaugccaguaacucauucauccgcagcacaaagaagagggcgcauaggaaggaaucccaaaaaugaaaaugaccaguacauuuauaugggggaaccccuagaaaaugaugaagauugugcucauuggaaagaagcuaaaauguuacuagacaacauuaacacgccagaaggaauuauaccaagcauguuugagcccgaaagagaaaaaguugaugcgauagauggagaauauagauuaagaggagaagcuagaaaaacuuucguagaccucaugcggcgaggagacuuaccuguauggcuugcauauaaaguagcagccgaaggaauaaacuacgcagaccgaaaauggugcuucgauggaauuaaaaauaaucagauacuagaagaaaauauggaagucgaaauauggaccaaagaaggugagaggaaaaaguuaaagccaaggugguuagacgcacgcauauauuccgauccucuggcccuuaaagaguucaaagaguucgcagcaggucggaaaagccugacccuuaaucugauaacugaaaugggacgacuaccaacauuuaugacccaaaaagcaaggaaugcuuuagauaauuuagcggucuugcauacagcggaagccgggggcagggcuuacaaucacgcacuuagugagcuaccggaaacucuugaaacucuucuacuacuaacauuguuagcgaccgugacugggggaauauuuuuguucuuaaugucagggaaagggauaggaaaaaugacauuagggauguguuguauuauuacugcaaguauauugcuguggcaugcacaaauacaaccacauuggauagcagcuucaauuauuuuagaauuuuuccuuauagugcugcuaauuccggaacccgaaaaacagagaacaccucaagauaaucaauugacuuauguugugauagcaauacuuacaguugucgcagcaacaauggcaaacgaaaugggauuuuuggagaaaacuaagaaagacuuaggcuugggaucaauaacgacucaggaaagcgaaucgaauauauuggauaucgaucuucgaccagcuucugccuggacauuauaugcagucgcaacuacauuuguuaccccgaugcucaggcauaguauagaaaauucuagugucaaugucucucugaccgcuauagcaaaccaagcaacgguguuaaugggauugggcaaaggauggccauuaucuaaaauggauaucggaguuccacuauuagcuaucggaugcuacagccagguuaauccuauaacauugacggcugcauuacucuuacuuguagcccacuaugccauaauaggaccaggauugcaagcaaaagcuacacgagaagcacagaaacgggcagcugcagguauuaugaaaaacccaacuguagaugguauaacaguaauugauuuggaaccuauuccauaugauccgaaauucgagaaacaacuagggcaagucaugcuucucauuuugugcguuacacaagucuugaugaugagaacgaccugggcucugugcgaagccuuaacuuuggcuaccggucccaucaguacacuuugggaagguaauccaggcagauucuggaauacgacaauagcgguuagcauggcuaacaucuucagagguucuuaccuggcuggagcgggguuacuguuuucaauuaugaaaaacaccaccucaacaagacggggcacagggaauauaggagagacuuuaggagaaaaauggaaaagccgacugaacgcccuagggaaaagcgaauuucaaauauauaagaagaguggcauacaagaaguagaucggacacuugcgaaagaagguauaaagagaggagaaacugaccaccaugcagugaguagagggucagcaaaacuccgaugguuuguagaacgaaauauggugaccccagaaggaaaaguaguagaucucggaugcgggagaggaggguggagcuauuacuguggaggacuuaaaaacguaagagagguaaaaggacuuacaaaagggggaccuggacacgaggaacccauaccuaugucgaccuaugguuggaaucuaguacgacuacagucggguguagauguauucuucacaccuccggagaaaugugauacuuuacugugcgauauaggagaaucaucaccaaacccaacuauagaagcaggccgcacauuaagaguacuuaaucuuguggagaacugguuaaauaauaauacgcaauuuugcauaaaagucuuaaauccauauaugcccagcguaauagaaaagauggaagcacuacaaagacaauauggaggcgcccuagucagaaauccauugagucgaaauucuacucaugaaauguacuggguaucuaaugcaaccgguaacauagugucuagcguaaacaugaucucuaggauguugauaaauagauucacuaugaaacauaaaaaggcaacguaugagccggacguagaucuuggaucaggaacuaggaacauaggcauugaaagugaaauacccaaccuugauauaauaggaaagcgaauugagaaaaucaaacaagaacaugaaaucucauggcacuacgaucaagaccauccuuauaaaacgugggcguaccauggaucauaugaaacuaaacaaacaggcagcgcgaguucgaugguuaaugggguaguacgccucuuaacaaaaccaugggacgucgucccaaugguuacccaaauggcgaugacagauacaaccccguucggucaacagagaguuuucaaggaaaaaguagauacucgcacacaggaaccgaaggaaggaacuaagaaauugaugaaaauuacagcugaauggcuauggaaagaauugggcaagaagaaaacacccagaaugugcacuagggaagaguucacuaagaaaguuaggucaaacgcagcuuuaggugcaaucuuuacugaugaaaauaaauggaagucugcgagagaagccguugaagauggucgauuuugggaacucgucgaucgcgagagaaauuuacacuuagaaggaaagugcgaaacguguguauauaauaugauggguaaacgagagaagaaauuaggggaauuuggaaaagcgaaaggcucacgagcgauuugguauaugugguuaggugcaagguuuuuggaauuugaggcucuagguuuccuuaacgaagaucauugguuuucacgcgguaauagucuaaguggaguagaaggagaaggacuacauagacuaggauauauccuuagagacguaggcaagaaagagggcggagcgauguacgcagaugacacugccggaugggauacacgcauaacucuggaggaccuuaaaaaugaggaaaugguuaccaaccauaugaaaggagaacauaagaaauuagcggaagcaauauucaaauuaacuuaccaaaacaaaguuguaagaguucaacgaccaaccccuagaggaacaguuauggacauuaucucgcggcgugaucaacgagguagcggacaaguagggacguacggucuaaacacauuuacgaauauggaagcccagcugauaaggcaaauggagggagaaggaaucuucaaaaguauucaacaucuaaccgcuacggaggaaauugcaguacagaauugguuagcaagggugggaagagagcgguuaagucggauggcgauuucaggagaugacugcguagugaaaccgauugacgaucgcuucgcaucggcgcugacugcccucaaugauaugggcaagguucgcaaggauauucaacaaugggagccgucaagagguuggaacgacuggacacagguaccguuuugcucgcaucauuuucacgagcuuguuaugaaggaugggcgagugcugguuguuccaugucguaaucaagaugaacuaaucgggagagccaggauaucacagggagccggguggagcuugaaagaaacggcaugccucgguaaauccuacgcacaaauguggacacucauguacuuucauagacgagaccucagauuagccgcaaaugcgauauguagcgcagucccaucgcauuggguucccacuagccgcacuacauggucaauucaugcaaagcaugaguggaugaccacugaagauaugcucgcuguuuggaauaggguauggauacaagaaaacccauggauggaagauaagacaccugucgaaagcugggaagaaguacccuaucugggaaagcgagaagaucaauggugcggaagccuaauuggauugacaucacgugccacaugggccaaaaacauucagacugcaaucaaucaaguccggagucucauuggaauagaagaguacacggauuacaugccauccaugaagcgauuucgucgggaagaagaagaagcggggguauuaugguaa

SEQ ID NO: 22432 - RNA, 9876 nt, Artificial Sequence
  derived and/or modified CDS sequence (opt6) from DENV-2__JF357906__SS-prME
acggcagggguaauaguuauguugauacccacggcaauggcuuuucacuugacgacaaggaacggagaaccgcacaugauagugggaagacaagaaaaagguaaaucauuauuauucaaaacagaagacggugugaauauguguacacuuauggcaauagaucuaggugaauugugugaagacacaauaacauauaaaugcccucuuuuaaggcaaaacgaaccagaagacauagauuguuggugcaauucuacaucgacguggguaacauauggaacguguacaacaacaggagaacaccgacgugagaaaaggucaguagccuuaguaccucauguagggauggggcuagaaacgaggacugaaacauggaugucaucugaaggcgcauggaaacacgugcagagaauagaaacguggauauuacgucaucccggauuuacgaucauggcagccguucuagccuacacaauuggaacaacgcauuuccaaaaagcccuaauauucauauuauuaacagccguugcuccgucuaugacuaugcgcuguauaggaauaucaaaucgugauuucguugaagguguaucuggaggcucauggguagauauagucuuagaacacggaucuugcguaacaacaauggcuaaaaauaaaccgacgcuagacuucgaauuaauaaaaacagaagcaaaacaaccggcaacacugagaaaauauuguauagaagcaaaacuaacuaauacgacuacggaaagcagaugcccaacacagggcgaacccucuuuaaacgaagaacaagacaaacgauuuauuuguaaacacuccaugguagacagagguugggguaacggauguggacuguucggcaaaggagguauaguuacaugugcaauguuuacguguaagaaaaauauggagggaaaagugguacaaccagagaauuuagaauauacaauagucauuacaccucauuccggugaagaacaugcagucggaaaugauacugguaaacauggcaaagagauaaaaauaacgccgcaaucguccauaacagaggcggaauuaacggguuauggcacuguuacuauggagugcucgccucgaacgggauuagacuucaaugaaaugguuuuacuacaaauggaagauaaggcuuggcuaguacauagacaaugguuuuuggaucuaccacuaccauggcuacccggugcagauacccaaggaagcaacuggauacaaaaagagacccuagugacuuuuaaaaacccacaugcuaaaaagcaagauguugugguguuggggagucaagaaggagcaaugcauaccgcacuaacaggagcuacagagauucaaaugucgucagggaaucuauuauucacaggccacuuaaaaugccgcuuacgcauggauaaauugcaacuuaaagguaugucauauaguauguguacagguaaauuuaagaucguaaaagaaauagcagagacacaacacggcacaauagucauaagaguccaauaugaaggagacggaaguccaugcaagaucccauucgaaaucaccgauuuagaaaagcgccacgucuugggaagauugauuaccgucaauccaauaguuacugaaaaagauagcccagucaauauagaagcggaaccaccauuuggugacucauacauaauaauaggcguggaaccuggacaacuaaaauugaacugguuuaagaaaggauccaguauagggcaaauguuugaaacaaccaugagaggcgcuaaacgaauggcuauucugggugacacugcaugggauuuuggaucacugggcggugucuuuacuucuauuggaaaagcauuacaccaaguauuuggcgcgaucuauggagccgcuuuuucaggcguaaguuggaccaugaaaauuuuaaucgguguuauuauaacuuggauuggcaugaauagccgaucaaccucucuaagcgugucacucguacucguaggaguaguuaccuuauacuuaggagcagucguacaagcagacaguggaugcguugugaguuggaaaaauaaagaacuuaaaugcggcuccggaauauuuauuacagacaauguccauacuuggacagaacaauacaaauuccaaccugaaucgccgucaaaauuggcgucugccauacagaaagcucaugaagaagggaucugugguauuagaagcgucacuagguuagagaaccuaauguggaaacagauaacacccgaguuaaaccacauuuuaucggaaaaugaagucaaauuaacuaucaugaccggugauauuaaaggcauaaugcaagcugggaaacgaucacugagaccucaacccaccgagcuaaaauauuccuggaaaacauggggcaaggcuaaaauguugaguacagaaucccacaaucaaacauuccugaucgaugggccagagacggcagagugucccaauaccaacagagcauggaacucguuagaagucgaagacuaugguuuuggugucuuuacaacaaauauauggcuuaaguugagagaaaaacaggaugucuucugugauucuaaacucaugagcgcagcaauaaaggauaacagagcgguacacgcggauaugggauauuggauagaaagugcccuaaaugauaccuggaaaauggagaaagcaucauuuauagaagucaaaucaugccacuggccgaaaagucauacauuguggaguaaugguguauuagaaagugaaaugauaauucccaaaaauuuugcaggucccguaagccaacauaacuauagaccgggcuaccauacacaaacggcuggucccuggcaccuuggaaaacuugagauggauuuugauuuuugcgaaggcacgacaguaguaguuacagaggacuguggaaaucgagguccaucauuacguacaacuacagcaaguggaaaacuaauaacggaauggugcugcagguccuguacguuacccccucuccguuauaggggcgaagacgggugcugguacggaauggaaaucagaccuuuaaaagaaaaagaagaaaaucuaguaaauucacuugugaccgcaggucauggucaaauagacaauuucucacucgguguauuggggauggcucuauuucuagaagaaauguuaagaacacgaauaggcacaaaacaugcuauacuauugguagcugucagcuuuguaacguugaucacagguaauaugaguuucagagaucucgggcgaguuauggucaugguuggggcaacgaugacagaugauaucggaaugggagucacguaccuugcuuuacucgcggcguucaaagucagaccgacuuucgcagcaggcuuacucuuaagaaaguugacaucuaaagaacuaaugauggcuacgauaggaauugcuuuacugucccaaagcacuauaccagagacaauauuagaguugacagacgcacuagccuugggaaugauggucuuaaaaaucguacgaaacauggaaaaguaccaguuagcuguaaccauuauggcaauuuccuguguaccaaacgcaguaauucuacaaaaugcauggaaagugucauguacaauccuugcagcuguaagcguaucgccucuacuauuaacgaguagccagcaaaaagccgauuggauaccauuagcacugacuaucaaaggcuuaaaccccacggcgauuuuucuaacaacacuaucgaggacaucuaagaaacguucauggccgcucaaugaagcaauaauggcaguugggaugguaagcauauuggcuaguucacuacuuaaaaaugauauuccaaugacaggcccccuagucgccgguggucucuugacuguauguuacguacuaacaggacgaucagcugaucuggaguuagaacgagccgcggauguuaaaugggaagaccaggcagaaauaagcggaucuucgccaauucuuucaauaaccauaagcgaagauggaucaaugaguauuaagaacgaagaagaagaacaaacucucacgauacuuauucgcacaggucuauugguaauauccggcauuuucccaguaucgauaccaaucaccgcggcggcuugguaucuuugggaagugaagaaacagcgugcgggagugcuuugggacguucccucuccucccccaguugagaaagcugaguuagaagauggggccuacaggauaaagcaaagaggcauucucggauauucacaaaucggagccggcguauauaaggaaggaacguuccauacaauguggcauguaacacguggagcaguucuaaugcaccgagguaaacggauugaaccuucgugggcagacgucaagaaagacuuaauaucuuacgggggcggauggaaguuggaaggcgaauggaaagagggcgaagaaguacaaguauuggcguuagaaccgggcaagaaccccagagcaguucagacuaagcccgguauuuuuaagacgaacaccgguacuaucggagcugucagcuuagacuuuucuccggggaccucgggaucgccaauuguugaucgaaaaggaaaagucguugguuuguaugguaacgguguagucacaagaucaggagcauaugugucagcaauugcacagacagagaaaagcaucgaagauaauccugaaauagaagacgacauauuccguaagaaaagacuaaccauuauggaucugcauccaggcgcuggaaaaacaaagcgguaucuuccugcuauuguacgugaagcaauuaagagaggccuucgaacuuuaauauuagcuccaaccaggguaguagcagcggaaauggaagaggcuuuacguggacuaccgauuagauaucagacgccugccaucaaaaccgaacauacagggagagaaauaguggacuuaaugugucaugccaccuucacaaugagauuguugagcccagucaggguacccaauuacaaccuuauaauaauggaugaagcucacuuuacugacccugcuagcauagcggcccgagguuauauuucaacaaggguagaaaugggagaggcagcgggcaucuuuaugacagcaaccccuccaggaucaagagauccauucccgcaaagcaacgcaccaauuauggaugaggaacgggaaauuccagaaaggucauggaacucaggacaugaguggguuaccgauuucaaagguaaaacuguaugguucgugccuagcauaaaagcuggcaaugauauagcggcgugccucaggaaaaaugguaagaaaguaauacaacuaucacguaaaaccuuugauagugaauacguuaaaacccgagcuaaugauugggacuuugugguaacaacagacauuucagagaugggcgccaauuuuaaggccgaacgggugauugacccucgacgauguaugaaacccgugauucuaaccgauggcgaagaaagggucauacuagcugguccgaugccagugacacacagcagcgccgcgcagcgaagaggaaggauaggacguaaccccaaaaaugaaaacgaccaguacauuuauaugggggaaccauuagagaaugaugaagauugcgcacauuggaaagaagccaaaaugcuucuggacaauauuaauaccccugaaggaaucauacccucuauguuugaacccgagagagagaaaguagacgccaucgacggagaauaccggcuucgaggugaggcaagaaaaacauucguggaucugaugaggagaggcgacuugccagucuggcuugcuuacaagguagcagccgaagggaucaauuauacugaccgaaaaugguguuucgacggcaucaaaaacaaccaaauauuggaagaaaauauggaggucgaaauauggacgaaagaaggugagagaaagaaauugaaaccgagauggcuggaugcccgaauuuauucugacccacuagcuuugaaagaguuuaaagaauuugcggcugggagaaagagccucaccuuaaacuuaauuacugaaauggggagacuacccacguuuaugacccaaaaagcucgaaacgcucuugauaauuuggcaguauugcacacugcugaagcugguggucgagccuauaaucaugcacugucggaauuaccagaaacacuggaaaccuuacuucuccucacguuacuugccaccguaacuggagguaucuuccuauuuuuaaugucagguaagggaaucggcaaaaugacauuaggaauguguugcauaauaacugcauccauccuucuaugguacgcccagauacaaccacauuggaucgcagcuucuauaauacuugaguucuuuuuaauaguacuacugauacccgaacccgaaaaacaacguacaccucaagacaaucaauugacguacguggucaucgcgauucuaacagugguagcagcaacgauggcuaaugaaaugggauuccuagagaagaccaagaaagaucucggguuaggcucuaucaccacgcaagaaagcgaauccaauauauuagacaucgacuuacggccagcaagcgcuuggacauuauaugcagucgcuacaacauucgucacaccuauguugagacauagcauagaaaacucuucuguuaauguaucauuaacugccauagcuaaucaggccaccguucuuaugggacucggcaaaggguggccauuaucaaaaauggauauaggagugccucuguuggcaauaggcuguuacucgcagguuaauccaauaaccuugaccgcagcacuuuuacuccuaguagcucacuacgcaauaauagguccagguuuacaagcuaaagcuacgcgcgaagcucagaaaagagcugcagcgggaauuaugaaaaauccaacgguugaugguauaacgguuauugaucuugagccuaucccuuacgaucccaaauuugaaaaacaauugggucaagugaugcucuuaauucugugugugacacaaguuuugaugaugcguacgaccugggcccugugugaagcccuuacuuuagcuacuggcccuauuucuacacucugggaaggcaacccagggcgcuucuggaauacaacuaucgcaguaucaauggcaaauauauuucguggaaguuaucucgcgggugcaggauuauuauucaguauaaugaaaaacacuacauccacaagacggggaaccgggaacauaggagagacacugggcgaaaaguggaaauccagauuaaaugcuuugggaaaaucggaauuucaaauuuauaagaaaucugggauucaagaaguggauagaacuuuagcuaaagaagguauaaaaagaggagagacggaucaucacgcgguaucuagaggguccgcuaaauuaagaugguuuguagaacgaaacaugguaacgccagaagguaaaguuguagaccuaggcuguggaagggguggguggucauauuacugcgguggucucaaaaauguuagggaagucaaaggauuaacaaaaggugguccaggucacgaggaacccauaccaaugucaacuuaugguuggaaucuaguuaggcugcaauccggaguagauguuuucuucacaccucccgagaagugugauaccuuauuaugcgauauaggggaauccuccccaaacccaaccauugaagccggucgaacacuacgggucuuaaaucuggucgaaaacugguugaauaacaacacacaauucugcauuaaaguacuaaauccauacaugcccucuguaauagaaaagauggaagcacuucaaagacaauacggaggagcauuagucagaaauccacuaaguagaaauagcacacaugaaauguauuggguuucgaacgccacgggcaacauaguuaguaguguaaauaugauaagucguaugcuaauuaauagguuuaccaugaaacacaagaaagcaacguaugagccagaugucgaucuaggaucaggaacaagaaacauaggcaucgaaucggagauaccaaacuuagacauaauuggaaagagaauagagaaaauaaaacaagaacaugaaauaucguggcauuacgaucaggaucacccguauaaaacuugggcguaccaugguagcuaugagacaaagcaaacaggaucagcaucgucaaugguuaacggaguaguucgacuacuuaccaaacccugggacguugucccuauggugacgcaaauggcgaugacagacacaacaccauuuggccaacagagaguuuucaaagagaaaguggauacgagaacucaagaaccaaaagaagggacgaagaaauuaaugaaaauuacagcagaauggcuuuggaaagagcuaggaagaaagaaaacaccaaggauguguacaagagaagaauuuacccgaaaaguacgaucuaacgccgcacucggagcaauuuucacagacgagaauaaauggaaaagugcucgggaggcaguagaagauggaagguuuugggaacuggucgaccgugagcgaaaucuacauuuagaaggcaaaugcgaaaccugugucuacaauaugaugggaaaaagagaaaagaaacuuggggaauuuggaaaagcgaaaggcucuagagcuauuugguacaugugguuaggagcgcgauucuuggaauuugaagcauuaggauuuuuaaaugaagaucacugguucaguagggaaaauucuuuaucagggguagaaggagaagguuuacauagacuugguuauauacuaagagaugucggcaagaaagagggaggagcaauguaugccgaugacacugcugguugggauacacggauuacacuagaagauuuaaagaaugaggaaaugguaaccaaucacaugaaaggggagcauaagaaacuagcugaagcaauauucaagcugaccuaucagaauaaaguaguacgugugcaacgucccacuccuagaggcacuguaauggauauaauaagccguagagaccaacgggguucaggucaagucggcacuuacggauuaaacacauucacaaauauggaagcacaacuuauuagacaaauggagggagaaggaauauuuaaaaguauacaacauuuaacagccacagaagagauagcaguucagaacuggcuugcaagggugggcagggaacgguuaagccgcauggcaauuagcggagaugacugugucguaaagccaaucgaugaucgauucgcgagugccuuaacagcauuaaacgacauggguaagguacgaaaagacauacaacagugggaaccgucacggggcuggaacgauuggacacaaguacccuucugcagccaucauuuccacgaacuuguuaugaaagaugggcgaguucuuguuguuccaugcagaaaucaggaugaacucauugggagagcaaggauaucccagggugcagguuggucuuuaaaggaaacugcaugucucgggaaaucuuacgcccaaauguggacacuaauguacuuucauagacgggaccuacgucuggcagccaaugcuauauguucggccguuccuagccauuggguaccaacuucuagaacuacaugguauauucaugcgaagcacgaguggaugacuacagaggauaugcuagcgguauggaauagaguuuggauacaggaaaauccauggauggaggauaagacaccaguagagucgugggaagaaguaccauaucuagggaaaagggaagaccaauggugcggaagccuuauuggauuaacaagcagagcuacaugggccaaaaacauccaaacagcaauuaaucaaguuagaagucugaucggaaaugaagaauacacggauuacaugccuucaaugaagcgguucagacgggaagaggaagaggcuggugugcuaugguaa

SEQ ID NO: 22433 - RNA, 9873 nt, Artificial Sequence
  derived and/or modified CDS sequence (opt6) from DENV-2__HQ705624__SS-prME
acugcugguguaauuguuaugcuaauaccaacagcaauggcauuccaucuaacaacacggaauggggagccacauaugauuguaggacggcaggaaaaaggcaaaucacuucuuuuuaaaacagaagacggaguaaauauguguacauuaauggccauagaucuuggagaacuaugcgaagauacaauaacauauaaaugcccuuuguuaagacaaaaugaaccugaagauaucgacugcuggugcaauucaacaucaaccuggguuacauacggaacuuguacuacuacaggcgagcaccgaagagagaaaagaucggucgcuuuaguaccacaugucggaaugggccuagaaacaaggacugaaacauggaugucgagugaaggugcauggaaacacguucaaagaauagagacguggauauuacgucaucccgguuucacaauaauggcagcaaucuuagcguacacaauugguaccacacauuuucagagggcuuuaauauuuauauuauuaacagcuguagcgccuucaaugacuaugcgaugcauaggcauaaguaacagagauuucguagaaggaguaucugguggaaguugggucgacauuguauuagaacacggaaguuguguaacaacaauggcgaaaaacaaaccaacuuuggauuucgaauuaaucaaaaccgaagcgaaacaaccggcaacauuacguaaauacugcauagaagcaaaauuaacuaauacuacaacggaaucgagaugcccuacacagggggaaccgucauuaaaugaagaacaagauaagagauuuaucugcaaacauucuaugguagaucggggauggggaaacgggugcggacuauuuggaaaaggugggauuguaacaugcgcuaaguucacuuguaagaagaacauggaagggaaagucguacagccagaaaaccuagaguauacuauagugauuacaccucacuccggggaagaacacgcaguugggaacgauaccggaaaacauggcaaagaaauuaagauuaccccacaaucuuccauuaccgaagccgaguuaacuggauaugguacgguaacaauggaauguucaccacgaaccgguuuggauuucaacgaaaugguuuuauuacaaauggaggacaaggcguggcuaguacaccgacaaugguuucuagaccuacccuuacccugguugccgggagcagacacacaaggcucaaauuggauacagaaagaaacauuaguaacuuucaaaaauccgcacgcaaagaaacaggauguaguaguacuugguagucaagaaggcgccaugcacacagcauugacaggugcaacugaaauacaaaugagcagcggcaaccucuuauucacgggacaccuaaaauguaggcuucgcauggacaaauuacagcucaaggguaugaguuacuccaugugcacagguaaauuuaagauugugaaagagauugcagaaacacaacauggaacuauuguaauucguguacaauacgagggcgacggaucaccauguaaggugccauucgaaauaaccgaucuagaaaaacggcacguauuaggucguuuaaucacagucaaccccauuguaacagaaaaagauucaccuguuaacauugaagcagaaccaccauuuggagauucauacaucaucauugguguagaaccuggacaauuaaaacuaaauugguucaagaagggaucauccauaggucaaauguuugaaacaaccaugagaggugcaaaacgcauggcaauacuaggcgauacggcaugggauuuugggagccuugggggcguauucaccuccaucggcaaggcacuucaucaaguauucggcgcaauauauggggcagcguuuuccggagugucauggacaaugaaaauacucaucggaguaauuauaacguggauaggaaugaacucaaggucgaccucacuaagcgucucuuuagugcuuguagguguaguaacauuauacuugggugcgaugguacaagcagauucaggaugcgucgucaguuggaaaaacaaggaacuaaaaugugguaguggcauuuucaucacugacaacguacauacauggacugaacaauacaaauuucagcccgaaucaccaagcaaacuagcgucugccaucaaaaaggcacaugaagagggcauaugcgguauccggagcguaaccagacuugaaaaucuaauguggaaacagauaacgccggaguuaaaccauauacuuucugaaaacgaggugaaacuaacaaucaugaccggggacauaagaggcauaaugcaagcagguaaacgaagccuccgaccacaaccuacugaacuaaaauauuccuggaagacuugggguaaagccaaaaugcuaucuacagaaagucauaaucagacuuucuuaauagacggaccagaaaccgcugaaugcccaaauacgaauagagccuggaauagccuagaaguagaagauuauggauuuggcguauuuaccacuaauaucugguuaaaauugagagacaagcaagacgucuucugugauaguaaacuaaugucagcugcuaucaaggacaauagagcaguccaugcugauauggguuauuggauagagucagccuugaacgauacuuggaaaauggaaaaagcauccuucauagaaguaaaaaguugucauuggccaaaaagccacacauuaugguccaauggcguccuggagucagagaugauuauaccuaaaaauuucgcaggaccggugucucaacacaacuaucgaccugguuaccacacacagaccgcaggaccauggcacuuaggaaaacucgaaauggauuucgaucugugugaagguacaaccguaguaguuaccgaggacugcggaaauagaggaccaucacuucgcacgacaacagcuucagggaagcucauuacagaaugguguugucgaagcuguacauuacccccacuacgauacagaggagaagauggguguugguacggcauggaaauaaggccguuaaaagaaaaagaagaaaaucucguaaacagccuaguuacggcaggucauggacaaaucgauaauuucucacucggcgucuuggguauggcuuuauuacuugaggaaauguuacguacaagaauagguacaaaacacgcgaucuuacuuguugcugucagcuucgucaccuuaauuaccggaaacaugaguuucagagauuuagguagggugaugguuaugguaggagcgacaaugacagaugauauuggaaugggaguaacuuauuuagcuuugcuagcagcguucaaaguucgaccaaccuuugcagccggucuacuauuaagaaaauuaacuagcaaggaacuuaugauggcuacaauaggcauugcacuacugucacaaucaaccauaccagagacaauuuuagaacuuacugaugcguuagcuuuaggaaugaugguauugaaaauaguaagaaacauggaaaaguaccaacucgcagucacggugauggcaaucucuugcgugccuaaugcgguuaucuugcagaaugccuggaaagucucauguacuauccucgcggcuguuucaguuucgccucugcuucuuacuucgucccaacagaaagccgacuggaucccacuugcguuaacgauaaaaggauugaacccuacagcuauuuuccuaacaacacuaucgagaacgagcaagaaacguuccuggccacuuaaugaggcuauaauggcagucgggaugguuucaauuuuggcaaguagucuacucaaaaacgauauaccgaugaccggaccacuuguggccggugguuuacuaacugugugcuaugugcuaacaggaaggagcgcagaccuggaauuggaaagagcugccgauguuaaaugggaggaucaagcggaaauaucagguucaucaccaauccugaguauaacaaucagugaagacggcaguaugaguaucaaaaacgaagaggaggaacaaacucucacuauauugauaaggaccggucuuuuaguaauaucugguguauuccccguuucaauaccaauaaccgcugccgcuugguacuuaugggaagucaagaaacaaagagcaggcguccugugggauguuccgucacccccacccguugaaaaggcggaauuagaggauggcgcguacaggaucaaacaaagaggcaucuugggauauucucaaaucggagcgggggucuacaaagaaggaaccuuccacacaauguggcacguaacuagaggugccguguuaaugcauagaggaaaacguauugagccuucaugggcagacgugaaaaaggaucugauaucuuauggcggcggcuggaaguuggaaggugaauggaaagagggugaagagguacaaguucuggcuuuggaacccgguaaaaauccacgagcaguucagaccaagccuggaauauuuaagaccaauacggguacaauaggggcaguaucauuagacuuuccuggaacaagugggagcccuauuguugacaggaaaggaaaaguagucgggcuauacgggaauggcgucguaacacggucuggcgcuuauguaagcgcuauagcacaaaccgagaaaucaauagaagauaauccagaaauagaagaugauauuuuucgcaagaaaagauugacgauuauggacuuacauccaggugcgggaaaaacuaagagauaucuaccugccaucguacgagaggcuauaaaacggggauuaagaacgcuaaucuuagcuccgacgcguguaguagccgcugaaauggaagaagcacuuagaggcuuaccuauccgguaccaaacgacugcaauuaaaacagagcauacuggucgugagauuguggaucuuaugugucaugcuacguuuacaaugcgccuacuaagcccggugagaguuccaaauuauaacuuaauaauaauggaugaagcucauuuuacugauccagccuccauagcggccagagguuauauuucgacacggguagagaugggagaagcggcagggauuuuuaugacugcaacaccgccaggaucuagagauccuuuuccccaaaguaaugcacccauaauggacgaagaaagagagauacccgagaggaguuggaacucgggacacgaauggguaaccgauuucaaggggaaaaccguaugguuugugccuucaauuaaagcuggaaacgacauagcugcgugccuaaggaaaaauggcaagaaaguuauacaacuaucaaggaaaaccuuugacucggaauaugucaagacaagagcaaaugacugggacuucgugguaacgaccgacaucucagagaugggggcaaauuucaaagcugagcgugucauagauccuaggcgcuguaugaaaccugucauacuaacugacggcgaagaaagaguaauucuagcuggccccaugccaguuacacacucaucugcugcgcaacguagagggagaauuggacgaaaccccaaaaacgaaaaugaccaauacauuuauaugggugaaccucuggaaaacgaugaagauugcgcucauuggaaagaggcuaaaauguuacuagacaauauaaauacaccggaggggauaauacccucaauguuugaaccggaacgagaaaaaguugaugcaaucgauggagaauauaggcuucggggagaagcucgaaaaacauuuguagacuuaaugaggagaggggacuuacccguuugguuggcauacaaaguugcagccgaaggaauaaacuacgcagaccguaaauggugcuucgauggaauuaagaauaaccagaucuuagaagagaauauggaaguugaaauauggacuaaagaaggugaaaggaagaaacuaaaaccaagaugguuagacgcaagaauauauagugacccauuagccuuaaaagaguucaaagaguuugcagcaggacgaaaaucacucacacuaaaccugauaacugaaaugggacgccuaccuacauuuaugacgcaaaaagcccguaacgcauuagacaauuuagcgguucuccauacugccgaagcgggaggcagagccuacaaccaugcuuugagcgaauugcccgagacguuggaaacauuauuauuauugacguuauuagcaacgguaacaggugguauauucuuguuccuuaugagcgguaaaggaauugguaaaaugacacucgggaugugcugcauaauuaccgccaguauucuauuaugguaugcccaaauacaaccacacuggauagcggccagcauuauacuugaauuuuucuugauaguacuguugauuccggaaccugaaaaacaaaggacaccacaggacaaucaacuuacauauguuguaauagcaauccugacgguuguugcagcgacuauggcaaaugaaaugggguuccucgagaaaacuaagaaagauuuaggucuugggucaaucacuacucaagagucagaaucuaauauacuugauauagacuugagaccagccagugcuuggacccucuacgcaguagcaacuacauucguaacaccaaugcugagacacagcauugaaaauucaagugugaaugugucauugacagcuaucgcuaaucaagcaacaguacuaaugggccuagguaaaggguggccauuaucaaaaauggauauaggagugccucuucuagcuauagguugcuacagucaaguaaaucccaucacccuuacagcagcacugcuauuacuugucgcccacuaugcuauaauagggccugggcuccaagcuaaggcuacaagagaagcacagaaacgugccgcagcaggaauaaugaaaaacccaacgguggaugguaucacaguaaucgaucucgaaccaauaccuuacgauccaaaauuugaaaaacaauuaggacaaguaaugcuauuaauacuuugugugacgcaaguauuaaugaugaggacaacgugggcucuaugcgaggcauuaacacuugcuacaggcccaauuucaacauuaugggagggcaauccuggcagauucuggaauaccacgaucgccguaaguauggcaaauauauuucgagggagcuauuuagccggagcuggacuucuauuuaguauaaugaaaaacacaacgaauacaaggagagggacugggaauauaggugaaacuuuaggggaaaaguggaaaucuagacucaacgcucuugguaaaagugaauuucaaauuuacaagaaaucggguauacaggagguagauaggaccuuagcgaaggaaggaauuaaacguggagaaacagaucaccacgcaguaucccgagggucugcuaaacucaggugguucguagaaaggaauauggugacaccugaaggcaaagugguggauuugggauguggaagaggaggguggaguuacuacugugguggacucaaaaauguacgagagguaaaaggguugacaaaaggagguccaggacacgaggaaccuauacccaugucuacguaugguuggaaucuugugagacuacaaucagguguugauguauuuuucacgccaccagaaaaaugugacacacuacuaugugauauuggggaaucgucgccaaaucccacuauugaggcggggcgaacucuucguguacuuaaccugguagaaaacugguuaaauaauaauacucaguuuuguauuaaagugcuuaacccguacaugccaucgguaauugagaaaauggaagccuugcaaagaaaguacggaggugcacucgucagaaaccccuuaagcagaaauaguacgcacgagauguauuggguaucaaaugcgacagggaauauaguaaguagcguuaauaugauaucaagaaugcuaauuaaccgauucacuaugaaacacaaaaaggcuacuuacgaaccagacguagaccuuggcaguggcacaagaaacauaggaauugaaucugagauuccaaacuuagauauaaucggaaaaagaauugaaaagauaaaacaggaacaugaaacauccuggcauuaugaucaagaucauccuuauaaaacaugggcauaucauggaucuuaugaaacaaaacagacaggaagcgcuucaucaauggucaauggagucguccgauugcuaacuaaaccaugggacguggugccaaugguuacucaaauggcgaugaccgauacaacacccuuuggacaacaaaggguauucaaggaaaaagucgauacacguacccaagaaccaaaagaaggaaccaagaaacuuaugaaaaucacagcugaauggcuuuggaaagaguuagggaagaagaaaacaccaagaaugugcacccgagaagaguucacgcggaaagugagauccaaugcagccuuaggcgcuaucuucacugaugaaaauaaguggaaaagcgcgagggaggccguugaagauggaagauuuugggaauugguggauagagagaggaaccuccauuuagagggaaaaugugaaaccugcguguauaacaugauggggaaaagagaaaagaaauuaggggaguucgguaaggccaagggcaguagagcaauaugguauauguggcuaggugcaagguuccuugaauuugaagcguuaggguuucuaaacgaggaucauugguuuucuaggggaaacagucuaucgggcguagaaggcgagggacuacacagauuaggauauauuuugcgcgacguggguaagaaagaaggcggagcuauguaugcugacgacacugcgggaugggauacaaggauaacacuugaagaccuaaagaaugaagaaauggugacaaaccacaugaaaggagaacauaaaaagcuggcagaagcuauauuuaaacuaaccuaucaaaauaaggucguucgaguacaaagaccuaccccgcgaggaacaguaauggauauuauaucacgaagagaccaaagggguaguggccaaguagggacauauggguuaaauaccuuuacgaacauggaggcccaacuaauucgacagauggagggagaaggaauuuuuaaaagcauucaacauuuaacagcaacugaggagauagcugugcaaaauugguuagcucguguaggcagagaacgacucagccgaauggcaauaaguggagacgacugugugguaaaaccaauugaugacagguucgccagugccuugacugcuuugaaugauaugggaaaaguaaggaaagauauccagcaaugggagccaucacgaggcuggaaugauuggacacaagucccguuuuguucccaccacuuucacgagcuaguaaugaaagauggucgcguacuuguagucccguguagaaaucaggaugagcuaauuggacgagcaagaauuucccaaggggcgggcuggaguuuaaaggaaacagcuugccuaggaaaaucauacgcgcaaauguggacucuaauguauuuucaccgaagagaccuaagauuagccgccaacgcuaucuguagugccgucccaagucacugggucccaacaucucgaacuacauggucaauucaugcaaaacaugaguggaugacaacugaagacaugcuagccgucuggaaccgcguuuggauacaggaaaacccguggauggaggacaaaaccccaguagaauccugggaggaagucccauacuuaggaaaacgcgaagaccaguggugugggagucuaauuggcuuaacuagcagggccaccugggccaaaaacauucaaacugccauaaaccaaguaagaagccucauaggcaaugaagaauauacugauuauaugccgucaaugaagagguucagacgugaagaggaagaagcggggguccuuugguag

SEQ ID NO: 22434 - RNA, 9876 nt, Artificial Sequence
  derived and/or modified CDS sequence (opt6) from DENV-2__HQ705625__SS-prME
acagcuggagucauuguuauguuaauaccuacagcaauggcuuuccaucugacgacgcggaacggggaaccacacaugauuguagggcgacaagaaaaaggaaaaucauuauuauuuaaaacugaagacggugucaauaugugcacauuaauggcaauagaccuuggcgaacuuugugaagauacgauuacguauaaauguccguuauugagacaaaaugaaccggaagauauagacugcugguguaauucaacuucaacguggguaacuuaugggacgugcacaacaaccggugaacaucgccgugaaaaacgaucagucgcacugguaccucauguggggauggggcuggaaacuagaacugaaacauggaugagcucagaaggcgcauggaaacauguccaacgaaucgagaccuggauacuacgucauccgggauucaccauaauggcagcaauuuuagcuuauacaauugguacgacgcacuuucagagagcacuaaucuuuaucuuauuaacagcagucgcaccuaguaugacaaugcgcugcauuggcauuucuaaucgagacuucguugaaggaguaucaggagguagcugggucgacauagugcuugaacacggcucauguguaacgacgauggcuaaaaacaaaccaacucuagauuucgaauugaugaaaacagaggcaaaacagccggccacucuaagaaaauacugcauagaagccaaacucacgaacaccaccacugagucacgcuguccaacacaaggagagccuagccuuaacgaagaacaggauaaaagguuuauuuguaaacauucuaugguggauaggggauggggaaauggaugcggacuuuucgguaaaggagggauaguaacuugugcgauguucacuugcaagaaaaauauggagggaaaagugguacagccugaaaauuuggaauacacuaucguaauuacgccucacucuggagaggaacaugcaguagguaaugauacggggaaacacggaaaagaaauaaaaauaacaccgcaaaguucaauaacggaagccgaacuaacaggauacgggacgguuacuauggaguguucgccccgaacgggacuggauuucaacgagaugguauugcuucaaauggaagacaaagcguggcuggugcacagacaaugguuccuggaucuaccuuugccguggcuaccaggagcagauacacaaggaagcaacuggauacaaaaagaaaccuuagugacauuuaaaaauccucacgccaagaaacaagaugugguagucuuaggcucccaagaaggugcgaugcacaccgcgcuuaccggugcuacugagauucagaugucgucuggcaaccuucucuucacaggucauuugaaaugucggcuaaggauggauaaauuacagcugaaaggaaugucauauuccauguguacaggaaaauucaaaauaguaaaagaaauagcagaaacucaacacgguacaauaguuauacgaguacaauacgagggagacgguucacccuguaaaaucccguuugagauaacugaucucgagaaaaggcauguccuaggaagauuaaucaccgugaaucccaucguaaccgaaaaagauucaccgguuaacauagaagcagaaccuccauuuggagauucauauaucauuauaggcguagaaccgggacaacuaaaacugaauugguuuaagaaaggaucaucuauuggucagauguucgaaacuacaaugaggggagcuaaacguauggccauucuaggagacacagccugggacuuuggaucacucgggggugucuucaccucaauaggaaaagcacuucaccaaguuuucggugcgauuuauggagcagcuuucucagguguaucauggacuaugaaaauucucauuggaguaauuauuacauggauugguaugaacucacgaaguacgucauuaucuguuucauugguacuggucggcgugguuacguuauauuuaggcgcgguaguacaagcugauucugguugcguuguaaguuggaaaaacaaagaacuaaaguguggaucaggaauauucaucacggauaaugugcauacauggaccgaacaauacaaauuccaaccggaaagucccagcaaauuagccuccgcaauucaaaaagcucaugaagaagguauuugugggauacgaucuguaacaagacuagaaaauuuaauguggaaacagauaacuccugaauuaaaccacauccuaucggaaaacgaagucaaacuaacaauuaugacaggugacauuaaaggaaucaugcaagcugggaagaggagucucagaccucaaccgacugaauuaaaauauucauggaagacuuggggaaaagcaaaaauguuaagcaccgaaucgcauaaucaaacauuuuuaauagauggacccgaaacugcugaauguccaaacacaaauagggcauggaacucacuugaagucgaggauuauggauuugggguguucacgaccaauauuuggcuaaaauugcgagaaaagcaggauguauuuugcgacuccaaacuuaugucugccgcuauuaaagacaacagagcugugcaugcagacauggguuauuggauugaaagcgcuuugaacgauacguggaagauggaaaaagcuagcuuuaucgagguaaaaaguugucauuggccaaagagucauacacuguggagcaaugguguauuggaaucggaaaugaucauuccuaaaaauuucgcaggcccgguuucacaacauaacuauagaccaggauaccauacucaaacugcagggcccuggcacuuagguaaacuugaaauggauuuugacuuuugugaaggaacaacaguagucguuacugaagauuguggaaacagagguccaucauuaaggacaacaacggcuagcgguaaauuaauaaccgaaugguguugucgcuccugcacucugccaccuuuacguuauagaggggaagacggcugcugguauggaauggaaauacggccgcuaaaagaaaaagaagagaaucugguaaauuccuuaguaacagccggacaugggcagauugacaauuucucucuuggcguauuaggaauggcguuguuccuagaagaaauguugaggacgcgcauagguaccaaacaugccauacuauuaguggccguuaguuuuguaacauuaauuacaggcaauaugucauuccgcgacuuaggucgaguaaugguaauggucggcgcaacuaugaccgaugacauagguaugggaguaaccuauuuagcauugcucgcugcauuuaaggugagaccuaccuuugcagcugggcuucucuuaaggaaguuaaccucgaaggaguuaaugauggcaaccauaggaauagcacuucugucacaaucaacuauaccggaaacaauuuuggaacuaacugaugcucuugcgcuaggaaugaugguucuaaaaauaguaagaaacauggaaaaauaucaauuagcaguaacaauaauggcaaucucuugcguaccaaaugccgugauucugcaaaaugccuggaaaguaucaugcaccauccuugcugcugugaguguaagcccucuuuuacugaccaguucacaacaaaaagcagacuggauaccacuagcgcucacaauaaaaggccugaauccaaccgcaauauucuugaccacauugagccgaacgagcaagaaacgcucguggccucuaaaugaagcaauuauggcugugggaauggucaguaucuuagcgagcucacugcucaaaaacgauauaccuaugacagggccauugguggcggguggauuacuuacaguauguuauguucuaacuggacgauccgccgauuuagaauuagaaagagccgcagacguaaaaugggaagaucaggcugaaaucucaggcagcaguccaauacuaucaaucacaaucucagaagauggaagcaugucuauaaagaaugaagaagaagaacaaacauugacgauuuuaauacggacaggauugcuagucauaaguggaguauuuccaguaaguauaccaaucacagcugcagcaugguauuuaugggaagugaagaaacaaagagcgggaguucuaugggacguuccaagcccaccaccaguagaaaaggcggaauuggaggacggagcguacaggauaaaacagcgcgguauccuagguuacucgcaaauaggggcuggcguauacaaggaaggaacuuuucauacuauguggcauguuaccagaggugcaguacugaugcauagagguaagagaauagaaccgucaugggcagacgugaagaaagaccuaauuuccuauggagggggcuggaaauuagaaggagaauggaaagaaggugaagaaguacaaguccuagcacuagaaccaggcaaaaauccccgcgcagugcagacuaaacccggaauauucaaaacaaauacgggaacuaucggagcaguaagccuagauuuuaguccaggaacaucuggaagcccuauaguagacagaaaaggcaaaguaguaggcuuauacggcaauggcgucguaacacgcaguggagcauaugugucagccauagcacaaacagaaaagucaauugaagacaacccagaaaucgaagacgauaucuuccgaaagaaacgccuaacuauaauggacuugcauccaggugccggaaaaaccaaaagauacuuaccggcuauaguacgugaagccauaaaaagggguuuaagaacucuuauuuuggccccgacaagaguuguugcugcugaaauggaagaggcccugagggguuugccaauucgauaccaaaccccggcgauaaaaacagaacacacaggccgagaaauaguagacuuaaugugucacgcuacuuuuacgaugcggcuuuuaucgccaguuaggguaccuaauuauaacuuaauaaucauggaugaggcccauuuuaccgacccagcaucaauagccgcccgaggguauauuucaacacguguggaaaugggugaagcugcuggcauauuuaugacagcaacaccuccagguuccagagaccccuuuccccaguccaaugcgccaauaauggacgaagaacgagagauaccagaacgaucauggaacagcggacaugaaugggucacagauuuuaagggaaaaacugugugguuugucccaucaauaaaagcggggaacgacauugcagcuugucugaggaaaaauggcaagaaagucauacagcuuagcagaaaaacguuugauagugaauauguaaaaacucgagcuaaugacugggauuuugucguaacgacugacaucucagaaaugggagcaaacuuuaaagccgaacgcguaauugacccgcgcagaugcaugaaaccgguuauauugacagacggugaggaaagagucauuuuggcugguccgaugccuguaacucauucuucugcagcacaaagacgagggcguaucgguagaaauccgaaaaacgaaaaugaccaauauauuuauaugggggagccucuagaaaacgacgaagacugcgcacauuggaaagaggccaaaaugcuuuuagauaacauaaacacacccgaaggaauaaucccuuccauguuugaaccagaaagagaaaaaguagacgcaauagauggagaauaucgacuacgcggagaagcuagaaaaacguuuguagaccugaugcgaagaggcgauuugccuguguggcuagccuauaagguagcagcugagggcauaaauuaugcggauaggaaaugguguuucgacgggacgaagaauaaccaaauauuagaagagaauauggaaguagaaaucuggacuaaggaaggugaacggaagaaacuuaaaccucgcugguuagacgcaaggaucuauucggacccguuagcacucaaagaauuuaaggaguucgcagcugguagaaaaagucuaacuuuaaaucuuauaacggaaauggguagauugccuacauucaugacacaaaaagcaagaaacgcauuagacaacuuggccguucuacacacagccgaagcuggcgguagagcauacaaucaugcacuaagugaauuaccagaaacucuagaaacuuuacugcuucucacuuuacuugcaacuguaacggguggaauauuucuauuccucaugucgggaaaaggaaucgguaaaaugacccugggaaugugcugcaucauaaccgcuaguauucuacucugguacgcacaaauacaaccacacuggaucgcagccaguauaauucuagaguucuuuuuaauaguacuauuaauaccggaaccugaaaaacaaagaacaccccaagauaaccaacucaccuacguugucauagcgauccuaaccgucguggcagccacaauggcaaacgaaaugggauuuuuagagaaaacaaagaaagaucuuggcuugggaaguauuacgacucaagaaagugaaucuaacauucucgauauugauuuaaggccagcaucugcauggacauuguacgcgguggcaacuacguuugugacaccaaugcuuagacacucuauagaaaauagcagcgucaacgugucauugaccgcuauagcuaaucaggcaaccguccuaaugggccugggaaagggauggccauuaagcaaaauggauaucggaguaccucuacuagcaaucgggugcuauucccaggugaauccaaucacucuaacugcagcgcuccuacuauuaguagcucacuacgcaaucauagggccaggauuacaagcaaaagcuacuagggaagcacagaaaagagccgccgcggguauaaugaagaauccaacaguggauggaauuacuguuauagaucuagaaccaauaccguaugacccaaaauuugaaaaacaacucggucagguuauguugcuaauucuaugcguaacacagguauuaaugaugagaacgacaugggcacucugcgaagcacugacgcuagcaaccggcccgauaucaacauuaugggaaggaaaccccggacgguuuuggaauacaaccauagcaguuagcauggcaaauauauucagaggaucauaccuagcuggggccggauuauuauuuucaauaaugaaaaauacaacaucgacaagaagagguacaggaaauauaggugaaacacuaggagaaaaguggaaaagucgauugaacgcacuaggcaaaucugaguuccagauuuacaagaaaagugggauacaagaggucgauagaacccuugcaaaagaagggauuaaacgaggugagacagaucaucaugcaguaucaagagguuccgcaaaacuaaggugguuuguagagagaaauaugguaacuccagaaggaaagguaguggaccuagggugcggaagaggaggguggaguuacuacugcggaggacuaaagaacguuagagaggugaaagggcuaacuaaggguggaccuggacacgaggagccgauaccuaugucuaccuauggauggaauuuaguuagacuccaaagugggguagauguauucuuuacuccucccgaaaaaugcgauacacuucucugcgacaucggggaaaguucacccaauccaaccauugaggcuggcagaacauugcgcguacugaaucuagucgaaaauuggcuuaacaacaacacacaauucuguauaaaaguccuaaacccauauaugccuucuguaauugaaaagauggaagcacuacaacgacaauaugguggagcccuaguuagaaauccauugucucgaaauuccacccacgaaauguauuggguaucaaaugcuacaggcaacauuguaucaucaguaaauaugaucucuagaauguuaaucaacagauucaccaugaaacacaagaaagcuacuuacgaacccgacguggauuuaggcuccgggacucggaacauuggaauagaaucugaaauaccaaacuuagacauuauaggaaagagaauagagaaaaucaagcaagaacaugaaauuagcuggcacuacgaccaagaccauccauauaaaacuugggcuuaucauggcaguuaugaaacaaaacagacuggaucagcuucuaguauggucaauggagucgucagacuccuaaccaaaccaugggauguaguuccuauggucacgcagauggcuaugacggauacuaccccguucggacagcaaagaguauuuaaggaaaagguggacacccgaacucaagaaccgaaagagggaaccaagaaauugaugaaaauaacagcagaguggcuuuggaaagaauuagggaagaagaaaacuccacguauguguacaagagaagaguucacgaagaaagugcgaucuaaugcagcacuuggagcuauuuucacagacgaaaacaaauggaagagugcaagggaagcaguggaggauggcagauucugggaauugguagaucgcgaaagaaaccuucaucuagaaggaaagugcgagaccugcguauauaacaugaugggcaaacgugaaaagaaauugggagaguucggaaaggccaaaggcagccgagcaauaugguauaugugguuaggugcgcgcuuucucgaauuugaagcauugggauuuuuaaacgaagaccacugguucucaagagguaauucacuuagugguguggaaggcgaagggcuacauaggcuaggguauauucuaagagauguaggcaagaaagaaggaggcgcaauguaugcggacgacacagcaggaugggauacccgaauuacgcuggaagaucucaaaaaugaagaaauggucacuaaccacaugaaaggugaacauaaaaagcuagcugaagcuaucuuuaaacuaacuuaucaaaacaaaguuguuaggguucaacgaccuacaccgcgcgguacaguaauggacauuauaagcagaagggaucaacgagggagcggacagguugguacauauggauuaaacacguuuaccaauauggaagcacaacuuauaagacaaauggaaggcgaaggcauauucaagagcauacagcaucuaacagccacagaagagauagcaguucaaaauuggcuagcgaggguggggagagaaagacuaagucguauggcaauauccggagaugacuguguuguuaaaccuauagacgaccgguuugcuagcgcguuaacugcguuaaacgauaugggaaaaguucgaaaagauauccagcagugggagcccucacgaggauggaacgacuggacucagguaccguucugcucucaucauuuucacgagcuaguaaugaaagacggaagaguauuaguaguacccugcaggaaccaagacgaacuaauuggacgagcgcgaauuucucagggagcuggguggucauugaaagaaacagccugccuaggaaaauccuacgcucaaauguggacuuugauguauuuucauagacgcgaccuaagacuugcagcaaaugcaauaugcucugcaguuccuagucauugggucccgacaagccgaacuacguggaguauacacgcaaagcacgaauggaugaccacagaagauauguuagcaguauggaauagaguuuggauacaagaaaauccuuggauggaagacaaaacuccaguggaaucuugggaagaaguaccuuaccucggaaaaagagaggaccaauggugugguuccuugauuggauuaacgagcagagcaaccugggcgaaaaacauacaaacggcgauaaaccaagugagaucauuaauaggaaaugaagaauacacugauuauaugccaucaaugaaaagauucagacgcgaagaagaggaagcuggaguguuaugguag

SEQ ID NO: 22435 - RNA, 9876 nt, Artificial Sequence
  derived and/or modified CDS sequence (opt6) from DENV-2__JF730052__SS-prME
acugcaggaguuauaguuauguugauaccaacggcuauggcauuccaucuaacaacgcggaacggggaaccacauaugauaguaggcagacaggaaaaagguaaaucacuauuauuuaaaaccgaagauggagucaauauguguaccuugauggcuauugaccucggugaauuaugugaagauacaaucacauauaaauguccccuacuucggcagaacgagccugaagacauugacugcugguguaacucgacaaguacauggguuacauacggaacuuguacaacaacaggugaacauagacgcgagaaacgaucaguugcccuuguaccccaugucggaaugggucuggaaacaagaacagaaacuuggaugaguagugaaggcgcguggaaacaugugcaacguauagaaaccuggaucuuaagacaucccggauuuacuauaauggcagcaauccuggcauacacaauaggcacaacccauuuccaaagagcacuaauauucauacuauuaacagcagucgcaccuucgaugacuaugcgauguauagguaucaguaauagagacuucguggaaggaguuucagggggauccuggguagauauuguacuggaacacggaucaugcguuacuacaauggccaaaaacaaacccacccuggauuuugaauuaaugaaaaccgaggcuaaacaaccagccacccucaggaaauauugcauugaagcaaaacuaacuaacacuacuaccgaaagccguuguccaacacaaggggagcccagucucaaugaagaacaggacaaacgcuuuauauguaaacauucuaugguagaccguggauggggaaaugguuguggacuuuuuggaaaaggagguauuguaaccugugcgauguucacuuguaagaaaaacauggaaggaaaagugguacaaccagaaaaucucgaguauacgauaguaauaaccccucacagcggagaagaacaugcugucgguaaugauacuggaaaacacgggaaagagauuaaaauaacgccacagagcaguauuaccgaagcugagcuaaccggauacggaacugugacgauggaguguucuccgagaacaggccucgacuucaaugaaaugguauuguuacagauggaagauaaagcguggcuaguacauaggcaaugguuuuuagacuuaccauuaccuugguuaccaggagcugauacucaaggaucuaacuggauacaaaaagaaacguugguaacauuuaaaaauccgcacgcuaagaaacaagacgugguaguucuagggagccaagagggugcgaugcauacugcacuuaccggcgcaacagagauacagauguccaguggaaauuuauuguucacagggcauuuaaaaugucggcugagaauggauaaacuucagcuaaaaggaaugaguuauaguauguguacaggaaaauuuaaaauagucaaagaaauagcugagacucaacacgggacaauaguuauaagaguacaguacgaaggggauggaaguccuugcaaaauaccuuucgaaaucaccgauuuggaaaaacgacauguucucgggagacucauuaccguaaacccgauagucacagaaaaagacuccccuguaaauauagaagccgagcccccguucggggauucguauauuauaauaggaguugaaccgggccaacuaaaacugaauugguuuaagaagggaagcucuauugggcaaauguuugagacuacaaugagaggagccaaaaggauggccauauugggugacacugcuugggauuucggcagccuaggaggugucuucacaucuauagggaaagcauuacaucaggucuuuggagccaucuacggggcugcauuuagcggaguaucguggacuaugaaaaucuuaauaggcgucauaauuacauggaucggcaugaacucuagaaguacuucccuaagugugagcuuaguauugguggguguagucacuuuauauuugggugccguuguccaagcggacuccggaugugucguaucuuggaaaaauaaggaacuaaaaugugggucagguauauuuauaaccgauaauguacauacauggacggagcaauauaaauuucaaccagaaaguccaaguaaauuagcauccgcaauacaaaaggcucacgaggaagggauauguggaauccgaagugucacgagacuagagaacuuaauguggaaacagaucaccccggaguuaaaccacauuuuaagugaaaacgaaguuaaauuaaccauaaugacuggcgauaucaagggcauaaugcaagcugguaaacgaucauugaggccacagccuacagaacugaaguacuccuggaagacauggggaaaagccaaaaugcuaagcacugagucacauaaccaaacauuccuaauagacgguccagagacugcagaauguccaaauaccaaucgugccuggaacucccuugaaguugaagacuacggauuuggcguuuucacuacgaauauaugguuaaaacuuagagaaaaacaagauguauucugugacucgaaauuaaugucugccgcaauaaaggacaaucgcgcaguacaugccgacauggguuauuggaucgaaucugcucucaaugacacuuggaaaauggaaaaagcaucauuuauagaaguaaaaaguugucauuggccuaaaucucauacgcuguggucaaaugguguauuggaaucagaaaugauaauuccuaaaaacuuugcaggacccgugucacaacacaacuaccgacccggauaccauacccagacagcuggaccuuggcaccugggaaaacuagaaauggauuuugauuuuugugaggguaccacaguuguaguuacagaagacuguggcaauagagguccaucguugcgaaccacaacugcuaguggcaaguuaaucaccgaauggugcugucgaagcugcacccucccacccuugagauauagaggggaagaugguugcugguauggaauggaaauuagaccauuaaaagaaaaagaggaaaaucuaguaaauucccuuguuacagccggacacggccaaauugauaacuucucacucggcguucucggcauggcacuauuuuuggaggaaauguuaagaacucggauaggcacgaaacacgcgaucuuacuuguugcugucuccuucgugacacuuacuacuggcaauaugucguuucgagauuuaggucgagucaugguaaugguuggcgccacuaugacagaugacauaggcaugggaguuaccuauuuggcguugcuggcagcauuuaaaguuagaccaacauuugcugccgguuuguuauugcgcaaauuaacaagcaaggaacuaaugauggcuacuauagguauagcuuugcuaucucaaucuaccauacccgagacuauucuugaauugacagacgcgcuagcacucggcaugaugguacuaaaaaucguacgcaauauggagaaguaccaacuagcagugacuauuauggcaaucucaugugucccuaacgcgguuaucuuacaaaaugcuuggaaaguuaguuguacgauacuggcggccgugucgguuagcccuuuacuauuaacaucuucacaacaaaaagccgacuggauuccgcucgcccuaaccauaaagggcuuaaauccaaccgcaaucuuucucacgacccuaagccguaccaguaagaaacgaucguggccauuaaaugaagcuauuauggccgucggaauggugagcauacuugccucgucauuacuuaaaaaugauauaccaaugacgggaccacugguagccggggguuuauugacaguuugcuauguauuaacgggccgaucggcggauuuggaacuggaacgggcagcggacguuaagugggaggaucaggcugaaauuucaggcucaaguccaauucuaucaauuaccauauccgaagacgguucuaugagcauaaagaaugaagaggaggagcaaacacuaaccauuuuaauaaggacuggauuauugguaaucagugguguauuccccguaaguauaccaauaacagcggcggcgugguaucugugggaagugaagaaacagagagcaggagugcucugggacgucccaaguccaccaccaguugaaaaagcagaauuagaagacggagcauauagaauaaaacagagagguauucuaggauauucacaaauaggugccggaguauauaaagaaggaacauuucauacuauguggcacgucacuaggggugcaguucuuaugcaucgcgggaaaagaauugaaccgagcugggcagacguaaagaaagaccuuauaucauaugguggaggcuggaaacuggaaggagaauggaaagaaggugaggagguacagguauuagccuuagaaccaggcaaaaauccucgugcgguccaaacgaaaccaggaauuuucaaaacaaauacaggaacuaucggcgcugugagccuagauuucaguccuggaacuucggguagucccaucguagauagaaagggaaaagucguaggacuuuacggaaacggugucguaacgagaagcggugcauacguuagugcuauugcucaaacggagaaauccauagaagacaauccagagauagaagaugacauauuuaggaagaaaagacuaacuauuauggauuuacaccccggagcaggaaaaacaaaacgcuacuugccggcaaucguacgugaagcgaucaaacgaggucuaaggacauuaauuuuggcacccaccaggguaguggccgccgaaauggaagaggccuuaagaggacuaccgauucgauaucaaacaccggcaauaaaaacagaacauacuggccgcgagauaguugaucucaugugccacgcaacauuuacaaugagacuauuaucucccguccgaguaccuaauuauaauuuaauuauuauggaugaagcucauuuuacagaccccgccagcauagcugcucgagguuauauaagcacaaggguagaaaugggcgaagcagcgggaaucuuuaugaccgccacaccaccaggaucuagagacccauuuccgcagucaaaugcccccaucauggacgaggaaagagaaauuccugaaagaucauggaacucaggucaugaaugggugacagacuuuaaaggaaaaacuguuugguuuguuccaucaauaaaagcgggcaaugauaucgccgcgugcuuacgaaagaacgguaagaaaguuauccaacuaagccguaagacauuugauagugaauaugucaaaacucgcgcuaaugauugggacuuuguagucacgacagauauaagugaaaugggagcuaacuuuaaggcagaacgaguuauagaccccaggagaugcaugaaaccugucauucuaacagauggagaagaacgggugauccuggcagggccaaugcccguuacacacagcucugcagcacagcgaagaggccgaauaggaagaaaucccaaaaaugaaaaugaccaauacauauacaugggugaaccccuugagaacgacgaagacugcgcacauuggaaagaggcgaaaaugcuauuggauaauaucaauaccccugaagggauuauaccuagcauguuugaaccagaaagggaaaaggucgaugcaauagauggggaguaucgccugagaggugaggcuaggaagacauuuguggacuugaugagaagaggagaccugccaguguggcuagcuuacaaaguugccgcagaagggauuaacuaugcugaucgaaaaugguguuucgaugguacuaaaaacaaccaaauuuuagaagagaauauggaaguagagauuuggacaaaagagggagagaggaagaaacuaaaaccgagauggcuggacgcgaggauuuauucugacccauuagcuuuaaaagaauuuaaagaauuugcagccggacgcaaaagccuaacccuaaacuuaauaacagaaauggguagacuuccaacuuucaugacacaaaaagccagaaaugcgcucgauaacuuagcaguguuacauacugccgaggcuggaggacgugcauacaaccaugcgcuuagcgaauuaccggaaacuuuggaaacguuacuguuguuaaccuuacuagcgacagucacuggaggaauauuuuuauuccuuaugucaggcaaaggaauuggaaaaaugacgcuagguauguguuguauuauaacagcaucaauucuacuaugguacgcacagauacaaccccauuggauagcugcaucaaucauauuggaguucuuucuaauuguacuuuuaauaccugaaccagaaaaacagaggacuccucaagauaaucagcuaacauauguuguuauagcaauacugacagugguagcagccacaauggcaaaugaaaugggguuucuggaaaagaccaagaaggauuuaggccuagguucaauaacaacacaagagagugaaucaaacauauuagacauagaucucagacccgcuucugcuuggacccuguaugcagucgcuacuaccuuuguuacuccaauguuacggcauucgauugaaaacucaagcguuaaugugucguuaaccgcuauugcaaaucaagcaacaguacucaugggauuggggaaaggauggcccuuguccaagauggacauuggaguuccucuacuggcaauaggauguuacucacagguuaauccuauaacccucacggcagcacuacuauuauuaguagcgcacuaugcaaucauaggaccagguuuacaagcaaaagccacaagagaagcucagaaaagagcagcagcagguauaaugaaaaauccaacuguggauggaauuacgguuauugaucuggaacccaucccuuaugaccccaaauuugaaaaacaauuaggacaaguaaugcuucugauacugugcguuacacaagugcucaugaugcggacuacaugggcgcuaugcgaagcguuaacccuagcgacuggaccuauaaguacgcuaugggaggguaacccuggaagauuuuggaacaccacaauagcuguaaguauggcaaacauuuuuagagggaguuaucuggcuggugcaggguuguuauuuucuauaaugaaaaacaccaccucaacacguaggggcacagggaacauuggcgaaacauuaggcgagaaauggaagagucguuuaaaugcauuagggaagucagaauuucaaaucuauaagaaaagcggaauccaggagguugaccgaacuuuagccaaggagggcauuaagagaggagaaacagaucaucaugcagucucacgugggucagcuaaacuaagaugguucguagaacgaaacauggucacacccgaagguaaagucguagaucucgguuguggaagaggaggcuggucuuauuauugugguggacuaaagaauguacgagaagucaaagggcuaacaaaaggagguccagggcaugaggagccaauuccaaugucuaccuacgguuggaaucuagucagauuacaauccggcguagaugucuuuuucacaccuccagaaaaaugugauacacuacuaugugacauaggagaaucaucucccaauccaacaaucgaagcaggacgaacgcuccguguacugaacuuaguugagaauuggcuaaacaauaauacacaauuuuguaucaaaguuuuaaacccauauaugcccucuguaauugagaaaauggaagcguuacaaaggcaauauggaggcgcuuugguaaggaauccauuaucacgaaauagcacucacgaaauguauuggguuucaaaugcaacagguaacauaguuucaucggugaauaugauauccagaaugcuuauaaaucgauuuacaaugaaacacaagaaagccacauacgaaccggacguugaucuagguucagguaccaggaauauaggaauagaaucagaaauaccaaaccuagacaucauagguaaacgaauagaaaagauaaagcaagagcacgagauaucauggcauuacgaccaagaccauccuuacaagacuugggcauaucauggguccuacgagacgaaacaaaccgggucugcaaguucgauggucaacggaguaguucgauuguuaacgaaacccugggacguaguaccaaugguaacucaaauggcuaugaccgauacuacacccuuuggccagcagcguguauuuaaagaaaagguggacacgagaacucaggaaccgaaagaagggaccaagaaacuuaugaagauuacggccgaauggcuauggaaggaauuaggaaagaagaaaacaccccguaugugcacgagagaagaguuuacuaagaaaguccgaucaaaugcagcuuuaggagcgauauuuacagacgagaacaaauggaaaagugccagggaggccguagaagauggucgcuuuugggaauuaguagaucgagaaagaaaccuacaccuagagggaaaaugugaaacaugugucuauaacaugauggggaaaagggagaagaaauuaggagaauuugguaaagcuaaagggucgcgcgcgauaugguauauguggcuuggugcccguuuccuggaauuugaagcauuaggauuuuuaaacgaggaucauugguuuucaagaggaaacucguuaucaggcguagaaggagaaggauugcaccgacuugguuauauacuuagagauguaggaaagaaagaagguggcgcuauguaugcugaugauacugccggaugggauaccagaauaacauuagaggaccuuaaaaaugaagaaaugguaacgaaucauaugaaaggagaacacaagaaauuggcagaagcaauauuuaaacuuacuuaucagaauaaaguagugagggugcaaagaccgacuccuagagguacuguuauggauauuauuaguagaagagaucagagaggaaguggacaaguugguacauauggccuuaauacuuucacaaauauggaagcccaauuaauuagacaaauggaaggagagggaaucuucaagaguauccaacaucucacagccacggaagagauagccguacaaaauuggcuagcuagggugggaagagaacgacuaagccgaauggcaauaucaggcgacgauuguguaguaaagccuaucgaugauagguuugcaucugcucugacggcacuuaacgacaugggaaaggucagaaaagauauacaacaaugggaacccucuaggggauggaaugauuggacacaaguccccuucuguucucaccauuuucaugaauugguaaugaaagacggucgagugcuggucguaccauguagaaaucaagacgagcugauagggagagcuagaauaucacagggcgcugguuggaguuuaaaagaaacugcuugcuuagguaaaucauacgcacaaauguggacucugauguacuuucacaggcgagaucuccgacuggcagcaaaugcaauuuguuccgcaguuccuucccauuggguucccacaagcagaacaaccugguccauacaugcuaagcacgaauggaugaccaccgaggauaugcuagccguauggaaucguguguggauacaagaaaauccguggauggaggauaaaacuccugucgagaguugggaagaaguaccauacuuagguaaacgagaagaucaauggugcgggucauuaauaggccugacauccagagcuacaugggcuaagaauauacagacagcgauaaaccaaguuaggucccuaauagggaaugaagaguacacagauuacaugccaucuaugaaacgcuuucguagggaggaagaagaagcaggaguacuaugguga

SEQ ID NO: 22436 - RNA, 9876 nt, Artificial Sequence
  derived and/or modified CDS sequence (opt6) from DENV-2__EU482748__SS-prME
acagcaggaguuaucguaauguugauaccgacagcaauggcguuucaccugacaacucguaauggggagccucacaugauaguuggaaggcaagaaaaagggaaguccuugcuguuuaagaccgaagacggaguuaauauguguacauuaauggcaaucgaccuuggagaacuaugugaggagaccauuacguauaaguguccccuacuaagacaaaacgaaccugaagacaucgauugcugguguaauucaaccaguacaugggugacuuacggcacauguaccacaaccggagaacacagaagggaaaagagaagugucgccuugguuccacacguuggaaugggucuagagacgagaaccgaaacguggaugaguucagagggagccuggaaacauguacaaagaauagaaacauggauucuucgacaucccggcuucacgauuauggccgcuauccuagcauacacaauaggaacuacacauuuucaaagagcgcucauuuucauauuauuaacagcgguagcaccuucuaugaccaugagauguauagggauaucuaaccgugacuuuguagaaggugucucgggggguucaugggucgauauugucuuggaacauggaucauguguuacuacgauggcaaaaaacaaaccuacauuagauuucgaacucauuaagaccgaagcuaaacaaccggccacacuacgcaaauauugcaucgaagccaaauugacaaauaccacgacugaaagcaggugcccgacacaaggcgaaccuucuuugaaugaagagcaagacaaacgguucauuugcaaacacuccaugguagacagagguugggguaacggcuguggacuuuucgguaaaggaggaaucguuacaugcgcuauguuuaccugcaagaaaaauauggaagggaaaguuguacagccugaaaaccuggaauacaccauaguaauaaccccccacucgggagaagagcacgcugugggaaaugacacaggaaaacaugguaaggagauaaaaauaacaccucagaguucaauuacagaagcagagcugacaggauauggaacugucacaauggaauguucaccuagaacgggauuagacuuuaacgagaugguccuacuacaaauggaggauaaagcauggcuagugcaccgacagugguuccuagacuugccucuuccuugguuaccgggggcggacacgcaaggauccaauuggauacagaaggagacacugguaacauucaaaaauccacaugcaaaaaaacaagauguagugguauuaggcucucaggaaggugcuaugcacacagcacuuacuggagccacggaaauucaaaugucuucaggcaaucuacuauucacuggccauuugaaaugcagauugcgaauggacaaacuacaauuaaaggguaugaguuacucaaugugcacaggcaaauuuaaaauaguuaaagaaauagcagagacacaacacgguacgauaguaauuaggguccaguaugaaggagacggaagcccauguaaaauaccuuuugaaauaaccgacuuagaaaagcgacauguuuuaggaagauuaaucacuguaaauccuauagucacagaaaaagauaguccaguaaauauugaggcugaaccuccguucggggauucauacauaauaaucgguguggaaccugggcaacuuaagcuuaacugguuuaaaaaaggaaguucaauaggccaaauguuugaaaccacaaugcgaggagcaaagaggauggcgauucuaggugacacugccugggacuucggaucacugggcggcguguucacgagcauagguaaagcauuacaccaaguguuuggcgcgaucuauggugcagcauuuucagggguaucauggacgaugaaaauacucaucggagugauaauuaccuggauaggaaugaauucacgcucuacaucauugagugucucguugguauuagucgguguaguaacuuuauaccugggagcuaugguccaagcugacagcgguugcgucguaucguggaaaaauaaagagcucaaauguggaagugggauuuucauaaccgauaacguucacacauggaccgaacaguacaaguuucaaccagagaguccuaguaaauuagcaucagcuauucaaaaagcacaugaagaaggaauaugcgguauacguagcgugacucgacuagagaacuuaauguggaaacaaauaaccccugaauuaaaccacauauuaagugagaaugaagugaaauuaacuauaaugaccggagauauaaaggguauuaugcaggcaggcaaacgaagucugaggccacaaccaaccgaauuaaaauauucauggaagaccuggggaaaagcgaaaauguuaagcacggaaucucauaaucaaacuuuccuaaucgaugggccugaaacagcagaauguccaaacacaaaucgagccuggaacagcuuggaagucgaggauuaugguuuugguguuuuuacuacgaauauaugguuaaaacuaagagaaaaacaggacguuuuuugcgauucaaagcucaugucagcugccauuaaagauaaucgugcgguacaugccgauauggguuacuggauagaaagugcauuaaaugauacuuggaaaauggagaaagcaagcuuuauugaagugaagaguugccauuggccaaagucucauaccuuauggucaaacgggguucuagaaagugaaaugauaauucccaaaaauuuugcaggaccaguaucgcagcauaacuacagaccaggguaccauacucaaacagcuggaccuuggcauuugggaaaauuagagauggauuuugaucuaugcgaagguacgacgguuguuguaacugaagauugcggaaacaggggucccagucuacguacgacuacagcaagcggaaagcugauaacagaauggugcugucguucauguacacuuccgcccuuacgauaucgcggagaagaugguuguugguauggaauggaaauaagaccuuuaaaagaaaaagaggaaaaccuagucaacucacucguaacugcgggucacgggcaaauagacaauuucucauuaggugucuuaggaauggccuuauucuuagaagaaauguuacgaaccaggauagguacuaaacaugccauuuuacuuguagccguaucauuuguuacacucauaacgggaaauaugagcuucagggaccucgggagaguaaugguuaugguaggggcaacgaugacggacgauauugguaugggcguaacauauuuagcguuauuagcggcguuuaaagugcgcccaacuuuugcagcgggacuacuacugagaaaacucacuagcaaagagcuaaugauggcaacuauaggaauagcacuuuuaucacaaaguaccauuccugagacaauauuagagcucacugaugcccuagcacuuggaaugaugguuuuaaagauuguaagaaauauggaaaaauaucaauuagcuguaacuaucauggcuauuucuugcguaccaaacgcugucauuuugcaaaaugccuggaaagucaguuguacaauuuuagccgccguuuccgucagcccacuucuccuaaccucgagccaacaaaaggcggacuggauaccucuagcauuaaccauaaagggcuuaaauccaaccgcaauauuuuuaacaacuuugucuagaaccucaaaaaaaagauccuggccucuaaaugaagcaauaauggccguagguaugguaucaauucuagcgucaucauuauuaaaaaacgauaucccaaugaccggaccguuaguggcuggcggucuacuuacggugugcuauguucuuacaggacgcucggcagaccuagaguuagagcgugccgcugauguaaaaugggaagaccaggcagaaauaagcggaaguagucccauacuaucaaucacaauaucagaagacgggucuaugucuauaaaaaaugaagaagaggaacaaacucugacaauuuuaauuagaacggguuuacuaguaauuagcgguguuuucccggucucuaucccaauuacagcagcagcuugguauuuaugggagguuaaaaagcaacgagcaggcguucugugggacgugccaaguccgcccccaguggagaaagcagaacucgaggacggggcuuauaggauaaaacaaagaggaauacuaggcuauucgcaaauaggugcaggugucuauaaagaggggacauuucacacgauguggcaugucacaagaggggcuguguuaaugcaccgcggaaaacguauagaaccguccugggccgauguuaaaaaggaccuaaucaguuacggaggaggauggaaauuagagggagaauggaaagaaggagaagaaguucaaguuuuggccuuggaaccaggaaaaaacccgcgcgcaguccaaacgaagccgggaauuuuuaagacgaacacugggacaauaggugccguaucuuuggacuucuccccagguacaucuggaucgccgaucguugaccguaaagguaagguuguuggauuauauggcaauggggugguaacucgaaguggagcuuaugucucggcgauagcucagacggagaaaucaauagaagauaauccggaaauagaagacgacauauuuagaaagaagcguuuaacaauaauggauuuacauccgggugcaggaaaaacaaaacguuauuuaccagcuauaguuagagaagcuauuaagcguggguugaggacuuugauucuagcaccaacaaggguaguugcagcggagauggaagaggcacugcgaggauuacccauacguuaucagacgccugcaauaaagacagaacacacagggcgagaaauaguagauuuaaugugucaugcuacuuuuacuaugcgacuucuaucaccuguuagagugccaaauuacaaucugauaauaauggaugaagcccauuuuacugauccggcaucaauagccgcuagaggauacauuagcacuagagucgaaaugggggaagcggcuggaauauuuaugaccgcaacaccccccggaucucgagaucccuucccccaaagcaaugcuccgauaauggacgaagagagagaaauaccugaacgcuccuggaacagcggacaugaaugggugacggauuucaaagggaaaacugucugguucguaccaucaaucaaggcgggaaacgacauagcugcgugucuaagaaaaaaugggaaaaaaguuauucaacuaucaagaaaaaccuuugacucagaauacguaaaaacgagagcaaacgauugggauuuuguaguuacaacagauauaagugaaaugggcgccaacuuuaaagcagaaagagucauagauccacgacgauguaugaaaccuguuauccuuacagauggagaagaacggguaaucuuagcagggccgaugccgguuacacacuccagugccgcacaaagacgcggacggauaggaaggaaucccaagaaugaaaaugaccaauacauauacaugggugagccccuagaaaaugacgaagauugcgcucacuggaaagaggcgaaaaugcuauuagacaacauuaauaccccggaagguauuauucccucgauguuugaaccugaacgagagaaaguugaugcgauagauggggaauauagacuuagaggagaggcuaggaagacauucguagaccugaugagacgaggggauuuaccagucuggcuggcauauaaagucgcugcagaagguauaaauuacgcagaccgaaaguggugcuucgacgguauaaaaaauaaucaaaucuuggaagaaaauauggaaguagaaauauggacuaaagagggugaacgaaaaaaacuaaagccacgaugguuagacgcaagaaucuauagcgauccuuuagcguugaaggaauuuaaagaguuugcggccggaaggaaaucauugacacuaaacuuaauaacugaaauggggcgauuaccgacauucaugacacaaaaagcaagaaaugcacuagacaaucuagcgguuuuacacaccgcagaggcugguggaagagcuuauaaucaugccuugagcgaguuaccggagacccuagagacauuacuauuacuaacauuacuagccacaguuacgggaggcaucuucuuauuucugaugagcgggaagggcauaggcaagaugacuuuagggaugugcuguauaauuacggccucaauucugcuaugguacgcacaaauccagccacauuggauagccgcuucuauaauauuagaauuuuuucuuauuguauugcuaauucccgagccugagaaacaaagaacgccucaagacaaccaacuuaccuacguuguaaucgcaauacuuacagugguugccgcaaccauggccaacgaaauggguuuuuuagaaaagacaaagaaggaccuaggacuagguaguauaacaacccaagaauccgaaucaaacaucuuggauauugaccugcgaccagcaagcgcauggacauuguaugcagucgcaacaaccuucguaacgccuaugcuccgccacucgauagaaaauucaucaguaaaugucucgcugacugcuauagcaaaucaagcaacgguauugaugggucugggaaaaggauggccccuaaguaaaauggauaucgguguuccccucuuggcgauaggcugcuauucacaaguaaauccgauuacacuaacagccgcucuucuucuacuaguagcucauuacgcaauuauugguccgggccuacaggcuaaagcgacccgcgaagcccaaaaaagagcagcggcaggaauuaugaaaaacccaacuguagacgggauaacaguaauagaccucgaaccuauaccauacgauccuaaauuugaaaaacaguuagggcaagucaugcuauuaauacuaugugucacacaaguucuaaugaugcgcaccaccugggcucuaugcgaagcacuuacucuagcuaccggccccauaucuacucuaugggagggaaauccgggccgguucuggaacaccacaauagcaguaucuauggcaaauauauuucgaggaagcuacuuggcaggagcaggucuucuuuuuuccauaaugaagaacacaacaucgacaaggcgagguacugggaacauaggagaaacauugggagaaaaguggaagucuagacucaacgcauuagguaagucagaauuucaaauuuauaaaaaauccggaauacaagaaguagauagaacacuugcaaaagagggcauaaaaagaggggagacugaccaucaugcagugagucggggaucggcaaaacuaagaugguucguagaaaggaacaugguuacaccugaagguaagguaguagaucucggaugugguagaggaggguggucauacuauuguggugggcugaaaaaugugagagaaguuaaaggccucacaaaaggugguccaggucaugaagaaccuaucccaauguccacauacgguuggaaccuaguacgccuucagagcgguguagacguauucuucacgccaccggagaagugugacacguuauuaugugauauaggcgaaagcagcccuaaccccacaauagaagcgggaagaacucuaagaguacuuaaucuuguagaaaauugguuaaacaacaacacgcaguucuguaucaagguauuaaacccguauaugccaucagucaucgagaaaauggaggcacugcaaagaaaauauggcggagcuuuaguucgaaaucccuuaucaaggaauucaacucacgaaauguauuggguuucaaaugcaacagggaauauagucagcucaguuaacaugauuaguagaaugcuaauuaaccgauuuacaaugaagcauaaaaaaacaacuuaugagccagacgucgauuuaggaucagguacccgaaauaucgguauagaaucagaaauacccaaucuugacauaaucgguaagagaauugaaaaaauaaaacaagaacaugagaccucauggcauuacgaucaggaccacccuuacaaaacaugggcuuaccacgguucuuacgaaaccaaacaaacuggaucagcaucuucaauggugaauggaguugugagacuuuuaacaaaacccugggauguggugccuaugguuacgcaaauggcaaugacagacacaacccccuuuggccaacaaagggucuucaaagaaaagguagacaccagaacccaggaaccgaaagaaggaacgaaaaaacuaaugaaaaucaccgcagagugguuauggaaagagcuaggcaaaaagaaaacaccacgcauguguacccgagaagaauuuacaaggaaaguacguaguaaugcugcuuuaggagccauauucacggaugagaacaaauggaagagugcaagagaagccgucgaggauggucguuucugggaguuaguggacagagagcgaaacuuacacuuagaagggaaaugcgaaacauguguuuauaauaugauggguaaaagagaaaaaaaacuaggagaauuuggaaaggcuaaaggcaguagagcuauaugguauauguggcuuggggcacguuuucuugaauuugaagcacuaggcuuccuaaaugaagaucacugguuuaguagaggaaacucauuaucgggcguagaaggggagggacuacauagguuaggcuacauuuuacgagacguuucuaaaaaagagggaggugcaauguaugcggaugauacggccgguugggacacaaggauaacuuuagaagauuuaaaaaacgaagagaugguuacgaaccacaugaaaggggaacacaagaaguuagcugaggccauauucaagcugacuuaccaaaauaaggucguaagaguacaacguccaacacccagaggaaccgucauggauauuauuucucggagagaccagagagguagcggucaggugggaacguacggauugaauacauuuacaaauauggaagcacaacuaaucaggcaaauggagggcgaaggcauuuuuaaaucuauacaacaccuuacggcuacugaagagaucguaguacaaaacugguuagcacguguugguagagaacggcugucgagaauggcaauaaguggcgacgacuguguugucaaaccaauagaugaucgauucgcaagcgcccuaacggcauugaaugauaugggcaaagugaggaaggauauacaacaaugggagccaucacgagguuggaaugacuggacacaaguuccuuuuuguucacaccacuuucaugagcuuguuaugaaggacggcagaguucuaguagucccguguagaaaucaagacgaauugauagggagagcgaggauaucucaaggagcagguuggucacucaaagagacagcgugcuuaggcaaaucauaugcacaaauguggacuuuaauguacuuucauagacgcgacuugaggcuugccgcaaacgcaauuuguucggccguucccucacauugggucccaaccucgagaaccacaugguccauucacgcaaaacaugaauggaugacuacagaagacauguuagccguauggaacagagucuggauccaagaaaauccauggauggaagauaagacuccgguagagucaugggaagaaguacccuauuuagguaaacgagaagaccaaugguguggaucgcucauagguuuaacuaguagagcaacaugggcaaaaaauauucaaacagcaaucaaccaagugcgaucacuaaucggaaacgaagaauauacggacuauaugccgaguaugaaaagauuuaggcgggaagaagaggaggcgggaguacuuugguga

SEQ ID NO: 22437 - RNA, 9876 nt, Artificial Sequence
  derived and/or modified CDS sequence (opt6) from DENV-2__EU482749__SS-prME
acagcaggggucauagucauguuaauaccuacugcgauggcauuccaucuuacgacaaggaauggugagccgcauaugauagucggccgccaagaaaagggaaaaaguuuguuauuuaaaacagaggacggggucaacaugugcacucuuauggcaauugaccucggugagcuaugcgaggauacuaucacauacaaaugcccucuauuacgucaaaaugagccagaggacauagauugcugguguaauucuacgagcacauggguuacauauggaacuuguacgacuacaggagaacaccgaagggaaaaacggucaguagcacucguaccacauguugguaugggcuuagaaacaagaacugaaacauggaugagcucagagggggcauggaagcauguucaaacaauagaaaccuggauacuacgacauccuggguuuacuaucauggccgcaauauuagcguauacgauagggacgacccauuuucaaagggcucucauauucauauuauuaaccgcaguggcgccaagcaugacaaugagguguauaggaaucaguaacagggauuuuguggaaggcguuucgggggguagcuggguggacauaguacuagaacauggcagcuguguuacaacgauggcuaaaaauaaaccaacauuagacuuugaauuaauaaaaacagaggcaaaacaaccagcaacguugcgaaaguauuguauugaagccaaguuaacuaacacuacuacagaaagcagguguccaacacaaggagagccuagccuuagugaggaacaggauaaaagauuuauauguaaacauucgauggucgaucgaggauggggaaaugggugcgggcuguucggaaagggugguauuguaacaugcgcaauguucacaugcaaaaaaaacauggaaggaaaggucguacaaccagagaaccuugaguacaccaucguaauaacgccucacuccggugaggagcacgcuguagguaacgacacaggaaaacauggaaaagaaauaaaaauuacaccgcaaagcucgauuaccgaagcagaacucacagguuaugguacugucaccauggaguguucaccgagaacuggauuagacuucaaugagaugguauuacuccaaauggaggauaaggcauggcucgugcaucgccaaugguucuuagaccugccucugccauggcuaccgggggcugacacacaagggucaaauuggauucaaaaagaaacucuagugacauuuaaaaauccacaugcuaaaaagcaagacguagugguucuagguucgcaggaaggagcaaugcacacagcacugaccggcgcaacagaaauucagaugaguaguggaaaccugcuuuuuacaggucauuuaaaaugucgauugcgaauggacaaacuucaauugaaaggaaugucauauucaauguguaccggcaaauuuaaaaucguaaaggaaaucgcggaaacccagcacgguacgauagugauacguguacaguacgaaggagacggaaguccaugcaaaaucccguucgaaaucacagaccuugagaagaggcacguauugggaaggcuuauaaccguaaacccaauuguaacagaaaaagauucuccgguaaacauagaggcagaaccuccguuuggugauucguacauaauuaucgggguagaaccuggacaauuaaaacuaaacugguuuaaaaaaggcucgucuauuggacaaauguucgaaacaacgaugagaggggccaagcgaauggccauuuugggagacacagcaugggauuuuggaucucuaggcggaguauucacuucaaucggaaaggccuuacaccaaguuuucggagcuauauacggagcagccuuuucgggaguaucuuggaccaugaaaauccuaauaggagugauaauuacuuggauaggaaugaauagccguucaacuuccuuaagcgugaguuugguacugguaggcgucguaacacuuuaccuaggagcuaugguacaagcagauuccgguugcguaguuagcuggaagaauaaggagcuaaagugcggcucaggaauuuuuauuaccgauaauguacauacauggacggaacaauauaaauuucaaccggaaagcccauccaaacuagcgagcgcaauacaaaaggcacacgaagaaggaauaugugguauucgaaguguaacacgucucgaaaauuuaauguggaagcaaauaacaccagaacugaaucauauacuuagugagaaugaaguaaaacuuaccauaaugacaggggacauaagaggaauaaugcaggcgggaaagagaagccuucguccccaaccaacugagcuaaaauauucuuggaagacgugggguaaagccaagaugcuauccacggagucccauaaucagacuuuucucauagacgguccugaaacagcagaguguccaaauaccaaccgggccuggaauucauuggaagucgaagauuacggcuuuggagucuucacaacaaacauuuggcuuaaauuaagagaaaaacaggacguuuuuugugacucuaaacuaaugucagcugcgauaaaagauaacagagccgugcaugcugauaugggcuauuggauagagucagcucugaacgauacguggaaaauggaaaaagcaucuuuuauagagguaaagucaugucauuggccaaaaucacacacgcuguggucuaacgggguacuagaaucagaaaugauuaucccaaagaacuuugcaggcccaguuucacagcacaacuauagaccuggcuaccacacacaaacagcaggccccuggcaccuuggaaagcuggaaauggauuucgaucuaugugaaggaaccacaguaguuguuaccgaagauugcgggaaucguggacccagcuuacgaacaacaaccgcguccggaaaauuaauuacggaaugguguugcagaagcugcacccugccacccuuaagauacagaggagaggacggauguugguacggcauggaaauucgaccuuugaaagaaaaggaagaaaaucuaguuaacagcuuaguaacugcaggccauggccaaauagacaacuuuucacugggcguguuggguauggcccuauuccuugaagagauguugcguacucguaucggaacgaagcaugcuauauuacuaguugcuguaucauucguaacgcuaauaaccggcaacaugaguuuuagggauuuaggaagggucaugguaauggucggugcaaccaugacggaugauauugguaugggaguaacauaccuugcgcucuuagccgcauuuaaaguaaggcccacauucgcugcgggacuauuguuaaggaaauuaacaagcaaagaacuaaugauggcgacgauuggaauugcacuacuuagucagaguacuauaccugaaacaauccucgaauugacagacgcguuagcccuuggaaugaugguacuuaaaauaguacgaaauauggaaaaauaucaacuugcagugacaauaauggccauaucuugcgugccaaacgcaguaauauuacaaaacgcauggaaaguaagcuguacuauuuuggcggcuguaucgguaucgccguugcucuuaacuagcagucagcaaaaggcugauuggaucccgcuugcacucacgauaaaaggccugaaucccacggcuaucuucuuaaccacucuuucgcguacuagcaaaaaaaggagcuggccuuuaaaugaggcaauaauggcagugggaauggucucaauuuuagccuccagucuccuuaagaaugacauccccaugacagggcccuuaguagcaggaggucuuuuaacagugugcuacguuuuaaccggcagaucagcugaucuugaacucgagagggcagccgauguuaaaugggaagaccaagcagaaauuagcggaucaagucccauccuuucaauaacaauaucugaagacgguuccaugucuauuaagaacgaagaagaagaacaaacucuuacuauacucauuagaacuggacuacuuguuaucuccgguguuuuuccaguuuccauuccaauaacggcagcagcgugguaucuuugggaaguaaaaaaacagagagccgguguauugugggacguuccuucaccaccuccgguagaaaaagcagaguuagaagacggagcguauagaaucaaacaaagaggcaucuuaggauauucacaaauuggggcaggaguguacaaagaaggaaccuuucauacgauguggcauguaacaagaggugcagucuugaugcaccgagguaaaagaauugagccaagcugggcugacguuaagaaagaucuaauuagcuacggugggggauggaaauuagagggugaguggaaggagggagaagagguacagguauuggcuuuagagccuggcaaaaauccuagggccguacagacaaaaccuggaauauuuaaaacuaauaccggcaccaucggagcugucucacuagauuuuucuccggguaccucuggaaguccaaucgucgauagaaaaggaaaaguuguaggacuauaugguaacggaguagucacgaggagcggggcauacguaagcgcaauugcgcaaacggaaaagagcauagaagacaacccagaaaucgaggaugauauuuucagaaagaaaagauugacuauaauggaccuucauccaggagccggaaagaccaaaagguaucuuccugcaauaguaagagaagcaauaaaacgcggacuacguacacuaauauuagcaccaacacguguuguugccgcagagauggaagaagcccuacgaggauugccaauaagauaccagaccacagcuauaaaaacugaacacacaggaagagaaaucgucgacuuaaugugucaugcgacauuuacaaugcgacuauuaucaccaguaagaguaccgaauuauaauuugaucauaauggaugaagcacauuucacggaucccgcauccauagcagccagaggcuauauaucuacaagaguggagaugggcgaagcagcaggcauuuuuaugacagcgacaccuccaggaucuagagaccccuucccacaaagcaaugcuccgauaauggaugaagagcgggagauucccgaaagaucuuggaauucggggcacgaguggguaacagacuucaaagguaagacagucugguucguaccgucaauuaaagcaggaaaugauaucgcugcaugcuuacggaaaaauggaaagaaaguuauucaauuaucacgaaaaacauuugacagcgaguacguaaaaacaagagcuaaugacugggauuuuguaguaaccaccgauauaagugaaaugggggcaaacuuuaaagcagagagaguaauugauccuaggcggugcaugaaaccugucauccucaccgacggagaggaacggguaauucucgcagguccaaugcccguaacacauaguuccgcagcgcaacgaaggggaagaauuggccguaauccaaaaaacgagaaugaccaauauaucuacaugggagaaccauuagaaaacgacgaagacugugcacacuggaaagaagcaaagaugcucuuggauaauauaaauacaccagaggguaucauuccuaguauguucgagccagagcgagaaaaaguagacgcaauagauggagaauacagacuaagaggagaagcacgcaaaaccuucguggaccucaugaggcgaggugauuuaccaguauggcuggcuuauaaaguagccgcagagggaauuaacuaugcagaucgcaaaugguguuucgacgguauaaaaaacaaccaaauucuugaggaaaacauggaaguugagauauggaccaaggagggagaaagaaaaaaacucaagcccaggugguuagacgcgagaauauauagugacccauuggcguuaaaagaauucaaagaauuugcggcugggagaaagagccucacacuaaacuugaucaccgaaaugggaagacuaccaacauuuaugacacaaaaggcacgaaacgcgcuggacaacuuggcggugcugcauacagcugaagcaggaggaagggcauacaaccaugccuuauccgaauuaccugaaacacuagaaacauuauuacuuuuaacuuuauuagcuacuguuacgggaggaauauucuuauucuuaauguccggaaaaggcauuggaaaaaugacacugggaauguguugcauaauaacagcgucaauacuauuaugguacgcgcaaauucaaccucacuggauugcagcaaguauaauauuggaauuuuuuuuaauuguauuguuaauuccagaaccagaaaagcaacgcacaccucaggacaaccaacuaacuuacguaguuauagcaauauuaaccguaguagcggcaacgauggcaaaugagaugggauucuuagaaaagacaaaaaaagaucuuggacucgguucaauaacaacacaagagucugagucuaauauuuuagauauugauuugagaccggcaagugcguggacuuuauacgcagucgccaccaccuucguaacucccauguuacgucauucgauagaaaauucaucgguuaacgucaguuuaacagcgauagcaaaucaagcaacaguacuuauggguuuaggaaaaggauggccacuuuccaaaauggacaucggcgucccauugcuugccauaggcuguuauucacagguaaacccaauuacauuaacagcugccuuacuacuacuggucgcgcauuaugcaauaauaggacccggcuugcaggcaaaagcaaccagggaagcucagaagagggcugcugcagggauaaugaaaaacccaacaguagaugguauaacgguuauagacuuagaaccgauaccguacgacccuaaauuugagaagcaauuaggucaagucauguuguuaaucuuaugugucacacaaguacuuaugaugagaaccacgugggcucuaugugaagcguuaacauuagcaacggguccaauauccacccuuugggaagggaacccggggcgcuuuuggaacacaacaauagcgguauccauggcaaauauauuuagggguuccuaucucgccggggcaggacuauuguucucaauaaugaaaaacacaacuaacaccagaaggggcacaggaaacaucggagaaacccuaggagaaaaauggaaaagccgucucaacgcacuugggaaaagcgaauuucagauauauaagaaaucugguauccaggaaguagaucggacccucgcaaaagaagggauaaagagaggagaaacugaucaucaugcuguuucaaggggaucagcaaaacugcgcugguuuguagagaggaacauggugacucccgaggggaaaguaguugauuugggaugcggaagggggggauggucauauuauuguggagguuuaaaaaaugugcgagaaguaaaaggauuaacaaaagggggaccagggcaugaagagccaauuccaaugucgacguacggauggaaccuuguacggcuucaaaguggaguggauguauucuucacgccgccagaaaaaugcgacacacugcuaugugacauaggugagucaagcccuaacccaacuauagaagcaggacgcacuuuacguguucugaacuuagucgaaaacuggcuaaacaacaacacccaguuuuguauaaagguacugaaucccuacaugccaucaguuauagagaaaauggaggcucuacaaagaaaauauggaggagcacuaguaagaaacccccuaucuaggaacaguacacacgaaauguauuggguauccaaugcuaccggcaauaucguaagcuccguuaauaugaucucccgcaugcugauaaauagauucacaaugaaacauaaaaaagcaacuuacgaaccagauguagaucugggaucgggaacgagaaacauagguauugaaucagaaauaccaaaucuagauauaauuggaaagcgaauugaaaaaauaaaacaagagcaugaaacgucauggcacuaugaccaagaccauccguacaaaacaugggcuuaucauggaucguaugagacgaaacagacgggaucugcuucuuccauggucaauggaguaguccgccuacuaacaaagcccugggauguagugccaauggugacccaaauggcaaugacugauaccacgccguucggacagcaaagaguuuuuaaagaaaaaguugauacuaggacgcaagaaccaaaagaaggaacaaaaaagcuaaugaaaauaacagcggaauggcucuggaaagaacucgggaagaaaaaaacaccucguaugugcacacgagaagaauucacgagaaaaguacguaguaaugcagcacuuggugcaaucuuuacagaugaaaauaaauggaaaucagcaagagaagcgguagaagaugggcgguuuugggagcugguagaucgugaaagaaacuuacauuuagaagguaaaugugaaacgugcguuuacaauaugaugggaaaaagagaaaagaaacuaggugaauuuggaaaggcaaaaggaucgagagccauuugguacaugugguuaggggcacgauuucuagaguuugaagcacuagguuucuuaaaugaagaucacugguucucaagaggaaacagccuaagcggcguggagggagaggguuuacauaggcuaggauacaucuugagagaugucgguaagaaagaagguggagccauguacgcugacgacacagcugguugggauacaagaauuacacuagaggauuuaaaaaaugaagaaaugguuacaaaccauaugaaaggagaacauaagaaacuagcugaggcaauuuuuaaguuaacauaccagaacaaaguaguaagaguacaaagaccaacacccagaggcaccgugauggauauaauuucgaggcgagaucaacgaggaucagggcagguggguacauauggacuaaauacauuuacgaauauggaggcgcaguuaauuagacagauggaaggggagggaauuuucaagucaauacaacaucuuacugcgacagaagaaauagcuguacaaaauuggcuugccagagucgguagagaaagauuaucgagaauggcaauaucuggugaugauugcguaguaaaaccaauagaugacagguucgcaagugcuuugacugcauugaaugauauggguaagauaagaaaagauauucagcagugggaaccaagccgaggauggaaugacuggacucaaguaccauuuuguucccaccauuuucacgaauugguaaugaaggacggcagaguucucgucguacccuguagaaaccaggaugaauuaaucgggcgagccaggauuagccaaggggcgggguggucucucaaggaaacggcauguuuaggcaagaguuaugcacaaauguggacccuuauguauuuccaccguagagacuuaagauuagcagccaaugcaauauguucagcggucccaucccacugggucccuacuaguaggacgacuuggucaauccacgcgaagcacgaauggaugacuacggaagacauguuggcagucuggaauagaguuuggauucaagaaaauccauggauggaagauaaaacaccagucgaaucuugggaggaaguucccuaccugggcaaacgagaggaccaauggugugguucauuaaucggguuaacaaguagagcaacaugggcaaagaacauacaaacugcaauuaaccagguaagaagccuaaucggcaacgaggaguacacggauuacaugccuucuaugaagagauuccgaagagaggaagaagaagcuggaguacuuugguag

SEQ ID NO: 22438 - RNA, 9876 nt, Artificial Sequence
  derived and/or modified CDS sequence (opt6) from DENV-2__EU482751__SS-prME
acugcuggggugauuguaaugcuuauaccuaccgcaauggcauuucaccuaacuacuagaaauggggaaccacauaugauaguuggccgacaagaaaaagggaaaucauuacucuuuaaaacugaagacggcgugaauauguguacccuuauggcaauagaucugggagaauugugugaagauacaaucaccuauaaauguccauuacuuagacaaaaugaaccagaggacauagacuguugguguaacucaacgucgaccuggguaacuuauggaacauguacuacuacaggggaacaucgaagagaaaagcguucagucgcccuagucccccauguaggaaugggacuagaaacaagaacagagaccuggaugucuagugaaggggcguggaaacauguucaacgaauugaaaccuggauucugcgccaucccggauucacgauuauggcugcaauacuggcauauacuauuggaacuacgcauuuccaaagagcacuaauuuuuauauugcuaacagcuguagcaccaagcaugacuaugcgaugcauuggaaucucuaacagagauuucguagaaggcgucucagguggaaguuggguugauauuguuuuagaacacgggagcuguguaacaacaauggccaaaaacaaaccuacacuugauuuugaauugauaaaaacagaagccaaacagccagcaacguugcgaaaauauugcauagaggcuaaacuuacuaauacgaccaccgaaucaagauguccgacacaaggagaaccaucgcugaaugaggaacaagauaaacgcuuuauauguaaacacaguaugguggacagaggcuggggaaacgguuguggccucuuugggaaaggaggcauuguaacgugcgcgauguuuacguguaaaaagaacauggaagggaagguugugcagcccgaaaauuuggaguauacaauuguaaucaccccucauucaggagaggagcacgcuguaggcaaugacacaggaaaacacgguaaagaaauaaagauaacaccucaaaguucuauaaccgaggccgaguugacgggauauggaacagucacgauggaauguaguccuagaacgggucuugacuucaacgaaaugguccuguuacaaauggaggauaaagccugguugguacacagacagugguuccuagauuuaccucuuccauggcucccuggugcagauacucaggggucaaacuggauacaaaaggaaacccuagucacuuuuaagaacccacacgccaagaaacaagauguaguuguucuaggaucccaagaaggugcgaugcauacagcguuaaccggagcaacugagauacaaaugucaagugguaaccuuuuauuuacgggccacuugaaaugucgccuccgaauggacaaauugcaacucaaaggcauguccuauucaauguguacuggaaaauuuaaaauuguaaaggaaauagccgaaacccaacacgggacuauaguaauccgaguacaguaugaaggugauggaucaccauguaaaauaccuuucgagauaacagauuuagagaagagacauguacuaggaagauugauaacuguaaacccuauagugacagaaaaagauagccccguaaacauagaagcggaaccaccuuucggagauucuuauauuaucauaggcguggaaccaggacaacuaaaguuaaauugguuuaagaaagggaguucaauuggacagauguuugaaacaacuaugcguggcgcaaaacggauggcaauuuuaggagauacugcaugggauuuuggcagucugggaggcguauuuacgaguauagguaaagcacuccaucagguauucggagcuauuuacggugccgcuuuuucaggaguaucuuggacaaugaaaauacuaauaggcgucauaauaacguggauaggaaugaacucaaggucaacaagccuuagcguaagucuaguccuaguuggcgucguuacucuuuaucugggcgcaguggugcaagcugacuccggcugugucguuucauggaaaaauaaagagcuuaaguguggcagcggcauuuucauuaccgacaauguacauacuuggaccgaacaauauaaguuucaaccagaaaguccaucgaaacuugcaucagcgauacaaaaagcacacgaagaaggaauauguggaauaagaucugucacaagacuugaaaaucugauguggaaacagaucacgcccgaauuaaaccauauccuaucugaaaaugagguaaaacuaaccauaaugacaggagauaucaagggcauaaugcaagcuggcaaaaggagcuuaagaccccaaccgaccgaauuaaaauacaguuggaaaacaugggggaaagcaaagauguugucuacagaaucgcacaaccaaacuuuccugauugauggccccgaaaccgccgaauguccaaacacaaauagagcauggaacaguuuggaaguggaagauuaugguuuuggaguuuuuacaacaaacauaugguuaaaauugcgagaaaaacaagauguauuuugugacucaaaguuaaugagcgccgcaauuaaggauaaccgagcaguacaugcugauaugggauauuggauugaaucugccuugaaugauacauggaaaauggagaaagcguccuucauugaagugaaaucgugucauuggccgaaaagucacacacuauggucaaauggagucuuagaaagcgaaaugauaaucccuaagaacuuugcuggaccgguaagccaacauaauuacagaccaggguaccacacacaaacugcgggaccauggcauuuagguaaauuagaaauggauuuugacuuuugugaaggaacgaccgucgucguaacagaagauuguggcaaucgugguccaagucucaggaccacaaccgcgaguggcaaacuaauaacagaauggugcuguagaucaugcacguuaccaccguugagauaucguggagaagacggcugcugguauggaauggaaauacgcccuuuaaaagagaaagaagaaaauuugguaaacagccuaguuaccgcgggucauggacagaucgacaacuuuagccuugguguucuugggauggcucuuuuucucgaagaaaugcucagaacuagaauugggaccaaacaugcaauauuacugguagcaguaaguuuuguuacauuaauaaccgguaacaugucguucagagauuuagggagaguuaugguaaugguuggcgcuacuaugacagaugauauagguaugggaguaacuuacuuggcuuugcuggccgccuucaaaguacgaccaacauucgccgcuggacuccuacugcguaaguuaacaaguaaagaguuaaugauggcgacaaucgguauagcuuuguuaucccaaucaacuauacccgaaacaauauuggaacuaacagaugcacucgcacucgggaugaugguacuuaaaauagucagaaauauggagaaauaucagcuagccguuacuaucauggccauaagcuguguacccaaugcaguaauauugcaaaaugccuggaaaguuuccuguacuauucucgcagcaguuuccguuucaccacuguugcuuacaucaucacaacaaaaagcugacuggauccccuuggcgcugacuaucaaagggcuaaauccgacagcgaucuuucuaacaacuuugagucggaccagcaagaagagaucuuggccauuaaaugaagcaaucauggcuguugggaugguuuccauacuugcuucaaguuuacugaaaaaugauauaccuaugacuggaccacuuguagcgggaggccuuuuaacaguauguuauguacuaacaggacgaagugcugacuuagaguuggaacgugcggcagaugucaagugggaagaucaagcagaaauuucagguucaucgccuauauuaagcauuacaauaucagaggauggaucuaugagcaucaaaaaugaagaagaagaacaaacuuuaacaauacuaauaagaacaggauuauugguaauaagcggaguauuuccaguguccauccccaucacagcagcagcaugguacuuaugggaagucaagaaacagcgagcagggguucuaugggauguaccaaguccaccuccgguagaaaaagcagagcuugaagauggagcauacaggauaaaacagcgaggaauacucggauauagccaaauaggugcuggugucuacaaagaaggaacuuuccauaccauguggcacguuacaagaggggcaguccuuaugcacagggguaagcguaucgaaccgucaugggcugaugucaaaaaggaucuaauuucuuaugguggcgguuggaaguuagaaggagaguggaaagaaggagaagaaguccagguguuagcucuagagccaggcaaaaauccacgugcaguccaaacaaaaccaggaauauucaaaacuaauaccggcacaauaggugcuguuucucuggacuuuuccccaggaaccucuggcucuccuauaguugauagaaaaggcaaaguaguaggccuauacggaaauggcguuguaacucgcucgggcgcauacguuucagcaauugcacaaacugaaaagucgauugaggacaauccagaaauagaagacgacauuuuuaggaagaagcgacuuacgauaauggauuuacauccgggagcgggaaagacgaaacgauaucuuccagcgauuguaagagaagcaauaaaaagaggcuugagaaccuuaauacuggcaccaacacggguaguagcagcagaaauggaggaggcauugcgcggacuacccauaagguaccaaacgccagcaauaaaaacagaacauacuggacgugagaucguagaucuuaugugccaugccacguuuacaaugagacuacuaagcccaguuaggguaccuaacuauaaccuaaucaucauggaugaagcacauuucacggacccagcuaguaucgcugcaagagguuauauaucaacgcguguggaaaugggugaagcagcagggaucuucaugaccgcaacaccaccggggucucgugacccauucccucagaguaacgcuccuaucauggaugaggaacgcgagauacccgaaagauccuggaacucaggucacgaguggguuacagauuucaaagguaaaacugugugguuuguacccucgauaaaagcagguaaugauauugcugcauguuugaggaaaaauggcaagaaaguuauacaacucucaaggaaaacuuucgacucugaauaugucaaaacccgugcuaacgacugggauuucguaguaacaacagacauaucugaaaugggugcgaauuucaaagcagaacgaguuauugacccccggagauguaugaagccuguaauacuaacggauggggaagagagaguaauccuugcaggccccaugccagugacacauagcagcgcugcucaaaggagggguaggauuggacguaaccccaaaaacgaaaaugaucaauauauauauaugggugaaccauuagagaaugacgaagacugcgcacauuggaaagaagcaaaaauguuauuagacaacauaaacacaccagaagguauaauuccuucaauguuugaaccagaacgagaaaaaguagacgcaauagacggagaauauaggcuacgcggagaagccagaaagacauuuguagacuuaaugagaagaggugacuuaccuguguggcuagcauauaaaguugcagcagaggguauaaauuacgcagauagaaaaugguguuucgauggaaucaaaaacaaucagauacuagaagaaaauauggaaguggaaaucuggacaaaagaaggugaaagaaagaaacuuaaaccaagguggcucgacgcaagaauuuacucagacccauuagcauuaaaagaauuuaaggaguucgccgcagguaggaaauccuuaacgcuaaaucuaauaacggaaaugggucgauuaccaacguucaugacucaaaaagcacguaacgcacuagacaaucuagccguacuacauacugcugaagcaggagggcgugcauauaaucaugcacuaagcgaacucccagagacgcuugaaaccuuacuacuucuuacguuauuagcuaccguuacaggggguauuuucuuguuuuugaugucagggaaagguauagguaaaaugacguuggguauguguuguauaauaacagccagcauauuauuaugguaugcacaaauucaaccgcacuggauagcagccaguauuauacuagaguucuuucuuaucguuuuacuuauccccgagccggaaaaacagcguacuccucaagauaaucaauuaaccuauguuguaauagccauuuugaccgucgucgcggcgaccauggcaaacgagaugggguuuuuagaaaagaccaagaaagaucuugggcucgggucuaucacuacgcaagaaucggaaucaaacaucuuggacaucgacuugagaccagcaucugccuggacacucuaugcgguugcuaccacguucguaacaccaauguuaagacauaguauugagaacucgagcguaaauguuucuuuaacagccauagcgaaccaagcgacgguacugauggggcuagggaaagguuggccccuaucgaaaauggauauugguguaccguuacucgccauaggauguuacagccaagucaacccaaucacauugacagcagcuuuguuacuauuagucgcacauuacgcgauaaucgguccaggccuacaagcaaaggcaacccgcgaagcucagaaaagagcugcagcagguauaaugaaaaauccaacggucgaugggauuacgguuauagaucuagaaccgaucccauaugacccaaaguucgagaaacaauugggucaaguuaugcuucuuauauugugcgugacacaaguacugaugaugagaacaacgugggccuugugugaagcucuuacgcuggcgacaggccccauaucaacgcuaugggaaggaaacccaggaagguuuuggaauacuaccaucgccguaucaauggcuaacauuuuucgagguagcuauuuagcaggggcagggcuucuguuuucaauaaugaaaaacacuacaagcacaaggagaggcaccgguaauauaggagaaacacucggagaaaaauggaaaucgcgacuaaacgcccucggaaaaagugaauuucaaauauacaaaaagaguggaauacaagagguggauagaacucuggccaaggaagggauaaagagaggagaaacagaucaccaugcggucagucguggaucagccaagcuaaggugguuugucgaacggaacaugguaacgccagaaggaaaggucgucgauuuggguugugggagggguggauggaguuauuauugugguggcuugaagaacguacgugagguaaaaggucuaaccaagggaggcccggggcaugaagaaccaaucccuaugagcacauaugguuggaaucugguaaggcuccaaucagggguugacguuuucuuuacaccgccagagaaaugugacacacuuuuaugugacauaggugagaguagcccaaauccuacuauugaagcaggacgaacacucagggucuuaaacuuaguagagaauugguuaaacaauaacacacaauuuuguauaaaaguacuaaacccauauaugccuucggugauagagaaaauggaagcucuacaacgucaauacggaggugcccuagugagaaaccccuuaucacggaacaguacucacgaaauguacugggucagcaacgcaacagggaauauugugagcaguguaaacaugauuagccgaaugcuuaucaacagguucacaaugaagcacaagaaagcgacuuaugagccagacguggauuuaggaucaggcacaaggaauauaggaauagaaagugaaauaccuaaccuagacauaauugggaagaggaucgagaaaauuaagcaagagcaugagauaucauggcauuaugaccaagaccacccauauaaaacuugggcauaucauggaagcuacgagaccaaacaaacuggaagcgccuccucgauggucaauggggugguucgauuguugacuaaacccugggauguuguaccuaugguaacccaaauggccaugaccgacaccacaccauuuggucaacaacguguauucaaagaaaaagucgauacucggacacaagagccaaaagaagggaccaagaaacuaaugaagauaacagcugaauggcucuggaaagaacuuggaaagaagaaaacaccaaggauguguacucgagaagaauuuacaagaaaaguaagaucaaaugcugcacucggagccauauuuacggaugagaauaaauggaaauccgcgagggaagccguagaagacggcagauucugggaguuaguggacagagaaagaaauuuacaucuggaagggaaaugcgaaaccugcguauauaacaugaugggcaaaagagaaaagaaauugggcgaauuugguaaagcgaaagguucacgagcuauuugguacauguggcuuggagcucgcuucuuggaguucgaagcacugggcuuuuuaaacgaagaucauugguuuaguagaggaaauagcuuaucaggaguugagggagaaggauuacauaggcugggauauauacuacgagacguaggaaagaaagaaggaggugcaauguaugccgaugauacagcaggaugggacacaagaauuacacucgaagacuuaaagaacgaggagaugguaacaaaccacaugaaaggagaacauaagaagcuagccgaagcuauauucaaauuaacuuaucaaaacaaaguugugcgaguacaacgacccaccccgagaggcaccgucauggauauaauuucucgacgggaucagcgaggaucagggcaaguaggaacuuauggauuaaauacuuucacaaacauggaagcacaacuaaucagacaaauggagggcgaaggcauauuuaaaucuauucaacaucuaacagcaaccgaagaaauugccguccaaaauugguuagcaaggguuggaagagaacgauuaucaagaauggcaauaucaggcgacgauuguguaguaaaaccaaucgaugauagguuugcaucagcauuaacugcacuaaaugacaugggaaaaguacgaaaggauauccagcaaugggaaccgucaagaggcuggaaugacuggacccaaguuccauucuguucucaccauuuccacgaacucgucaugaaagauggacgaguccuaguaguaccaugucggaaucaagacgaauugauagguagagcucgaaucucacaaggcgcugguuggucacuuaaggaaacugcaugccuaggaaaaucguaugcucagauguggacccuaauguauuuucauaggagggaucuacgguuagcugccaacgcaauaugcucggcaguaccgagccacuggguaccaacaucgagaacaacauggaguauacaugcgaaacaugaauggaugacuaccgaagacauguuagccguuuggaaucgaguguggauccaagagaaucccuggauggaagauaaaacaccgguagaaucuugggaagaaguuccauaucuagguaagagagaagaucagugguguggaucgcucauaggucuuaccagcagagccacuugggcuaaaaacauccaagcagcuauaaaucagguacggucauuaauagguaacgaagaauauacugauuauaugccauccaugaaaagauuccgcagagaagaggaagaggcaggaguucuaugguaa

SEQ ID NO: 22439 - RNA, 9876 nt, Artificial Sequence
  derived and/or modified CDS sequence (opt6) from DENV-2__GQ868604__SS-prME
acagcgggagugauaguaaugcuuauaccaacagcaauggcauuucaccuuacaacuagaaauggagagccccacaugauaguuggaagacaagaaaaaggaaagagcuuacuuuuuaaaacagaagacgguguuaacaugugcacacuaauggcuauagaucuaggugaauuaugcgaagauacaaucacauauaaaugcccauuauuaagacaaaaugaaccugaagauauagauugcugguguaauucaacgucgacaugggugacuuaugguacuugcacuacuacuggggaacaucgacgagagaaacggucagucgcccuaguaccucacguaggcaugggucuggagacgcgaacagagacguggaugaguuccgaaggugcauggaaacacguacaacgaauagaaacuuggauuuuacgacauccuggcuuuaccauaauggccgcaauauuggcguauacaaucgggacgacacauuuccaacgagcuuuaauauucauucuucuaacagcuguagcgccaagcaugacuaugcguugcauaggcaucucuaaccgagauuucguagaaggugugucagggggcaguuggguagauauaguauuggagcaugguaguugcguaacaacaauggcgaaaaacaaaccaaccuuggacuucgaguuaauaaaaacagaagcaaaacaaccggcgacgcuaagaaaauacuguaucgaagcuaaacuaacaaauacuacgaccgaauccagaugccccacgcaaggggagccuucauuaaaugaagaacaagauaaaagauuuauuuguaaacauaguaugguagaucggggaugggggaauggaugcggccuguuuggaaaaggagguauuguaaccugcgcaauguuuacauguaagaaaaauauggaagggaaagugguacagccggaaaaucuagaauauacaauuguaaucacgccucauuccggcgaagaacacgcaguagguaaugauacgggaaaacacggaaaagaaauuaaaauaacaccgcaauccagcauaacagaagcugaauuaacuggcuauggcacuguaaccauggaaugcuccccaagaacgggauuggacuuuaaugaaaugguguuauuacaaauggaggauaaagcauggcuaguacauaggcaaugguuccuagacuuaccacuaccauggcuuccuggugcugacacgcagggguccaauuggauacagaaagagacccuaguuacuuucaaaaauccacaugcgaagaaacaagauguaguggugcuaggcagccaagagggugcuaugcacacagcacuuaccggagcaaccgagauccaaaugaguuccggaaaucuacucuucacgggacaucugaaauguagguuaagaauggacaaacuccagcugaaaggaaugucuuauagcauguguaccggaaaauucaaaaucgucaaagaaaucgcagaaacucaacacggaacaauagugauaagagugcaauacgaaggcgauggaucuccauguaaaauuccuuuugaaauaacggacuuagagaaaagacacguauuaggcaggcugauuacuguaaauccgauaguuacugaaaaagauucacccgugaauauagaagcugagccaccauucggggauagcuauauaauaauaggcguugagcccggccaacucaaacugaacugguucaagaaaggaucaagcauaggacaaauguuugagacuacaaugcgcggugcaaaacgaauggcaauuuugggugacacugcaugggauuucgggaguuuaggcggaguguuuacgagcauaggcaaagcacugcaccagguauucggagccauauacggggccgcauuuagcggcguaucauggacaaugaaaauuuuaaucgguguaauaauuacauggauaggaaugaacucgcgcucaaccagcuuaagugucucguugguguuaguugguguaguaacacuauauuuaggagcuguuguacaggcagacaguggaugcguugugucauggaaaaacaaagagcuuaaaugcggcagcggcauauuuaucacggacaacguacacaccuggacagaacaauauaaauuucaaccagaaucgcccucgaaauuagccucggcuauucaaaaagcacacgaggaaggaaucugcggcauuaggaguguaacucgccuggaaaaccuuauguggaaacaaauuaccccagaacucaaccacauacugucagaaaacgagguaaaauuaacgauaaugacuggagauauaaaaggaaucaugcaagcaggaaaaaggagcuuacgaccgcagccaaccgaacugaaauacucauggaaaacuuggggaaaggcgaaaauguuaucuacugaaucucauaaucagacuuucuugaucgauggaccagaaacagccgaauguccuaacaccaacagagccuggaacagucuugagguagaggacuauggauuuggcgucuuuacaaccaauauaugguugaagcuaagagagaaacaggacguuuucugugacucaaaauuaaugagcgcagcaauaaaagauaacagagcaguccacgcagacaugggcuauuggauagagucugcucucaaugauacauggaagauggaaaaagccagcuucauagaagucaaguccugucauuggcccaaaucucauacacucuggucaaacggcguacuugaaagcgaaaugauaauacccaaaaauuuugcaggacccgugucccagcauaacuauaggccaggcuaccauacgcagacugcugguccuuggcaucuagguaaacuugaaauggauuuugacuuaugugaagguacaacaguggucgugacagaagauugugguaaccgagguccaagucugcgaacuaccacagccucuggcaaacuaaucacggaaugguguugucguaguugcacacuaccaccguuaagauaccggggagaagacgguugcugguacgggauggaaauaagaccacucaaagagaaagaagagaauuuaguuaauucucuagugacugcaggccgaggucagaucgacaauuucucgcuagggguacucggaauggcucucuuccuugaagaaauguuaagaaccaggauuggaacgaaacacgcgauauuacucguagcuguuucauucguaaccuuaauuacuggaaacauguccuuccgugacuugggcaggguaaugguuauggucggggcaacaaugacggaugacauagggaugggagucacauaucucgcucuacuugcugccuucaaagugcgcccgacauuugcggcuggauuguuguuacgcaaacuuacaaguaaagaauuaaugauggccaccauugguaucgcauuauuaucccagucaacuauaccagaaaacauauuagaacuaacugacgcuuuagcucugggaaugaugguacugaaaauaguccguaacauggaaaaauaucaacuagcaguaacuauaauggcuauaucauguguaccuaacgcugugauuuuacaaaaugcauggaagguaucgugcacaauacuagcagccgucaguguaaguccauuacuacugacguccagucaacagaaagcagauuggauuccuuuggcuuugaccauuaaaggacugaacccaacggcaauuuuucuuaccaccuuaucgagaacaagcaagaaaagaucauggccuuugaacgaagcuauaauggccguugguaugguuucuaucuuagccucuuccuuacugaaaaacgacauuccaaugacgggcccgcucguagcuggcggacuucuaacaguauguuacgucuuaacaggaaggucagcagaucuugaauuagaaagggcagcagacguuaaaugggaagaucaagcagaaauaucuggaaguagccccauauuauccauaacaauaucagaagacggaucgaugucaauuaaaaaugaagaagaagaacaaacguuaaccauauugauaagaacagggcuccuugucaucucgggaguuuuccccgugaguauuccuauaacugcagcagcgugguacuuaugggaagucaagaaacaaagagccggggugcuaugggacguaccaucaccaccuccaguagaaaaagcagaauuagaggacggagcuuaucguauuaaacagagaggaauccuggguuacucacaaaucggugcaggcguuuauaaagaagguacuuuccacacgauguggcauguaaccagaggagcaguacuaaugcauaggggcaaaagaauugagccaaguugggcugacguaaagaaggaucugauuagcuaugggggugguuggaaauuagaaggagaauggaaagaaggggaagagguacaaguccuggcacuagaaccugggaaaaauccucgggcaguccaaacaaaaccaggaauauuuaagaccaauaccggaacaaucggagcugucagcuuagacuucucuccugggacaucuggaucacccaucguagaucguaaagggaaaguaguaggucuuuacgguaauggcgucguuacacgcucaggggcuuacguaagugcuauugcccaaacugaaaaaucaauagaggacaauccugaaaucgaagacgauaucuuuagaaagaaaagacuuaccauuauggaucuacauccuggggcagguaaaacaaagagauaccuaccagcgaucguacgugaagcaauaaaaagaggacugaggacguuaauccucgcaccuacacgaguugucgcagccgaaauggaggaggcauuacgaggacuccccaucagauaucaaacgccagcuaucaagacagaacacacggggcgagaaauuguagauuuaaugugccaugcuacuuucacuaugcgguuacuuucuccgguuagaguaccaaauuacaauuuaaucauaauggaugaagcacacuuuacagacccugccagcauugcagcgagaggauacauaucaaccaggguagaaaugggggaagcagcagguauauucaugaccgccacuccaccgggaucaagagaccccuuuccgcaaucuaacgcaccuauaauggacgaggaacgggaaauucccgagagaucguggaacucaggacacgaauggguaacugauuuuaaggguaagaccgugugguucguccccucaauaaaagcagggaaugauaucgcagcguguuuacgaaagaaugggaagaaagugauucaauuguccagaaaaacuuuugacagugaguauguuaaaacgcgcgcuaaugauugggacuuuguuguaacaacagacaucucugagaugggcgcuaauuucaaagccgaacggguuauagauccacgacgcuguaugaaacccguaauauuaacggauggagaagagaggguaauauuagccggaccaaugccagugacacauucuucagccgcucaaaggagggggcggauaggcagaaaccccaaaaaugaaaaugaccaauauauauauaugggugaaccacucgagaacgaugaagauugugcccauuggaaggaagcuaaaaugcuucuagacaacauuaauacucccgaaggcaucaucccuucaauguucgaaccagaacgagagaagguagacgcaauagauggagaauaccgucuaagaggcgaagcacgaaaaacauuuguagaccugaugagacguggugaucugccagucuggcuagcguacaaagucgcagcagagggcaucaacuacgcagauagaaaaugguguuucgauggaauuaaaaacaaucaaauauuggaagaaaauauggaaguugaaauauggacaaaagaaggugaaagaaagaaacugaaaccgagauggcuugacgcuaggauuuacagugacccguuggcauuaaaagaguuuaaagaguucgccgcagguagaaaaagccuuacucuuaacuuaauuaccgaaauggggagacugccaacuuucaugacacagaaagcuagaaacgcgcuugacaacuuggccgugcugcacacagcagaagcuggugggcgagccuacaaucaugcacuaagcgaacuaccagaaacauuagaaacauuauuauugcugacacuucucgcaacaguaaccgguggaauuuuccucuuucucaugucaggcaagggaauaggaaagaugacgcuagguaugugcuguauaauaacugcuucgauauuacugugguaugcccaaauucaaccucacuggauagcagcaaguauaauccuagaauuuuuccugauaguuuuacuuauuccagaaccagaaaaacaacgaacaccacaagauaaucaacuuacauacgucguuauugcaauacuaaccguaguugcagcaacuauggcuaaugagauggguuuucuggagaaaaccaagaaagauuuagggcucggcucaauaacgacucaggaaucggaaagcaauauacuagacauagauuugcgcccggcaagugcuuggacucuuuaugccguugcaaccacguuuguaacuccaauguuacgucauucgauagaaaacucgaguguaaaugugaguuuaacggcuauagcaaaucaagcaacaguacuaaugggauuggguaaaggauggccgcuaucaaaaauggacauaggugucccacuauuagcuauaggaugcuacagucaagucaauccgauuacuuuaacugcugcguuguuacuccuaguugcacacuaugccauuaucggcccaggacuacaagcuaaagcgacaagagaagcacagaaaagagcugcugcgggaauaaugaagaauccaaccguagauggaauuacagucaucgaucuagaaccaaucccauacgauccaaaguucgaaaaacaauuagggcaggucauguuguuaauauuguguguaacucaaguauuaaugaugaggacaaccugggcccuaugugaggcuuugacacuagcaacgggaccgauaucuacacugugggaagguaauccuggccgguuuuggaacacuacaaucgcuguaagcauggcaaauauauuccggggaucauauuuggcaggagccggauuauuauuuuccauaaugaagaauacaacuuccacacgccgugguacggguaacauaggagaaacucuaggcgaaaaauggaagucgcgucugaaugcccuagguaaaucugaauuucaaauuuacaagaaaucugguauacaagaagucgauagaaccuuagccaaagaagggauaaaaagaggggaaacagaucaccaugcaguaagcagaggaucagcuaaguuaaggugguuugucgaacguaauaugguaaccccagaaggaaaaguaguagaucuugggugcggaagaggaggguggucauauuacugcggcggacucaaaaauguacgugaagucaaagggcucaccaaaggggguccuggacacgaagaaccaauuccaaugucgacauacgguuggaaucuugugcgccuccaauccggaguugauguguucuucacucccccagagaaaugugauacacuacucugugacauuggugaaaguucuccgaauccaaccauagaagccggucgaacauuaagaguucuaaacuuaguugaaaauuggcuaaacaacaauacccaauucuguauaaaaguucuuaauccuuacaugccaagcgucaucgagaaaauggaagcccuucaacgacaguacggaggagcauugguuagaaacccauuauccagaaauucuacgcacgaaauguacuggguuucuaacgcuacagggaauauagucucuagcguaaacaugauuucacgaaugcuuauaaaccgauucacaaugaaacacaagaaagccacauaugaacccgauguagaucuuggauccggaacacggaauauaggaaucgagagugaaauuccaaaucuggauaucaucggaaaaagaauagagaaaauaaagcaggaacacgagauaucauggcacuacgaccaagaccaucccuacaaaacaugggcauaccacgguaguuacgagacaaaacagacaggaucggcaucaucgaugguuaacgggguuguacgucuucucaccaaacccugggaugugguucccaugguuacacaaauggcuaugacggauacaacgccguuuggccaacaacguguauucaaagagaaaguugacacacgaacgcaagaaccaaaagaagguaccaagaaauugaugaaaauuacagcugaguggcuauggaaagaguuaggcaagaagaaaacaccuaggaugugcacaagggaagaguuuaccaagaaagugaggucuaacgcugcauuaggagcaauauucaccgacgaaaacaaauggaaguccgcuagagaggcaguagaagauggacguuucugggaguuaguggauagagaacgaaaucuucacuuagaggguaagugcgagacaugcguuuacaauaugauggguaagagagagaagaaauuaggcgaguuuggaaaggcgaagggaucucgggcgauaugguacauguggcuaggagcuagguuucucgaauuugaggcccuuggcuucuugaacgaagaucacugguucagccgagguaacagcuugucaggcguugaaggcgaaggucuucauaggcuagguuacauccuuagggaugucgguaagaaagagggcggcgcaauguaugcugacgauacggcagguugggauacacgcauaacgcuugaagaucugaaaaaugaagagaugguuacaaaccauaugaagggagaacauaagaaacuugccgaagcuauauuuaaacuuacguaucaaaacaaagucguucgaguacaaagaccaacaccgagagggacggucauggauauaauuucuagaagagaucaacgcggaucuggacaagucgguacguauggauuaaauacauuuaccaauauggaagcucaacuuauucgacaaauggaaggugaaggaauauucaaaucgauucagcaucuaacugcgacagaagaaauagcaguucaaaacuggcuagcccggguugggcgugaacgacuuucccgaauggcuauuaguggugacgauuguguagucaaaccgauagaugauagauuugcaucagcauuaacagcuuuaaacgauauggguaaagugaggaaggauauucaacaaugggaaccaucaaggggauggaaugauuggacccaaguaccuuuuuguagucaucauuuccacgaacucguaaugaaagauggaagaguguugguaguaccuugccguaaucaagaugaacuaauugggcgagcuaggauuucucaaggagcuggcuggucauuaaaggaaacugcaugucucggcaaaaguuacgcacaaauguggacacuaauguauuuccacagaagagaucucagacuggcggcaaacgcgauauguuccgcggucccaucucauuggguacccaccucgcguacuacauggaguauucaugccaagcacgaauggaugacuaccgaagacaugcuagcaguguggaauaggguauggauacaagagaaccccuggauggaagauaagacuccgguagagucaugggaagaagugccuuaucucggcaaacgagaagaucaauggugugguagcuuaaucggacuaacaucaagagcaaccugggcaaagaauauacagacugccauuaaucagguuaggaguuuaauagguaaugaggaauauaccgacuacaugccaaguaugaaacgauuucguagagaagaagaagaagcggggguacugugguaa

SEQ ID NO: 22440 - RNA, 9876 nt, Artificial Sequence
  derived and/or modified CDS sequence (opt6) from DENV-2__EU482752__SS-prME
acugcugggguaauugucaugcuaauaccaaccgcuauggcauuucaucuaacuacaagaaauggugaaccgcauaugaucguaggacgucaggaaaaaggaaaaucauuauuauuuaaaaccgaagacgguguaaacauguguacuuuaauggcuauagaucuaggagaauuaugcgaagacacgauaacuuacaaauguccauuauuaaggcaaaacgaaccagaagacauagauuguuggugcaauaguacaagcacuuggguaacuuauggcacaugcacaacaacaggugaacacagaagggagaaaagaucugucgcguuagucccacacguaggcaugggacuggaaacaagaacagaaacuuggaugucaagugaaggugcauggaaacauguacaaagaauugaaacauggauauuaagacauccuggauuuacuauaauggcagcgauauuagcauacacgaucgguacgacacacuuucaacgagcauuaauuuucauauuacugacugcaguugcgcccucuaugacgaugagaugcauaggaauuucuaauagagauuuugucgaaggggugucuggcggcucguggguagauauuguacuagaacaugguucguguguaacuaccauggccaaaaauaaaccgacuuuagauuuugaauuaauuaaaacagaagcaaaacagcccgcaacccuucggaaauacuguauagaagcaaaacuaacaaauacuacuaccgaaucacguugcccuacacaaggagaaccaucuuugaaugaggaacaagauaaaagauucaucugcaaacauagcaugguggauagggguugggguaauggaugcggauuguucgguaaaggaggaaucguuacuugcgcaauguuuaccugcaagaaaaauauggaaggcaaaguuguacaaccagaaaacuuagaauauacaauuguaauaacuccgcacucaggcgaagaacacgcaguaggcaaugacacugggaaacaugguaaagagaucaaaauaacuccacaaucuaguauaacugaagcagaacuuacagguuacggaaccguuacuauggaguguagcccacguacuggucuugacuuuaacgaaaugguuuuauugcagauggaagauaaagcaugguuaguacauagacagugguuuuuggaucuuccguuaccauggcuacccggagcagacacccaaggcucaaauuggauacaaaaagagacguuggucaccuucaaaaacccccaugccaagaaacaagauguuguaguauugggaagucaggaaggugcaaugcauacagcacuaacgggcgccacugaaauccaaaugaguucugguaacuuacuauucacuggacacuuaaaaugucggcucagaauggauaaauuacaacuaaaaggaaugaguuauuccaugugcaccgguaaauuuaaaauaguaaaggaaauagcugaaacucaacauggaacgauagugauuagaguacaguaugaaggagacggaucgccguguaagauaccguucgagauaacggaccuugaaaagcgacacguacuaggaagauuaauaacaguaaauccuauaguuacugagaaagauagcccgguaaacauagaagcggaaccuccauuuggagauucauauauaauaauaggaguagaaccaggucagcuaaaguuaaauugguuuaagaaaggaaguaguaucggacagauguucgaaacuacaaugagaggagccaaaaggauggcuauccugggagauaccgcuugggauuuugggaguuuagguggagucuucacaaguauaggaaaagcgcuccaucagguauucggugcaauuuauggagccgcauuuagcggaguaagcuggacaaugaaaauacuaauagguguaauaauaacguggauaggaaugaacucacgaucuaccucacucucaguuagcuuaguccuaguaggcguuguaacguuauacuuaggagcuaugguacaggcagauucgggcugugucguaaguuggaaaaauaaagaacuaaagugugggucuggaauuuucaucacugauaacguacacaccuggaccgagcaauacaaguuucaaccagaaaguccgagcaaguuagccuccgccauacaaaaggcgcaugaggaaggaauaugcggaaucagaagugucaccagacuagaaaacuuaauguggaaacagauaacaccugaauuaaaucauauacuauccgaaaacgaaguuaaacucacuaucaugaccggcgauauacgcggcauuaugcaagcuggaaaaagaucauuaagaccacaaccuaccgaauuaaaauauucuuggaaaaccuggggaaaagcgaagaugcuuagcacagagucucauaaucaaacauuucuuauugacggucccgagacugccgaauguccaaacaccaacagagcauggaacagccuugaaguagaggacuauggauuuggaguuuucacaacaaacauuuggcuaaaacuucgcgaaaaacaagacguauuuugcgauuccaaacuuaugucagccgcaauaaaagauaauagagcuguacacgcggacaugggguauuggauugaaucugcacuuaacgauacauggaaaauggaaaaagcgucguuuauugaaguaaagagcugucauuggccaaaaucucacaccuuauggucaaaugggguacuagagagugaaaugaucauuccaaagaauuucgcgggcccuguaucucaacauaauuaccgaccgggauaucauacgcaaacugcaggaccauggcaccuugguaaacuggaaauggacuucgauuuaugcgagggcacuacugugguagugaccgaagacugcggaaauagaggaccaucuuuacgcacuacgaccgcuaguggaaaacuaauaacagaaugguguugucgaucaugcacuuuaccaccguugagauaucgaggcgaagacgguuguugguacgguauggaaaucaggccacugaaggaaaaggaggaaaacuuaguuaauagucucguuacugcgggacacggacaaaucgauaacuuuaguuuaggcguauuaggaauggccuuauucuuagaggaaaugcuaagaacacgaaucgggacaaaacaugcaauacuacuggucgcaguaucauuugucaccuuaaucaccggaaauaugucuuucagggaccuagggaggguuaugguuaugguaggagcaacaaugacugaugacauugguaugggcgugaccuacuuagcuuuguuagccgcauucaaagucagaccuaccuucgcugcuggauuacugcuaagaaaguuaaccucgaaagaauuaaugauggcgacaauugggauugcacuauugagucaaucaaccauccccgagaacauuuuggagcuaacugaugcgcuagcuuuagguaugaugguacuuaaaauaguacgaaacauggaaaaauaccaauuggcugucacgauuauggccaucucauguguaccgaaugcagucauacuacaaaaugcguggaaagugucuuguaccauucuagcggcggucagcgucucaccucuguuauuaacaucaucucaacaaaaagcagauuggauucccuuggcacuuaccauaaaggggcuaaauccgacggcaauauuuuuaacuacauuaagcagaacaagcaagaaaagaaguuggccguuaaaugaagcaaucauggcugucggaauggucucaauacuagcuucaucucuucucaagaaugauauuccaaugacgggaccccuuguagccgguggauuacuaacaguauguuauguguuaaccggacgauccgccgaccuagaacuugagcgggcugcagaugugaaaugggaagaccaagcagaaauaagcggaucaagucccauacuaucaaucacuauuagcgaagacggauccaugaguauuaaaaaugaggaagaggagcagacacugacuauccucauucgaacaggauuacugguuauuagcggggucuuucccguaucgauuccgaucacagcugcagccugguaccuuugggaagucaagaaacaacgagcaggaguccugugggacguaccaucuccaccgccagucgaaaaagcugaauuagaagauggggcauauaggaucaaacaaagagguauucuggguuauucgcaaaucggagcugguguuuacaaagaaggaacuuuucacacaauguggcaugucacgcgaggagcuguauuaaugcauagaggcaaacguaucgaacccagcugggcugacguuaaaaaggaccuaauuaguuaugguggaggauggaaauuggaaggagaauggaaagagggggaagaagugcaaguauuggcauuggaaccagguaaaaauccgagagcuguccaaacaaaaccaggcauuuuuaaaacaaacacugguacaaucggggccguuaguuuggacuucucaccaggaacaagugggucuccaauuguggauagaaaggggaaggucguaggcuuauauggaaauggcguaguuacaagguccggugcguacguuagcgcaauagcgcagacagagaaaaguauugaggauaacccugagauagaagaugacauauucagaaagaaaagauuaacaauaauggaccuacaucccggugcaggaaagacuaaacgauaucugccugcgauaguaagagaagcgauuaagcguggacuuagaacauugauucuagcuccgacaagaguaguugcggcugaaauggaagaggcacuuagaggucuuccaauuagauaucagacaaccgcgauaaaaacggagcacacagguagagaaauaguagaucuaaugugucacgcgacuuucacaaugagguuacuaucgccagugagaguaccgaauuauaauuugauaauuauggaugaagcacacuuuacagauccugccagcauagcagcucgagguuauaucagcacacgaguagaaaugggagaggccgcugguauuuuuaugacagcaacuccuccagguuccagggacccauuuccgcaaucaaaugcacccauaauggaugaagaaagagagauccccgaaagaucauggaauaguggacacgaaugggucacugacuucaaaggcaaaacugucugguuuguaccgucaauuaaagccggaaaugacauagcagcuugucuccggaagaaugguaagaaaguuauucaacuuucaaggaaaacuuuugauucagaguauguaaaaacucgggcuaaugauugggacuuuguagugacuacagauaucagugaaaugggugcuaacuuuaaagcagaaagaguuauagacccaaggagauguaugaaacccguaaucuuaacugauggagaggaacgcguaaucuuagcugggcccaugccgguuacacacaguagugcugcccagcgacgcggucggauaggcagaaauccgaaaaacgaaaaugaucaguacauauacaugggagaaccuuuagagaaugacgaggauugcgcgcauuggaaagaagcuaagauguuacuggacaauauaaacacucccgagggaaucauuccuagcauguucgagccagaacgcgaaaagguggaugcaauugauggagaauaucggcugagaggagaagcgagaaaaacauucguagauuuaaugcgaagaggagaucuuccaguauggcuugcuuauaaaguugccgccgaagguauuaacuaugcagaucggaaaugguguuuugaugguaucaaaaacaaucaaauccuggaagaaaauauggaaguugaaauuuggacaaaagaaggugaacgcaagaaacuuaaaccgagaugguuagacgcucgaauuuauuccgacccauuagcauugaaagaauuuaaagaauuugcggcaggacgaaaaucuuuaacacuuaaccugauaacagaaaugggaagacuacccacguucaugacgcaaaaagcucgaaacgcccuagauaauuuagccguacuccacacagcggaagcggguggucgggcauacaaucacgcauugagcgaacugccugaaacccuagaaacucuucuacucuugacguuguuagccacgguaacuggcggcauauuuuuauuuuuaaugagugguaagggaauagggaaaaugacucucggaauguguuguaucauaacagcuaguauauuacucugguacgcccagauacaaccacauuggauagcagccaguauaauuuuagaguucuuuuuaaucguucuauuaauucccgaaccggaaaagcagagaacaccacaagauaaucaacuaacuuauguaguaaucgcaaucuugacaguuguagcggcaaccauggcuaacgaaaugggauuuuuagaaaagacuaagaaagaucuuggauuaggcucuauaacaacucaagagucagaaucgaacauacuagacaucgaccuacgcccagcuuccgcguggacgcuguaugcgguggcgacuacuuucguaacacccaugcugcgucacagcauagaaaacagcuccguuaaugucagucuuacugcaauugccaaccaagcaaccgucuuaaugggacucggaaagggauggccgcuaucuaagauggacauaggcguaccgcuucuggccauuggcugcuacucacaaguaaauccaauuacucuaacggcugccuuauuacuuuugguugcucauuaugcaaucaucggcccuggacuucaagcaaaagcuacacgagaggcucagaaaagagcagcggcugguauaaugaaaaacccaacgguggacggcauuaccguaauagaccuagaaccaauaccauacgauccgaaauuugaaaaacaauuaggacaggugauguuacuaaucuuaugcguaacucaaguucuaaugaugcgcacgacaugggcucuaugugaagccuugacucuugcuaccgggccaaucagcacuuuaugggagggcaacccuggucgguucuggaauacgacuaucgcaguaucuauggcuaacaucuuuagggguaguuaucuagcuggagcgggacuguuguucaguauuaugaaaaacacaacuaauacucguaggggaaccgguaacaucggagaaacgcuaggggaaaaauggaaaagccggcucaaugcauuaggcaagucagaauuucagauuuacaaaaagagcgguauacaagaaguugaucggacauuggcuaaggaagguaucaaacgaggugaaacagaccaucaugcaguaagcagaggcuccgcaaaacuucguugguucguugagagaaauaugguaacacccgaaggcaaagugguugaucuagguugugguagaggcggcuggucuuauuauugcgguggacucaaaaauguaagggaagucaaagggcuaacgaaaggaggaccuggucaugaggaaccgauccccaugucaaccuacggauggaauuuaguaaggcuacaaagcgguguagauguauucuuuacuccuccagaaaagugcgauacacugcuaugcgauauaggugaaucaagcccuaacccaacaauugaagcugguagaacuuuaaggguuuuaaaccuaguagaaaacugguuaaauaauaauacacaauucugcauaaaaguacuaaacccauauaugcccagcguaauagagaaaauggaagccuuacaaagaaaauauggcggugcccuaguaaggaacccacuaaguagaaauagcacccacgaaauguauugggugucaaaugccacggggaauauuguaucaucugugaacaugaucagccgaauguugauaaaccguuucacgaugaagcauaagaaagcaaccuacgaaccagacguugaccuugguagcggcacaagaaauauaggaaucgaaagugagauuccuaacuuagacauaauaggaaaaagaauagagaaaauuaaacaggagcaugagacauccuggcauuaugaccaagaccauccguauaaaacaugggcauaccaugggaguuacgagacgaaacagacaggaucagcuuccucaaugguaaacggagucgucagacuuuuaaccaaacccugggauguagucccgaugguaacacaaauggcuaugaccgacacgacgccuuucggccagcaacgaguguucaaggaaaaagucgauacaagaacacaagaacccaaggaaggaacuaagaaacuaaugaaaauaacggcggaguggcuauggaaggaacugggcaagaagaaaacuccgaggauguguacacgcgaagaguucacaaggaagguucgcagcaacgcagcacuaggggcuauauucaccgacgaaaauaaauggaaaucagcucgagaggcaguagaggauggucgauuuugggagcuaguggacagagaacguaaccugcauuuagaaggcaaaugugaaacuugcguuuauaauaugaugggaaagagagaaaagaaacugggugaauuugguaaggcaaaagguucaagagcuauaugguacauguggcugggugcacgauuucuggaauuugaagcacucggauuuuuaaaugaggaucauugguuuaguaggggaaacucacuaucuggcgucgagggagagggcuuacaucgauuagguuauauuuugcgugauguugguaagaaagaagguggugcuauguacgcugaugauacagccggcugggacacacgaauaaccuuagaggauuugaaaaaugaagagaugguuacaaaucauaugaaaggagagcauaagaaacuagcagaggccaucuuuaaauuaacguaccagaauaaagucguacggguacaaagaccaaccccgcggggaacaguaauggauauuauaucacgaagagaucaaagaggcucuggacaaguaggaacauauggucuuaacacauuuaccaauauggaagcacagcucauucgacagauggaaggagaaggaauuuuuaaauccauccaacauuuaacugcaacggaagagauagccguacaaaacuggcuagcaagagucggaagggaaagacugagccguauggcaaucucaggcgaugauugcguugugaaaccgauagaugaccgcuuugcaagugcucuuacagcacugaacgacaugggcaaaguaagaaaagacauccaacaaugggaaccgucaagggguuggaacgauuggacucaaguacccuucugcagucaucauuuucaugaauuaguaaugaaagaugggagaguauuggugguuccaugcagaaaucaggacgagcugauuggcagagcuagaaucucucaaggugcugguuggucccucaaagaaacugcgugucugggcaaaagcuacgcacaaauguggacauugauguauuuccaucgaagagaucucagauuggcagcaaaugcuauuugcagcgcagugccaucacacugggucccaacaagucguacgacuugguccauacaugcaaaacacgaauggaugacuaccgaggauaugcuggcaguuuggaaucgcguauggauacaagaaaaucccuggauggaggacaagacaccgguagaaagcugggaagaagugccauacuuggguaaaagggaagaucaguggugcggcucacuaaucggauuaacaucuagggcuaccugggcuaaaaacauccaaacagcaauuaaucaaguaagaaguuuaauaggaaaugaagaauauacugauuauaugccuuccaugaaaagauuuagaagggaagaagaggaagccggaguacucugguaa

SEQ ID NO: 22441 - RNA, 9876 nt, Artificial Sequence
  derived and/or modified CDS sequence (opt6) from DENV-2__EU482753__SS-prME
acugcuggaguaauaguaaugcuuauaccaacggcuauggcauuucaucuuaccacuagaaacggggaaccacacaugauaguaggaagacaagaaaaaggcaaaucccuacuguuuaaaaccgaagauggugucaauauguguacuuugauggcaauagauuuaggagaauuaugugaagauacaauuacauacaaauguccucuacucagacaaaaugaaccagaagacauugauuguugguguaauaguacguccaccuggguuacauaugguacgugcacaacaaccggcgaacaccguagggaaaaacgcuccguggcucuaguaccacacguuggaaugggauuagaaacuaggacugaaacguggaugaguagugaaggagcuuggaaacauguacaacggauugaaacauggauccuaagacauccgggauuuacaauaauggcggcaauacuagcauacaccauagguacaacucauuuucaacgcgcauugaucuucauucuauugacggcuguggcuccaucaaugaccaugagguguauugggauaaguaacagagacuuuguugaagguguaucaggagguagcuggguggacauuguacuggagcacggauccugugucacuacuauggccaaaaauaaaccaacucuagacuuugaauuaauaaaaacagaagcaaaacaaccagcaacacuacguaaauacuguauagaagcaaaacugacaaacacaacaacugaaucaagaugucccacacaaggagaaccgagccuaaaugaagaacaggauaaaagauuuauuuguaaacauucuauggucgacagggguugggggaauggaugcggcuuguuuggcaaaggugguaucgugacgugugcgauguucacauguaagaaaaauauggaggguaaagugguccagccugaaaaucuagaauacacaauaguaaucacuccacauagcggcgaggaacacgcaguagguaaugauaccgguaaacauggcaaagaaauuaaaauaacaccacaaucaucaaucaccgaagcagaauuaacuggauacgguacuguaacuauggaguguucaccaagaacggggcucgacuuuaacgaaaugguccuauugcaaauggaagacaaagcgugguugguccaucgucaaugguuuuuggaucuaccgcuaccuugguuacccggcgcugauacccaaggaucaaauuggauacaaaaagagacguuagugacauucaaaaauccacacgcgaagaaacaagacguuguaguccuuggaucucaagagggagcuaugcauacagcacucacgggggccacagaaauucagaugucaagugguaauuugcuuuucacaggucauuuaaaaugcaggcuacguauggauaaacuacagcugaaagggaugagcuauagcaugugcacaggaaaauuuaaaauugugaaagaaauugcugagacacaacaugggacaauuguaauaaggguccaauaugaaggggacggcagcccuuguaaaaucccguuugaaauuacugaccuagagaaaaggcauguacuuggcagacuuauuacagucaauccuauaguaacagaaaaagauuccccaguuaacauagaagccgaaccuccauucggggacagcuauauuauaauagguguagaaccgggacaauugaaacuuaauugguucaagaaaggaagcucuaucggucaaauguucgagacaacaaugcguggagcaaaaagaauggcaauuuugggcgauaccgccugggacuucggaucauuaggaggcguuuuuacuucaaucgguaaagcgcuacaucaaguauuuggggcuaucuauggugcagcuuucucgggugugaguuggacaaugaaaauccuuauaggcguuauuauaacauggauaggaaugaacucgcgcucaacguccuugucuguuucucugguccuagucggaguagugacuuuauaucucggagcaauggugcaagcagauagcggcugugucgucaguuggaaaaauaaggagcucaagugcggaagcgguauuuucauuacagacaauguacauacauggacggaacaauauaaauuccaaccugagagcccuaguaaauuagcuucagcuauacaaaaagcacaugaagagggaauaugugguauacgaucaguuacucgccuggaaaaucuaauguggaagcaaaucacaccugaauuaaaucauaucuuaucagaaaacgaagucaagcugacgaucaugacgggugauauacgaggaauuaugcaggcggguaaacgaagucucagaccucaaccuacagaacuaaaauacucguggaagacuuggggaaaggcuaagaugcucucuacagaaucacauaaucaaacuuuucugauagauggaccagaaacggcggaguguccuaacacaaaucgagcauggaauagucuagaaguagaagauuacggcuuuggcguauucacaacaaacauuuggcuaaaacuacgagaaaagcaagacguuuucugcgauucgaaacugauguccgcagcaauaaaagacaauagggcaguccacgcagacauggguuauuggauagaaagugcgcuaaaugauacuuggaaaauggaaaaagcaaguuuuauugaagugaaaucgugucauuggccaaaaagucacacauuauggucaaacgguguucuugaguccgagaugauaauacccaaaaauuuugcaggaccuguaucucaacacaauuaucgcccugguuaucauacucagacagcaggccccuggcacuuaggaaaguuagaaauggauuuugaccuaugcgaagguacuacgguuguagugacggaagacugugguaauagaggccccucacuaagaaccacaacugcaaguggaaaguuaaucacggaaugguguugucguagcugcacgcucccgccguuaagauauagaggagaagauggcuguugguacggaauggaaauaagaccucuaaaagaaaaggaggaaaauuuaguaaauucucuaguaacagcaggacauggucaaauugacaauuuuucuuugggugugcuuggaauggcgcuuuuccuagaggagaugcuaagaaccaggauaggaacaaaacaugcgauccuccuaguagccgugucauuugucacacucaucacgggaaauaugagcuuuagagauuuaggucgugucauggucauggucggcgccacuaugacggaugacaucggaaugggcguuacguaucuagcauugcuagcugcauucaaagugagaccaaccuucgcagcaggucuauuauuaagaaagcuaacaucaaaagaacuaaugauggcaaccauaggcauagcauuacucucucaaaguaccaucccagaaacaauacuagaauuaaccgaugcacucgcuuuggggaugaugguauuaaaaauaguacggaauauggaaaaauaucaguuagcaguaacaauaauggcgauaagcugcguaccuaaugcaguaauacugcagaaugcguggaaaguaaguuguacaauacuagcugcuguauccguaucgccacuauugcucacauccagccaacaaaaagccgauuggauuccucuggcucuaaccauaaagggccuaaauccuacagcaauauuucuuacaacucucucucgaacaaguaagaaaagauccuggccacuaaaugaagccaucauggcuguugggauggucucaauauuggcaucaucuuuauugaaaaaugauauaccgaugacuggucccuuaguugccgggggacuauugacugucugcuacguacuuacaggaagaagcgcggaccuagaauuggaacgagcugccgacgugaaaugggaagaccaagcagaaauuaguggcucgaguccgauucuaucuaucacaauuucagaggaugguaguaugucuauaaagaacgaagaagaagaacaaacguugacuauuuuaauacgcacuggguuauugguuauaucagggguguuuccuguaaguauacccauaacagcagccgcuugguaucucugggaggucaagaaacaaagagccggaguucuuugggacgucccaagcccaccgccuguugaaaaagccgaacuagaggacggagcuuaucggauuaaacaaagaggaauauuggguuauucucagauaggggccggcgucuacaaagaagguacauuccauaccauguggcauguaacuagaggagcaguacuaaugcauagagggaaaagaauagaaccauccugggcagauguuaagaaagaccuaauaucuuacgguggcgguuggaaacuugaaggagaauggaaagaaggagaagaaguucagguauuggcgcuugaaccuggcaaaaauccuagagcuguacaaaccaagccggguauauuuaagacaaauacaggaacaauaggagcaguaucauuggacuuuagcccuggaacaucaggcucaccaauuguagauagaaaaggaaagguaguuggauuguauggcaauggagugguuaccagaaguggagcuuauguaucggcuaucgcccagacagagaaaaguauugaggauaauccugagauagaagaugauaucuuuaggaagaaacguuuaacuauaauggaucuccauccgggcgccggcaagacaaaacgcuaucuaccagcgaucguacgugaagcaauuaaaagagguuuacgaacacuaauacuagcuccaacucggguuguagcugccgaaauggaagaggcuuuaagaggguugccaauacgguaucaaacaacagcgauuaaaacggaacauacaggaagagaaaucguugaucuaaugugccacgcuacguucacaaugcgacuccuuagcccuguucggguaccaaauuauaaucuaauaauuauggaugaggcccacuuuacagauccugcuucaauagccgcccguggguauauaucaacgcgcguugaaaugggugaagccgcggguauuuucaugacugcuacacccccggguagcagagauccauuuccccaaucaaacgccccuauuauggaugaagaacgggaaauaccagagcgcucguggaauaguggacaugaauggguaacagauuucaaaggcaagaccgucugguucguaccuucgaucaaagcugguaaugauauagcagcaugccugcguaaaaaugguaagaaaguaauccaacucucaagaaaaaccuuugacucggaauauguuaaaacucgagcaaacgauugggauuucguugugacuaccgauauauccgagaugggggcaaauuucaaagcggaacgugugauugauccaagaaggugcaugaaacccguaauucucacagacggggaagaacgaguaauacuagcaggucccaugccaguaacccauaguucagccgcucaaaggagggguaggauuggacgaaauccgaaaaaugagaacgaucaguauauauauaugggcgagccacuagaaaacgaugaagacugugcccauuggaaagaggcuaaaaugcugcucgacaauaucaauacaccagaaggaauaauucccaguauguucgaaccugaacgcgagaaaguugaugcuauagauggagaauauagauugaggggcgaagcucgaaagacuuucguagaccugaugagacgcggggaucuuccaguaugguuggcauauaagguagcagcagaggggauuaauuacgcugacaggaaaugguguuuugacggaauuaagaacaaucaaauacuggaagaaaauauggaaguggaaauauggacgaaggaaggcgaacggaagaaauuaaaaccccgauggcuagaugcucggaucuauucugauccuuuggcuuugaaggaauuuaaagaauuugcagccggaaggaaguccuuaacucuuaauuuaaucaccgagauggggagacucccuaccuuuaugacacaaaaggcaaggaacgcacuagauaaucuggcggugcuccauaccgcagaagccggugguagagcauauaaccaugcauuaucagaauugccagaaacauuagaaacccuacuccugcuaacucuauuggcuacaguuaccggagguauauuucuauuuuuaaugagugguaagggcauuggaaagaugacccuugguaugugcugcaucauaacagcaagcauucuccugugguaugcccaaauccaaccccauuggaucgcggcuaguaucauacuugaguucuuucugauuguccuguuaauuccagaacccgaaaaacagcguacaccacaagauaaucaacucacauauguaguaauugcaauauuaacugugguggcugcaacgauggcaaacgaaaugggauuucuugagaaaacuaagaaagauuuaggguuagguucaauuacaacacaagaaucugaauccaauauccuagauauagaucugagaccggcaucagcauggacacuuuaugcuguagcuacuacguuuguaacaccaauguuaaggcacucaauagagaacaguucagugaaugugagccuaacagcaauagcuaaccaagcuacagugcuaaugggccuuggcaagggguggccauugucaaaaauggauaucggaguuccucuauuagcgauagggugcuacucacagguuaacccgaucacacuaacggcggcucuuuuacuauuaguggcgcauuaugcuauaauagggccuggccugcaagcuaaggcgacuagagaggcgcagaaaagggcagcggcaggaauaaugaaaaacccuacgguagacgguauaacaguaaucgaucuagaaccaauccccuacgauccaaaguucgaaaagcaacucggccaagugaugcuucuaauucuauguguaacccaaguacucaugaugagaacaacaugggcgcuuugugaagcacuaacgcucgccacggggccgauaagcacucugugggaggggaacccagggcgauuuuggaauacaacaauagcuguaucgauggcgaacauauucagggguaguuauuuagccggugcaggccugcuauuuaguaucaugaaaaacacuacaaauacucgacguggaacggggaauauuggcgaaacguuaggcgaaaaguggaaauccagacuaaacgcauuagguaaaagugaauuucagauuuauaagaaaagcggcauucaagaaguugaucgaacauuggcuaaagaaggaauaaagagaggagaaacggaccaccaugcagucucaaggggcucagcaaaauuacguugguuuguagaaagaaauaugguaacgcccgaaggcaagguugucgacuuagguuguggaagaggggguuggagcuauuauuguggaggccuaaagaacgugcgagaaguuaaaggcuugacaaaagggggcccgggacaugaagaaccuauacccauguccacguaugguuggaaccuaguaagacugcaaaguggaguagacguauucuuuacuccgccggaaaaaugcgauacccuacuuugugauauaggugaaagcucucccaauccuacaauagaggccggccgaacucuaagaguacuuaaccuaguagagaauugguuaaauaauaacacacaguucuguauaaaaguacuuaauccauacaugccuagcguaauagagaaaauggaagcacuacaacgcaaauacggaggcgcccuaguacgaaauccucuaucaagaaauucgacacaugaaauguacuggguaagcaaugcaacaggaaauauugucagcagcgugaauaugauuucucgcaugcugauuaaucguuucaccaugaaacacaagaaagcaacuuaugaaccugaugucgauuuggggaguggaacucgcaauauuggaaucgagagcgaaauuccgaaucucgauauaauugguaaaagaaucgagaaaauaaaacaagaacaugagacaaguuggcauuacgaccaggaucacccguauaagacaugggcauaucauggaucauacgaaaccaaacaaacaggcagugcuaguucgaugguuaacgggguaguuagacuauuaacaaaaccaugggauguuguuccaaugguuacacagauggcgaugacagauaccacgccuuuugggcaacaacguguauuuaaagaaaaagucgacacaagaacacaggagccgaaggaagguacgaagaaacuaaugaaaaucaccgcggaaugguuauggaaagaauuaggcaaaaagaaaacgccucgaaugugcacuagagaagaauuuacaagaaaaguacggaguaaugccgcacuaggagcgauauucacagacgaaaauaaauggaaaagugccagagaggcgguagaggauggacgguuuugggagcucguugauagagaacguaacuuacauuuagaaggaaaaugcgaaaccuguguguacaacaugaugggaaagcgggagaagaaauuaggugaauuuggaaaagcuaagggaucuagagcaaucugguacauguggcugggagcuagguuuuuggaauuugaagcauuagguuuucuaaacgaagaccauugguucucaagaggaaacagccucucggguguagaaggugaaggauuacauagacuaggauauauacuaagggauguugggaagaaagaaggaggcgcgauguacgcagacgauaccgcaggcugggauaccaggauuacgcucgaagaucugaaaaacgaggaaaugguaacuaaccauaugaagggugagcauaaaaagcuagcagaagcaauuuucaaacuuacauaccaaaauaagguagugaggguacaacgacccacgccccgaggcacugucauggauauaauuucgcgaagggaccaaagaggaagcggucaagugggaaccuauggauuaaauacguuuacaaacauggaagcccaguugauacggcaaauggaaggagaaggcauuuuuaaaagcauacaacaccuuacggccaccgaagaaauagcgguacagaacugguuggcucgugucgggagggaaagacuuagccguauggcaauaagcggagacgauugugugguaaaaccgauagacgaccguuucgcauccgcauuaacugcacuuaaugacaugggaaaagucagaaaggauauucaacaaugggaaccuagucgcggauggaaugacuggacacaaguucccuucugcucacaucauuuucaugaauugguaaugaaagauggacgaguucuaguaguaccaugucgaaaccaagaugaauuaauuggucgagccagaauuagucaaggugcuggauggucucuuaaagaaacugcuuguuuagguaaaagcuaugcacaaauguggacacuaauguacuuccacagacgcgaccuuagacuugccgccaacgcuaucuguagcgcagucccaucgcauugggugcccacaucaagaacaacguggucaauacacgcuaaacacgaauggaugacaacggaagauauguuagcaguguggaaucgugucuggauacaagaaaacccguggauggaagacaagaccccagucgaaucaugggaagaaguaccuuaccuagguaaaagagaggaucaauggugcgguagcaugauaggauugacgucuagagcgacuugggcuaaaaacauacaaacugcaauaaaccagguccgaucccuaauagggaaugaagaauauaccgacuacaugccaaguaugaagcgauuuagacgcgaagaggaggaagcagggguacuuugguag

SEQ ID NO: 22442 - RNA, 9876 nt, Artificial Sequence
  derived and/or modified CDS sequence (opt6) from DENV-2__EU482680__SS-prME
acagccggagucaucgucaugcuaaucccaaccgccauggcauuucacuuaacaacacguaacggggagccacauaugauuguaggacgucaagaaaaagggaaaagucuccuauucaaaacagaggacggggugaacaugugcaccuugauggccauagacuugggggagcuuugugaagacacaauuaccuacaagugcccacuauuaagacaaaaugaaccugaagacauagauugcuggugcaacucaacauccacauggguaacauacggaacaugcaccacgacaggcgaacauagaagagaaaaaagaaguguagcuuuggucccccauguaggaauggguuuagaaacaagaacggaaacauggaugucuucugagggagcauggaaacaugugcaaagaaucgaaacauggauacugcggcauccgggauuuaccauaauggccgcgauuuuagcauauacaauuggaacgacucauuuccaacgagcgcuaauauuuauauuauuaacagcaguugcuccaucaaugacgaugagauguauaggaauaucuaaccgagacuucguugaggguguaagcgggggaaguuggguggauauagugcuugaacacggcucaugugugacaacaauggcgaaaaauaaaccaacuuuagauuucgaacuaaucaaaacugaagcgaaacaaccagccacucuccgaaaguacuguauugaagccaaauuaacgaauaccacuacagaauccagauguccgacucaaggugagccaaguuugaacgaagagcaagacaaaagauucauauguaaacacuccaugguagaccgggguugggguaacgggugugguuuguuuggaaaaggagguaucguaaccugcgcuauguuuacuuguaagaaaaauauggaagguaaaauuguccaaccugagaaccuugaguacacuauaguuauaacaccacacucuggagaagaacacgcuguuggaaacgacacggggaaacacgggaaagaaauuaaaauaacaccucaaucaaguauaacagaagccgaacuaacaggauaugguacaguaaccauggaauguaguccuaggacaggacuagauuuuaaugaaaugguucuacuacaaauggaagacaaggcauggcuaguccaccgacaaugguuccuagacuuaccacuacccugguugccgggugcggauacgcaggguuccaauuggauacagaaagaaacccuuguaacauuuaagaauccgcaugcuaaaaagcaagacguaguaguacuggggagccaagaaggugcgaugcauacggccuuaacuggcgcgacugaaauacaaauguccagcgggaaccucuuauuuacaggucacuuaaaauguagauugagaauggauaaacuacaauuaaaagggaugaguuacucaauguguacagguaaauucaagauaguaaaagaaaucgccgaaacucaacaugguacuauuguaauaagaguacaauaugaaggggaugguagcccuuguaaaaucccauuugaaauaacugaccuagagaaaaggcacguuuuagggagacucaucacaguaaacccaauaguuaccgagaaagauagcccugucaauauagaagcagagccuccuuuuggagacucuuauauaaucauuggaguugaacccggccaacuaaaauugaacugguucaaaaaagguucgucuaucgggcaaauguuugagacaacaaugcgaggagccaaacgcauggcgauccuuggggacacagcuugggauuuugguaguuuaggcggaguguucacaucuauuggcaaggcacuccaucaaguauuuggcgccauauacggugccgcauuuucagguguaucguggaccaugaagauauuaauuggcguaauuauuacauggaucgggaugaacaguagaucaacuaguuuaaguguaucacuuguacuaguugguguagucacacucuaucucggagcgaugguacaggcggacucaggauguguaguauccuggaaaaauaaagaacucaaaugugggucaggcaucuucauuaccgauaaugugcacacuuggacagaacaguauaaauuucaaccagagagccccaguaaauuagcaucagcgauacagaaagcacacgaagaagguauaugcggaauaagaucaguaacgcgccuugaaaacuugauguggaagcaaaucacacccgaauuaaaccauauuuuaagugaaaacgaaguuaaacugacgauaaugacgggggacaucagagguauaaugcaggcuggaaagaggucgcuaagaccacagccaacagaacuuaaauauuccuggaagaccugggggaaagcuaagauguuauccacagaaucacauaaucaaacguuccuaauugacggaccggaaacugcugaaugcccaaauacaaacagagcauggaacucacuggagguagaagauuacgguuucgggguuuucacaacuaacauauggcuuaaacugcgggaaaagcaagauguuuuuugugauucuaaauugaugagugcagcgauuaaagacaacagggcaguccaugcagauaugggauauuggauagaaagcgcucucaaugacacuuggaagauggaaaaagcaucauuuauugaagucaaaagcugucacuggccuaaaucucauacauuauggucuaauggaguguuagaaucagaaaugaucauaccaaagaacuuugccgguccaguaagucaacauaacuauaggccagguuaucauacucaaacggcgggaccauggcaucuaggcaaauuagagauggauuucgauuuaugugaaggcacaacuguaguaguaacugaagacugcgggaauagaggacccucacuucgaacgacuacagcaucaggaaaacuaauaaccgaaugguguuguagauccuguacuuuaccaccguuaagauacagaggagaagacggcugcugguacggaauggaaaucaggccuuuaaaagagaaagaagaaaaucuaguaaauucguuagugacagccggacauggccagauugauaacuuuaguuuaggaguacuaggaauggcacuauuccuugaagaaaugcuaaggacaagaauagguacaaaacaugcaauucuacugguugcugucucuuucguuacauuaauaacuggaaauaugaguuuuagagaucuaggucgugugaugguuauggucggcgcgacaaugacagaugauauaggaacuggaguaacauaccuggcccuauuggcggcguuuaaaguaaggcccacguucgcagcuggacuucuguuacguaaacuaaccuccaaggaacuuaugauggcaacuauaggcauagcuuuacugagccagucaacaauaccggaaacaauccuagagcucacggacgccuuagcacuggguaugaugguauuaaagauuguccguaauauggaaaaauaccaguuggccguaacaauuauggcaauaaguugugugccaaaugcuguaauauuacagaaugcuuggaaaguuaguugcacaauacuagcagccguaucuguaucaccucucuuauuaacgucuucgcaacaaaaagcggacuggauuccauuagcucuaacuauaaaaggcuugaacccuacugcaauuuuucugacuacauuaucccggacaucuaaaaagagaagcuggccucuaaacgaagcuauaauggccguaggcauggugaguauauuagcgucaucccuucuaaagaacgacauaccgaugacagggccuuuaguggcagggggucuucuaacgguauguuacguucuaacagggcguucagcagaucuagaacuggaaagagcggcugauguaaagugggaagaccaagcugagauaucagggucaucaccgauuuuaucuaucacuauaucugaagaugggucaauguccauuaaaaaugaagaggaagaacagacacuaacgauacuaauuaggaccggcuuacugguuauaaguggugucuucccugucagcauuccaauaacagcggcggcgugguaucuaugggaaguaaaaaagcaacgcgcaggaguucuaugggacguuccaucaccaccuccaguagaaaaagcagagcuagaagauggagcauauagaauaaaacagaggggcaucuuggguuacagccaaauuggggccggcguauauaaagagggcacuuuucauacuauguggcaugugacuaggggagccguucuuaugcaccgagggaaacggauugaacccaguugggcggacguaaaaaaggaucuuauaaguuacgggggaggguggaaguuggaaggugaauggaaggaaggggaagaagugcaaguuuuagcacucgaacccgguaagaacccgagggcaguacaaaccaagccgggcauauuuaaaacaaauacuggcacgauuggcgcagucucacuugauuucaguccaggcaccucaggaagucccauagucgacagaaagggcaaagugguaggacucuaugguaacggaguagugacucgaaguggugcuuauguaucagccauugcccaaacagaaaaaucaauugaagauaauccugaaauagaggaugacauuuuuagaaaaaaacgacugacaauuauggacuuacacccuggcgcaggaaaaacaaaacguuaccuacccgcaauugugagagaagcaauaaaaaggggauuacggacacuaauuuuggcgccuacgcgagucgucgcggccgagauggaggaagcgcuacgaggccuaccaauacgauaucaaacaacagcuauaaaaacugaacauacaggaagagaaaucguagacuuaaugugucaugcaacguuuacaaugagguugcugaguccaguucggguaccaaauuacaaucuuauaauaauggacgaagcccauuuuaccgacccugcuucaauagcggcgcgugguuauauaaguacuagagucgaaaugggugaagcugcagggauuuuuaugaccgcaacuccuccggggucucgagauccguucccacaaagcaaugcgccgauaauggaugaagaaagagaaauacccgaaagaucauggaacaguggacaugaguggguaacagauuuuaaaggaaaaacuguaugguucguuccuagcauaaaagcagggaacgacauugccgcuugucuacgaaaaaauggaaaaaaagucauacaacuaagucgaaaaaccuuugauucagaauacgucaaaacuagagcaaaugacugggacuuuguugugacuacugauauaagcgagaugggugcuaacuuuaaagcagaaagagugauagacccaaggcgaugcaugaaaccugugauuuuaacugauggcgaagaaagggugauacucgcagguccaaugccagucacacacucgucugccgcacaacguagagggagaauaggcaggaaucccaaaaacgagaaugaucaauacaucuacaugggagaaccauuagaaaaugacgaagauugcgcgcacuggaaagaagcuaaaaugcucuuagauaacaucaacacuccagagggaauaaucccaaguauguuugaacccgagcgagaaaagguugaugccauagauggagaauacagguuacgaggugaagcacgaaaaaccuuuguagaucugaugcguagaggcgacuuaccaguaugguuggcauauaagguggcagcagagggaauuaauuaugcagauaggaaaugguguuucgauggcauuaaaaacaaucaaauucucgaagagaacauggaaguagaaauuuggacgaaagagggugaaagaaaaaaguuaaaaccuaggugguuagacgcacguauauacuccgauccucuugcacucaaagaauuuaaggaauuugcggcaggucgcaaaucgcucacguuaaaucuuauuacagagaugggacgguugccaacuuucaugacucaaaaagcaagaaaugcucuugauaaucuugcaguacuccacacagcugaagcugggggccgagcauauaaucacgcauuaucagaacugccugaaacccuagagacuuuguuacuucuaacuuuguuagcaacagugacuggcggcauuuucuuauuucucaugucaggcaaaggcauaggcaaaaugacauugggaauguguugcauuauaacagcuucuauauugcuaugguaugcacaaauacaaccacacuggauagcagcuagcauaauccuagaguuuuuccuuaucguccucuuaauuccugaaccugagaaacaaagaacaccacaagacaaucagcuuacuuacguaguaauagcgauacuaacuguaguagcagcaacgauggcaaaugaaauggguuuuuuagagaaaacgaaaaaagauuuaggguuaggauccauuacgacgcaggaauccgagucaaauauauuagauauagaucuucgaccggccuccgcauggacauuguaugcaguugcgacaacauucgucacaccaaugcuaaggcauucaaucgagaauucguccguaaacguuucacuuacagcgauugcaaaccaagcaacaguacuaaugggccuagguaaaggcuggccauuaucgaaaauggauauaggaguaccauuacuggcaaucggauguuauagucagguaaacccaauaacacuaacggcagcgcuucuccucuugguugcccauuacgccauaauaggcccgggacugcaagcuaaagcgacucgagaagcccaaaaaagagcggccgcaggcauuaugaaaaacccuacuguugauggaauuacaguaaucgaucuggaacccauuccuuacgauccuaaguuugagaaacaacuagggcagguaaugcuacuuauucucuguguuacgcaaguacuuaugaugaggacuacuugggcauuaugugaagcauuaacuuuagcuacggggccuauaagcacucucugggaggguaaucccgggcgcuuuuggaauacuaccaucgcuguuaguauggcgaacaucuucagagggaguuaucuagcaggggcagggcuccuauuuaguauuaugaagaauacuacaaauacaagacgcggcacugguaauaucggagaaacucuuggagaaaaauggaagagccgacugaaugcauuaggaaaauccgaguuccaaaucuacaagaaaucuggcauacaagagguggacagaacccuugccaaagaaggaauaaagcgaggagagacggaucaucacgcagucucccgagguuccgcuaagcuccgcugguuuguagaaagaaauaugguaacaccagaaggaaaagucguugaucuggggugugggcgaggcggauggucuuauuacugugguggguuaaagaacguacgcgaggugaagggacuuacuaaaggaggaccaggucacgaggaacccauuccgaugucaacauacggcuggaauuugguuagacuacagagugguguagauguauucuucacuccgccggagaagugcgacacauuacugugugacauuggcgaaagcucgcccaaccccacuauagaagcaggacgaacacuaagaguauuaaaccuaguagagaauugguuaaacaauaauacacaauucuguauaaaaguauugaacccuuauaugccgagugugauagaaaagauggaagcauuacaaaggaaauacggaggugcacuuguacgcaauccucucagccguaacagcacucaugaaauguauuggguaaguaacgcaacugggaauauuguaucaagugugaacaugauaucucgaaugcugauuaaccguuuuacuaugaaacacaaaaaagccacguacgaaccugacguagaccuagggagcgguacaagaaacaucggaauagagagugaaaaaccaaacuuagauaucauaggaaagaggaucgagaaaauaaagcaagaacaugagacaaguuggcacuaugaucaagaucacccauacaaaacaugggcauaccaugggucuuaugagacaaagcaaacaggaagcgcaucaucuaugguaaauggagucguucgauuacuaacuaaaccuugggacguaguaccgaugguuacucaaauggcaaugacggauacaacuccauuuggccagcaacgaguauuuaaagaaaagguugacaccaggacacaggaaccaaaagaagggacaaaaaaauuaaugaaaauaacugcggaguggcuguggaaagaacugggaaaaaaaaaaacaccacgaauguguacucgcgaagaguucacgaggaagguacgaaguaaugcugcauuaggcgccauauucacugaugagaauaaguggaaaucagcacgugaggcaguagaagauggaagauuuugggaguuaguugauagagaacgaaauuuacaucuagagggaaagugcgaaacaugugucuacaauaugaugggcaaacgagagaaaaaauugggagaauuugggaaagccaaaggaagccgggccauuugguauauguggcuuggggcaagauuucuugaguuugaggcauuagguuuuuuaaaugaagaccauugguuuucaaggggaaauaguuuaagcgggguagaaggagagggauuacauagguugggauacauacuaagggacguaggaaaaaaagaagggggagcaauguacgcggaugauacggccggaugggauacucgaauaacauuagaggaucuaaagaaugaagaaaugguaacgaaccauaugaagggggaacauaaaaaacuggccgaagcaaucuuuaaacucacuuaucagaacaaaguaguaagaguucaaaggccaacgccuagaggcaccgugauggauauaauuagccgacgugaucaaagaggaucgggccaaguuggaaccuauggguuaaauacauuuacaaacauggaagcacaacugauaagacaaauggaaggugagggcaucuuuaaaucaauacagcauuuaacugcaacagaggaaauugcgguccaaaauugguuagcucggguaggccgugagcgacugagccguauggcaaucucuggcgacgauugcguagucaagccaaucgaugaccgauuugcguccgcgcugacagcgcuaaacgauaugggaaaagugcgaaaagacauacagcaaugggaaccuuccaggggguggaaugacuggacucagguccccuuuuguagucaucacuuucaugagcuagugaugaaagaugguagaguacucgucguuccuugucggaaccaggaugaacuuauuggacgggcaaggauaagucaaggagcagguugguccuuaaaagaaacagcguguuuagguaaaucuuacgcucaaauguggacacugauguauuuucaucgaagagaccuucguuuagcugcuaacgcuauauguucagccgugcccucacauuggguaccaacaucacgaacaacguggucaauucaugcaaaacaugaguggaugacgacugaagauauguuagcagucuggaacagaguauggauccaagagaacccguggauggaagacaaaacaccgguagagagcugggaggaagucccuuauuuagggaaaagagaagaccaauggugcggaaguuuaaucgggcuaaccucccgugccacuugggcaaaaaauauccaaacagcaauaaaucagguuaggucuuuaauagguaacgaggaauacacagacuauaugccaaguaugaaacguuuucggagggaagaggaagaagcaggagugcuuugguaa

SEQ ID NO: 22443 - RNA, 9876 nt, Artificial Sequence
  derived and/or modified CDS sequence (opt6) from DENV-2__EU482754__SS-prME
acagcgggggugauugucaugcuaauucccacagcuauggcauuucaccuaacaacaagaaauggagaaccacauaugauuguaggacgucaagaaaaagguaaaagucuguuguucaaaacagaagacggcguaaacaugugcacacuaauggcaauggacuuaggugaacuuugugaagauacaauuacauauaaaugcccucuucuucgccaaaacgaacccgaagacauugauuguugguguaacagcaccaguacaugggugacauauggaacuuguacaacaacaggugaacaccgacgagaaaaacguagcguugcuuuggugccgcacgucggcaugggauuagaaacacgaacggaaacauggaugucaagcgaaggugcuuggaaacauguucaaaggaucgaaacuuggauacuacgccauccuggauuuacgauuauggcagcaauuuuagcauauacgauagggacgacgcacuuucaacgagcauuaauauuuauccuuuugacagcaguagcuccuaguaugaccaugaggugcauaggaauuucaaauagggacuucguggaagguguuuccggagguucuuggguggauauaguacuagagcauggaagcugugugaccacaauggccaaaaauaaacccacuuuagacuucgaauugauaaaaacagaagcgaaacaacccgcuacuuuaagaaaauacugcauugaggcaaagcucaccaacacaacgacugaaucaagaugucccacacaaggggagcccucucuuaaugaggaacaggauaagagguucauaugcaagcacaguaugguagacagaggguggggaaaugggugcggucuguuuggaaagggaggaauuguaacaugcgccauguucaccuguaagaaaaauauggagggaaaaguuguacaaccagaaaaccuugaauacacaauagugaucacgccgcacaguggugaggaacaugcaguagguaaugacacuggaaagcaugguaaagagaucaagauaacaccccaaucaucaaucacggaagcugaacuaacuggauauggaaccguuacaauggaaugcucgcccagaacuggacuugacuucaaugagaugguccuucugcaaauggaagauaaagcguggcuaguucaucgccaaugguuuuuggauuuaccauugccauggcuaccgggagcagauacucaagggucgaacuggauccaaaaagaaaccuuaguuacguuuaaaaauccacacgccaagaaacaagacguaguuguauuaggaagucaagaaggagcaaugcacacggcuuuaacaggugcuacagaaauucaaaugucgucuggcaauuuacuauucacaggacaucuaaaaugccgauuaagaauggacaaauuacaguuaaaagguauguccuauucgaugugcacggguaaauuuaaaauuguaaaagaaauagccgaaacccagcaugguacuauuguuauuagaguacaguacgaaggagauggcucaccguguaagauacccuuugagauuacugaucucgaaaaacgucauguguugggcaggcuuauaacaguaaacccgauaguuacagaaaaagacaguccagugaauauagaggcagagccuccauuuggagacucuuauaucauaauuggaguugaaccaggacaauugaaauuaaauugguucaagaagggaucaucuauuggacagauguucgaaacuacaaugcgaggagcaaagagaauggccauacuuggagacacagcaugggauuuugggucccuaggagggguauuuacuagcauaggcaaggcacugcaucaaguauuuggagcgaucuacggggcugcuuuuaguggaguaucguggaccaugaaaauccuaauaggcguaauaauaacauggauugggaugaacaguagaucaacuucgcucucgguuagucucgucuuaguuggagucgucacuuuguauuugggugccaugguucaagcggauaguggauguguggucuccuggaaaaauaaagagcucaaaugugguuccggaauauuuauaaccgacaacauacauacauggacagagcaauacaaauuucagccugaaucaccaucgaagcuagcaucugcuauacaaaaagcacacgaagaagguauuugugggauaagaucaguaacacgccuagaaaaucuaauguggaagcaaauuacgccugaguuaaaccauauacucucugagaacgaaguaaaacuaacuaucaugacaggugauauuagagguauaaugcaagcaggaaaaagaucccugcgaccucagcccacagagcuuaaauacagcuggaagacguggggcaaagcaaaaaugcuuuccacugaaucucacaaucagaccuucuuaauagauggaccggaaaccgcagaauguccaaacacaaaccgugcauggaauagccuugaaguagaagacuaugguuucggaguauuuacgacuaauauaugguuaaaacuucgagaaaaacaagaugucuuuugugauaguaaacuuaugagugcagcaauuaaagauaaucgggcaguacaugcugauaugggguacuggauagaaagcgccuuaaacgauacguggaagauggaaaaagcaucauucauugagguaaagaguugucacuggcccaaaagccauacauuguggucaaaugguguacuugaaucugaaaugauaauaccuaaaaacuuugcagggcccgugucucaacacaauuacaggcccggauaucauacucagacugcagggccauggcauuuaggaaaauuagaaauggauuuugaccuuugugaggguacaaccgucgugguuacagaggauuguggaaacagaggacccagccuucgaacaacuacugcgucaggaaaacuuauuacagaauggugcugccggagcuguaccuuaccuccccuacguuauagaggugaagauggauguugguacggaauggaaauucgaccacuaaaagaaaaagaagaaaaccuaguaaauucucuagucaccgcuggacauggacaaauagauaauuuuagcuuagggguuuuaggaauggcguuauuuuuagaagagaugcugcggacaagaaucggaacuaagcacgcaauacuguugguugcaguaaguuuugugacauugaucacgggaaacaugucauuucgugaucuaggacguguaaugguaaugguuggcgcgacuaugacggaugacaucgguauggggguaacauaucucgccuuauuagcagcauucaaaguacgaccuacuuucgccgccggucuacuucuacggaagcugaccucaaaggaacuuaugauggcgaccaucgguauagcgcuacuaucacaaaguacaaucccagaaaccauuuuagaacuuacggaugcguuagcgcucggcaugaugguguugaaaauaguaaggaacauggagaaguaucaauuggcagucacgauaauggcaauaagcugcgugccaaacgcuguaauauuacagaaugcuuggaaaguaucauguacaauauuggcggcagugagcguaagcccauuauugcugacgagcagccagcagaaggcagauuggauaccgcuggcucuaacaauaaaaggucuaaauccuacagcaauauuuuuaacaacuuugucacguacuucgaagaaaagaaguuggccauuaaaugaagcaauuauggcaguagguaugguuucaauucuugcuagcucauugcuaaagaacgauauuccaaugacagggccauuaguugcgggugguuuacuaacaguauguuacguucugaccgggcgaucugccgauuuggaauuggagagagcggcagaugucaaaugggaggaccaagcagagauaagugggaguucgccgauauuaucuauuaccauaagugaggaugguucuaugagcauuaaaaacgaagaagaagaacaaacacuaacaauuuuaauucgaaccggacuccugguaauuaguggaguauuuccaguaucgauaccuauuaccgcugccgcaugguauuuaugggaagugaagaaacaaagagccgguguucuaugggaugugccaaguccaccacccguggaaaaagccgaacucgaggacggcgcuuaccgaauuaaacagagaggaauauuggguuacagucaaauuggugccgguguguauaaagaaggaacauuucauacuauguggcauguaacgagaggugcaguauuaaugcaucgugguaaacgaauagaaccgucaugggcagacguaaagaaagauuuaauaagcuacggcggagguuggaaacucgaaggagaauggaaagaaggugaagagguucaaguacuagccuuagagcccggcaaaaaucccagggcggugcaaacuaaaccuggaaucuuuaaaacuaauacaggaacaauuggggcaguaucucuugauuuuagcccaggcacuucugggagcccuauaguagacaggaaaggaaaaguaguuggauuauauggaaauggggucguuacacgaucuggcgcuuauguuuccgccaucgcccaaacagagaaaaguaucgaggacaaccccgaaauagaggacgacauuuucagaaagaaaagacucacaauuauggaccuacauccuggagcugggaagacuaaaagauauuuaccggccauaguaagagaggccauuaaacgugguuugcggacacuuaucuuagcaccuacacgcgucguggcagcagagauggaagaggcuuuacgggggcuaccgaucagauaccaaacaaccgcuauuaaaacagaacauacagggcgugaaauaguagacuuaaugugucacgcaacuuuuacaaugagacuucuaaguccaguacgaguuccaaauuauaaucuaauaauaauggaugaggcacauuuuaccgauccugcuucuauagcagcucgaggauacauaucgacgcguguagaaaugggugaagcagcgggcauuuucaugacagccacaccaccgggcucacgagaccccuuuccccaaucaaacgcgccuauaauggaugaagaacgugagaucccugagcgaucauggaacucugggcacgaauggguaacagacuuuaaaggaaaaacaguaugguuuguuccuucaauaaaggcaggcaacgauauagcugcaugucuucguaaaaacggaaagaaaguaauucaauuaucgaggaaaacuuuugauuccgaauaugucaaaacgagagcaaaugacugggauuucgucguaacaacggauauaucagagaugggcgcuaauuuuaaagcugagagagucaucgauccuaggcgauguaugaaaccugucauacuaacagacggugaagaacgaguaauucuggcagggccaaugccaguaacacacucaucugccgcucaacgacgcggacgcauuggccguaaucccaaaaaugagaacgaccaauacaucuauaugggagaaccucuagaaaacgaugaagauugcgcucauuggaaagaagcgaaaaugcuucuagauaauauuaacacaccagagggaauuauuccauccauguucgagccugaacgagaaaaaguagaugcgaucgacggugaauacagauuaagaggagaagcaagaaagaccuuugucgaccugaugagacgaggggaucuucccguguggcuugcuuacaaaguagcugcugagggaaucaauuaugcagaucggaaaugguguuucgacgggaucaagaacaaccaaauacuggaagaaaauauggaagucgagauuuggacaaaggagggcgagaggaagaaauuaaaaccuagauggcucgaugcucgaauauacucagacccauuagcauugaaagaguucaaagaguucgcugcagguaggaaaucccucacgcuuaaucucauuacagaaaugggaagacuuccuacuuuuaugacucaaaaagcgcgaaaugcacuagauaauuuagcuguucuacauacugccgaagcaggaggacgagcauauaaucacgcccucucagaacucccugagacauuagaaacucuucuucugcucacacuauuagcaacaguaacuggaggaauuuucuuguuucucauguccgguaaaggaauagguaaaaugacacugggcauguguugcauaauaacagcuagcauauuacugugguaugcgcaaauccagccacacuggauagccgcaaguauaauauuagaauuuuucuugauaguauuguuaauuccggaaccagaaaaacaaagaaccccacaggacaaucaacuaaccuauguaguaauugcuauuuugacaguaguagcggcuacuauggcaaaugagauggguuuccuugaaaagaccaagaaagaccuuggucuaggcucaauaacuacccaagaaucggaaucuaacauucuagauauagauuugcgacccgcauccgcuuggacacuauaugcagucgcaacgacauucguuacgccaaugcugcgacacuccauagaaaauaguucaguuaacgucucgcucacagcaauagcgaaucaggcuacuguuuugaugggucuaggcaaaggcuggccguugucaaaaauggauauugguguaccuuuguuggcgauaggauguuauucgcaaguaaauccaauuacccuaacggcugcacugcuacuauugguagcgcauuaugccauaaucgguccaggucuucaggcgaaagcgaccagggaagcacagaaaagagcugcugcagguaucaugaaaaacccgacugucgacggaaucacuguaauagacuuagaaccgauaccguaugauccaaaauuugagaaacaacuuggacaagucauguuacucaucuuauguguaacacaaguauuaaugaugagaacuacuugggcccuuugcgaagcauugacacuagcaacggguccuauaucaacacuaugggaaggaaacccaggacgguuuuggaauacaaccauagcugugucgauggccaacauauuucgaggguccuaccuugccggagcaggacuauuauuuucuauaaugaaaaauacuaccaauacgagaagagguaccgguaauaucggcgaaacauuaggugaaaaauggaaaagcaggcuuaacgcacuaggcaaaucagaauuucaaauauauaagaaaagcgggauucaagagguugacagaacauuagcuaaagaagggaucaaacgcggagaaacagaccaccaugcuguaucacguggcucagcaaaacuacguugguucguagagcggaacaugguuacaccagaaggaaaagugguugaucuuggaugcgguagaggcgguuggaguuauuauugcgguggacucaagaauguaagagaaguaaaaggucugacaaaaggcggcccaggucacgaggagccuauuccuaugagcacauacggauggaacuuggucaggcuccaaaguggaguugacguauucuuuacuccacccgaaaaaugcgacacuuuacugugcgauauaggcgagucgaguccaaaucccacaauugaggcaggaagaacacuccguguauugaaccuggucgaaaauugguuaaauaacaacacccaauuuuguauaaaaguuuuaaauccauacaugccuucaguaauugagaaaauggaagcccuccaaagaaaauacgggggagccuuaguacgaaauccauuauccaggaauagcacgcacgaaauguacuggguaaguaaugcaacaggaaacauagucagcucuguaaacaugauaucuagaauguugauuaauagauuuaccaugaaacauaagaaagcaaccuaugaacccgacgucgaucucggaagcgguacgagaaauaucggcauagaaucagaaauaccgaaucucgauauaaucggaaaaagaauugagaaaauuaaacaagaacacgagacaucauggcacuacgaucaggaucauccauauaaaacaugggccuaccauggaucguacgaaacaaaacagacagguucagcaucguccaugguuaacggagucguaagacuauuaacaaagcccugggaugucguacccaugguaacucaaauggcaaugaccgauacaacuccauucggucagcaaaggguguuuaaagaaaaaguagauacacguacgcaggaaccuaaagaaggcacuaaaaagcuaaugaaaauaaccgcugaauggcuguggaaagaauugggcaagaagaaaacucccagaauguguaccagagaagaauuuacaagaaaaguccguucaaaugccgcucuuggagcaauauuuacagacgaaaauaaauggaaaucagcgagagaagcgguugaggauggacgcuucugggagcuaguugaucgagagaggaacuuacaccuagagggaaagugugaaacgugugucuauaacaugauggguaaacgagagaagaaauuaggugaguucgguaaagccaaggguaguagagcaauaugguauauguggcuuggugccagguuccuagaguucgaggcguuaggcuuccugaaugaggaucacugguuuucacgggguaauucucuuaguggagucgaaggagagggguuacaucgguuaggauauauccuccgugacguuggcaagaaagaagguggagcuauguacgcggacgauacugcagggugggacacaagaauaacacuugaagauuugaaaaacgaggaaauggugaccaaccauaugaagggggaacacaagaaacuagcggaagcaauauuuaaauugaccuaccagaacaaaguaguuagaguacaacgacccacuccgcgaggcacagucauggauauuauaagucgccgugaucaacgcgggucugggcaaguuggaacauauggguugaacacauuuaccaacauggaagcacagcuuauaaggcagauggaaggggaaggaauauuuaaaagcauucagcauuuaacagcgacagaagaaauagcaguucaaaauuggcuugcaagaguuggcagagaaagauuaagucgaauggcaaucucgggggacgauugcguugugaaaccaaucgaugauagauuugcuucugcacuuacugcacuuaaugauaugggcaaagugaggaaagacauacaacaaugggagccgaguagaggcuggaacgacuggacgcagguaccauucuguucucaucauuuucacgaacucguuaugaaggaugguaggguccuaguaguaccgugccgaaaccaagaugaauuaauuggacgagcaaggauuagccaaggcgcaggauggagccuaaaggagaccgcuugcuuggggaaaucauacgcacaaauguggacguuaauguauuuccaucgucgugauuugcguuuagcggcaaaugcuauuuguagcgcuguaccgagccauugggucccaacuagccgaacuacuuggucaauacacgcuaaacacgaauggaugacaaccgaggauaugcuagcaguauggaaucgugucuggauacaggaaaaucccuggauggaagauaaaacaccaguagaaucaugggaagaggugccuuaucuaggaaaaagggaggaccaauggugugguucguuaauugguuuaaccagucgcgcaacaugggcaaagaauauacaaacagcaauaaaucaaguaagaaguuuaauaggaaaugaagaauacacugauuauaugccuagcaugaaacgauuuagacgcgaagaagaagaagcaggaguuuugugguag

SEQ ID NO: 22444 - RNA, 9876 nt, Artificial Sequence
  derived and/or modified CDS sequence (opt6) from DENV-2__FJ478455__SS-prME
acagcuggagugauuguaaugcugauuccgaccgcgauggcguuccacuuaacaacacggaauggugaaccucauaugaucguagggagacaagaaaaagguaaaucucuacuauucaaaaccgaagaugggguaaauaugugcacucugauggcaauagaccuaggagaacuuugugaagacacaauuacauauaaaugcccauuguuacgccaaaacgaaccugaagauauagauugcuggugcaauucaacuucaacauggguuacuuauggaacuuguaccacgacuggugaacauagaagagaaaaacgaucaguugccuuaguaccacacguuggaaugggucuagaaacgcgaacagaaacuuggaugaguagugaaggagcauggaaacacgugcagaggaucgaaacuuggauauuacgccauccaggauucaccauaauggcugcuauacuggcuuacacaauaggaaccacucauuuucaacgagcacuuaucuuuauauuauuaacagcaguugcgccgaguaugacgaugcgaugcauagguaucagcaauagagauuucguugaaggaguaagcggagguucguggguugauauaguccuugaacauggaucgugugucacgacaauggcgaaaaacaaaccaacgcuggauuucgaauuaauaaaaaccgaagcgaaacaacccgcaacucuccgaaaauauugcauagaagcaaaacuuacaaacaccacgacugaaucaagaugcccaacucaaggcgaaccgagcuuaaaugaggaacaagauaaacgguuuauuuguaaacauucaaugguagaucgggguuggggaaaugguugugggcuguucgggaaaggaggaauugucacaugugcgauguucacguguaagaaaaauauggaaggaaaaguaguucaaccugagaacuuagaauauacaauagugauaacaccccauucaggugaggaacacgcugucgguaaugacacagguaaacacgguaaagaaauaaaaaucaccccucagagcucaauuacugaagcagagcugacgggguacggaaccgucacaauggagugcucgccucggacggguuuggacuucaacgaaaugguacuauuacaaauggaggauaaagcaugguuagugcaucgacaaugguuccuugaccucccauugcccugguugcccggagcagauacucaaggaucaaauuggauacaaaaagagacccucgugacuuuuaaaaacccccacgcaaagaaacaggauguaguaguuuuaggcagccaagagggcgcaaugcacacugcacuaacaggggcaacagagauccaaaugucaucuggcaauuuguuguuuacgggucacuuaaaaugucgauuaaggauggauaaacuacaacuuaaagggaugucauacucaaugugcacggguaaauuuaaaauagugaaagaaauagccgaaacucagcaugguacgauuguaauuaggguccaguaugaaggugacggaagucccuguaaaaucccauuugaaaucacagaucuagagaaaagacacguauuaggucgauuaauaacaguuaauccuauagucacagagaaagauaguccaguaaauaucgaagcagagccaccauuuggugacucauauauuauuaucggugucgaaccugggcaauuaaaacuaaauugguucaagaaagggucgucaauuggucagauguuugaaaccacgaugagaggagcgaaacguauggcaaucuugggcgacacagcuugggauuucggaucguuaggcggugucuucaccagcauugguaaggcuuugcaucagguauuuggugcuauuuacggagcagcuuuuucaggagugucauggacuaugaaaauacuuaucggaguaauaauaacuuggauuggaaugaacucacguucaacaucacuaucaguauccuuaguuuuagugggaguuguaacacuauauuuaggugcuguuguucaggcagacagcgguugcguuguaucauggaaaaauaaagaauuaaaaugugggagcggaauuuucaucacagauaauguccacaccuggacagaacaguacaaauuccagccugaaagcccaucaaaacuagcaucggcaauucaaaaagcucaugaagaaggaauuugcgguauuaggucagugacacguuuagaaaaucucauguggaaacaaaucacaccagaauuaaaccauauacugagugaaaaugagguuaaacuuacgaucaugacaggugacauaaaagggauaaugcaagcuggaaaacgaaguuuaagaccacaaccuaccgagcuaaaauauucuuggaaaacaugggguaaagccaaaaugcuuucgacggaaucccacaaucaaacguuuuuaauugauggaccugaaacuguagaaugcccaaauacuaauagagcauggaacaguuuagaaguagaagacuacggauucggcguauucacuacgaauauaugguugaaauuacgagagaaacaggacguauucugugacucaaaacucaugucagccgcaaucaaggauaauagagcaguacacgcagauaugggcuauuggauugaaagugcuuuaaaugauacauggaaaauggaaaaggccucauucauugaagucaaaucuugucauuggccgaaaucgcacacguuguggucuaauggaguuuuggagagugaaaugauaauccccaaaaauuucgcggggccggugagucaacauaauuaccgaccuggcuaccauacucaaacagccggacccuggcacuuagguaaauuggaaauggauuucgauuuuugcgaaggcacaacaguaguaguaacugaagauugugguaaucgugggccgagccucagaacuacaacggcuucaggcaaauuaauaacagaaugguguugucguucauguacauugccuccguuacguuaucggggcgaagaugguuguugguaugguauggaaaucaggccgcucaaagaaaaagaagaaaauuugguaaauucucucguaacagccggacacggccaaauagauaauuuuucucuugggguguuagguauggcuuuauuucuugaagaaauguuacguacacguauagguaccaagcaugcaauuuuauugguagccguaucuuuuguaacccugaucaccggaaauaugaguuuuagggaucucggacgaguuauggucaugguuggagcuacgaugacggacgacauagguaugggaguaacuuacuuagcacuuuuggcagcauucaaagucagaccaaccuuugcggcggguuuauugcuucgaaagcuaacuucaaaagaauuaaugauggcaacuauuggaauagccuuacuaucacaaagcacuauaccugagacaauucuagaacuaacagaugcccucgcgcuuggaaugaugguacugaagauuguacguaauauggaaaaauaucagcuggcugugacaaucauggccaucucauguguaccuaacgcgguaauacugcaaaaugcuuggaagguaucuuguacuauccuagccgcaguaucuguauccccguuauuauuaacuucaucucaacaaaaagcagacuggauuccuuuggcacuaacaaucaaaggccucaauccaaccgcuaucuuuuuaacaacauuaucucgcaccaguaagaaacgaucuuggccucuaaaugaagcgauuauggccguagguauggucaguauauuggcuucaagucuccucaaaaacgacaucccuaugacuggaccauuagucgcaggcggguuacuaacaguuuguuauguucuuacaggacgcucagcggaccuagaacuagaacgcgcugcugauguaaaaugggaagaccaagcugaaaucaguggcaguucgccaauucuauccauaaccaucagcgaggacggcaguaugucuauuaaaaaugaagaagaagaacagacuuuaacgauauuaauaaggacaggacugcuaguaauaucgggcguauucccggucuccauaccuauuacugcagcagcgugguacuuaugggaagucaagaaacaacgagccggaguacucugggauguaccaaguccaccuccgguugaaaaagcagaauuagaagauggugcuuacaggauaaaacaacgagggauucuaggauauucacaaauaggcgcugguguuuacaaagaaggaacauuucauaccauguggcauguaacuagaggagcaguauugaugcauagaggaaaaagaauagaacccucgugggcagaugucaagaaagaucugauuucauacggcggaggguggaaauuagaaggagaauggaaagaaggugaagagguucaaguacuagcuuuagaacccgggaaaaacccacgugcaguacagacaaagcccggcauauuuaagacuaauacuggcacuauaggcgcagugucuuuagacuucucuccagggacgaguggcagccccauuguagauagaaagggaaagguuguaggauuguaugguaacggcguagucacacgaucaggugcauacguuagugcgauagcacaaacugagaaaagcauagaagauaacccagagauugaggaugauaucuuccggaagaaacgacuaacaauaauggaucuccacccuggggcaggaaaaacgaaaagauacuuacccgccauaguucgagaagcaauuaaacgcggucucagaacgcuaauauuggcaccuacaagggucguggcugcugaaauggaggaagcguuaaggggauugccaauacgguaucaaacaccagcgauaaaaacugagcacacggggcgugaaauaguugaucuuaugugucacgcuacauuuacuaugcgccuucugaguccaguaagaguuccuaacuauaacuugauaauaauggaugaagcccacuuuacugauccugcaucaauugcugcgagaggauauauaucgacgcgaguagaaaugggugaagcugcaggaauauucaugacagcaacucccccagggucacgggacccuuucccccaaucaaaugcuccaaucauggacgaagaaagagaaauaccugaaagaaguuggaauagcggucaugaauggguaacagauuucaaaggaaaaacaguaugguuuguaccuuccaucaaagcagggaaugacauugcugcaugccucaggaaaaacggcaagaaaguaauucaauugaguagaaaaacguuugauagcgaguaugucaaaacgagggcuaaugauugggacuuugucguaacgacagauauuucagaaaugggagcgaauuucaaagcagaacgcguaauagacccacgccgaugcaugaagccuguaauauuaaccgauggggaagaaagaguaauucuagcuggaccaaugccaguuacccacucaucagcagcacaaagacguggacggauaggaaggaacccgaagaaugaaaacgaucaauacauauacaugggggagccacuugagaacgacgaagauugugcgcauuggaaagaagcaaaaaugcuauuggauaauauaaauacaccggaaggaaucauuccgucaauguuugaaccugagagggagaaaguagaugcaaucgauggggaauacagacuuagaggagaagcucguaagaccuuuguagaucuuaugagacgaggagaccuucccguauggcucgcuuauaaagucgcagcagaagggaucaacuacgcagacagaaagugguguuuugaugggauuaaaaauaaucaaauacuagaagagaauauggagguugaaauuuggacaaaagaaggugaaaggaagaaauuaaaaccucgguggcuggaugcuagaauauauuccgacccucuagcgcucaaagaauuuaaggaauuugcagccggucgaaaaagucuuacacuuaauuugauaacggaaauggggcgacucccaacuuuuaugacucagaaagcgaggaacgcguuagacaauuuagcgguacuccauaccgcugaagcaggcggacgugccuauaaccacgcccuuucagaacucccagagacucuagagacacuguuauuacuuacacuacuugccacaguaacuggagguauuuucuuauuucugaugagugggaaagguauuggaaaaaugacauuaggcauguguugcauaauuacagcgucaauucuacucugguaugcgcaaauacaaccacauuggauagcagccucuaucauauuagaauuuuucuuaauuguauuauugauuccugagccagaaaaacaaaggacaccucaagauaaucagcucacguacguagugauugcaauacuaaccguaguggcagcgacuauggcaaacgaaauggguuuucuugagaaaaccaaaaaggacuuaggacugggaagcauuacuacgcaggaaucugaaucgaauaucuuagacauugacuuaagaccagcuagugccuggacucuauaugcgguagcuacuacauucguuacuccuaugcuacggcacucgauugagaacucauccguaaaugugaguuuaacagcgaucgcaaaucaagcuaccguauuaaugggucuaggcaaaggcuggcccuugaguaagauggacauugguguucccuuguuagcaauagguugcuauucucaaguaaauccaaucaccuuaaccgcugccuuauuguugcuaguggcccacuacgccaucaucggcccgggucuacaggccaaagcuacuagagaagcacagaaacgugccgcagcaggaauaaugaaaaauccaacaguagauggaauaacuguuauagaccuagaaccaauaccuuaugacccaaaguuugaaaaacaacuuggucaaguaaugcuacuaauucucuguguaacacaaguucuaaugaugaggacaacaugggccuuaugcgaagcacugacucuugcaacaggccccauaucaacccuaugggaaggaaacccgggaagguuuuggaacacaacgauagcagucagcauggcaaauaucuuucgugggagcuacuuggccggagcaggcuuauuguucucaauaaugaaaaauacaacaucgacccggagaggcacagguaacauuggagaaacacuaggggaaaaauggaaaucucggcuaaaugcgcuuggcaaaucagaauuucagauauauaagaaaucaggcauucaagaaguagauagaacacuggcaaaagaaggaauaaaaagaggagaaacugaucaucacgcaguaucacgcgguagcgcgaaauuaagaugguuuguugaaagaaacaugguuacaccagagggaaaagugguagaccuaggaugugguaggggcggguggucauauuauugugguggacuuaaaaacgucagagaagucaaaggucuaacuaaagggggaccgggccacgaagaaccaauaccuaugaguaccuauggauggaaucuaguacgucuccagucuggaguugauguuuucuuuaccccaccagaaaagugcgacacacuacucugcgacauuggugaaaguucuccgaauccaaccauagaggccggcagaacgcucagaguacuaaacuuaguagagaacuggcuuaacaacaauacccaguuuugcaucaaaguauugaauccguacaugcccucgguuauugagaaaauggaggcuuuacaaaggcaauauggcggugcuuuaguacgaaacccguuaucaagaaacucgacacaugaaauguauuggguaucaaacgccacaggcaauauugucaguaguguaaauaugauuucgcgaauguugauaaaccgauucacgaugaaacauaaaaaggcaaccuacgaaccugacguagaucuggguucgggcacaagaaacauagggauugaaucugagauuccaaaucucgacauuauagguaaacgaauagagaaaauuaaacaagagcacgagauaaguuggcacuaugaccaagaucaccccuauaaaacaugggcuuaucacggaucuuaugaaacaaagcaaacaggaucugccaguaguauggucaauggaguaguacgcuuauuaaccaaacccugggacguggugccaauggugacccagauggcaaugacagauacuacccccuucggacaacaaagaguauuuaaggagaagguagauaccaggacacaggaacccaaagaaggaacuaaaaaguuaaugaagaucacagcagaauggcuauggaaagaauuagguaaaaagaaaacuccucgaauguguaccagagaagaguucacaagaaaagugagaaguaaugcggccuugggagcuauauuuacggaugagaauaaauggaaaucggcccgagaagcaguagaagauggacguuuuugggaauuaguagauagagagcguaauuuacaccuugaggggaaaugugaaacguguguauacaacaugauggguaaacgugagaagaaauuaggcgaguucggaaaagcaaaaggcagucgggcaaucugguacaugugguugggagcuagauuccucgaauuugaagcacucggcuuccucaaugaagaccauugguucucaagaggaaacagucuuucaggcguagaaggugagggauuacacagauugggauacauacuaagagauguuggcaagaaagaagggggagcuauguaugcggaugacacggcugguugggacacacgaauaacguuagaagauuuaaagaaugaagagaugguaacaaaucauaugaaaggagaacacaagaaacuggcugaggcuaucuucaaauuaaccuaucagaacaaaguaguccgggugcagagaccuacaccuagggggacgguuauggacaucauuagcagaagggaucaacgaggauccggccaaguugggaccuacggauuaaauacauuuacuaauauggaggcacaauugauaagacaaauggaaggagaagguauuuucaaaagcauacaacaccuuacagcuacugaggaaaucgccgugcaaaacugguuggcgcgagugggaagagaaagacuuagcaggauggcaauuagcggagaugacuguguagugaagccaauugacgacagauuugcgagcgcauugacggcuuuaaacgauaugggcaaaguaaggaaagauauucaacaaugggaaccuucuagagguuggaacgauuggacacaggucccuuucuguagucaucauuuccaugaacuuguaaugaaagacggaagaguacucguuguaccauguaggaaucaagacgagcuaauagguagagcacguauaucucaaggagcgggguggucacuaaaagaaacugcuugucucggcaagagcuacgcacagauguggacccuaauguacuuucacagaagggacuuaagacuagcugcaaacgcuauaugcucggcuguaccuucucacuggguucccacaucccgaacaaccuggaguauacacgcuaaacaugaauggaugacgaccgaggauauguuagcuguuuggaacagaguauggauacaggaaaacccuuggauggaagacaagacaccuguagaaucgugggaggaaguuccauauuuaggcaagcgcgaggaccaaugguguggaucacuuaucggucuuacaagcagagccacaugggccaaaaacauucaggccgccauaaaucaagugagaagucuaauaggcaaugaagaauauacggacuauaugccuucgaugaaacgcuuccgacgugaagaggaagaagccgguguacuaugguga

SEQ ID NO: 22445 - RNA, 9876 nt, Artificial Sequence
  derived and/or modified CDS sequence (opt6) from DENV-2__EU482756__SS-prME
acagcaggaguaauaguuaugcuaauaccaacugcaauggcguuccacuuaacaacaagaaauggcgagccucauaugauaguggggcgucaagagaaaggcaaaucauuacuuuuuaaaacugaagacgguguuaauauguguacccuuauggcuauagauuuaggugaacuaugcgaagauaccauaacauauaaaugcccauuacuacgccagaaugaaccagaagauauagacuguugguguaauagcacgucgacauggguaacuuauggaacaugcacgacgacgggagaacaccguagggagaaaagaucaguugcucucguuccucauguaggaaugggguuggaaacgaggacugaaacguggaugagcucggaaggagcuuggaaacauguccaaagaauagaaacguggaucuugcgucauccagguuucacgaucauggcagccauuuuggcuuacacgaucgggacgacacacuuccagagagcccuaaucuuuauccuacuaacagcaguugcgccgucaaugacgaugagaugcauagguauaucgaacagagauuucgucgagggagucucuggcggaucuugggucgauauaguucuggaacaugguucauguguuacuacaauggccaaaaauaaaccaacgcuagauuuugaguuaaucaaaaccgaagcaaaacaaccugcaacacuccgcaaauauuguauugaagcuaaauuaacaaauacaacaacugaaucaagaugcccuacucaaggagaaccaucgcugaacgaggaacaggauaaacgguucauauguaaacauucaaugguagaucgagggugggguaaugggugcggauuguucgguaaaggagguauaguaacaugugcaauguucacaugcaagaaaaacauggaagggaaaguuguacagccagaaaacuuagaauauaccauaguuauaacuccucauagcggggaggagcaugcgguuggcaaugacacgggaaaacacgggaaagaaauaaaaauaacaccucaaagcagcaucacugaagcugaacuuaccggauaugggacaguaacaauggaaugcucaccacguacugguuuagauuuuaaugaaaugguccuccuucagauggaagauaaagcauggcuaguacacaggcagugguuuuuagauuugccacuaccuugguuaccuggagcugacacccagggaucuaauuggauccaaaaagaaaccuugguaacauuuaaaaacccccaugccaagaaacaagacguugugguuuuaggaucacaagaaggagcaaugcauacagccuuaacaggugccaccgagauacaaaugaguagcggaaaccuucuuuucacuggacauuuaaaauguagacuaaggauggauaaacuacaguuaaaaggaaugucauacucgauguguacaggcaaauuuaaaauaguuaaagaaauagcugaaacacaacauggaacaauagucauucgagugcaauacgaaggugacggaagcccauguaagauuccauuugaaauaacagauuuagagaagcgucauguucuuggacgccuuauaaccguuaauccaauuguaacggaaaaggacucacccguaaacauugaagcagagccuccauucggugacuccuauauaauaauaggagucgaaccaggucaguuaaaacugaauugguucaagaaaggcucaaguauaggucaaauguucgaaacaacgaugagaggggcaaagaggauggcgauauuaggugauacggcuugggauuucgguucguuaggugguguuuuuaccaguauagguaaagccuuacaccaaguauuuggcgcuauauauggagccgcauucagcggcgucagcuggacgaugaaaauacugauuggaguaauuauuacauggauaggaaugaacucucgaucaacuagcuuaucagugagucuaguacuuguaggcguaguaacauuauauuuaggagcgaugguucaagccgacucagguuguguuguaucauggaagaacaaagagcuuaaauguggguccggcauuuuuauaacggauaacguucacacguggacagaacaauauaaauuucagccagaaaguccaucuaaguuagcaagcgccauacagaaggcacacgaagaaggaaucuguggaauaagaagugugacgcggcuagaaaauuuaauguggaaacaaaucacuccugaacugaaucauauucuaagcgagaaugaagugaaguuaacuauaaugacaggugauauaaggggcauaaugcaagcugguaaaagaaguuuaagaccucaaccuaccgaguugaaauauagcuggaaaacguggggcaaagccaaaauguugaguacggaaucgcacaaucaaacauuuuugauugauggaccagaaaccgccgaauguccuaacacuaacagagcauggaauagcuuagagguagaagauuacggcuuugguguauuuacgacgaauauaugguugaaacugagggagaagcaagauguguuuugugauucaaaauuaaugagugcugccauaaaagacaauagagccguccaugcugauaugggcuauuggaucgaaagugcauuaaaugauacguggaaaauggaaaaagccagcuuuaucgagguaaaaaguugucacuggccaaaaagccacacucucuggucaaauggaguucuagaaucggaaaugauaauucccaaaaauuucgcaggaccaguaagucagcauaauuaccguccuggauaucauacgcaaacagcaggaccauggcauuuaggcaaacuugagauggauuuugaucuaugugaagggacuacagucguaguaacugaagacuguggcaacagaggccccucacuaagaacuaccacugcuucgggcaaauuaauaacugaaugguguuguaggagcuguacacuaccuccucuacgauauagaggugaggacgguugcugguaugguauggagauccgaccccuuaaagaaaaagaagaaaaccuaguuaauagucuuguaacugcgggucacgggcaaauugauaauuuuaguuuaggaguacuaggcauggcacuauuuuuagaggaaauguuaagaacacgaauagguacaaaguacgcaauauuguuggucgcuguaucguuuguuacgcuaauaacaggcaauaugucuuuuagagauuuaggcagaguuaugguaaugguaggagcaacaaugacagaugauauuggaaugggggucaccuacuuagcucugcucgcugcguuuaaaguacggccaacuuuugcugcaggacuuuuauugaggaaacuaacuucuaaagagcuaaugauggcaacaaucggaauagcacuacuuucacaaucaacgaucccugagacaauccuagaacuaacagacgcuuuagcucuagguaugaugguacuuaagaucguacggaacauggaaaaguaucaacuggcuguaacuauaauggcuauuucgugcgucccuaaugcaguuauauugcaaaacgcauggaaagucucauguacgauccuagccgccguaucuguauccccacuacuucuaacaucaucgcaacagaaggccgacuggauaccacuugcgcuuacuauaaaaggauuaaauccuacagccauauucuuaaccacacugaguagaacaucgaagaagagaucguggccgcuaaacgaggccauuauggcugucggaaugguaagcauacuugcuaguucccuuuuaaagaaugacauaccgaugacagggccucuaguugcuggagguuuauuaacuguuugcuacgucuuaacaggacgaagcgcugacuuagaauuggaacgggcagcagacguaaaaugggaagaccaagcagaaauuucagguaguuccccuauacucucaaucacaauuucggaagacgguaguaugaguaucaaaaaugaagaagaagaacaaacauuaacaaucuuaauccguacaggucuacuggucauuucaggaguauuccccguaagcauaccuauaacagcggcagcaugguacuuaugggaagucaagaaacagagggcgggcgugcuaugggauguacccucgccaccaccuguugaaaaagcagaauuggaagacggggcguaucguauuaagcaaagaggcaucuugggauauucacaaaucggggcaggaguauauaaagaaggaacuuuucauacuauguggcauguaacaaggggugcagugcuuaugcaucgcggaaagcgcauagaacccaguugggcagacgucaagaaagaucucauuagcuaugguggagguuggaaauuagaaggagaguggaaggagggagaagagguccagguuuuagcuuuagaaccugguaaaaauccgagagcaguucaaaccaagccuggcauuuuuaaaacaaacacaggaacuaucggcgcugucaguuuagauuuuagcccaggaaccagcggaucacccauaguugauaggaaaggaaaggucgucgggcuuuacgguaaugguguuguaacgagaucaggggcuuaugucagcgccaucgcacagacagagaaaucuauagaagauaauccagaaauagaagacgauauauuuagaaagaaacggcuaacuaucauggaucuccauccaggagccgguaaaaccaaaagauauuuaccagcuauaguaagagaagccaucaaaagaggauuaaggacucuuauucuugccccaacgagaguuguagcggcggaaauggaagaagcucucagaggauugccaauacgauaccaaacuacagcaaucaaaaccgaacacacuggacgagaaaucguugauuugaugugucaugcuacauuuacaaugagauuacuaagcccaguaagaguuccgaauuacaacuuaauaauaauggacgaggcgcacuuuacugauccagcguccauugcagcgagaggauauaucagcacuagaguggaaaugggcgaagcugcagggaucuuuaugacugcaaccccuccggguagcagagaucccuuuccccaaucaaaugcaccaauaauggacgaggaacgugaaauacccgaacgaagcuggaacaguggucaugaguggguuacugacuuuaaagguaaaacaguaugguuuguaccuagcauaaaagcgggaaaugauauagcagcuugucuaaggaagaaugggaagaaagucauucaacuuucuaggaagacguuugauucagaauacguuaagacacgagcaaaugauugggauuucguggugacuaccgauauuucggaaaugggugcaaauuuuaaggcagaacgaguaauagauccuagacgcugcaugaagccaguaauauuaaccgacggagaagaacggguaauuuuagcaggcccuaugcccguaacucauucaucggccgcucaaagacguggacguaucgggagaaacccuaagaaugaaaacgaucaauauauuuauaugggagaaccauuggaaaacgacgaagacugugcucacuggaaagaagcuaaaaugcucuuggauaacaucaacacaccugaaggaauuauccccuccauguuugagccugaaagggaaaaaguggacgcgauagauggagaguauagguuacgcggggaagcuagaaaaacauuuguugaccucaugaggcggggugauuuaccuguauggcuagcguacaagguggcugcagagggcauaaauuaugcagauagaaaauggugcuucgaugguauuaaaaacaaucaaauauuagaagaaaauauggagguagaaauuuggacuaaggaaggagaaagaaagaaacuaaaaccaagaugguuagaugcacguauauauucagaucccuuggcucuaaaagaauuuaaggaguucgccgcaggaagaaagagcuuaacguuaaaucugauuacugagaugggacguuuaccaacauucaugacacaaaaagcgagaaacgcacuggauaaucuagcagugcuccacacugcagaagcuggaggacgggcauacaaccacgccuugucugaacucccugaaaccuuagagacuuuauuauugcucaccuuacuagcaacaguaacuggagguauauuucuuuuccuaaugagugguaagggaauagguaagaugacccuaggaaugugcugcauaauaacugccagcauacuccuaugguaugcccaaauccaaccccacuggauugccgcuagcauuaucuuggaauuuuuccuuaucguucuuuuaauaccagagccagaaaaacaaagaacaccacaagauaaucaauugacuuacguagugauugccauccucacaguaguugcugcaacaauggcuaaugaaaugggguuucuagaaaagaccaagaaagauuuaggauuagggucaauaacgacccaggaaagugagaguaacauucuugauauagaucucagaccagcgucugcuuggacguuauaugcaguugcuacuaccuucguaacaccuauguuacgucacaguauugaaaacucuucagucaacguuucauuaacagcuauugccaaccaagcaaccguacuuaugggauuggggaaagguuggccuuuaaguaagauggauauaggagugccacugcuugccauagguuguuacucgcaagugaauccaauaacacuuacagcggcuuuauugcuucucguggcucauuaugcuauuauuggaccaggucuacaagccaaagcaacccgagaagcacaaaagcgggcagcugcggguauuaugaaaaauccgacgguagaugggauuacagucaucgauuuagaacccauacccuaugacccgaaguuugaaaaacagcuuggacaaguaauguuauuaauauuaugcgugacgcagguacugaugaugagaacgacuugggcucuuugcgaggcauugacauuagccacaggacccauaagcacguugugggaaggcaauccaggucgauuuuggaauacgacuauagcaguaaguauggcaaauauauucagaggaaguuaucuagccggagcuggguuauuauucaguauaaugaaaaacacgacaaauacuaggcggggaacagggaauaucggagagacucucggggagaaguggaaaagccgcuuaaacgcacuaggaaaaucagaauuucaaauauacaagaaaagugggauacaagaagucgaccgaaccuuagcaaaagagggcauaaaacgaggugagaccgaucaucacgcuguaagccgcggcuccgcaaaauugagaugguuuguggaacgaaacaugguuacaccugaaggaaaggugguagacuuagggugcggucguggagggugguccuauuacuguggaggccugaaaaauguaagggaagucaagggucuaacgaaagggggcccuggccaugaagaaccaauuccgaugucaacuuaugguuggaaucuaguaagacuacaauccggaguagacguguucuuuacuccacccgaaaaaugugacacguuguuaugugauaucggagaaagcucaccaaauccgaccauagaggcagggcggacucuacguguucugaauuugguggaaaacuggcucaacaauaauacucaguuuuguauaaaaguucugaaccccuacaugcccucuguaauagaaaagauggaggcacuccaacguaaauaugggggcgcauuaguaagaaacccacuaaguaggaacaguacucaugaaauguauuggguaucaaaugcgacggggaauauaguuagcagugucaacaugauaucacggaugcucauuaauagauuuacuaugaaacauaagaaagcgacauacgagccggacguagauuuagguucggggacccgaaauauagguauagaaucagagauuccuaaucuagauauuaucggcaagcggauugagaaaauuaagcaagaacaugaaacaucguggcauuaugaucaagaucauccauauaaaacaugggcuuaccauggaucuuaugaaacgaaacaaaccgggucggcaucauccauggucaaugguguggugcgucuuuuaacuaaaccaugggauguaguuccuaugguuacucaaauggcaaugacugauacgaccccauuuggacagcaaagaguuuucaaagaaaaggucgauacucgcacucaggaacccaaagaaggaacaaagaaacuaaugaaaauaacugcagaaugguuauggaaagaauuagguaaaaagaaaacaccaagaauguguacuagggaagaguuuacaaggaaaguaagauccaaugcugcguuaggagcgauauuuacagaugaaaauaaauggaaaagugcacgagaggcugucgaggauggacgcuucugggaguuaguagauagggaaagaaaucuacaucucgaaggaaaaugugaaaccuguguauauaauaugauggggaaacgagaaaagaaacuaggagaauuugguaaagcuaaggguucacgagcaauaugguauauguggcuuggugcuagauuucuagaguuugaagccuuaggcuuuuuaaaugaggaucacugguucagccgugguaauuccuuaaguggugucgaaggcgagggcuuacaccgacuuggauauauauuaagagaugugggaaagaaagaaggcggcgcgauguaugcagaugacaccgccgggugggauacucgaauuacacuagaggacuugaaaaaugaagagaugguuacgaaucauaugaaaggugaacauaaaaaguuagcagaagcgaucuucaaacuaacauaccaaaacaaagugguucgaguccaacgaccaacuccucgagguaccgugauggauauuaucucaagaagggaccagagaggcucuggacagguuggcacuuaugguuugaacacauuuacuaauauggaagcacagcuaauacggcaaauggaaggcgaaggaauuuucaaaucgauucaacauuugacagccacggaggagauugcaguccaaaacugguuagcaagagucggacgggagagauuaucaagaauggcaauuucgggagaugauuguguaguaaaacccauagacgacagauuugcaucggcgcucacagcucuaaaugauauggguaaaguacgaaaagacauacagcagugggaaccaucacggggauggaaugacuggacgcaaguuccuuucuguagucaucacuuccaugaauuggugaugaaagauggcagaguguuggugguuccaugccgaaaccaggaugaauuaauaggucgggcaaggauaucucagggggcagguuggagccuuaaagaaacagcuuguuuaggcaaaagcuaugcgcaaauguggacacugauguacuuucaccgucgcgauuuacgacuagcugcgaacgcuauaugcucugccguaccuucccauugggucccaacaucgcggacaaccuggaguauucacgccaagcaugaauggaugacuacugaagauauguuggcaguuuggaaccgcguuuggauacaagaaaacccuuggauggaggauaagaccccaguggagucaugggaagagguaccuuaucuugggaaacgagaggaucaaugguguggaaguuuaauuggauuaacuagccgagcuacaugggcuaaaaauauucaaacagcgauaaaucagguccgaucucugaucggaaaugaggaauauacagauuauaugccuucaaugaagagauucaggagagaggaggaagaggcuggugugcuuugguag

SEQ ID NO: 22446 - RNA, 9876 nt, Artificial Sequence
  derived and/or modified CDS sequence (opt6) from DENV-2__EU482757__SS-prME
acagcggguguaauugugaugcugauacccacugcaauggcauuucaucuuacuacuaggaauggagaaccccauaugauaguagggagacaagaaaaaggaaaaucacuacucuuuaaaaccgaagaugguguuaacauguguaccuuaauggcgauagaccuaggagaauuaugugaagacacgauaacauacaaaugucccuuauuaaggcaaaacgaacccgaagacaucgacugcuggugcaauagcacaucaacuugggugacauacgggacauguacuacaacuggagaacaucgacgagagaaaagaaguguggcauuaguaccgcauguaggaaugggauuggaaacgagaacugaaacauggaugucgagcgaaggagcauggaaacaugugcagaggauugaaacuuggauccugcgucacccuggauuuacaaucauggcggcgauacuggcauauaccauaggaacuacucacuuucaacgcgcucuuauauuuauacuuuugacugcuguagcgcccucgaugacgaugagaugcauaggcaucucgaauagagacuuuguagaaggggugucaggaggaucuuggguugauauagugcuugaacauggaucauguguaaccacuauggccaaaaauaaaccaacguuagacuuugaauuaauaaaaacagaagcaaaacaacccgcuacauugagaaaauauuguauugaagcuaaauugacuaacacaaccacagaauccagguguccuacacaaggagaaccuagccugaaugaagaacaagauaaaagauucauuugcaagcacucaaugguagacagggguugggguaacgguuguggauuauucggcaaaggagguauaguaaccugugcuauguuuacuugcaagaaaaauauggaagguaaaguggugcaaccagagaaccuagaauauacaauaguuauaaccccacauucuggugaagaacaugcuguugguaacgacaccgggaaacauggaaaagaaauaaaaaucacuccacagucuucaauaacugaagcugaacucaccggauauggaacgguaacaauggaguguaguccgaggacuggauuagauuucaaugagauggugcugcugcaaauggaagacaaagcguggcuaguucaucgccaaugguuucuagaucuccccuuaccaugguugcccggugcggacacgcaaggaucaaauuggauccaaaaagaaacccuaguaacauuuaagaauccacacgccaagaaacaagacguaguaguguuagggagccaagagggugcaaugcauaccgcauugacuggugcaacagaaauccaaaugaguucagggaaucuucuguucacaggucaccugaaaugucgucuaagaauggauaaauuacagcuaaaaggaaugagcuacuccauguguacaggaaaauuuaaaauaguuaaagagauugccgaaacacaacacggcacaauaguaauuagaguacaguacgagggagacggaucaccuugcaagauucccuuugaaaucacugauuuggagaaaagacacgugcuaggaagauuaauaacaguaaacccuauagugacugaaaaagauucucccguuaauaucgaagcagaaccaccuuucggggauucauacauuauuauugguguagagccggggcaacuaaaguuaaacugguucaagaaagggaguucaauuggacaaauguucgaaacuaccaugagaggggcaaaacggauggccauucucggagauaccgcuugggauuuuggaagucuuggaggaguguuuacaaguauuggaaaagcacuucaucagguauuuggagccauauauggugccgccuuuagcgggguuucauggaccaugaaaauauuaaucggcgugauaauaacuuggauaggaaugaacucaagaucgacuucucuuuccgugucccuaguccuaguagguguaguuacacucuaucuaggugcaaugguacaagcugauucagguugugucgugucuuggaagaacaaggaacuuaaaugcggcucuggcauauuuauaacugauaaugugcauacauggaccgaacaauauaaauuucaaccagaaucuccuuccaaacuagcaucagcuauccaaaaagcacaugaagaaggcauaugcggaauccgaagcguaacuagauuagaaaaccuaauguggaaacaaaucacuccagagcuaaaucauauucuuucggagaaugagguaaaguuaacgaucaugacuggugauaucaaaggaaucaugcaagcaggcaaaagaucacuacgaccacaaccaaccgaacuuaaauacucguggaagacaugggguaaggcuaaaauguuaagcacagaaucucauaaccaaacguuuuuaauugauggcccggaaaccgcagaaugucccaauacaaaccgcgcguggaauagcuuggagguagaagacuacgguuuuggugucuucaccaccaauaucuggcuuaaacucagagaaaaacaagacguuuucugugacucuaagcugaugucagccgcaauaaaggauaaccgcgccguacaugcagacauggguuacuggaucgaauccgcacuuaaugacacguggaaaauggaaaaagcaaguuucauagagguaaaauccugccacuggccaaaaagucauacacuauggucaaauggaguccuugaaucagaaaugauuauaccaaagaacuucgcgggaccugugucacagcauaauuaucgcccaggauaucauacacaaacagccggaccauggcaucuuggaaaacuugaaauggauuuugacuugugugaagggacuacagugguuguuacggaggauugcggcaauagaggucccucauuacggacgacaacagcaucgggaaaguuaaucacagaauggugcugcaggaguuguacguugccaccccuuagauacaggggcgaagauggaugcugguauggaauggaaauacgaccccuuaaagaaaaggaagaaaaccucgugaacagcuuagugacggcaggacauggacagauagauaauuucucacucggcguucuaggcauggcuuuauuccuugaagagauguuacguacuaggauugggacaaaacacgcaauccucuuaguugcaguuucuuuuguaacucucaucacugguaacaugagcuuccgagaccuagguagagugaugguuauggugggugccacaaugacggaugauaucggaaugggaguaacauaccuagcauuacuugcugcuuucaaggucagaccgaccuuugccgcuggucuucucuuacggaaauugaccaguaaagagcuuaugauggcaacaaucgguauugcauugcugucacaaaguacaauuccagaaacaauacucgaacuaacagaugcccuagccuuaggaaugaugguacugaaaauaguucgaaacauggaaaaauaccaacuugcuguuacaauuauggcuauaucguguguaccuaaugcuguaauccuacaaaacgcauggaaaguaucuuguaccauuuuagccgcagugucaguaucuccacuucuacuaaccucuagccaacaaaaagcugauuggauaccauuggcacuuacgauaaaaggauuaaauccaaccgcgauauuccugacgacuuugucucgcaccaguaaaaagaggagcuggccucuuaacgaagcgaucauggccguaggaauggucagcauccuagcgaguucacuacuaaagaacgauauuccaaugacaggaccccuaguagcugggggauuacuaacaguuugcuacguacuuacugguagguccgcagauuuggagcuagaaagagcagccgacguaaaaugggaagaucaagcagaaauuuccgggucauccccaaucuuaagcauaacaauaagcgaagacggaucaaugaguauaaagaaugaggaagaagaacaaacguugacaauacuaauuagaacaggacuauuaguuauuaguggcguauuuccaguaucaauaccaaucacggccgcagcgugguaccugugggaaguaaagaaacaaagagcaggcguacucugggauguuccaaguccacccccuguagaaaaagcugagcuagaagauggcgcauauagaauaaaacaaaggggaauccuaggcuacucccaaaucggggccgguguauauaaagaaggaaccuuucauacgauguggcauguuacaagaggcgcggugcuaaugcauagagggaaacguaucgagccgucuugggcagaugucaagaaagaccucauuuccuacgguggagguuggaagcuagaaggagaauggaaggaaggagaagaaguucaaguucuagcuuuagagccaggcaaaaacccgcgugcugugcaaacaaaaccagggaucuucaaaaccaacacaggaacuauaggugccguaucccuugacuucuccccugguaccagcggcaguccaaucguugacagaaaaggaaaaguuguagggcuauacggaaauggcguagucacacgaaguggggcuuacguauccgccauagcacagacagaaaagucgauagaagauaaccccgagauagaggacgauauauuuaggaagaaacguuuaacgaucauggaucuacauccaggagccggaaaaacaaaacgguauuuaccggcuauaguacgggaggcgauaaaacguggucugaggaccuuaauucucgcaccuacgagagugguagccgcugagauggaagaagcguuaagaggucugccuauacgguaucagacaccagccaucaaaacugagcacacggggagggaaauaguggaucucaugugucaugccacauuuaccaugagacuguugagucccguucguguaccaaacuacaauuuaauuaucauggaugaagcccauuuuacagacccggcgucgaucgccgcgaggggauacauaagcacgcgaguugagaugggagaagccgcgggaauauuuaugacggcuacuccuccuggaaguagagacccuuucccgcaaucgaaugcgccuauuauggacgaagaaagagaaauaccugaacguuccuggaacucagggcacgaauggguuacagauuuuaaaggaaaaacaguuugguucgucccgaguaucaaagcaggcaacgauauagccgcaugcuuaaggaaaaauggcaagaaaguuauacaacuuagucgaaaaacuuuugauucagaauaugucaaaacaagagcgaaugacugggauuuuguuguaacaacggauauuucagaaaugggagcaaacuucaaagcggaacgagugaucgauccacgccgaugcaugaaacccguaauauuaaccgauggagaggaaagaguaauucuagccgguccuaugccugugacacacagcagugcugcucaaaggagaggucgaauugggcguaauccuaaaaaugaaaacgaccaauauauuuauaugggugaaccacuugaaaaugaugaagacugugcucacuggaaagaggcuaaaauguuacuagauaacaucaacacaccugaaggaauuauaccaucaauguuugagccggagagggagaaaguugacgcaauugacggcgaauacagauuacgaggggaggcgcggaaaacuuucguugaucuaaugaggcgcggugaccuuccagucuggcuagcauauaaaguagcagccgagggaauaaacuaugcagaccgaaaaugguguuucgaugguauuaaaaauaaccaaauacuugaggaaaauauggaaguugagauuuggaccaaggagggagaacgcaagaaauuaaaaccaaggugguuggaugcucgaauuuauagugacccguuagcacugaaagaguucaaagaauuugcugcagguagaaaaucgcuaaccuuaaaccucauaacagaaaugggaagacugcccacuuuuaugacucagaaagcucguaacgcucucgauaaccuugcagugcuacacacagcugaagccgguggccgcgcuuauaaucacgcacuaagcgaacucccagaaacucuagagacgcuacuuuuacuaacauugcucgcaacaguaaccgguggcauauuucuuuuucucaugucugggaaaggcauagggaaaaugacacuuggaauguguugcauaauaacugcuagcauacuuuuaugguaugcucaaauacaaccccauuggauugccgcuaguauaauccucgaguucuuuuuaauaguacuauuaauaccggagcccgaaaaacagcgaacgccucaagauaaucaauuaacauacguagucauagcaauauuaaccguagucgcggcaacuauggcaaacgagaugggauuucuggaaaagacgaagaaagauuugggccuagguuccaucacuacacaggaaagugagucuaacauacuagauauagacuuacgacccgcaucagcauggacucuguaugcuguggcaacaacauuuguaaccccgauguugagacacuccauugaaaacagcagugugaauguaagccuuacggcuauagcaaaccaggcuacgguccucaugggacugggaaaaggcuggccacuaaguaaaauggacauaggagucccacuucuggcaauuggaugcuauagucaagugaacccuaucacacuuacggcugcguuauuacuauugguugcacauuaugcaauaauaggaccggggcugcaagcuaaagcaacacgagaggcgcaaaaacgagcggcggcaggaauaaugaaaaauccaacuguagauggaauaacggucaucgaccuagaaccgauaccauaugaccccaaguuugaaaaacaacuuggccaagugaugcugcugauccuaugcguaacacaaguauuaaugaugagaacaacaugggcguuaugcgaagcguuaacucuagcgacagguccaaucaguacauuaugggaaggaaauccaggacguuucuggaauacuacaauugcggugucaauggcuaauaucuucagaggaagcuaucuugcgggggccggccuauuauuuucuauuaugaaaaauacgacaaguacuagaagagguacuggcaacauaggugaaacacucggugaaaaguggaaauccagacuaaacgcucuugggaaaucugaauuucaaauuuauaagaaaagugguauacaagaaguugauaggacacuugccaaagaaggcauuaagagaggggaaacagaccaucaugcuguaucuagaggaucagccaaacuucgaugguuuguagaacgaaauauggucacucccgaggguaaaguagucgacuuagggugcgguagaggagguuggagcuauuacuguggaggacugaaaaacguaagagaaguuaaaggauuaacaaaaggagggccagggcaugaggaaccaauuccaaugaguacauauggauggaaucuugucagguuacaauccggaguagacgucuucuuuaccccaccggaaaaaugcgauacucuucuaugcgauaucggagaaucgucacccaaucccacuauagaagcaggucgcacccuccggguccugaacuuaguggagaacuggcuaaauaacaauacacaauuuugcauaaagguuuugaauccuuauaugcccucaguuauagagaaaauggaagcauuacaacgcaaauaugggggcgcgcuugugaggaauccccucucaaggaauagcacucaugagauguauuggguauccaacgccacuggcaauauuguuucuucaguaaauaugauaagucgaaugcugaucaauagguucacaaugaaacauaaaaaggcuaccuaugagccagauguagaccuaggaucuggcacuagaaacauugggauugagucugaaaucccuaaucuagauauuauagggaagcguaucgagaaaaucaaacaggagcaugaaacaaguuggcauuaugaucaagaucaucccuauaaaaccugggcuuaucaugguuccuacgaaacaaaacaaacgggcucagcauccagcaugguuaauggugugguaagauuguuaacaaagccuugggauguaguaccuaugguuacacagauggcuaugacagacacuacaccauuuggacagcaaagaguauuuaaagaaaaagucgacacaagaacucaagaacccaaagaaggcacuaagaaacuaaugaaaauaacagcagaauggcuauggaaagaauuggguaagaagaaaaccccuaggaugugcaccagagaagaauuuacuaggaagguacggucaaaugccgcgcuaggggcaauuuucacggaugaaaauaaauggaagucugcacgugaagcaguagaggauggaagguucugggagcugguagacagagagagaaauuuacaucuagaagguaagugcgaaacaugcguauauaauaugaugggaaaacgugaaaagaaguuaggagaauuugguaaagcuaaagguucucgggcaauuugguauauguggcuuggagcaagguuuuuagaauuugaagcucuuggcuuccuaaaugaagaccauugguuuaguaggggaaacucacuaagcggaguggaaggagaagggcuucaccgguugggauacauauuaagggacguuuccaagaaagaagguggagcaauguacgcugacgacacugcagguugggacacuagaauaaccuuagaggaccucaaaaaugaagaaaugguuaccaaucacaugaaaggcgaacauaagaaacuagcagaagccauuuucaaacugacuuaucagaauaaggucguaaggguacagcgaccuacuccacguggaacggugauggacauaauuucaagacgagaccaaagggguucaggucaaguagguacuuauggccuuaauacuuucacaaauauggaagcgcaguugauaagacagauggaaggugaagguauuuuuaagucuauacaacauuugacagcaaccgaagagauaguaguacaaaauuggcuagcaagaguuggacgcgaaagacuaucucgaauggcaaucucgggugacgacugcgucgucaaaccaauagacgaucguuucgcgucagcauuaacagcucugaaugauaugggaaaggugcgcaaagauauacaacaaugggagccgaguagaggauggaacgauuggacucagguuccuuucuguucacaccauuuccacgaacuggucaugaaagacggacgaguucucguaguccccuguaggaaccaagacgaauuaauaggcagagcucgaauaucacagggugccgguuggucuuugaaagaaacugcgugucuuggaaaaucauaugcccagauguggacacuaauguacuuccauagacgagauuugaggcuagcagcuaaugcaauuugcagugcagugccaagucauugggucccaacaaguagaacaacuuggucaauucaugcaaaacacgaguggaugacaacugaagauaugcuugccgucuggaaucgagucuggauacaagagaaucccuggauggaagacaaaacaccuguagaauccugggaggaaguuccuuaucuaggaaaacgagaagaccaauggugcggaagucuuauaggacuaacaagucgggcgacuugggcuaaaaauauccaaacagccauuaaucaaguuaggucauuaauagggaaugaagaauauacagauuauaugccgucuaugaaaagguuucggagagaggaagaggaagccggaguccuaugguga

SEQ ID NO: 22447 - RNA, 9876 nt, Artificial Sequence
  derived and/or modified CDS sequence (opt6) from DENV-2__FJ906956__SS-prME
acggcugggguaauagugauguugauuccuacugcuauggcauuucacuuaaccaccagaaauggugaaccacacaugauuguagguaaacaagaaaaagggaaaucacuauuauuuaaaacagaagauggugucaauauguguacgcuaauggcaauugacuugggggaacuaugugaagacacaauaacguacaaauguccacuucucagacaaaaugaaccagaagacauugauuguugguguaacuccacuucaacauggguaacuuauggaaccuguacaacaacgggagaacacagacgugagaaaagaaguguggcguuagucccgcacgucgguauggguuuagagacacgaacugaaacuuggaugaguucagaaggagcauggaaacaugugcagaggaucgaaacauggauuuuacggcauccggguuuuacgauaauggcagcuauuuuagccuauacgaucggaaccacucauuuucaaagagcacuaaucuuuauccuacugacggcaguugcgccauccaugacaaugcguuguauaggcauaucaaauagagacuuugucgaaggcguaagcggagggucuuggguggauauaguacuagaacacgguucgugcguaacuacaauggcuaaaaacaaacccaccuuggauuucgaacuuauaaaaacugaagcgaaacagccagcaacucuacguaaauacugcaucgaagccaaacuaacuaacacaacuaccgaaucucgauguccuacccaaggagaaccuucuuuaaaugaagaacaagauaaacguuuuauaugcaaacacaguaugguggaucguggauggggaaaugguuguggacuauuuggcaaaggggguauugugacuugugcgauguuuacguguaagaaaaauauggagggaaaaguugugcagccagaaaacuuagaauauaccauugucauuaccccacauucaggggaagaacaugccgucgguaaugauaccggaaaacaugggaaagaaauuaaaaucacaccucaaucuagcauaaccgaagcggaauuaacaggauaugguacggucacaauggaauguucaccccgcacugguuuggacuuuaacgaaaugguauuauugcaaauggaagauaaagcgugguuaguucaucggcaaugguuuuuggaucugccacucccauggcucccgggugccgauacccaaggcaguaauuggauucaaaaagagaccuuaguaacauucaaaaacccccacgcgaagaaacaggacguuguaguuuugggcagucaagaaggagcgaugcauacugcauuaacuggagccaccgaaauacaaaugagcagcggaaaccucuuauucacaggucaccuaaaaugucgguugaggauggacaaacuccaacuaaaaggaaugucauacaguaugugcacgggcaaauuuaaaauugugaaagaaauugcagaaacucaacaugguacaauugugauacgaguacaauaugagggggacggcagcccauguaaaauacccuucgaaauaaccgacuuggaaaagaggcaugucuuaggacguuuaauuacagucaacccgauaguaacagggaaagacucaccaguaaauauugaagcagaaccgccauuuggggauucauauauaaucauuggaguugaaccaggucagcugaaacuuaauugguuuaagaaaggaucaagcauuggacaaauguuugaaacaacuaugagaggugcaaaaaggauggcuauucucggagauacagccugggacuuuggaucccuuggugguguauucacgagcauugggaaggcauugcaucaaguauuuggugccauauauggggcugcuuuuagugggguuaguuggacaaugaagauacucauaggugugauaauuacuuggauaggcaugaacucaagaucgacaagccuaucgguaucacugguauuagugggaguagugacucuguauuuaggugcaauggugcaagcugacucggggugugugguguccuggaagaauaaagaauuaaaaugugguucaggaauauuuaucacugauaaugugcauacauggaccgaacaauauaaauuccaaccagagagcccuagcaaauuagcaucggcuauacaaaaggcacaugaagaaggaauuugugggauacguucaguaacaagacuagaaaaucucauguggaaacagaucacgccagaauugaaucauauacucucugaaaacgaagucaaacuuacuauaaugacaggugauauaagaggaauaaugcaggccggaaaacgaagccuaagaccccagccuaccgaacuuaaguauucguggaaaacauggggaaaagccaaaaugcugucaacagaaucacacaaccaaacauuuuuaauagacggaccugaaacagcggaguguccaaacacgaauagagcuuggaacagccuugagguagaggauuacggcuucggaguguuuacgacaaauauauggcuuaaacucagagagaaacaagacguuuucugugauaguaaacuaaugucagcagcuauuaaagauaauagagcugugcaugcagacaugggauauuggaucgaaagcgcacuuaaugauacuuggaagauggaaaaagcaaguuuuauagagguaaaaucaugucauuggccaaaaagccacacccucuggaguaauggaguuuuggaauccgaaaugguaauaccgaaaaacuuugcuggaccugugucucagcacaauuaucggccaggguaccacacucaaacugcagggccauggcaucuaggaaaauuggaaauggauuucgacuuaugcgaggguacgaccguaguaguuaccgaagauugcgguaauaggggaccaucucugcgcacgacuacggcaaguggcaaacucauaacagaguggugcugcaggucauguacgcuaccaccacugagguauagaggugaagacggauguugguacgggauggaaauaagaccauuaaaagagaaagaagaaaaucugguaaacucacuuguaacugcaggucauggucaaauagacaacuuuucauuaggaguccuaggaauggcauuguuccuagaagaaaugcuaagaaccagaauugggacaaaacaugcaauacuccuaguugcaguuuccuuugucacuuuaauaacaggcaauaugagcuuucgcgauuuaggaagaguaaugguaaugguaggggcaacgaugacggaugacauugguaugggugucacuuauuuggcacuucuagcugcauuuaaggucagaccuacauuugcagcggguuuacuucuaaggaaacugacauccaaggaacucaugauggcgaccaucgguauagcccuuuugagccaaaguacaauuccugaaacuauacuggaacuuacagacgcccuugcacuaggcaugauggugcuuaaaauaguaaggaacauggaaaaauaccagcucgcaguaaccauuauggcaaucucuuguguccccaaugcuguuauauuacaaaacgccuggaaggugaguugcacuauucuagcagcggucagcguuaguccacuucuacuaacaucaucucaacagaaagcugauuggauaccucuggcuuuaacuauaaaagguuuaaauccuacggcaauauuccugacaacgcugaguagaacaaguaagaaaagaucauggccacuuaaugaagcaauaauggcgguaggaaugguuucaauacuugcgaguucgcuacucaaaaaugacauuccaaugaccggaccucuaguugccggugguuuguuaaccguauguuacguuuuaacuggacgauccgccgaucuugaauuggaacgagcugcagauguaaaaugggaagaucaggccgaaauaucuggcagcucaccuauauugaguauaacaauaucagaggauggauccauguccaucaaaaaugaagaagaagaacaaacucucacaauacuuauucgcaccggucucuuagugauaagcggcguuuuuccagucucaaucccaauaacagcagcagcuugguaucuuugggaagugaagaaacaacgggccggaguacuuugggaugucccaagcccaccaccuguggagaaagcagaacuugaagauggagcuuaccggauaaaacaacgcgggauccuggguuacagucaaauaggagcuggagucuauaaggaggguacauuccauacuauguggcauguaacacgcggagcuguccuuaugcauagaggaaaaagaauugagccaagcugggcggacguuaagaaggaucugauaaguuauggugggggauggaaguuggaaggugaauggaaagagggagaagaagugcaaguuuuagcacuugaaccuggcaaaaauccgcgcgcaguacaaacgaaaccagguauauucaaaaccaacaccggcacaauaggugcuguaucgcucgacuuuucuccagguacauccggauccccuauuguagauagaaaagguaagguagucggucuguacggcaacggaguuguaacaagaucaggggcuuacgucuccgcgauagcccagacagagaagaguaucgaagacaacccagaaauagaagaugacauauucaggaagaaaagacuuacaaucauggaucuacauccgggugccgggaaaacuaaaagauaucuaccagcaauaguucgagaagcuauuaaaagaggucuucgaacucuaauauuagcaccgacaaggguaguagcugccgaaauggaggaagcguuaaggggccuaccuauacgauaccaaacaacagcuauaaaaacugagcacaccgguagagaaauaguugauuuaaugugucacgcaaccuuuaccaugcgauuacuaaguccuguucgagucccaaacuacaaucuaauuauuauggaugaagcgcauuuuacggauccugcuucaauugccgcacgagguuauauuucuacaagagucgaaaugggugaagcagcaggcauauucaugacggcuacaccaccuggguccagggacccauuuccgcaaucaaaugccccuauuauggaugaagagagagaaaucccugagagaaguuggaacucaggacacgaguggguaacugauuucaaaggaaaaacuguaugguucguuccaucuauaaaagcaggaaaugauauagcagcaugcuuaaggaaaaauggaaaaagaguaauucaacuaucucgaaaaaccuuugacagcgaauauguaaaaacacgagcuaaugauugggauuuuguagugacuacagauauaucagaaaugggugcgaauuucaaagcggagcgaguaauagaccccagaagguguaugaagcccgucauacugacagauggcgaagaaagaguaauauuggcaggccccaugccugucacccacagcucugcagcucaaaggcguggucgcauugguagaaaccccaaaaacgaaaaugaccaguacauauauaugggugagcccuuagagaacgaugaagacugugcccauuggaaagaagcaaaaauguuauuagacaacauaaacacaccugaagggauuauaccaucuauguucgaacccgaaagagaaaaaguagacgcaaucgauggggaauacagauuaagaggugaagcgcgaaaaacauuuguagaccuaaugcgacgaggugacuugccaguauggcuggcuuacaagguagcagcggagggcauaaauuacgcggaccgaaagugguguuuugauggcauuaaaaauaaucaaauauuagaagaaaacauggaaguugaaaucuggaccaaggaaggcgaacggaagaaauugaaaccaagauggcuagaugcacguaucuacuccgauccucuagcauuaaaagaguucaaggaguucgcagccggaagaaaaucacuuacacuaaauuuaaucacggaaaugggacggcugcccacuuucaugacacaaaaagcucgcaaugcauuagacaaccuagcuguauuacacacugcagaggccggagggagagcauacaaccaugcuuuaucggaauuacccgaaacgcuagagacucuuuuacuauuaacucuauuagcaaccgucacugguggcauauuccuauuuuuaaugagcggcaaaggaaucggcaaaaugacguuagguauguguuguaucauaaccgcaucgauucuccuuugguaugcacagauacaaccccacuggaucgcugcaaguauaauauuagaguucuucuugauagugcugcucauaccugagcccgaaaaacaacguacuccacaagauaaucaauugaccuauguuguuaucgcaaucuuaacagucguagcagccacgauggcgaaugaaaugggauuccuagaaaagacuaagaaagaucuaggucucggaucaauaacaacacaggaaucagaaaguaacauauuggauaucgaccuaagaccagcaagugcauggaccuuguacgcugucgcaacgacauuuguuacgccuaugcugagacauuccauagaaaacucuaguguaaauguaucguuaacggcaaucgcuaaucaagcuaccguauuaauggggcuagguaaagguuggccguuaucaaagauggauauaggaguaccauuguuagccauaggaugcuauagucaggugaauccgaucacgcuuacugcugccuuacuauuauugguagcacacuaugcaauaauaggcccuggcuuacaagccaaagcaaccagagaagcacagaaaagagcggcugcaggcauuaugaagaacccuacgguggauggaauaacggugaucgaccuugaaccgauucccuaugaucccaaguucgaaaaacaacuaggacaagucauguuacucauacuaugugugacacaggugcuaaugaugcgaacaacgugggcguuaugcgaggcgcuuacucuggcuacagguccgauuucuaccuuaugggagggcaaccccggaagguuuuggaauacaacaauagcgguaucaauggccaauauuuuccgagguucuuaucuagcuggcgcaggguugcucuuuucaaucaugaaaaacacuacaaacacaagacgagguacugguaacaucggcgaaacgcuuggcgaaaaauggaaaucccgauuaaaugcguuagggaaaagcgaauuucaaaucuauaagaaaucuggcauacaggaaguagauagaacacuugcgaaagaaggaauaaaaagaggagaaacggaucaccaugcugucucuagagguagcgcaaaguuacggugguucguagagaggaauaugguaacaccagaggguaaggugguagaucuagguugcggaagaggaggauggaguuacuauugcggaggacuuaaaaaugugcgcgaaguaaaaggguugacgaaagguggcccgggucaugaagaaccuaucccaaugucaacuuauggauggaacuuagugcgcuuacaaucagggguagacguauuuuucacacccccagagaagugugauacuuuauuaugugauauuggagaaaguucaccuaauccaacaauagaggcaggucguacauugaggguacucaauuuaguagaaaacugguuaaacaacaauacacaauucuguauaaaaguauuaaauccuuauaugccuucagucauagagaaaauggaggcccuccagagaaaauacggaggggcauuggucagaaauccucugagucgaaauucaacccacgaaauguacuggguaucgaaugcaacagggaauauaguaagcaguguuaauaugaucaguagaaugcuaauuaacagguuuacaaugaaacauaagaaagcaacauaugaaccugaugucgaccugggauccgguacacguaauauuggcauagaaagugaaauaccaaacuuggacaucauaggaaaaagaaucgagaaaauaaaacaagaacaugaaacaucauggcauuaugaccaggaccauccuuacaagacgugggcauaucacgggaguuaugagacuaagcaaaccgguuccgcaucaaguaugguaaauggugucguacgacugcuaacaaaacccugggauguggucccaauggucacucaaauggcaaugacagauaccacaccauuuggccaacaacgagucuucaaagaaaaaguggacacgagaacacaagaaccuaaagaagguaccaagaaauuaaugaagauaacugcagaauggcuuuggaaagaauuggggaagaagaaaacgcccagaaugugcacuagggaagaguuuacgcguaaaguacgaaguaaugcagcacuuggugcaauauucacagaugaaaauaaauggaaaucagccagggaagcgguggaagaugggcgauuuugggagcuaguagauagagaaagaaauuugcauuuggagggcaagugugaaacuuguguauauaacaugauggggaaacgagagaagaaauuaggugaauuuggcaaggccaaaggcucccgcgcgauaugguacauguggcucggcgcgagguuucuugaguuugaggcguuagguuuucuaaaugaggaucacugguucucuagggguaauagcuuaucuggaguugagggugaaggguugcaucgauuagguuacauacuuagggauguaggcaagaaagagggaggagcuauguaugcugacgacacugcggguugggauaccaggaucacauuagaggacuugaaaaaugaagaaauggugacuaaccauaugaaaggcgaacacaagaaacuagcugaagcuauauucaagcuaacguaucaaaauaaaguaguuagaguccaaagaccgacaccacgaggaacagucauggauauaauuucucguagagaucaacgcggaucaggucaaguagguacauauggauuaaauacuuucacuaacauggaagcccaacuaaucaggcaaauggagggugagggcauuuucaaauccauacagcacuugacagcaacggaggaaauagcaguucaaaacuggcucgccagaguuggccgcgaacgacuuucaaggauggcaauauccggggaugauugcgucguaaaaccaaucgaugacagguuugcaucagcacugacugcuuuaaaugauaugggaaaaguacgaaaagauauucagcaaugggaaccaucuagaggauggaaugauuggacgcaagucccguucugcucccaucacuuucaugaacuugucaugaaagacgguagaguuuuagugguuccguguagaaaccaggacgaauuaauugguagggcaaggaucagucaaggugcgggcuggagucucaaagaaacugcuugcuugggaaaguccuacgcucagauguggaccuuaauguacuuucauagacgagauuugcgacuggcugcaaaugcaauaugcagugcagugcccucacauuggguaccaacuucaagaacaacauggucaauucacgcaaaccacgaauggaugacaacagaagauauguuagccguauggaacagaguuuggauucaagagaaucccuggauggaagauaaaacgcccgucgagaguugggaagaagucccauaucuaggaaagcgagaggaccagugguguggaucauugaucggauugacuucacgggcaacaugggcgaaaaacauucagacagcgauuaaucaaguacgaucauuaaucggcaacgaagaauacacugacuauaugccaucaaugaagagauuccgucgugaggaggaggaagcgggaguguuaugguaa

SEQ ID NO: 22448 - RNA, 9876 nt, Artificial Sequence
  derived and/or modified CDS sequence (opt6) from DENV-2__EU482759__SS-prME
acagcagggguuauaguaauguugauaccuacagcuauggcuuuucacuuaacuacucgaaauggggaaccccauaugauaguuggacgacaagaaaaagguaaaagucuucuauucaaaacagaagacggaguuaacauguguacauuaauggcaauagaucuaggggaauuaugcgaagauacuaucacauacaaauguccauuacuccggcaaaacgaaccagaagauauagacugcuggugcaacucaacaagcacauggguuacauauggaacaugcacaacuaccggugaacauaggagagagaaaaggucaguugcgcuaguuccucacguaggaaugggucuagaaacaagaacagaaaccuggaugaguucggagggagcguggaaacauguccaaagaaucgaaacguggauauuacgacaucccggauuuacaauaauggcugcaauuuuggccuauaccauaggaacaacccauuuucaaagagcacuaaucuuuauacugcuaaccgcaguagccccguccaugacaaugcgaugcaucgggauuuccaauagagacuuuguggaaggcguuucaggcggguccuggguagauauugugcuagaacacggcaguugugugacuaccauggcuaaaaacaaacccaccuuagauuuugagcuuauaaaaacagaggcgaaacagcccgcaacguuacggaaauacuguauugaagcaaaauuaacgaauacaacaacagaaucacguugucccacucagggugagccgucuuuaaaugaagaacaggacaaaagauuuauaugcaaacacucuaugguggacagaggauggggcaacgggugcggacuauucgguaaaggaggaauugucacuugugcgauguucaccuguaagaaaaauauggaaggaaaaguuguacaaccugaaaacuuagaauacacuauugugauuacaccgcacaguggggaggagcaugcuguagguaaugauaccgggaaacacggaaaagaaauuaaaaucacuccacagagcucaauaacagaagcagaacuaacuggauauggaaccguuacuauggaauguaguccccgaacggggcuagacuuuaacgaaaugguacugcuucaaauggaggauaaagcauggcuuguucauaggcagugguuuuuagaucugccauugccaugguuaccaggggcggauacacaggggucaaauuggauucaaaaagagacuuuaguaacauucaaaaacccacacgccaagaaacaagaugucgugguauuagguucucaagaaggcgcgaugcacacggcuuuaacaggugccacugaaauacagaugaguucuggcaaucuacuauucaccggacaucuuaaaugccgguugcgaauggauaaacuacaacuuaaaggcaugucauauucaaugugcaccgguaaauucaaaaucguuaaagagauagcagaaacgcaacaugguacaauugugauaaggguucaguaugaaggcgauggaagccccugcaaaaucccauuugagauuaccgacuuagagaaacgacacguacuaggaagacugauaacgguuaacccuauuguaacagaaaaagacuccccaguuaauaucgaagcugaaccgcccuuuggagauagcuauauuauuauuggcguagaacccgggcaacuuaaauuaaauugguucaagaaaggauccucaauaggacaaauguucgaaaccacaaugagaggugccaaaagaauggcaauacuuggagauaccgcuugggacuuuggcagcuuaggcgguguuuuuaccagcaucggaaaagcacuucaccaaguuuucggagcaauuuacggggcagccuucaguggcgucuccuggaccaugaaaauuuuaauuggggucaucauuacauggauuggaaugaacucgagaucuacgagccuuucggucagccuuguauugguaggagugguaacauuauacuugggugcaaugguccaagcagauucuggauguguuguuucauggaaaaacaaagaauuaaaaugcggaagugguaucuuuauuacugauaacgugcacaccuggacggagcaauacaaauuccagccagaauccccaucaaaacuagcuucggcgauucaaaaagcacaugaagaagguaucugcgguauacggucaguaacgcgccucgagaaccucauguggaaacagauaacucccgaguuaaaucacauauuaagugaaaaugaggucaaauuaacaauaaugaccggugauauucgggguauaaugcaagcgggaaaaagaucauuacguccgcagcccacagaacugaaauauaguuggaagacuugggggaaggcaaaaauguugagcacagaaucacauaaucaaacuuuccuuauagauggcccggagacggcagaaugcccaaacacaaaccgugcuuggaacucacuugaggucgaagauuauggcuuuggcguuuucacaacgaauauuugguugaagcuacgugaaaaacaagauguauuuugugauagcaaguuaauguccgcagcuauaaaagacaaucgagcuguccaugcagacaugggauacuggauagaaagcgcgcuaaaugauacauggaaaauggagaaggcuagcuuuauugagguaaagucaugccauuggccuaaaucccacacacucuggucuaacgggguguuagaaucugaaaugauuaucccuaagaacuuugcaggaccgguuagucaacacaauuauagaccggguuaccauacacaaacggcagguccguggcauuuagguaaacuugaaauggauuucgacuuaugcgagggaacgaccguugucguaacugaagauuguggaaaucgagguccgaguuuacguaccacaacagcuagcgguaaauugauaacggaauggugcugcagaucgugcacuuugccuccucuuagauauagaggagaagaugguuguugguaugguauggaaaucagaccucuuaaggaaaaggaagagaacuuaguuaacagccuaguuacagcaggacauggacaaauugacaacuucagucuaggggugcugggcauggcacuguucuuggaggagauguuacgaacaagaauugggacaaaacacgcaauacuccuaguugccgugucauucguaacacuuauaacagggaacaugucauuucgcgacuuaggaagaguaaugguaaugguaggcgcuacaaugaccgaugacauaggaauggguguaacauaccuagcgcuucuggcagccuuuaagguuagaccuaccuucgcagcaggcuuacuauugagaaaauugacuagcaaagagcuaaugauggcaaccauagguauagcuuuacuuucacaaucaacuauaccggagacuauacuagaauuaacagaugcguuagcacuaggaaugaugguacuuaaaauaguccgaaauauggaaaaauaucaauuagcuguuacgauaauggcgauuaguugcgucccgaaugcaguuauucuacaaaaugcuuggaaagugagcuguacaauauuggccgcgguaucagucuccccucuucuacugacuucaucacaacagaaagcggacuggauaccucuagcauuaacaaucaaaggacuuaauccaacagcuaucuucuugacgacuuuaaguagaacgucaaagaaaagaucauggccccuuaacgaagcuauaauggcuguuggcauggucucuauauuggcuaguucucuauuaaagaaugauauuccaaugacugguccauugguagcaggaggacugcugacagucugcuauguauuaacuggccgcagcgcggaucuugagcuagaaagagcugcugaugucaaaugggaagaucaagcagagauuucuggaaguucaccaauacuaucaauuacuauauccgaggauggcucuaugaguauaaagaaugaggaagaggaacaaacuuuaacuauacuuauucguaccggacuauuaguuaucucuggaguauuuccaguuuccaucccgauuacagcugcugccugguacuuaugggaagugaagaaacaaagggcugguguacugugggauguaccguccccuccuccaguagaaaaagcugagcuggaggauggugcauacaggauaaaacaacgagguauauuaggauauucgcaaauuggagccggaguauauaaggaaggaacauuucacacaauguggcaugugacaagaggagccguacuaaugcacagagguaaaagaauagaaccgucaugggccgacgucaagaaagauuuaauuucuuacggagggggauggaagcuagaaggugaauggaaggaaggagaagagguccaaguauuagcuuuagaaccaggcaaaaacccucgugcaguacaaaccaagccagguauuuuuaaaacaaacacagggacuauaggagcuguuucauuagacuuuucccccgggacgagcgguucccccauaguugaucguaaaggcaaagucguuggacuauaugguaauggcgugguaacaaggucaggugcauauguuucugcuauagcccaaacagaaaaaucaauagaggauaauccagagauagaggacgauauauucagaaagaaacgacuuacaauuauggaucuucauccaggcgcgggcaaaacaaagcgguaucuacccgcuauuguacguggagcuauaaaacgaggucuaagaacauuaauacucgcuccuacacgagucgucgcagcugaaauggaagaagcauuaagagggcuuccaauucgauaccaaacuacagcaauaaaaacagaacacacuggacgagaaaucguggaccucaugugccaugcaacauuuacaaugagacuguuaucaccaguuaggguuccuaauuauaauuuaauaauaauggacgaagcgcauuuuacagauccagcaucaauagcagcccgggguuauaucagcaccagaguugaaaugggcgaggcagcagggauuuuuaugacugcgacgccaccggguucacgagacccguuuccucagagcaaugcaccuauuauggaugaagaacgagaaauuccggaaagaucuuggaacucugggcaugaauggguaacagauuuuaagggaaagacaguaugguucguuccaaguauaaaagcaggaaaugauauugcugcguguuuacguaaaaauggcaagaaggugauccaacugucucgaaaaacguuugauagugaauacguaaaaacccgagcaaaugacugggauuuuguaguuacaacagauauuucugagaugggagcuaauuucaaggccgagaggguuaucgaucccagaagaugcaugaaaccaguaauccucaccgauggagaagaaagaguaauacucgcuggaccaaugccgguaacgcauaguagugcagcacaacgaagaggcagaauaggaagaaacccaaagaacgaaaaugaucaauacauauacaugggagaaccguuagagaacgaugaggauugugcacauuggaaggaggcuaaaaugcuuuuagacaauauuaauacuccagaggguauuauaccaucgauguucgaaccagaaagagaaaaaguugaugcgauagauggagaguauagguuacgcggcgaagcaagaaaaacauuuguagaccuaaugaggagaggagauuuaccgguguggcucgcuuauaaaguagcagcagaaggaauuaauuaugcggaccgaaaguggugcuuugaugggaucaaaaacaaucaaauccuggaagaaaacauggaaguagaaauauggacuaaagaaggugagcgaaagaaauuaaaaccaagaugguuggaugcgcgaaucuauagugauccuuuagcacucaaagaauuuaaagaguucgcagccggacguaaaucucuaacgcuaaauuuaauaacggagaugggacgacuccccacauuuaugacgcaaaaagcuagaaaugcuuuggacaaucuagcuguccuacauacagccgaagcaggaggacgugccuacaaccaugcccucucggaauuaccagaaacauuagaaacccuacuucuauuaacacuauuagcaacagucacgggagguauauucuuguuucuaaugucagggaaaggcauagggaagaugacuuuaggaauguguugcauaauaacggccuccauauuacuaugguaugcucaaauacaaccucauuggaucgcugcaucaauaaucuuagaguucuuucugauaguucuucuaaucccagagccagaaaaacaaagaacaccgcaagauaaucaacuaacuuacgucguaaucgcuauacuuacaguaguggcugccacgauggccaacgaaaugggauuuuuagagaaaacaaagaaggaucucggcuuaggaucaauaacgacgcaggaaagcgagucuaacauucuugauaucgauuuacgaccagcaagcgcauggacucuauacgcaguugcaacuacauucguaacaccaauguuaagacauaguaucgagaacucuucagugaacguaaguuuaacugccauagccaaucaagcaacaguccucaugggauuaggcaagggauggccuuuaucuaagauggacauuggaguaccucuacuagcaauugguuguuacucacaaguuaaccccauuacauugacagcagcauuauuguugcucguagcacacuaugccauaauuggacccgggcuucaagccaaagccaccagagaagcacagaagcgagcugcagcaggaaucaugaaaaaucccacaguagacgguauaacuguuauagaccuugagcccauuccauaugauccaaaauucgagaaacaacugggucaaguuaugcugcuaauccuuugugucacgcaaguauuaaugaugagaacaacuugggcgcuuugugaagcacugacacuagcaacugggccaauuagcacguugugggaagguaacccugggcgauuuuggaacaccacaauugccguaucuauggcuaacauauuucgugguuccuauuuagcaggagcaggauuauuguuuucaaucaugaaaaauacuaccaauaccagaagaggcacugggaacauaggcgaaacuuugggggaaaaguggaagagucguuuaaaugcccuaggcaagagugaguuucaaaucuauaagaaaucgggaauccaggaaguugauagaacucuggcaaaagaagggauaaaaagaggagaaacagaucaccaugcuguaagccguggaagcgcaaaguuaaggugguucguagaacgaaauaugguaaccccugaaggaaaaguuguagauuuaggcugugguagaggaggauggucauauuauuguggcggacucaaaaauguaagagaaguuaaaggucuaacuaaaggggguccuggucacgaagaacccaucccaaugucgacguauggauggaaccuugugagguuacaaaguggagucgacguauucuuuaccccgccagagaagugcgauacauugcucugugacaucggugagaguuccccgaacccuacuauagaagccggacgaacucuaagaguucuuaacuuagucgaaaauugguuaaacaacaacacacaauuuuguaucaaaguccugaacccuuacaugccuucuguaauugagaaaauggaggccuugcaacgaaaauacgggggagcucuuguaaggaauccguuauccagaaauucaacucaugagauguauugggucagcaaugccacaggaaauauuguuagcucuguaaacaugauaucaaggauguugauaaaucgcuuuaccaugaaacauaaaaaggcuacguaugaaccugacguagaccucggaucgggaacucgcaauauuggaauagagucagaaauuccuaaucucgacauaauagggaaaagaaucgagaaaauaaagcaagaacaugaaaccaguuggcacuaugaucaggaucauccuuauaagacgugggcauaccacggaucauacgaaacuaaacagaccgguagugcuucaagcaugguuaaugguguaguacgguugcuaacaaaaccuugggaugucgugccaaugguaacccaaauggcaaugacagauacuacaccuuuugggcagcagcgaguguucaaagaaaagguugauacaagaacgcaagaacccaaggaaggaacaaagaaauuaaugaaaauaacggcagaaugguuauggaaagagcuuggcaagaagaaaacuccacguauguguacuagagaagaguuuaccagaaaaguucguaguaaugcggccuuaggagcaaucuuuacugacgaaaacaaauggaaaagugcuagggaagccguagaggacggaagguuuugggaacugguggaccgagaaaggaacuugcauuuagaaggaaaaugugaaacuugugucuacaacaugaugggaaaaagagagaagaaacucggugaauuugguaaggccaaaggaagccgggcgauaugguauauguggcucggagcuagguuuuuagaauuugaagcgcugggcuuucuaaacgaagaccauugguucaguagaggaaauagcuuauccggcguagagggugaaggucuucacaggcuaggauauauuuugcgcgaugugggcaagaaagagggaggcgccauguaugcugaugauacugcagguugggacaccagaauaacccuugaagaucugaaaaaugaagaaauggucacgaaccauaugaaaggugaacauaagaaacucgcggaagcuauauuuaaacuaacuuaccaaaauaagguugucagaguucaacgaccgacuccacgcgguacaguuauggauaucauaaguagaagggaccaacgaggcuccgggcaaguaggaacauauggguugaauacuuuuacuaacauggaagcacaacuaauacgccaaauggaaggagaaggaauuuuuaagaguauacaacaucuuacugcaacugaagaaauagcugugcagaacuggcucgcaagaguaggucgagaaagguugagccgaauggcaauaaguggggaugauuguguuguuaagccaauagaugaucgauucgcgagcgcauugacagcacuaaaugauaugggaaagguuagaaaagauauacagcaaugggaaccgucaaggggcuggaacgacuggacccaaguuccauuuugcagccaucacuuucaugaauuagugaugaaagauggaagaguccuaguaguaccuugucgaaaucaagaugaauuaauagguagggcgcguauaucacaaggagcaggcuggagcuuaaaagaaacagcaugccuggguaagucguaugcgcaaauguggacauugauguauuuucacagaagagaucuaagauuggccgcaaaugcaauuugcagugcugucccuucacauugggucccaacgucuagaaccacauggaguauacaugcaaagcaugaguggaugacaacggaagauaugcuagcgguguggaaucgaguauggauacaagagaauccguggauggaagauaagaccccuguagagagcugggaggagguacccuauuuaggcaaacgugaggaccaauggugcggaucacuuaucggacucacaucucgugcaaccugggcaaagaauauccaaaccgccauaaaccaagucagaagccuuaucggaaaugaggaguacacggauuacaugccuaguaugaaaagguuucgaagagaagaagaagaagcaggaguccucugguga

SEQ ID NO: 22449 - RNA, 9876 nt, Artificial Sequence
  derived and/or modified CDS sequence (opt6) from DENV-2__EU482760__SS-prME
accgcaggaguaauuguaaugcugaucccaacggccauggcguuccaccuuacuacucgaaauggagaaccucauaugaucguuggccgucaggaaaaaggaaaaucauuacuauucaaaacagaagacggagugaauauguguacuuugauggccauugauuugggagaacuuugcgaagauaccauaacauauaaaugcccgcuauuacgacagaaugaaccagaagauaucgacugcuggugcaauagcacuucuacuugggucacauauggaacaugcgccacgacaggagaacauagacgugagaaaagaucagucgcauuggucccacacguagguauggguuuagaaacgagaaccgaaacuuggaugaguagugaaggggcuuggaaacauguucaaagaaucgaaacauggauauuaagacacccuggauuuacaauaauggcugccauacuugcuuacacuauagguacuacacacuuucagagagcauugauuuuuauccuauuaacggccgucgcaccaucuaugaccaugagaugcauaggaaucaguaauagagacuucguggaaggcgugagcggaggauccuggguagacauuguccuggagcauggaucaugcguaaccacgauggcaaagaauaagccuacguuagauuucgagcuaauaaagacugaagcuaaacaaccggccacgcuaagaaaguauuguauagaagcuaaguugacaaacacgacgacagaaucaagaugcccuacccaaggcgagccuucuuugaaugaggaacaagauaaacguuucauauguaaacacucgauggucgauagagguugggguaauggguguggauuguuugggaagggaggaauagucacgugcgcgauguuuacuugcaagaaaaauauggaagguaaaguaguccagccagaaaaccuugaauacacaauaguaauuaccccacauuccggagaggaacaugcagucggaaaugauacagguaaacauggcaaagagauaaaaauaacaccucagagcucaauuacugaggccgaauuaacggguuacggaacgguaacuauggaguguagcccacggacgggucuagauuucaacgagauggugcuacuccagauggaagacaaggcguggcuaguccaucgccaaugguuucuagaucuuccacuaccaugguugccuggagcagauacacaaggauccaauuggauucaaaaagaaacucuggugacauuuaaaaauccucaugcaaagaaacaggaugucgucgucuuaggaucacaggaaggugcuaugcauacagcauugacaggggcaacggaaauacagaugucuucuggaaaccuacuuuucacaggacaccugaaauguagacuacguauggacaaacuacaacuaaaaggcaugagcuacuccaugugcacuggaaaauucaaaauuguuaaagaaauugccgaaacucaacaugguacgaucguaauaagaguacaauaugaaggcgauggaucacccugcaaaauuccauuugaaauaacagaccucgagaaaagacacguuuugggucgacuaauuacugugaacccaaucgugacggagaaagacaguccuguuaacaucgaagcagaaccaccauuuggcgauucauacauuaucauaggcguugaacccgggcaauuaaaacucaacugguuuaaaaagggcucaucgauaggccaaauguuugaaacuaccaugcgaggagcaaaaagaauggcaauuuuaggagauacagccugggacuuuggcucucucggcggaguuuucacuagcaucggcaaagcacugcaucaaguauucggagcaauauacggugcagcauucucagggguuagcuggaccaugaaaauuuuaauaggaguaaucauaacauggauugguaugaacucgaggucuacgaguuuaucugugagucuaguauuaguugguguuguuacauuauauuugggugcaaugguccaagcugacagcggauguguuguuucguggaagaacaaggaacuuaaaugcggcucaggaauauucaucacagauaauguacacacuuggacggaacaguauaaauuucagccagagagucccucaaaacuagcaucggcaauacaaaaagcccaugaagaaggaauauguggaauuaggucaguaacaaggcuggaaaaucucauguggaaacaaaucacaccagaauuaaaccacauucuaagcgagaacgaaguaaaacuuacuauaaugacaggagacaucaggggaauaaugcaggcagguaagagaucgcuaagaccacaaccaacugaauuaaaauauagcuggaagacguggggaaaagcuaaaauguuaaguacugaaucgcauaaucaaacauucuuaauagauggaccagaaacagcagagugucccaacacuaauagagcuuggaacucuuuagaaguugaagauuauggguucggcguuuuuacuacaaauauauggcuaaaacuucgagaaaaacaagauguauuuugugauagcaaacucaugucugcggcgauaaaagauaauagggcaguucaugcugauaugggauauuggauagaaucggcacugaacgauacauggaaaauggaaaaggcuuccuuuaucgaaguaaaaagcugucauuggccaaaaucacauacauuguggucuaacggcguccuugaaucagagaugauaauacccaaaaauuuugcgggaccaguaagccaacacaauuacagaccaggauaucauacacagacagcaggaccuuggcauuuagggaaguuggagauggacuucgaucucugugaaggaacgacagucgugguaacugaagauugcgguaaccgaggccccucucugcgcacuacaacagcgagcgguaaacucauuacagaaugguguuguaggucuugcacgcuacccccguuacgauauagaggagaggacggguguugguacggaauggaaauucgaccauuaaaagaaaaagaagaaaacuuagugaacucuuuggugacggccggccacggacagauagacaauuucucacuaggaguauuagggauggcgcuuuucuuagaggaaaugcugcguacaagaauaggcaccaagcaugcaauuuuguuaguagccguuucguuuguaacacuuauaaccggaaacaugagcuuucgagauuuaggaaggguuaugguaaugguaggugcgacaaugacagacgacauaggcaugggugucaccuauuuagcguuacucgccgcguuuaaaguuagaccuacauucgcagcaggacugcuauuaagaaaguugacuucgaaagaauuaaugauggcgacaauuggaauugcuuugcuaucacaaucaacuauuccagagacuauacuugaacuuaccgacgcauuagcgcugggaaugauggucuuaaagauuguacgaaauauggaaaaauaucaguuagccguaacgauaauggcaauuaguuguguccccaacgccgugauacuccaaaacgccuggaagguuaguuguacaauacucgcagcaguuucaguauccccacuccuacugacauccagccaacagaaggcagauuggaucccgcuugcuuugacuauuaagggacucaacccaaccgccauuuuucuaaccacuuuaucuaggacaagcaagaaaagauccuggccacuuaacgaagcgauaauggcaguggguaugguaucuauucuugcaaguucccugcucaaaaaugacaucccaaugacagggccccuuguggcagggggucuauugacaguuugcuauguuuuaacgggaagaucagcagaucuggaguuagaaagggcggcugaugugaaaugggaagaucaggcagaaaucuccggauccucaccgauacuuucuauaaccauaucugaagacgguagcaugaguaucaaaaaugaagaagaggaacaaacgcucacuauuuugauccguaccgguuugcucguaauaucaggaguuuucccagucucuauaccaauaaccgcugcggcaugguauuuaugggaaguuaagaaacaaagggcggguguauuaugggaugugccuuccccacccccggucgaaaaagcagaacuugaggacggagcguaccggauaaaacaaagaggaauauuaggauacagccaaauaggcgcaggcguauauaaggaagggacauuccacacgauguggcacguuacacggggagcgguccuuaugcaucguggaaagcggauugaacccucuugggccgauguaaagaaagaccuaauuucauauggagggggauggaaauuggagggcgaauggaaagaaggagaagaaguacaggugcuagcacuugaaccagggaaaaauccacgugcgguacaaacuaaaccgggaauuuuuaaaaccaacacugguacgauaggagcugugagucuagacuucucuccaggcaccucaggcaguccgaucguugauaggaagggaaagguaguuggauuauauggaaauggaguaguuacgcggaguggagcauauguauccgcuaucgcucagacggaaaaguccauagaagauaauccagaaauugaagaugauaucuucaggaagaaaagacuuacaauaauggauuugcaccccggugccgguaaaacaaaaagguauuuaccagcaauuguuagggaagcaauuaaaagaggccuaaggacucuuauucucgccccaaccagaguuguagccgcggagauggaggaagcccuacgggggcuacccauuagauaccaaacgacagccauuaagacugaacauaccggucgugaaaucguggaccucaugugucacgccacuuuuacuaugagacuuuuaaguccaguccgaguuccgaacuacaacuuaauaauuauggacgaagcucacuuuacugauccagcaagcaucgcugcccgagguuauaucuccacaaggguagaaaugggagaagcagcugguauuuucaugacagcuacaccgccuggaucacgugaucccuuuccacagaguaacgcuccaaucauggaugaagaaagggaaaucccagagagaucguggaauagcggccacgaguggguaacugauuuuaaaggcaaaacaguuugguucguaccuucgauaaaagcaggaaacgacaucgcggcaugccucaggaaaaaugggaagaaaguaauccaauuaagcagaaaaacuuuugauucagaauauguuaaaacucgagccaaugauugggauuuugucguaacgacggacauuucagagaugggugcaaauuuuaaagcugaacggguaauagauccucgucguuguaugaaaccagugauacuaacggauggagaagagagagugauccuugcagggcccaugccaguuacacacuccagcgcagcgcaaagacgugguagaauuggaagaaacccuaaaaaugagaaugaucaguacauauauaugggagaaccgcuggagaaugaugaggauugcgcgcauuggaaagaggcaaaaauguuacuugacaacauuaacacaccugaagguauaaucccgaguauguucgagccggaacgcgaaaaaguggaugcaauagauggugaguauagauugcguggggaggcuagaaaaacauuuguggacuugaugaggcgaggagaccuaccaguauggcucgccuacaaaguugccgcagagggaauaaauuaugcugaucggaaaugguguuucgaugguauuaaaaauaaccaaauauuagaagaaaacauggaagucgagaucuggacaaaagaaggagaaaggaagaaacuuaaaccccgauggcuggacgcucguauuuauagugauccacuagcccucaaagaauuuaaggaauuugcagcgggaagaaaaucuuuaacgcuaaauuuaauaacagaaauggguagauuaccuacguucaugacucagaaagcaagaaaugcccucgacaauuuagcgguacugcauacagccgaggcuggagguagagcguauaaccaugcauuaagugaauuaccagaaacacuagaaacuuugcugcuuuuaaccuuacuagcaacugugacaggaggaaucuucuuauucuuaaugucugggaaagguauaggcaaaaugacguugggaauguguuguauaaucacagcaaguauauuauuaugguacgcacaaauccagccucacuggauagcugccaguauaauauuagaguucuuuuugauaguuuuacuuaucccagaacccgaaaaacaacgaacaccacaggauaaucaauugacuuaugucguaauugcaauucuaacaguaguagcugcaaccauggcaaaugaaauggguuuucucgagaaaacaaagaaggauuuaggauuaggauccauuacaacacaagaguccgaaagcaauauauuagauauugaucuccgacccgcaagugccuggacguuauacgcaguugcaacuacauuuguaacuccuaugcuccgccauucgauugaaaacucaucaguaaacguaagccuaacugcuauagcaaaccaagcgacaguauuaauggguuuagguaaaggauggccuuuaaguaaaauggauauagguguucccuuauuagcgauaggauguuauagccaagugaauccgauuacuuuaacagcggccuugcuauuauuaguagcacacuaugccauuauuggacccggauuacaagcaaaagcaacaagagaagcacaaaagagagcugcugcgggcauaaugaagaacccuaccguugacggcauuacagugauagaucuagagccuauaccauaugaucccaaauucgaaaaacaacucggacaagucaugcuacucauucuaugugugacgcaaguccugaugaugcgaacuacgugggcauuaugugaagcacugacucucgcgacagguccuauaaguacguuaugggaagguaauccagguagguuuuggaauacaacgauugccguuuccauggcuaacauauuuaggggaucauauuuggccggcgcuggacuucuauuuucaauaaugaaaaacacgacuaacacucgaagaggaacaggcaauauaggggagacgcuuggggaaaaauggaaaucacguuugaacgccuuagguaaauccgaguuccaaauuuauaagaagucggggauacaggaaguggacaggacacuagccaaagaagguauuaaaagaggcgaaacagaucaucaugcuguuuccagaggcagugcaaaauuaagaugguucgucgaaaggaauaugguaacaccagaaggaaaaguaguggaucuaggaugcggaagggguggguggucguauuauugugggggacuaaagaaugucagggaaguuaagggauugacuaaaggaggaccaggacacgaagaaccaauaccaaugucuacauauggauggaaccuagugcgucuucaaagcggcguugauguauuuuucacaccuccagaaaaaugugauacacuucucugugauaucggagaaucaucaccuaaccccacuaucgaggcaggacguacccuacgaguucuaaaucucguugagaacuggcuaaauaauaauacucaauuuugcauaaaaguauugaauccuuacaugccuuccguaauugaaaagauggaggcgcuucaacguaaauauggaggagcccuaguaagaaauccacuaagucgcaauucaacccaugaaauguacuggguaucaaaugccaccggcaauauuguaucauccgugaauaugauuaguagaaugcugauaaaucgcuuuaccaugaaacauaagaaagccacguaugaaccugauguugauuuagguagcgguacgcgaaauaucggaauagaauccgagauaccaaauuuagauaucauuggcaaaagaaucgaaaagauuaaacaagagcaugaaacaaguuggcauuaugaucaagaccacccuuacaaaaccugggcauaucauggaucauaugagacgaaacaaacagggucagcaucuagcaugguaaacggaguaguuagguuacuuacaaaaccaugggauguaguuccaaugguuacccagauggcaaugacugacacgacaccguuuggucaacagaggguauuuaaagaaaaaguagauacaaggacgcaagagccaaaggaggguacuaagaaauugaugaaaauaacagcagaauggcuauggaaagaacuuggcaaaaagaaaacaccaagaaugugcacacgagaggaauuuacgcggaaaguacguuccaacgcagccuugggagcaaucuuuacggacgaaaauaaauggaaauccgcgcgugaagcaguagaggacggucgcuucugggaacuggucgaucgagaacgaaaccugcauuuagaaggaaagugcgagacauguguauauaauaugauggguaaaagggagaagaaacucggagaguucgggaaagcuaaaggaucaagagcaaucugguauaugugguuaggcgcaagauuccuagaguucgaagcacuuggauuucucaaugaagaccauugguucuccagagguaauucacugucgggagucgaaggugagggacuacaucgacuuggauacauacuccgggacguuggaaagaaagaagggggagcgauguaugcugaugauaccgcagguugggauacacguauaacguuagaagaccucaaaaaugaagaaaugguaacuaaucacaugaaaggcgagcacaagaaacuggccgaagcuauauucaaguuaacguaucaaaauaaaguagugaggguucaaagaccaaccccgagaggcacgguuauggauaucauaucaagacgagaccaaagagguucgggucaaguaggaacauauggacuaaauacuuucacaaacauggaggcacaacugauucggcagauggaaggagaaggaauuuuuaaaucaauucaacaccuaaccgcaaccgaggaaauagcaguccaaaacuggcuggcaagaguuggucgugaaagauugagcagaauggcuauuucuggggaugacuguguuguaaaacccauagacgacagauucgcaucugcucuuacagcauuaaaugauaugggaaaaaucagaaaagauauccagcaaugggaaccaaguaggggcuggaaugauuggacucaaguaccguuuuguagccaccauuuucaugagcuuguuaugaaggaugggagaguauugguuguaccuuguagaaaccaggaugagcucauaggacgcgcuagaaucucacaaggcgccggauggagucugaaagagacagcaugcuuaggcaaaucuuacgcucaaauguggacgcuaauguauuuucacagaagagacuuaagacuugccgcuaaugcgauuuguucggcuguuccgagucauuggguaccgacuucaagaacaacuugguccauucaugccaaacaugaauggaugacuaccgaagauaugcuagcaguuuggaaucgcguuuggauacaggaaaacccuuggauggaagacaagacgccaguggagucaugggaagaaguuccuuauuuagggaaacgugaagaucaauggugcggcucacugauaggacuuacaaguagagccacuugggcuaaaaauauucaaacagcaauaaaucaagugcggucacuaaucggaaaugaagaauacacagauuauaugcccaguaugaaaagguuuagacgagaggaggaagaagcggguguacuaugguag

SEQ ID NO: 22450 - RNA, 9876 nt, Artificial Sequence
  derived and/or modified CDS sequence (opt6) from DENV-2__EU482762__SS-prME
acagcaggagugauuguaaugcuuauaccaacagcaauggcauuucauuuaacaacucguaacggagaaccccauaugauuguuggacgacaagaaaaagguaaaaguuugcuauucaaaacugaagauggaguaaauauguguacccuaauggcuauagacuuaggugaacugugcgaagauacaauaacguacaaaugcccacuccucagacaaaaugaaccagaagacauagauugcugguguaauucuacaagcacaugggugacguaugguacauguaccacaaccggcgaacacaggagggagaaaagaaguguggcguuaguaccccauguuggaaugggguuagaaacacgaacagaaacauggaugagcucugaaggagcuuggaaacacguucagcgaauagaaacauggauauuacgucacccugguuuuacaauuauggcugcaauauuggcuuacacuauaggaacgacacauuuucagagagcauugauauuuauucugcuuacagcggucgcaccaucaaugacaaugagauguauugguaucucgaauagggauuucgucgaaggagucucgggaggaucauggguugauauaguauuggaacaugggaguuguguaacuacaauggccaaaaauaaaccuacauuggacuuugaacuaauaaaaacggaagcaaaacaaccagcaacuuugaggaaauacugcauugaagcaaaauuaacaaacacuacaaccgaaucacgauguccaacucaaggugaacccagcuuaaacgaagaacaggauaaaagguucaucuguaaacauucuauggucgauaggggguggggcaauggauguggacuuuucggaaaaggugguauugugacaugugcuauguuuacauguaagaaaaauauggaaggaaaaguugugcaaccugaaaacuuagaauacacaauaguaauuacuccacacagcggagaagaacaugcuguuggaaaugauacuggcaaacacgggaaagaaauaaaaaucacaccucaaucgucuauaaccgaagcggaacuaaccggauauggaacagucaccauggaaugcucuccuagaacugguuuagacuucaacgaaaugguacuacuacaaauggaagacaaagcaugguugguccaucgacaaugguuccuugaucuuccauuaccauggcuaccgggggccgauacgcaagguucgaauuggauacaaaaagaaacgcuuguaacguuuaaaaacccucaugcaaagaaacaagauguaguuguauugggcagccaagaaggggccaugcauacggcuuuaacgggggcaacggaaauccaaaugucaucaggaaaccugcuuuucacuggacaccuaaaaugccgucuacguauggacaaguuacaacucaaaggaauguccuauaguauguguacagguaaauuuaaaauagugaaagaaauugcugaaacacagcacgguacaauaguaauucgaguacaauaugagggagacggauccccauguaaaauaccuuucgaaauaacagaccuagagaaaagacaugucuuagggagauuaauuacuguuaauccuauagucacugaaaaagauuccccgguaaauauugaggcggaaccuccauuuggagauucguacauuaucauaggaguagaaccaggacagcugaaauugaauugguuuaagaaaggaagcucgauugggcaaauguuugaaacgacaaugaggggcgccaaaagaauggcaauuuuaggggauacagccugggacuuuggcucccuugggggaguuuucacuagcauaggaaaagcacuccaucagguauucggagccauuuacggggcugcauuuaguggcguaucauggacaaugaagauucugauaggagugauuauuacauggauugggaugaacucuaggucuacuucuuuaagcguaagucuaguucuaguaggaguaguaacccuauaucuuggcgcaaugguucaagcugacagugguugugucguuagcuggaaaaauaaagaacuaaaguguggaucgggaauauuuauuacggauaauguucacaccuggacagaacaauauaaauuccagccagagucaccaucaaagcuggccucugccauccaaaaagcacaugaagaagguauauguggcauaagaucugugacucgauuagaaaauuuaauguggaaacaaauuaccccagaacuuaaucauauucucagcgagaaugaaguuaaacuaacaaucaugacaggagauauacgcgggauuaugcaagcaggaaagcgaagccuaagaccccaaccaacugaauuaaaauauaguuggaagacaugggguaaggcuaagauguugucgacugaaucccauaaucaaacauuucuuauagacgggccagaaacagcagaaugcccaaacacgaaucgcgcauggaacagucuagaagucgaagacuauggcuuuggaguauucacaacaaacauuugguuaaaauuaagagaaaagcaagacguuuucugcgauucuaagcuaaugucggccgcaauaaaagauaacagagcaguccacgccgauaugggauauuggauugagagugcuuuaaaugauacuuggaaaauggaaaaagccuccuuuauagaaguaaaauccuguuauuggcccaaaucucauacacuguggagcaacggaguauuggaaagugaaaugauuauaccuaaaaauuucgccggacccguaucacaacacaacuacagaccaggguaccacacucaaacagcgggaccauggcaucuagguaaauuagagauggacuucgacuuaugugaaggaaccacaguuguugucacagaggacugugguaacagagggccgucacuacggacuacgacagccaguggaaaguugauuacagagugguguugucgaaguuguacacugccaccucugcguuaccgaggggaggacggaugcugguauggaauggaaauacgaccgcuaaaagagaaagaagagaauuuagucaacucguuaguaacugcggggcauggccagauagacaauuuuucauuaggaguucuggguauggcgcuauuucuugaagagaugcuuaggacaaggauuggaaccaaacaugcaauacuuuugguagccguuuccuuuguaacacugauaacaggaaacauguccuucagggaucuaggucgcguuaugguaaugguuggugcaacgaugacagaugauauaggaaugggagugacauauuuagcuuuacuagcugcguuuaaagugagaccaacuuucgcagcuggguuauuacugcguaaacugacuagcaaagagcugaugauggcuacuaucggaaucgcucuauugagucaauccacaauaccagagacuauacuugaacuaaccgaugcacucgcacuagguaugaugguuuugaagaucguuagaaacauggaaaaguaccaguuagcaguuacgauaauggcaauaucgugugugccuaaugcaguaauucuacaaaaugcguggaaaguaagcuguacaauuuuagcagcuguuagugugucaccauuacuucuuacaaguucacaacaaaaagcagauuggauaccuuuagcacuaaccauaaaaggacuuaaccccacagcuauauuccugacaacguugagcagaacaagcaagaaaagaucauggccacuaaaugaagcaauuauggcuguagguauggucaguauauuagcaucuagcuuacuuaagaaugauauaccgaugacuggaccacuuguugcagggggcuuacuuacaguaugcuauguuuuaacggguaggucagcggaucuagaacuugaacgagcugcagauguuaaaugggaggaucaggcggaaauaucagggucaagcccuauucuaucaauuacaauuagugaagacgguuccaugucgaucaaaaaugaagaggaagaacagacuuuaacaauccuuauaagaacuggcuuauuaguaauuuccgggguuuuuccgguaaguauuccuauaacggcagcugcuugguacuuaugggaagucaaaaagcaaagagcggggguguuaugggacguaccgucucccccgccaguugagaaagcagaacuagaagacggggcguauagaauaaaacaaagaggcauacuagguuauagccagauaggagcaggaguauauaaagaaggcacguuucauacuauguggcacgugacucgcggugccguacugaugcacagaggcaagcgcauugagccgucuugggcugacgucaagaaagacuugaucucuuauggagguggauggaaguuagaaggugaauggaaagaaggcgaggagguucaagugcucgcauuagaaccugggaaaaaucccagggccguacaaacgaaaccagguauauucaagacuaacacagguaccaucggagcgguaagucuagauuuuagcccaggaacaagugguucuccaauaguagauagaaaaggcaaagucguaggucuuuacggaaauggagucguuacucgcucaggagcauauguaucagcaauugcccaaacugaaaaauccauugaggauaauccagaaauagaagaugauauauuucgaaagaaaagguuaaccaucauggauuuacauccuggggcaggaaagaccaaaagauauuuaccggcgaucgucagagaagcgaucaaacgcggucuuagaacauuaauauuagcacccacuagaguaguagcugcggaaauggaggaggcuuugaggggucuacccaucagauaucagacuacagcaaucaaaacagagcauacaggaagagaaauuguugacuugaugugucacgccacguuuacuaugagauugcuaucaccggugagggugccaaacuacaaccugauuauaauggaugaagcucauuucacagauccugcaaguauagcagcuagaggcuauauauccacgcgaguagaaaugggcgaagccgccggaaucuucaugacugcuaccccuccaggcuccagagaccccuuuccccaauccaaugcacccauaauggaugaagaaagagaaauaccagagcguucuuggaacuccggacaugaauggguuacagauuuuaaagguaaaacugucugguuuguuccuagcaucaaagcagggaacgacauagcugcaugcuugaggaaaaacggcaagaaaguaauccaacuuucacguaaaacguuugauagugaauacguuaagacgagagcuaacgacugggacuucgugguaacaaccgacauaagugaaaugggagcgaacuucaaggcagagagaguuauagacccccgaaggugcaugaagccagucauucuuacagauggagaggaacguguuaucuuagcggggccuaugcccguuacccauucuuccgcugcucaacggagagggagaaucggucgcaaccccaaaaaugagaaugaccaguauauauauaugggagaaccccuugaaaacgaugaggacugcgcacauuggaaagaggcgaaaauguugcuagauaacauuaauaccccugaggggauuauuccuuccauguuugaaccggaaagggagaagguggaugcaauagacggggaauauagguugagaggcgaagcacguaaaacauuuguagauuugaugcgaaggggagaccuuccugucuggcuugccuacaaaguugccgcagaggguauaaacuacgcugaucgaaaaugguguuuugacggaaucaagaauaaucagaucuuagaagagaauauggaaguagaaauuuggacuaaagaaggugaaaggaagaaacucaaaccaaggugguuagaugcucgcauauauucugauccucuagcuuuaaaagaguucaaggaguucgccgccgggagaaaauccuugacucuaaauuuaauuaccgaaauggguaggcugccuacauuuaugacacaaaaagccagaaaugcacuugacaaucuugcugucuuacauaccgcugaagccgguggacgagcguauaaucacgcuuuaagcgaauuaccugaaacuuuggagaccuuguuacuacuuacauuacuagcuacuguaacgggcggaauauucuuauucuugaugucaggaaaaggaauaggaaagaugacauuagguaugugcuguaucauuacagccucuauauuacuaugguaugcucaaauacaaccacauuggaucgcagcgucuauuauucuagaguucuuucuaauuguucucuuaauaccagaaccagaaaaacaaagaaccccucaagauaaucaguuaacuuauguagucauagcaauauugaccguggucgcagcaacaauggcgaacgaaaugggauucuuagagaaaacuaagaaagacuuaggguuaggaaguauaaccacacaggaaucugagaguaauaucuuagacauagaccuucgaccggcaucagcguggacguuauacgcuguagcgacaacauucgucaccccgauguuacgacauucaauagaaaauucuucuguaaacguuagucuaaccgcaaucgcaaaucaagccaccguuuuaauggggcuaggaaaggguuggccucucucuaaaauggacauaggagugccucuccucgcuauagguugcuauucucaaguuaauccgauaacacuaacggcagcauugcuacuacuugucgcacauuacgcaauuauagguccgggccuccaggcuaaagccacucgggaggcacaaaagcgugcagcggcgggcauuaugaaaaauccgacagucgauggaaucacaguaauugauuuggaacccauaccauaugacccgaaauuugaaaagcagcuuggucaggucaugcugcuaaucuuauguguuacacaagugcugaugaugcgcaccacaugggcacucugugaagcguuaacucuugcuacugguccuauaaguaccuuaugggaaggaaacccaggacgcuuuuggaacacuaccauagcaguuaguauggcaaauaucuuuagaggcaguuaccuagcaggagcuggauuauuauuuagcauaaugaaaaacacaacaaauacaagacgcggaacggggaacaucggagaaacuuuaggagagaaauggaaaagcagguugaaugcuuuggguaaaagcgaguuccagauuuacaaaaagucaggcauucaagaaguugacagaacguuagcuaaggagggcauaaaaagaggagaaacagaucaucaugcaguaucgagggggagcgcaaaauugagaugguucguagagaggaauaugguuacaccagaaggaaaaguuguagaucuaggaugcgguaggggaggguggagcuauuacugcgguggacugaagaacguccgugaagucaaaggucuaacgaaaggcggcccgggccaugaagaaccgauuccaaugucaacuuauggauggaauuugguuagacuacagucuggaguggauguauuuuucacaccuccagaaaaaugcgauacuuuacuuugugauauuggagagucaucucccaauccgacaauagaagcgggaaggacacuuagaguauuaaacuuaguagaaaacugguuaaacaauaauacacaguuuugcauaaaaguacucaauccauauaugccaucuguuauagagaaaauggaagcauugcaaagaaaguacgguggagcacucguuagaaauccguuaagccgaaacagcacccacgagauguauuggguaaguaaugcuacaggaaauauagucuccucgguaaacaugauaucuaggauguuaauuaauagauucaccaugaaacacaaaaaggccacauacgaaccugacguagauuugggcuccggaacaaggaacaucgggauugaguccgagauaccgaauuuagauauuaucgggaaaagaauugagaaaauaaagcaagaacaugaaacgucauggcacuaugaccaagaccauccauauaagacaugggcuuaucacgggucauaugagacgaagcaaacugggucagcgucgagcaugguuaacggaguuguccgacugcuuaccaaaccaugggacgugguuccgaugguuacacaaauggcaaugacggauacuaccccuuucggacaacaacggguguucaaagaaaaaguagauacaaggacacaagagccaaaagaaggaaccaagaaauuaaugaagauuacagcagaaugguuauggaaagaacuagggaagaagaaaacuccccguauguguacucgugaagaguucacgaggaaagucaggaguaaugcugcucuaggcgccauauuuacagaugagaacaaauggaaaucagccagagaagcuguggaagacggaagauucugggaacugguugaucgugaacgcaaccuucacuuggaaggaaaaugugaaacguguguauauaacaugaugggaaaacgagaaaagaaauugggagaguucggcaaggcuaaaggaaguagagccauaugguauauguggcucggcgcgagauuccucgaguucgaggcucuuggauuccuaaacgaagaucacugguuuucccggggcaauucucuaucaggcguagaaggcgaaggucuucaccgacuuggauauauacucagggauguaggaaagaaggagggaggagcaauguaugcugaugauacagcggguugggauacucggauuaccuuagaagaccucaagaaugaagaaauggucaccaaccauaugaaaggagaacacaagaaacuggcagaagccauuuuuaaacuuacauaucaaaauaagguaguucguguacagagacccacgcccagaggcacugugauggauauaauaagccgcagggaucaaagaggaucaggacaaguagguacauauggcuugaacacguuuacgaauauggaggcucaacuaauaaggcaaauggaaggugaggguauauucaaaaguauacagcaucuaacagcgacagaagaaaucgcuguacaaaacugguuagcacgagugggcagggaaaggcugucaaggauggcaauaagcggugaugacuguguggugaaaccaauagaugaucgauucgcuucggcacuaacugcacucaaugacauggguaaaguaagaaaggacauccaacagugggaaccuucacgagguuggaaugauuggacacagguaccauucugcucgcaucauuuucaugaauuagucaugaaagaugggcgcguuuuaguagugccauguagaaaccaagacgaacucauagguagggcccgaaucucucaaggggcaggcuggucucuuaaagaaacugcaugcuuagggaaaaguuaugcacaaauguggacuuuaauguacuuucacagaagagauuuaagauuggcagcaaacgcaauaugcagcgcaguacccagccauuggguuccuacaucacguacgacauggucgauacacgcaaaacaugaauggaugaccacagaagacaugcucgcaguauggaauaggguguggauacaagaaaauccauggauggaagauaaaacuccuguagaaucaugggaagaaguucccuaucuaggaaaacgcgaagaucaauggugcggaagccuaauuggacucacgucucgagccacaugggccaagaauauucagacagcgauaaaucagguaagaagucuuauuggcaaugaagaauauacugauuauaugcccucuaugaaacgauucaggcgcgaggaggaggaggcugggguauugugguaa

SEQ ID NO: 22451 - RNA, 9876 nt, Artificial Sequence
  derived and/or modified CDS sequence (opt6) from DENV-2__EU482763__SS-prME
acugcgggagucauagucaugcuaauaccuacugcaauggcguuccaucuuacaacucggaauggugaaccccacaugauugucggaagacaagaaaaaggaaagagcuuacuauuuaaaacagaagauggaguuaauauguguacguuaauggcaauggaccuaggagaauuaugugaagacacaauaacuuacaaauguccacuucuaagacaaaacgaaccugaagauaucgauuguuggugcaauucaacgucuacauggguaacauaugguacuuguaccacuacuggggaacauagacgagagaaaaggucagucgcauuaguaccucacguugguauggggcuugaaacuaggacagaaaccuggaugucaagcgaaggugcguggaaacaugugcagagaauagaaacuuggauacuuagacauccaggauucacuauaauggccgcaauauuggccuauacaauaggaacgacacacuuccagagagcauuaauuuuuauacuccuuacggcaguagcgccaagcaugaccaugagaugcauuggaauaaguaauagggauuucguagaaggugucagugguggcucguggguagacauaguacuagaacacgguucuugcguuacuacaauggcaaagaacaaaccuacccuggacuuugaauuaaucaaaacagaagcgaaacaacccgccacuuuaagaaaguauuguauugaagcgaaauugacaaauacuacaacagaaaguaggugccccacacaaggagaaccaagucuuaaugaagaacaagauaaaagauuuauuuguaaacacucaaugguugacagagguuggggcaauggcugugguuuauuugguaaaggagggauaguuaccugugcaauguuuacuuguaagaaaaacauggagggcaaaguaguccaacccgaaaauuuagaauacacaauugucauuacaccccauuccggugaagaacaugcaguggguaaugauacgggaaagcacggaaaagaaauaaaaauaacaccucaaagcagcauaacggaagcagaacugaccggguacgggacuguaacuauggaauguucgccucgaaccggauuggacuuuaacgaaaugguccuguugcaaauggaagauaaggcuuggcuaguacauagacaaugguuucucgaccucccucuuccguggcuaccuggugcagacacacaaggaucgaauuggauacaaaaggaaacacuuguaacuuuuaaaaauccacacgcgaagaaacaagauguaguuguacuagguucgcaagaaggagcaaugcauacggcauuaacaggcgcaacggaaauucaaaugucaucuggaaacuuacuauuuacggggcaucuuaaaugcagauuaagaauggauaaguugcaacuaaaaggaaugucuuacaguauguguaccggcaaauucaaaauagugaaagaaauugcagaaacacaacaugguaccauaguaauucguguccaguaugaaggugauggaagucccuguaagauaccauuugaaaucacagaucuugagaaaaggcauguacuagguagacuaauaacgguuaaccccauagugacagaaaaagacaguccagugaauaucgaagccgaaccaccguucggggacaguuauauuauaauaggaguugaaccaggucaacuuaaauuaaacugguucaagaaagguucuaguaucggucaaauguuugaaacuaccaugcggggugcgaaacguauggcaauacucggcgauaccgcuugggacuuuggaucccugggugguguauuuacaucaauaggcaaggcuuuacaccaagucuucggagcuauauauggugcagcguuuucaggcgugagcuggaccaugaaaauacuaauugguguuaucauaacuuggauagguaugaacagccgaucuaccucuuuauccguuagucuuguauugguggggguugugacauuauaccugggugcaaugguacaagcagauagcgguugugugguaucauggaaaaacaaagaauuaaaaugugggucugguauauuuauaacagauaauguacauacauggaccgaacaauauaaauuucaaccagagucgccaucaaaauuggcaagcgccauucaaaaagcacaugaagaaggaauauguggaauuagaucaguaacuagacuagaaaacuuaauguggaaacaaauuacaccugaauuaaaucacauauuaagugaaaacgaggugaaauuaacgauaaugacaggagauauuaggggcauaaugcaagccgggaaaagaagccuaagaccacaaccuaccgaacuuaaauauaguuggaagacguggggaaaagccaaaaugcuaucaaccgaaagccauaaccaaacguuuuuaaucgacggacccgaaacugccgaauguccaaauacaaauagagcuuggaacucauuggaaguagaggacuauggauucgggguauuuacaacuaauauaugguugaaacuuagggaaaaacaagauguauuuugcgacucuaaguuaaugucugcagcuauuaaagacaaccgggcaguacaugcugauaugggauacuggauugaaagcgcguuaaaugauacauggaaaauggagaaagcuagcuuuauagaaguaaaaucuugucauuggcccaaaucacauacucuauggagcaauggagugcuagaaagugaaaugaucauaccgaaaaauuucgcugggccagugucgcaacacaauuauagaccgggauaucacacucagacugcuggucccuggcaccuagggaaacuggagauggauuuugauuuaugcgaaggaacuacggucgucgucacugaagacugcggcaaccgaggucccucacucagaacaacuacggcaaguggaaaauuaauaacugaguggugcuguagaaguugcacucuaccaccucugcgauaccgaggugaagacggaugcugguacgguauggaaauuagaccauuaaaagaaaaagaagaaaacuuagucaauucacuugucacagcaggucacggccaaauugacaauuuuucucuaggcguuuugggaauggcucucuuccuugaagaaaugcuaaggacacgcauaggcacuaaacaugccauccucuuaguugcggugucauucguuaccuuaauaaccgguaauaugaguuuucgugaucuaggccgagugaugguaaugguuggggcaaccaugacagaugacaucggaaugggaguuacguacuuagcccugcuagccgcauuuaagguuagacccacauuugcugccgggcuacucuugaggaaauugacaucaaaggaauugaugauggcaacgaucggcaucgcauugcugagucagagcacaauccccgaaacaauacuggaacuaaccgaugcuuuagcauuaggcaugauggugcuuaagauaguaagaaacauggaaaaauaccaacuagcagucacuaucauggccaucuccugugugcccaaugcaguuauacuacaaaaugccuggaaaguauccuguacuauucuggcagccgucaguguauccccucuucuucuaaccucgucccaacaaaaggcugauuggauaccccucgcacucacaaucaaaggacuuaauccgacagccaucuuucuaacgacccucucccgaacauccaagaaaagaagcuggccguugaaugaagcgauaauggcaguaggcaugguuucaauuuuagcaucgucucugcucaaaaacgacauccccaugacagguccucuaguggcgggaggucuguuaacaguuugcuaugucuuaacaggucgaagugcugacuuagaguuagaacgggccgcugacguaaaaugggaagaccaggcugaaauaagcgggucuucacccauucuuucaauaacaauuucugaagaugggaguaugucuaucaaaaaugaggaagaggagcaaacauuaacuauauuaauaagaacaggacuucuaguaauaucuggcguauuccccgugucaauccccauaacugcggccgcgugguaccuaugggaggucaagaaacaacgagcuggcguacugugggacguuccaaguccacccccgguagaaaaagcugaguuagaagauggagcguaucgaauaaaacaaagagguauauuagguuacagucaaauuggcgcaggggucuauaaagaaggcacauuucauacaauguggcacgugaccagaggugcggucuugaugcaucggggaaagcggauagaacccucaugggcagaugugaaaaaggacuuaauaaguuacggagguggauggaagcuagaaggggaauggaaagaaggagaagaaguacagguauuggcacuagaaccaggcaaaaauccgagagcgguacaaacaaaaccaggaauuuucaagaccaauacaggcacaauaggagcaguuucauuagacuucucaccagguacaucugguaguccaauuguagauagaaaggguaaaguaguaggucuauauggaaacggcguugucacuagaagcggagcuuacguaagcgcuaucgcacaaaccgaaaagucgaucgaagauaauccagaaaucgaagacgauaucuucagaaagaaacguuuaacaauaauggaucuacauccgggugcgggaaaaacaaaaagguaucuuccugcaauuguacgagaagccaucaaacgaggauuaagaacacucauacuugcgccaacucgggucguagccgcagagauggaagaagcucuacgcggucuuccaauacguuaucagacgacugcuauuaagaccgaacauacagggcgugagauaguagaucucaugugucacgcaaccuuuacaaugcgacugcuuuccccaguacgcgucccgaacuacaauuuaauaauaauggacgaagcacacuucacagacccugcaaguauagcggcaaggggauacauaaguacacgaguugaaaugggagaggcagcugguauuuuuaugacugcgacaccaccaggaagccgugacccauuuccucaaucuaaugcaccgauaauggaugaagagagggaaaucccagagagauccuggaacagugggcaugaguggguaacagauuucaaagggaaaacagucugguucgucccaucgauuaaagcuggcaaugacauagccgcaugucuacguaagaacggaaagaaggugauccaacucuccagaaaaacauuugauagcgaauaugucaaaacuagggcaaaugauugggauuuuguuguuacaacugacauauccgagaugggugcaaauuuuaaagcugaaagaguuaucgauccacgacguugcaugaagccgguuauacuuacugauggugaagaaagggucaucuuggcaggaccgaugccggugacgcauucuucagcagcccaacgacgcgguaggauaggucgcaauccuaaaaaugaaaaugaucaauacauuuauaugggcgaaccgcuagagaaugacgaggacugugcucacuggaaagaggcaaaaaugcugcuagauaauauuaauacaccugaaggaauaauaccgaguauguucgagccggagagggaaaaaguugacgcuauugauggcgaauauaggcucagaggggaggcucgaaaaacguuuguggaccuuaugcgccgaggagacuuaccuguaugguuggcguacaaaguagcagcagaaggaauuaacuacacggaccgaaaauggugcuuugaugguauuaagaauaaucaaauucuggaagaaaauauggaaguagaaauauggacgaaagagggugaacgaaagaaauuaaaaccgaggugguuagacgccagaauauauucugauccccucgcauuaaaggaguucaaagaauuugcugccgggaggaagucuuuaacacucaaccuaauaacagaaaugggccgauuaccaacuuucaugacgcaaaaagcgcgaaaugccuuagauaauuuggcuguacugcacacagcagaagcuggaggucgugcuuacaaucaugccuuaucugaacuaccagagacucuugaaacgcuguuauuauuaacucuucuagccaccguuacaggaggaauuuuucuguuccuaaugucagguaaaggaauagggaaaaugacccuaggaauguguuguauaauaaccgcaaguauauuacuaugguacgcucaaauucaaccacauuggauagcagcuagcauuauuuuagaguucuuccuaaucguccuuuuaauuccagaaccagaaaaacaaagaacaccgcaagauaaucaguugacauauguaguaauugcuauuuuaacuguggucgcggcaacaauggcaaaugaaaugggcuucuuagaaaagaccaagaaagaucuaggacuuggaucaauaacaacccaagagagcgaauccaacauucuggauauagaccuaaggccugcgagugcuuggacucuuuacgcgguagcuacaacuuuuguaacaccaaugcucaggcauucuaucgagaauagcucuguaaauguaucuuuaacagcuaucgcgaaucaagcuaccguuuuaaugggcuuagguaaggguuggccacuaucgaaaauggauauuggagucccacuauuagccauagguuguuacucgcaaguaaaucccauuacacuaacggcagccuuguuacuauuagucgcacauuacgcuauuauagguccuggucuucaggcaaaagcgacacgagaggcacaaaaacgggcagccgcuggcauaaugaaaaauccaacaguagacggaauaacuguaauagacuuagagccaauucccuaugauccgaaauuugaaaaacaacuagggcagguaaugcuauuaauacucugcgugacucagguccugaugaugagaacuaccugggcauugugugaagcguugacguuagcuacaggcccaauaaguacauuaugggaaggaaacccgggucgauucuggaauacaacgauugccgucaguauggcaaacauauucagggggagcuaucucgcaggggccggauuauuauucuccauuaugaaaaauaccacuaauacacguagagguacggggaauauuggagaaacacuuggagagaaauggaaaucuagacugaaugccuuaggaaaaucagaauuucaaaucuacaaaaagucuggaauacaagaaguggacagaacuuuggcaaaagaaggaaucaaacgaggggaaacagaccaucaugcgguuagcagaggaagcgcgaaauugaggugguuuguagaacgaaacaugguaacccccgaggguaagguaguagacuuagguugugggcgaggcggguggucauauuacugugguggucuaaagaacguccgugaaguaaagggucuaaccaagggagggccuggccaugaggaacccauuccuaugagcacauacggauggaacuuagugaggcuccaauccggcgucgauguguucuucacucccccugaaaaaugcgauacacuucuaugcgauauuggagaaucauccccaaacccaacuauagaagcgggaagaacccuaaggguauuaaacuugguagagaauugguuaaacaacaacacacaauucuguauaaagguauuaaauccauauaugcccucaguuauagagaaaauggaggcuuuacagagaaaauacgguggugcauuagugaggaacccguuaucaaggaacucaacccaugaaauguacugggucaguaaugcgacagggaauauagucagcagcguuaauaugauaucucguaugcugauuaauagguucacuaugaaacauaagaaggcgaccuaugagccggaugucgacuuagggucuggaacaagaaauauaggaauagaaucagagauucccaaccuagauauaauuggaaaaagaauagagaaaaucaaacaagagcaugaaacaagcuggcacuaugaucaggaccaucccuauaaaaccugggcauaucauggaucuuaugaaaccaaacaaacaggaagugccucgagcaugguuaaugggguuguuagacugcucacaaaaccuugggauguagucccuaugguaacacaaauggcaaugacugacacaacgccguucggacaacaacgcguauucaaagagaaaguugauacaaggacacaagaaccaaaagaagguaccaagaaauuaaugaaaauuacagccgaaugguuguggaaagaauuaggcaaaaagaaaacuccacgcauguguaccagagaagaguuuacuagaaaaguccgauccaaugcagcauugggagccauauuuacagaugaaaacaaauggaaaucugcuagagaagccguugaagacggacgguucugggaauuaguggauagggaacguaaucuacaucuggaagguaaaugugaaaccugcguuuacaauaugaugggaaaacgugagaagaaauuaggagaguuugggaaagcaaaagguucacgugccauuugguauauguggcuuggagcacgauuucucgaguucgaagcacuugguuuucugaacgaagaccauugguuuucacggggaaauucauugucagggguagagggggaagguuuacacagacuuggguauauauuacgggacguaggcaagaaagaaggaggagccauguaugcugaugauacagcuggaugggacacgcgaauuacgcuggaggaccugaaaaacgaggaaauggugacaaaucauaugaaaggagaacauaagaaacuagcagaggcaauuuuuaaauuaacguaccaaaauaaagucgucaggguccagcgaccaacuccaagaggaacggucauggacauaaucucgcgcagagaucagcgggguucugggcagguagggacauauggccuuaauacguuuacgaauauggaggcgcaauuaauuagacagauggaaggagaggguaucuucaagucaauacaacaccuuacagcaacugaagagauugcuguucagaacuggcuagcaagaguaggaagagagcgccuaucaagaauggccaucagcggagaugauuguguuguaaagccaauugaugacagauuugcaagcgcacugacagccuugaaugauauggguaaaguccguaaggauauacaacaaugggagccgucaagaggauggaaugauuggacgcaagugccauuuugcucucaucauuuucaugagcuaguaaugaaagauggaaggguguuagugguuccauguagaaaccaagaugaacuaaucggacgggcaaggauaucccaaggagccgguuggaguuugaaggaaaccgcuugccuagggaaaucuuacgcucaaauguggacauuaauguauuuccacagaagggaccugaggcuugcugcaaacgcuauaugcagugcugugcccucacauuggguccccacaucgcgcacaacuuggucaauacaugcgaaacacgaauggaugacaacugaggauauguuggcgguuuggaauagaguuuggauacaagagaacccguggauggaagacaagacaccagucgaaucuugggaagaaguuccauacuuagggaaaagagaagaucaauggugcgguucguuaaucggacuuacgagcagagccacaugggcuaagaauauccagaccgcaauuaaucaaguaaggagucuaauuggaaacgaagaauauacagacuacaugccaagcaugaaaagauuucgucgagaggaggaggaggccgguguuuuaugguaa

SEQ ID NO: 22452 - RNA, 9876 nt, Artificial Sequence
  derived and/or modified CDS sequence (opt6) from DENV-2__EU482444__SS-prME
acagcaggaguaauuguuauguuaauacccacagcaauggcauuucacuugacgacacgaaauggcgaaccgcacaugauuguuggccgacaagagaaagggaaaucauuauuauuuaaaacagaagacggcgucaacaugugcacgcuaauggccauggaccuaggugaauuaugcgaagauacaauaacuuauaaauguccacuuuuaagacagaaugaaccagaagauaucgauuguugguguaacuccacaucaacguggguuaccuacgggacauguacgacuacuggggaacauaggagagagaagcgaucaguagcauugguaccacauguaggaaugggacuagaaacacgaacagaaaccuggaugucuagugagggagccuggaagcaugugcaaagaaucgaaaccuggauccucagacauccaggcuucacuauaauggcugcuauauuagcuuauacaauugguaccacccacuuccaaagagcacucaucuuuauacuacucacagccguagcaccaucaaugacuaugcguuguauugguauuucaaacagggacuuuguagaaggcgucaguggugggucuuggguagauauaguuuuggaacauggcaguuguguaacaacuauggcgaaaaauaaaccaacgcuagacuuugaauuaauaaaaacagaagcaaaacagccggcaacccuccgaaaguauuguauugaggcaaagcuuaccaauacaaccacggaaucaagaugccccacucaaggugagccgucucuaaaugaggaacaagauaaaagauucauauguaaacauucaaugguagacagaggauggggaaacggauguggccuauucggaaaaggaggaauuguaacgugcgcaauguuuacguguaagaagaauauggaagguaaaguaguacaaccggagaaccuugaauauacuauaguuaucaccccgcacucuggagaagagcacgcuguggguaacgauacuggaaaacacggcaaggagaucaaaauuacaccccaaagcucaauaacagaagcugaacuaacuggguacggcacuguaacuauggaauguucgccgaggacaggauuggacuucaaugaaauggugcuuuugcaaauggaagacaaggcaugguuagugcaccgacagugguuuuuggacuuaccccuucccuggcuaccuggagcugauacgcagggaucgaauuggauacagaaagaaacguuagucacauuuaagaauccacaugcgaagaaacaagacguaguaguauugggaagucaagaaggagcaaugcauacagcauugaccggagcuaccgagauucaaauguccagcgggaacuuacuguucaccggacaucugaaaugccgacugcgaauggauaaauuacagcuuaaagguaugucauacuccauguguacaggaaaauucaaaaucguaaaagagauagccgaaacacaacacggaacaauuguaauuagagugcaauaugaaggagacggaucaccuugcaaaauuccauuugaaaucacagauuuagaaaaaagacauguucugggcagacuaaucacgguuaacccaauaguuacggaaaaagacaguccaguaaacaucgaagcugaaccaccuuucggcgauaguuauauaauaauuggagucgaacccggacaauugaaacuaaauugguucaaaaaaggcucaagcauaggacaaauguucgaaacaacuaugagaggagcaaagaggauggcgauccuaggagauacagcuugggauuucggaucauuaggaggggucuucaccucaauuggaaaagcucuccaccagguauucggagcaauuuacggggcggcauuuuccggagugaguuggacaaugaaaauacuaauaggugugauaaucacauggauuggaaugaacucccgaagcacaagcuugaguguaagccuggucuuagucgggguuguaacucuauaccuuggggcuaugguacaagcagauaguggaugcguugucucuuggaaaaacaaggaguugaaaugcggaaguggaauuuuuauaacugacaauguacacaccuggacagaacaauacaaauuccaaccagagucuccaaguaaacucgcgagugcgauacaaaaggcacaugaagaaggaauuuguggaauacggagugucacuagauuagaaaauuuaauguggaaacaaaucacaccagaacuaaaucauauacuauccgaaaaugaaguaaagcuuacgauaaugacaggagauaucagaggaaucaugcaggccgguaaacgaucauuacggccacaaccuacagagcuaaaguauaguuggaaaacuuggggcaaagcaaagauguuaucgaccgaaucgcauaaucaaacauuccugauugacggcccagaaaccgcugaaugcccuaacaccaauagagccuggaauucauuagaaguggaagauuauggauuuggaguauuuaccacuaacauuuggcuuaaauugcgggaaaaacaagauguguucugugacagcaaauugaugagugcggcaauuaaagauaauagggcaguucaugcagacaugggguacuggauugaaucagcccuaaaugauaccuggaaaauggaaaaggcuaguuuuauagaggucaaaucgugccacuggccgaaaagucauaccuuauggucaaacggcguacucgaaucggaaaugauuauuccaaagaauuucgcggguccaguuagucaacauaacuaucgcccaggauaucauacacaaacagccggucccuggcauuuggguaagcuagagauggauuucgaccuaugcgaaggcaccacaguuguaguaacagaggauugugggaacagaggaccauccuugcgcacaacaaccgccagugguaaacucauuacagagugguguugucguucuugcacuuuaccuccauuaagauacaggggugaggacggcuguugguauggcauggaaauacguccauuaaaagaaaaggaagaaaauuugguaaacucacuuguuacugcuggacacggacagauagacaauuucucauuaggcguacugggaauggcgcuguuccucgaagaaaugcuuaggacgcgcauaggcaccaaacaugcgauucuuuuagucgcaguuagcuucgucacucuuauaacgggaaacaugagcuuucgcgaucuagggagggugaugguuauggucggagcaaccaugacagaugacauuggcaugggaguuacauaucucgcacuacuagccgcauuuaaaguccgaccuacauucgcagcaggccuccuacucaggaaacucacuaguaaagaauuaaugauggcuacaauagggauagcucuacuaagucaaucaacgauaccggaaacaauauuagaacuuacagaugcacucgcguuagguaugaugguauuaaaaaucguuaggaacauggaaaaauaucaauuggccguuacuauaauggcgauaaguugugugccuaacgccgugauauugcagaacgcauggaaaguaucauguacuauauuagcagcuguuucaguaucaccacuuuuguuaacuucuucucagcaaaaagcagauuggauuccucuggcucucacgauaaaagguuugaauccgacugcaauauuucuuacaacacucuccagaacaaguaaaaaacguaguuggccucuaaacgaagcuauuauggcuguaggaaugguuucgauacucgcuucgagccuauuaaaaaacgauaucccaaugacaggaccccucguggccggaggguuguugacgguauguuauguguuaaccggaagaucugcugauuuagaacuugagagggccgcugacgucaaaugggaggaccaagcggaaauaucaggaaguucgccuauuuuaucuauaacaauaucagaagauggaucaaugagcauuaagaaugaggaggaggaacaaacuuuaacuauauugauacgaaccggccuuuuaguuauuucaggcguauuucccguaagcauacccauuacugcggcagcaugguauuugugggaaguaaagaaacagcgagcuggcguacuaugggacguaccaagucccccucccguagaaaaggcagaauuagaggacggagcauaccguaucaaacaacgagguauacuggguuauagucagaucggggcaggcguguacaaggaagggacauuucacacuauguggcacgugacuagaggugcuguauuaaugcauaggggcaagagaaucgaaccgucuugggcggacguaaagaaagacuugauaucuuacgggggugguuggaaauuggaaggagaauggaaagagggagaagaaguccaaguccuggcauuagaaccaggaaaaaacccgagggcuguucaaacgaagccaggaauuuucaagacgaauacuggcaccaucggagccguauccuuagacuucuccccgggcacaucaggaaguccaauaguagaccgaaaagggaaggugguagggcuguacggaaacgguguagugacgcguucuggagcauauguaucugcaauagcacaaacagaaaaaagcauagaagauaacccagaaauagaagaugauauauucaggaagaagagauuaacgauuauggauuuacacccuggagcgggcaaaacaaaaagauacuuaccggcgauaguuagagaggcaauaaaaaggggucuaagaacacuaauuuuagcgccaacaagggugguagcugcugaaauggaagaggcacucagaggauuaccuaucagauaccaaacaacagccauuaaaacagaacacacaggucgagaaauaguagauuuaaugugccaugcaacauucacaaugcguuuacuuucuccaguucgugugccaaauuacaacuuaauaauuauggaugaggcgcauuucaccgauccagcaagcauugcagcccgaggauacauuaguacacgcguagaaaugggagaggcugcagggauauucaugacagcuacaccuccuggcucuagagauccuuucccacaaaguaaugcaccgauaauggacgaagaaagagagaucccagaaagaagcuggaacucuggccaugaauggguuacugauuuuaaaggaaagacgguuugguucguaccaucuauaaaagcaggaaacgauaucgccgccugccuaagaaagaauggcaaaaaagucauucaacuuucgagaaaaacuuuugacucggaauacguaaagacuagagcuaaugacugggauuuuguugugacaacugauauaucggaaaugggggccaauuuuaaagcagaaagaguuauagacccucgaagauguaugaaaccuguuauuuuaaccgacggagaggaaagaguuauauuggcagguccaaugcccguaacccauucuucagccgcacaaaggagaggacgcauaggaaggaauccaaaaaaugaaaaugaucaguauauuuauaugggggaaccguuggaaaaugacgaagacugugcccauuggaaagaggcuaaaauguuacuggacaauauuaauacaccugaagguaucauuccuucaauguucgaaccggagcgggaaaaaguagaugcuaucgacggagaguaccgccuccggggagaggcaagaaaaacguuuguggaccuuaugaggcggggagaucuccccgugugguuagcauauaaaguggcagcagaaggcauaaauuacgcagaccgcaagugguguuuugaugggauuaaaaacaaccaaaucuuagaagagaacauggaaguugaaauauggacgaaagaaggggagaggaaaaaauuaaaaccacgcuggcuagaugcaagaauuuauagugacccucuagcuuuaaaggaguuuaaggaauucgcagcggggcggaaaaguuuaacacucaacuuaaucacagagaugggacgacuaccuacguuuaugacacagaaggcucguaacgcacuagauaauuuagccguauuacauacugcagaagccggggggcgugcauacaaccaugcgcuaagugaacuccccgaaaccuuggaaacgcuguuauuauuaacacuacuugcuacagugacaggcgggauauuccuguuccuuaugagcggcaaaggaauugggaagaugacacuaggaauguguuguaucauaacggcuaguauauuguugugguacgcacagauacagccacauuggaucgcugcaucgaucauacuugaauucuuuuugauuguuuuacucauaccagaacccgaaaaacaacgaacuccccaagacaaucaacuuacauauguaguaauagcaauacuaacuguaguagcggcaacaauggcuaaugaaaugggauuucucgagaagacuaaaaaagauuuaggauuaggaucgaucaccauccaagaaagugaaaguaacauucucgauauugauuuaagaccugcaagcgccuggacguuauacgcagucgccacaacauucgucacccccaugcuaagacauaguauagaaaacucuuccguuaacguaucauuaacagcaauugcaaaucaagcuacgguauugaugggucucggaaaaggcuggccacugagcaagauggauaucggugucccuuuacuugcaauugguuguuauucgcaagugaacccuauaaccuuaacugcagcucugcuccuguuaguagcgcauuacgcaauuauagguccugguuugcaagcaaaggcaacuagagaagcccaaaaaagggcagcagcaggcauaaugaagaauccaacaguugaugggauaacuguaaucgauuuagagccgauaccauaugauccuaaauuugaaaaacaauugggacaggugaugcuucuaauuuuauguguaacacaggugcucaugaugcgaacgacaugggcguuaugcgaagcacuaacacuggccaccggcccaauuucuaccuuaugggagggcaaucccggucgauuuuggaauaccacuauugcaguuagcauggccaauaucuucagaggaagcuauuuggccggcgcugguuuacuuuuuuccaucaugaaaaauacgacaaauacaaggcguggaacaggcaauauaggggagacauuaggugaaaaauggaaaucgcgguuaaacgcccuuggaaaaagcgaauuccaaauauacaagaaaaguggaauucaggaaguagauagaacuuuagccaaagaagggauaaaaagaggugagacugaucaucaugcugucucccgaggaagcgcgaaacuaagaugguucguagaacgaaauauggucacuccugaggguaaaguaguugaucuaggcugcgguagagguggauggucauacuauugcgguggauuaaaaaacguacgcgaaguaaaaggcuuaaccaaggggggccccggccacgaagaacccauaccgaugagcacguauggauggaaccuaguaagauuacagucugguguagaugucuuuuucaccccaccugaaaaaugugacacacuacucugugacauuggagaaucuucaccaaauccgacaauagaggcuggacggacucuucgaguuuuaaaucucgucgaaaacuggcugaauaauaacacgcaguuuuguauaaaaguccuuaacccuuauaugccgagugugauagaaaaaauggaggcauuacaacguaaauauggaggagcccuaguaaggaauccauuaaguagaaauucaacgcaugaaauguacuggguaagcaacgcuacgggaaauauuguaagcucaguaaacaugauaagcagaauguuaaucaaucguuucacgaugaaacacaaaaaagccacguacgagccggacguagacuuggguagcggaacuaggaauauuggaauagaaagcgagauuccgaaucuugauauaauaggaaaacgaauagaaaagauuaaacaggaacaugagacuucauggcauuaugaucaagaucacccguauaaaacaugggcauaccauggaagcuaugaaaccaaacaaacuggauccgcaucgaguauggucaauggcguuguacgucuacuaacaaaaccaugggauguaguaccgauggugacacagauggcaaugacugacaccaccccauucggacaacaaaggguuuuuaaggaaaagguugauacacgaacacaagaaccaaaagaggggacaaaaaaauuaaugaaaaucacugccgaauggcucuggaaagaacucggcaagaaaaaaacgccacgcauguguacccgagaggaauuuacccgaaaaguacgcagcaaugcagcauugggcgcgauuuucacagacgaaaauaaauggaaaagcgcgcgugaagcgguagaagauggaagguuuugggaauuaguagaccgggagaggaaucuccacuuggaggguaagugugagacauguguuuauaacaugaugggaaaacgagaaaaaaagcuaggugaguuuggaaaagcaaaagggagcagggcuauuugguacaugugguugggugcaagauuuuuagaguuugaagcacucgguuucuuaaaugaagaucauugguuuaguaggggaaauucgcucagcggcgucgaaggcgagggacuucacagauuaggauauauucucagggacguggguaagaaagaaggggguguaauguaugccgaugacacagcagguugggauacacggauaacuuuagaggaucuaaagaacgaagagcuaguaacaaaccauaugaagggggaacacaagaaacuugcugaagccaucuucaaacuaaccuaccaaaacaaggucguaagaguucaacguccuacaccuagggguacgguaauggauauaaucucgcgccgugaucaacgggguaguggucaagucgguacguacggccuaaauacauuuacuaacauggaagcacaacugauaagacaaauggagggagagggaauuuucaaaaguauacaacacuugacugcaaccgaagaaauugcaguacaaaacuggcucgcgcgugucggaagggaaagauuaagcaggauggcuaucucgggggacgauuguguaguuaagcccauagaugaccgauuugcaucggcauuaacagcacuuaacgauaugggaaagguccgcaaagauauccaacaaugggaaccuuccagaggauggaaugacuggacacaaguaccuuuuugcagucaucauuuucacgaacuaguuaugaaagauggaaggguccuaguuguuccgugcagaaaucaagaugaauuaaucgggcgagccaggauaucacagggugcugguuggucacuaaaagaaacggccugcuuaggcaaaagcuacgcacaaauguggacacuaauguauuuucauagacgagaucuaagguuagcggcaaacgcuauauguagcgcugucccgucccacuggguacccaccuccagaacaaccuggaguauacaugcaaagcaugaguggaugacaacagaagacaugcuugcaguauggaacagaguguggauucaagaaaauccauggauggaggauaaaacuccaguggaaaguugggaggagguuccauaucuggguaaaagggaagaccaauggugugguucacucauagguuuaacuuccagagcuacuugggcaaaaaacauacaaacagcaauaaaccagguccgaucccuaauaggaaacgaagaauacacagacuauaugccgucuaugaagcgauucagaagggaagaagaagaagcaggaguauugugguga

SEQ ID NO: 22453 - RNA, 9876 nt, Artificial Sequence
  derived and/or modified CDS sequence (opt6) from DENV-2__EU482684__SS-prME
acugcuggaguaauaguaauguuaauaccaacugcgauggcauuucauuuaacaacucgcaacggagaaccccauaugauuguaggacgacaggaaaaaggaaaauccuuguuauuuaaaacagaagauggaguaaauauguguacgcuaauggcaaucgaccuuggagaauugugugaagacacgaucaccuacaaauguccauugcuaagacaaaacgaaccggaagauauagacuguuggugcaacucaacuuccaccuggguaacauaugguacauguacaaccacaggggaacauagacgugaaaaacggucaguugcuuuagucccucacguugguaugggucuagagacuagaacugaaacauggaugucgagugaaggagcauggaaacaugugcaaagaauugaaacguggaucuuaagacacccaggauucacuauaauggcuacgauucuagcuuauacaauuggaaccacgcauuuucaaagggcgcugauauuuauccuacuaacagcuguagcucccucuaugacaaugagaugcauagggauaucuaaccgugacuuuguagagggaguaaguggaggaucaugggucgauauuguauuggagcacgguagcuguguuacaacaauggcuaaaaacaaaccuacccuagacuuugaguuaauaaaaacagaagcuaaacaaccggcuacacuuagaaaauacuguauagaggcuaaacugacuaauacgacuaccgaaagccgaugccccacacagggagaaccaagucucaaugaagaacaagauaaaagauucauauguaaacauucaaugguagacaggggauggggcaaugggugcggauuguuugggaaaggggguauaguuacaugcgcuauguuuacuuguaagaaaaauauggaaggaaaaguagugcaaccagagaaccuugaauacacaauaguaauaacaccucauaguggugaagaacacgcagugggaaacgauacgggaaaacaugguaaagaaauuaaaauaaccccucagucuuccauuacagaagcggaacucacaggauauggaacagucaccauggaaugcucaccucgcacagguuuggauuuuaacgaaaugguauugcugcagauggaagauaaagcaugguuaguucacagacagugguuuuuggauuugcccuugccaugguuaccaggagcggauacacaaggcagcaauuggauacaaaaagaaacauuagugacauucaaaaacccacaugcgaagaaacaagauguaguaguauuggggucacaagaaggugcaaugcacacugcauuaacaggggcaaccgaaauacaaaugaguaguggcaaccuacuauuuacaggacaccugaaaugccgauuacggauggauaaacuacaauugaaaggaaugagcuacagcaugugcacugguaaauuuaaaauagucaaagaaauagcggagacucaacauggcacuauaguuauaagaguucaguaugagggagaugguucacccuguaaaauccccuucgaaauaacagaucuagaaaaacgccacguacuagggagacuaauaacugugaauccaaucgugacggaaaaagauaguccaguaaacauugaggcugagccacccuuuggagacuccuacaucauaauugguguugaaccaggacaacuuaaacuuaauugguucaagaaagguucuuccaucggacaaauguucgaaaccacuaugcgaggugcaaaaagaauggcuauucugggagacacagcaugggacuuuggcuccuuggguggaguguucacgucgauaggcaaagcacuucaccaaguuuuuggugcaauuuauggagcugcauucucagguguaucauggacaaugaagauauuaaucggaguaauuauaacguggauagguaugaacucaaggagcaccaguuuaagcgugagcuuaguguugguagguguuguaacauuauacuuaggcgcagugguccaagcugauuccggauguguugugaguuggaaaaauaaggaauugaaaugcggcagugguauauuuauuaccgauaaugugcauaccuggacagaacaauacaaauuucaaccagagaguccaucuaaacuggcaucagcuauacaaaaggcccaugaggaaggaauauguggcauuagaagcguuacgagguuggaaaacuuaauguggaaacaaauuacaccggaacuaaaucauauucuaagcgaaaacgagguaaaauuaacuauaaugacaggagauauaaaaggcauaaugcaagcagggaaaagaaguuugcguccccaacccacugaauuaaaguauaguuggaagaccuggggcaaggcaaaaauguuaucgacggagucacacaaucaaacguucuuaauagauggaccagaaacggcagaaugcccuaauacaaaucgagccuggaauagucuagagguugaagauuauggauucgguguauuuaccacaaacauauggcuuaaguugcgugaaaaacaggauguguuuugcgacucuaaauuaaugagcgcagcuaucaaagacaacagggcaguacacgcagauaugggauauuggauagagucugcccucaaugauacauggaaaauggagaaagcauccuuuaucgagguaaaauccugccauuggccaaaaucacauacgcuauggagcaaugguguacuggaauccgagaugauuaucccgaaaaacuuugcgggaccagugucucaacauaauuauagaccaggauaucacacccaaaccgcgggaccguggcaccuugguaaacuagaaauggauuuugauuucugugaaggaacgacgguaguaguaacugaggauuguggaaauaggggcccaucacuuaggacgaccaccgcaucugggaaacuuauuacugaaugguguugcagaaguugcacauugccucccuugcgguaccgcggggaggauggcuguugguauggaauggagauucguccauuaaaagagaaagaagagaaucuuguuaauucacugguaacagcaggacacggacaaaucgacaauuuuucacucggugucuuagguauggcgcuauuucuggaagagaugcuacguacgagaauugguacaaaacacgcgauauuauuaguagcuguaucauucguuacacuaauaacgggaaauaugagcuucagagacuuggguagaguuauggucauggugggagcaacuaugacagaugauauuggcauggggguuacauaucucgcauuacuggcggcauuuaagguaagaccaacuuuugcagcaggauuguuauugaggaaauuaaccaguaaagaauuaaugauggcgaccauuggaauugcauuguuaagccaaaguacgauuccugagacgauacuagaauuaacagaugcucuugcucuaggaaugaugguucuaaaaaucgucagaaacauggagaaguaccaacuggcuguuacaauaauggcgauaucaugcguaccuaacgcugucaucuugcaaaaugcguggaaaguuaguuguaccauauuagcugcuguaagcguaucaccacuccugcucacgagcucgcaacaaaaggcggacuggaucccucuugcauugacaauaaaaggucuuaauccaacagcgauauuuuuaacuacccuaucuagaacguccaagaaaagaaguuggccauugaacgaggcuauuauggcaguagguaugguaucuauucucgcuucuucucuacucaaaaacgacauaccuaugacaggcccgcuaguagccgggggacuauuaacgguguguuacguacuaacagguaggagcgccgaucucgaacucgaaagagcagccgacguuaaaugggaagaccaagcugaaauaucaggcaguagcccaauucugucuaucacaauaucagaggacgguucaaugaguauuaaaaaugaggaggaagaacaaacguuaaccaucuuaauacgaacaggacucuuaguaauaucaggcguguucccaguuaguauaccaauaacugccgcugcuugguacuuaugggaaguaaagaaacaaagagcagggguacucugggacgucccaaguccaccaccagucgagaaggcugaauuagaagauggagcguaucgcauaaagcagagagggauucuugguuacucucaaauaggggcuggggucuauaaagaggggacauuccauacgauguggcaugucacacguggcgcaguguuaaugcacaggggcaaaagaaucgaacccaguugggcagacguuaagaaagacuuaaucucuuacggaggaggguggaaguuagaaggugaguggaaagagggagaggaaguacaaguacuggcuuuagagccagggaaaaauccgcgagccguacaaaccaaaccuggaaucuucaaaacuaauacugguacuauaggagcuguauccuuggauuucagucccggaacguccggaagcccgauaguugaccguaaggguaaaguagucggacucuacgggaacgggguuguaacgagaucuggugcguaugugucugcaauugcacagacugaaaaaucaauagaggacaaucccgagauugaagacgacauauuuagaaagaaaagguuaacaauaauggauuuacauccgggugccgguaaaaccaaaagauauuuaccggcuaucguacgcgaagcaauaaaacgaggacuuagaaccuuaauauuagcgccuacaagggugguggcugcagaaauggaagaagcacuacgagggcuuccaauaagauaucaaacuccagcuauaaaaacagagcauacagggagggaaauaguggaccucaugugucacgcaacuuuuaccaugcgccuccucucacccgucaggguaccaaauuauaaccuuauaauaauggacgaagcacauuucacugaucccgcauccaucgcagcgagaggauauauaaguacaagagucgaaaugggagaagcggcagguaucuuuaugacugcaacgccgccagguucaagagaccccuucccacaaucaaaugcacccauaauggacgaggagcgggaaaucccugagaggagcuggaacucuggacaugaauggguaacagauuucaaaggcaaaacaguaugguuuguaccaaguauuaaagcagguaaugacaucgccgcaugccuuaggaaaaauggcaagaaagugauacagcuuucuagaaagacuuuugauagugaauauguuaaaacgagagcaaaugauugggauuuuguaguuacaacagacauuucagaaaugggggccaauuuuaaggcugaacgcguaaucgacccaagacgguguaugaaaccaguaauacuuacugauggugaggaaaggguuauucucgcggguccuaugccaguaacucacucuagugcagcacaaagaaggggaagaaucgguaggaacccaaagaacgaaaaugaucaauauauuuacaugggagaaccacuggaaaacgaugaagauugcgcccacuggaaagaagcaaaaaugcuuuuagacaauauaaauaccccagagggaauaauuccgaguauguuugagccugaaagagaaaaaguugacgccauagauggagaauauagguuacgaggagaggccagaaaaacauuuguagacuuaaugagacguggugaucuacccguguggcuagcauauaagguagcugcagaaggaaucaacuaugcugaucgcaaguggugcuucgaugggauuaaaaauaaccaaauauuagaggaaaacauggagguagaaauuuggacaaaagaaggcgagaggaagaaguugaaaccgcgaugguuagaugcacgaaucuacagcgaucccuuggcgcuuaaggaauuuaaagaauuugcugcaggccggaaaagccucacacugaacuuaaucacagaaauggguagacugccgaccuucaugacccaaaaagcaaggaacgcgcucgauaaccuggccgucuuacauaccgcugaagccggugggcgagcuuauaaccacgcguuaagcgaauuaccagaaacuuuagaaacacuauuauuguugacauuacuagcgacugucacgggugguauauuucucuuucucaugucaggaaaggguaucggaaaaaugacccuaggaauguguuguauaauaacagcuagcauacuguuaugguaugcacaaauucagccucacuggauagcggcaaguauaauacuagaguucuuucuaauuguuuugcuaaucccggaaccagaaaagcaaagaacuccgcaagauaaucagcuaaccuaugucguaaucgcuauuuuaaccgucguagcggcuacuauggccaacgaaaugggauuuuuggaaaagacgaagaaagacuuaggcuuagggucuauaacaacucaggaaagugaaucgaauauuuuagacauagaucuaaggccagcgucagcauggacucuuuaugcuguagccaccacguuuguuacaccuaugcuacgacauuccauagaaaauucguccgugaauguuucccuaacugcaauugcaaaucaagccacuguacugaugggcuuggguaaagguuggccacuuucaaagauggauaucggugucccauuguuagcgauugggugcuacagucaggucaacccuaucacucuaaccgcugcguuacuacuucuaguggcacacuaugcuauuauagggcccgggcuacaagcaaaggcgacccgagaagcucagaaacgagcagcggcgggcauaaugaaaaacccaacgguagauggaauaaccguaaucgaucuugagccaauaccguaugauccuaaauuugagaagcaacuaggccaaguaauguuacuaauucugugcgucacacagguauuaaugaugcgaacgacgugggcccuuugugaagccuugacuuuggccaccggcccaaucucaacucuaugggaagggaauccuggcagauuuuggaauacuacaauagcgguaucuauggcaaauauauuccgcggaagcuaucuagcuggagccggacuguuguucucaauaaugaaaaauaccacauccacacgaagagggacgggcaacauuggggaaacauugggagaaaaauggaaauccagacuuaaugcauuagguaagucagaguuucaaauuuauaagaaaucuggcauucaggaagucgacagaacucucgcuaaagagggaauaaaaaggggagagacggaucaucacgcuguuuccaggggaagcgcaaaauuacgcugguuugucgagaggaauaugguuacaccggaagggaaagucguagaucuagguugcggucgaggagguuggucguacuacugcggaggacuuaaaaauguacgugaagugaaaggacuaaccaaaggaggcccaggacaugaagaaccaauaccaauguccacauauggauggaauuuaguacgcuuacaauccgguguagauguguucuuuacgccacccgaaaagugugauacacuguuaugugacauaggugaaucuucaccuaauccuacaauugaagcaggaaggacuuuacgaguauuaaacuuaguagaaaauugguuaaauaacaacacucaauuuuguauuaaaguuuuaaaucccuacaugccgucuguuauagagaagauggaagcccuccaaagacaauaugguggagcccuaguucggaacccacuaaguagaaauaguacccacgagauguauuggguaucaaacgccacaggcaauauaguaucaucuguuaauaugauaucgagaaugcuaaucaaucgauuuaccaugaaacauaagaaagccaccuacgagcccgacguagaucuaggaucaggcaccagaaauauuggaauagaaucagagauaccuaaucuggacauaauagggaaacgcauugaaaagaucaaacaggagcacgaaauuaguuggcauuacgaccaggaucauccauauaaaacaugggcauaucaugguuccuacgagacgaaacagacugguucagcaaguucgauggugaauggaguuguuaggcuacuaaccaaacccugggauguagucccaauggugacgcaaauggcgaugacggacacuacucccuucggacaacagagaguguucaaggaaaaaguugacacuagaacucaggaacccaaagaaggaacuaagaaauuaaugaaaauuacggcugaguggcuauggaaggaguuagguaagaagaaaacgccacguauguguacaagggaagaauuuacgaaaaagguuagaucuaacgccgcuuuaggcgcgauauuuacagaugagaacaaauggaaaucagcaagggaagcaguagaagauggccgauuuugggaacuugucgaccgugaaaggaaccuucaccuggaaggaaaaugugaaacguguguauacaauaugaugggaaaaagggagaagaaacugggugaguuuggaaaagcaaaagguuccagggcuauaugguacauguggcugggagcaagguuuuuagaguucgaagcgcuuggguuccuuaacgaagaucauugguuuucaagggguaacuccuuaagcggcguagaaggagaaggguugcacagguuagguuauaucuuaagagauguugguaagaaagaaggcggggcaauguacgcugacgacacggcgggaugggauacuagaauaacccuagaggauuugaaaaacgaagaaaugguaaccaaucauaugaaaggggaacauaagaaacuagcagaagccauuuuuaagcuaaccuaucaaaauaagguaguuaggguacaaagaccaacaccuaggggaaccguaauggauauaauaagccgacgcgaucaaagggggucuggacaaguaggcaccuauggauugaauacguuuaccaacauggaggcccaguugaucagacaaauggagggugaggggauauuuaaaucgauacaacauuuaacggcuaccgaggagauagcagugcagaauuggcucgcaaggguagguagagaaagguuaucacgcauggccauaucuggugacgauugugugguuaagccuauugaugacagauuugcaagugcuuuaacagcguugaacgacauggguaagguccggaaagauauccaacagugggaaccuagccgagguuggaaugauuggacgcagguaccguuuugcucgcaucacuuccaugaacucguaaugaaagacgguagaguucuaguuguaccaugucgaaaucaagacgaacuaauuggccgcgcacguauaucucaaggagccgguuggucguuaaaagaaacugccugccuugggaaaucguaugcucaaauguggacauuaauguauuuccaucggcgagaccuuaggcuugcugcuaaugcaaucugcagugccguaccaucgcacugggucccaacuucaagaacaacauggaguauacacgcaaaacaugaguggaugacuaccgaagauaugcuggccguauggaauagggucuggauacaagaaaauccguggauggaagauaaaacaccaguagaaaguugggaagaaguuccguaccucggcaaaagagaggaccaauggugcggaaguuugauaggguuaacaucuagagcaacaugggccaaaaauauacaaacagccaucaaccaaguuagaagucuaauaggcaacgaagaguauacggauuauaugccaaguaugaaaagauuucgacgugaggaagaagaagccgguguuuuaugguaa

SEQ ID NO: 22454 - RNA, 9876 nt, Artificial Sequence
  derived and/or modified CDS sequence (opt6) from DENV-2__EU482685__SS-prME
accgcuggaguaauagugaugcuuauaccgacagcuauggcauuccauuuaacuacucgaaacggagaaccacauaugauugucggacgucaggaaaaaggaaagucacuguuguucaaaacggaagacggaguaaacauguguacacuaauggcaauagaccugggcgaacuuugcgaggacacaauaaccuauaaauguccacuacuucgacagaaugagccagaggauaucgauuguugguguaauucuacaaguacuugggucaccuauggaaccugcacaaccacgggagaacacagaagagaaaagagaucaguagccuuaguuccacauguaggaaugggucuagaaacgagaacagaaacuuggaugagcagugagggugcauggaaacacguucaacgcauugaaacuuggauacuaagacacccgggauuuacaaucauggcugcaauacuggccuacaccaucggcacgacgcauuuucaacgugcacuuauuuuuauucuauuaacagcuguagcaccgucaaugaccaugagaugcauaggaaucucaaaucgcgauuucguagaaggaguuucaggcgguucauggguggauauuguauuagaacauggaucauguguaacaacuauggcgaaaaacaaaccaacauuagacuuugaguuaaucaaaacugaggcuaaacaacccgccaccuugagaaaguauuguauugaagcaaaguugacaaacacaacaacagagucaagguguccaacacagggggaaccaucuuuaaacgaagaacaggacaaaagauuuauuuguaaacacucuaugguagaucgagggugggggaaugguugcgguuuguucggcaaaggagggauagucacaugcgcaauguuuacaugcaaaaaaaacauggaaggaaaaguagugcaaccggaaaaucuugaauauacuauagucauaacaccccacagcggagaagaacaugccgucgggaaugacaccggaaaacauggaaaagaaauuaaaauaacuccacaaaguucuauuacagaagcggagcuuacuggauacggcaccgugaccauggagugcagcccacgaacagguuuagauuucaacgaaaugguauuguuacaaauggaggauaaagccugguuaguacaucgacagugguucuuagacuuaccacucccuugguuaccaggggcugauacacaaggcucaaauuggauucaaaaagaaacacuggugacauuuaaaaauccacaugcuaaaaaacaagauguaguagugcuaggaagccaagaaggggcaaugcauacagcccucaccggcgcaacagagauacaaaugucuagcggcaacuuauuguuuacagggcaucuuaaauguagacugagaauggacaaacugcaacuaaaaggcaugucauauucuaugugcacggguaaguuuaaaauuguaaaagaaauagccgaaacccaacacggaacuauuguaauacguguccaguacgaaggggaugguaguccguguaaaauuccguuugaaauuacggaucuggagaaacgacacguguuaggacgacucauuacagucaauccaaucguuacggagaaagauucacccgucaauaucgaagcggagccuccauuuggggauaguuacauuauaauagguguugaaccgggucagcugaaauugaauugguucaaaaaagguucauccauuggccagauguucgaaacaacaaugcguggagccaagaggauggcuauacuaggggauacggcaugggacuuuggaucccuuggagggguuuucacguccauuggcaaagcauuacaucaaguauuuggugcaauauauggagcagcauuuucuggcgugucauggacgaugaagauauuaauaggggucaucauaacauggauuggaaugaauucucgcucaacuagcuugucggugaguuuaguucuaguaggagucguuacccuguaucuaggggcuguaguacaggcugauucagggugcguaguauccuggaagaauaaagaacucaaguguggaucagggauuuuuauaacggauaacguacauacauggacagaacaguauaaauuucaaccagaaucaccuagcaaacuagcaucugcaauucagaaggcucaugaagaaggaauuuguggaauacgcagcguaacuagauuagaaaaccuuauguggaaacaaauaacaccugaacuaaaccauauauuaagugaaaacgaaguaaaacucacaauaaugacgggggauauaaaaggaauaaugcaggcuggcaagcguucgcuacgaccacaaccaacugaacugaaguacucguggaaaacuuggggaaaggcaaaaaugcugaguacugagucacacaaucaaacuuuuuuaauagacggcccagaaacggcggaaugcccgaauacaaauagagcauggaauaguuuagaaguugaagauuauggcuucggcguuuucacaaccaacaucuggcuaaaauuacgcgagaagcaagauguuuuuugugauucaaaauuaaugucugcggcuauuaaagacaacagagcaguucacgcagauaugggauauuggaucgaauccgcacucaaugauacauggaagauggaaaaagcaagcuucauagaagucaagucaugccauuggcccaaaucucacacacuguggucgaacggaguauuagaaagugagaugauaauaccgaaaaacuucgcaggaccuguuagccaacauaacuaucgucccggguaccacacacaaacugcggguccuuggcauuuaggcaagcuagaaauggacuuugacuucugcgaaggcacaacugucgucguaacugaagauugcggcaaucgcgggccaaguuuaaggacgacuaccgcauccgggaaauuaauaacagaaugguguugcaggucguguacacucccaccguuaagguauagaggcgaggauggcuguugguacgguauggaaauucguccuuuaaaagagaaagaagaaaaucugguaaacagucuagucacagccggcaaugggcaaauugauaacuucagucuggggguacucggaauggccuuauucuuagaagaaaugcuaagaacuaggauagguacaaaacaugcgauacuuuuaguagcuguaucguuugucaccuuaauaacaggaaauaugucuuuccgagaccuugguaggguuaugguuaugguaggggcaacuaugacugacgauauaggaaugggagugacuuacuuagcauuacuugcugcauucaagguaaggcccacguuugcagcuggucuauuauugagaaaauuaacaaguaaagaauuaaugauggcaaccauagguauagcacuauuaucucaauccacgauaccugagaccauacuagaacuuacagacgcauuagcauuggguaugaugguauuaaaaauuguucguaacauggagaaauaucaauuagcagugacaauuauggcuaucucgugugucccaaacgcagucaucuuacaaaacgcauggaaaguguccuguacgauauuagcagcggucucggucuccccacuacuauuaacguccucacagcaaaaagccgauuggauuccucuagcuuugacaauuaagggucuaaauccaacggccauauuucucacuacauuaagucgaacguccaaaaaaagaucguggccgcuuaaugaagcgauuauggcuguuggaaugguaagcauauuagcaagcagucuauuaaaaaaugauauaccaaugacaggaccuuuaguagcaggagguuugcuaacaguguguuauguacuuaccggacgauccgccgacuuggaauuagaacgggccgccgacgugaaaugggaagaucaagccgaaaucagcggaagcagccccauacuuucuaucacaaucucagaggauggaucaauguccauaaaaaaugaagaagaggaacaaacucuaacaauccuaauuaggacaggucuucuaguuauuucaggcguuuuucccguaaguauuccuauaacagcagcggcaugguauuuaugggagguaaagaagcaaagagccggagugcuaugggauguuccgucuccgccaccgguagagaaggcggaauuggaagacggugcguaucgaauuaaacagagagguauacuaggauauucccaaauaggagcaggaguauacaaagaggguacauuucauacuauguggcacguaacgcgaggagcgguauuaaugcauagaggaaaacgaauugaaccaagcugggcggaugucaaaaaggaucuaaucaguuauggaggcggauggaaauuagaaggugaauggaaagaaggggaggaaguacagguacuagcacuagaaccaggaaagaauccaagggcuguacaaacgaaaccggguaucuuuaaaaccaacacuggaacgauaggugcggucagcuuagauuucucuccgggaacaagcggaucccccauaguugacaggaaaggaaaaguaguggggcuuuacgggaacgggguuguuacaaggaguggagcguauguaucggcaaucgcacaaacagaaaaguccauagaagauaauccugaaauugaagaugauauauuucgaaagaaacgguuaacuaucauggaucugcacccuggugccggaaaaacaaaaagauaccuuccugcgauaguccgugaagcaauuaaacgaggguuaaggacacuaauacuggccccaacacguguuguagcagccgaaauggaagaagcguuacgaggucuaccaauaagguaccaaacuccagcgaucaaaacagaacacacaggacgagagauaguagauuugaugugccaugcaaccuucacaaugaggcuuuugucaccgguacguguaccgaauuauaaucugauaauaauggaugaggcccauuuuacagaucccgccucaauugcagcacguggauacaucucuacgagaguagaaaugggcgaagcagcagggauauuuaugacugcaacaccuccuggaagucgggaccccuuuccacaaucaaacgccccaaucauggacgaggaaagagagauaccagaacgaucauggaacagcggccaugagugggucacugacuucaaaggaaaaaccguaugguuuguuccuucaaucaaagcaggaaaugacauugcugcuugccuucgaaaaaauggaaaaaaaguaauacagcugucuagaaagacauucgacagcgaauauguaaagacacgagcuaaugacugggacuucguagucacaacugauaucucugaaaugggagcuaacuucaaagcagagaggguaauugauccgagaagaugcaugaaacccguaaucuuaacagauggagaagaaagaguaauuuuggcagguccaaugccuguuacucauucaucugcugcacagagaagggguagaauuggaagaaauccaaaaaaugaaaacgaucaguauauauauaugggggagccguuagaaaacgaugaggacugcgcacacuggaaagaggcgaaaauguuauuagauaauauuaacaccccugaaggcauaauaccaagcauguucgaaccugagagagaaaagguagaugcaauugauggagaauaccgauuaagaggggaagcaagaaagacauuuguagauuuaaugagacgaggcgaucuaccaguaugguuggcguacaaagucgcugcugaaggaauaaacuaugcagaccgaaaaugguguuucgacgguauaaaaaauaaucaaauucuagaagagaacauggaggucgaaauuuggacgaaagagggagaacgaaagaagcuaaagccacgauggcuugacgcacguauauauucagauccccuagcacuaaaggaauucaaggaauucgccgcagguagaaaaucccucacuuuaaaccuuauuaccgaaaugggcagguuaccaacauucaugacacagaaagcucguaaugcauuagauaauuuagccguccugcauacugcggaagcgggaggcagagcuuauaaccacgcauugucugagcugcccgaaacccuagaaaccuuauuauuacugacuuuacuugcaaccguuacaggagguauauuucuuuuuuuaaugucuggaaaaggcauaggaaaaaugacacuggggauguguuguauaauuacagcaucaauacuacugugguaugcacagauucagccacacuggauagcggccucaauaauccuggaguucuucuuaauaguacuacuaauaccagaaccagagaaacagcguacuccccaagacaaccaacuuaccuauguaguaaucgcaauuuuaacagucguugcugcaacaauggcaaacgaaauggguuuucucgaaaaaacuaagaaggaucuaggauugggcaguauaacgacgcaagaaagcgagucaaauauucuugauauagacuugcguccggcaucagcguggacgcuguaugcaguagcaaccacuuucgucacaccgaugcuaagacauucaauagaaaauaguaguguaaauguaucacugacggccauugcaaaucaagcuaccgugcuaaugggacuaggcaaaggguggccacuauccaaaauggacauuggaguaccgcuauuggcaauaggaugcuauucgcaaguaaaucccauaacacugaccgcggcucuguuguugcuuguugcucauuacgcaauaauagguccaggccuacaagcaaaggcgacacgugaagcucaaaaacgagcggcagcaggaauuaugaagaauccgacuguagauggaaucacuguuauagaucuggaaccaaucccauacgauccaaaauuugaaaagcaauugggacaaguaauguugcucauacuguguguaacucaaguauugaugaugcgaacgaccugggcacugugugaagcauuaacccuggcaacgggaccaauaucaacuuuaugggaaggcaacccaggacgcuuuuggaacacuacaauugcggugagcauggcaaacauauucagaggaaguuaucuagccggugcggguuuacuuuucucuaucaugaagaacaccacaucuacaaggagaggaacaggaaauauuggugaaacuuuaggagagaaauggaaaagucggcuuaacgcacuuggaaaaucagaauuucaaaucuauaaaaagucgggaauacaagaaguugaucggacucuugccaaagaggggauuaaaagaggagaaaccgaucaucacgccgugaguagaggaucagccaaguuaagaugguuugucgaaaggaauauggugacaccagaagguaaaguaguugaccugggaugcggaagaggaggcuggucauacuacugcggugguuuaaaaaacguacgucaaguaaaagggcuaacgaaaggggggccuggacaugaagagcccauccccaugucaacguacggauggaaucuuguacgauuacaaucagguguugauguuuucuuuacaccacccgagaaaugugauacgcuauuaugugauauaggagaaaguagucccaacccuacaauugaagcaggucguacucuaagaguccuaaaccuuguagagaauuggcucaauaacaacacgcaauuuuguaucaaaguauuaaaccccuacaugccuucuguaauugaaaaaauggaggccuugcaacgucaauaugggggcgcacuuguucggaacccucuuucucguaauagcacacaugaaauguacugggucagcaacgcuacagggaauauuguuucaaguguuaauaugauuucacguaugcuaauuaauagguuuacgaugaaacauaaaaaagcaacuuaugaaccagacguugaccuaggaagcggaacucgaaacaucggcauugaaagugagauaccgaacuuagauaucauagguaagcguaucgaaaaaauaaaacaagaacacgaaauaucauggcauuaugaucaagaucauccauacaaaacaugggccuaucacggaucauaugaaacaaaacaaacagggucggcaaguucaaugguaaauggagucguacgacuauuaacuaaaccaugggacgugguaccaaugguaacgcaaauggcuaugacggauaccacaccuuuuggacaacaaagaguuuuuaaggagaagguagacacacggacccaggaaccaaaagaagguacgaaaaaauugaugaagauaacagccgaaugguuauggaaagaacugggaaaaaagaaaacuccgcgaauguguacgagggaagaauuuacuaaaaaggugcgaucgaaugcagcucuaggggcgauauuuaccgacgagaauaaauggaaaucagccagggaagcgguagaggauggacgauucugggagcugguagauagggaaagaaaucuucaucucgaagggaaaugugaaacaugcguauauaauaugaugggaaaaagagaaaagaaauuaggagaguucggaaaagccaaagguucuagagcaauuugguauaugugguuaggagcacguuuccuggaauucgaagcuuuggguuuucuaaacgaagaccauugguuuagucgaggcaauucuuugaguggaguugaaggagaagggcuccauagguugggauacauacucagagauguaggaaaaaaagaaggaggcgccauguacgcugaugauacagcaggaugggauacuagaaucaccuuagaagaccugaaaaaugaagaaauggucacaaaucauaugaaaggugaacauaaaaaacuugcagaagcaauuuucaaauuaacguaccaaaacaaagugguaagggugcagaggcccacaccgcgcgguacaguuauggacauuauuucucgaagagaccaacgcgguagcggacaagucgguacguauggccucaauacauuuacaaauauggaagcgcaacuaauacggcaaauggaaggagaagguauuuucaaaucuauccaacauuuaacugcgacagaagaaauagcugugcaaaacuggcuagcccgcgugggacgcgaaagauugucaagaauggcaauuaguggugacgauuguguagucaaaccgaucgaugaucgcuuugcaagugcgcugacagcucuaaaugacaugggaaaggugcgaaaagauauccaacagugggaaccuagucggggauggaacgacuggacucaaguaccauuuuguucgcaucauuuucacgaguugguaaugaaagacggaagaguucucguaguucccugccguaaucaagaugagcucaucgggagagcgcggauuucacaaggggcgggauggucauugaaggagacugcauguuuaggcaaaucuuaugcccaaauguggacauuaauguauuuucauaggagggacuugagauuggcagcaaaugcaauaugcagugcaguaccaucucacuggguaccuacaagccguacaacguggucuauucacgcaaaacacgaauggaugaccacagaagacauguuagcgguuuggaaccgcgucuggauacaagaaaacccguggauggaagauaaaaccccaguagagucaugggaagaaguaccguaccugggaaaacgagaagaucaauggugcgggucgcucaucggguugacuucgcgagcaacaugggcuaaaaauauacaaacugcuauuaaucaagugagaagucuaauuggaaaugaggaguacacagacuauaugccuaguaugaaaagauucagacgggaggaagaagaagcgggaguguuaugguag

SEQ ID NO: 22455 - RNA, 9876 nt, Artificial Sequence
  derived and/or modified CDS sequence (opt6) from DENV-2__EU482687__SS-prME
accgcaggaguaauaguuauguuaauaccgacagcuauggcuuuucaucuaacgacccguaacggggaaccgcauaugauaguagguagacaagaaaaaggaaaaucacugcuuuucaaaacagaagauggagugaacaugugcacucuaauggcgauagaucuuggagaauuaugcgaagauacaauuacauauaaauguccacuauuacgucaaaaugaaccagaagacauagacugcugguguaauucuacaucaacauggguaacauacggcacauguacaacaacaggagaacaucgcagagaaaaacggucuguggcuuuaguuccucaugugggaaugggauuagagacaagaacagagacauggaugucaucagagggagcuuggaaacauguucaacgaauugaaacauggauucuaagacacccuggauucacuauaauggcagcaguuuuagcauacaccauugguacaacacacuuccaaagagcgcuuauuuuuguccuucuuacagcaguagcacccagcaugaccaugcgaugcauaggcaucucuaacagagacuucguugaaggaguaagcggggguaguuggguagauauuguccuugagcauggguccuguguaacgacuauggccaaaaauaaacccacgcuugacuuugaguuaauaaaaacugaagcuaaacaacccgcuacauuaagaaaauacugcaucgaggcgaaauugaccaauaccacaacugagaguagaugcccaacacaaggggagccuucacucaaugaggaacaagauaaacgcuuuauuuguaaacacucuaugguagauagaggcugggggaacggaugcggacuguuuggaaaaggagguaucgugacuugugcuauguuuacuugcaagaaaaauauggagggcaaaguuguccaaccagaaaacuuagaguacaccauagucauaacuccccacucgggcgaagaacacgcaguaggcaacgauacgggaaaacacggaaaagaaauaaaaauuacaccgcaaucgaguauaacugaagcagaacucacgggauacggaacaguaaccauggaaugcaguccgcgcacgggacuggauuuuaaugaaaugguccucuuacaaauggaagauaaagcaugguugguacacagacaaugguuccucgacuuaccgcuucccuggcuaccuggagcugauacccaaggcucaaauuggauacaaaaagaaacucuuguuacuuuuaaaaauccucacgcuaagaaacaagaugugguuguguuaggaagccaagagggggccaugcauacggcccuuacaggugcaacagaaauacaaauguccucaggaaaucuacuguucacaggucaccucaaauguagacucaggauggacaaauugcaacugaaaggaaugucauauaguauguguacaggcaaauucaaaauaguuaaagaaauagcggaaacucaacacgguacgauugucauuagaguccaauacgaaggugaugguucccccuguaaaauuccauuugaaauuaccgaccucgagaaaagacacguucucggucgacucauaaccguaaauccgaucguuacagaaaaagacucucccguaaauauagaagcagaacccccuuucggagacuccuacaucauuauagggguagagccuggccaacucaaauuaaacugguuuaagaaagggucaagcauuggacaaauguuugagacuacaaugagaggugcuaaaagaauggcgauauuaggggauacagcaugggacuuuggaucguuaggagggguauuuacaaguauuggaaaagcacuucaucaaguauucggagccauauacggggcugcuuuuuccggaguuucguggacaaugaaaauauuaaucggaguaauaauaacuuggaucgguaugaacaguagaaguacaagucuaucuguaagucucguauuagucgguguaguaacguuauaccuuggagcagucguccaagcggauucaggauguguaguaucauggaaaaacaaagaacugaaaugcggaagugguauauuuauaacagauaacguccauaccuggacggagcaauacaaauuccaaccugaaucgccaaguaaauuagccuccgcaauacaaaaagcacacgaagaaggcauauguggcaucagaucuguuacgcgcuuggaaaaccugauguggaaacaaauaacuccugaauuaaaucacauacuaagugaaaacgaagucaaauuaacaauaaugacaggugacauuaaaggcauuaugcaagccggaaaaagauccuuaagaccucaacccacugaauugaaauauucguggaaaaccugggguaaagcuaaaauguuguccacugaaagccauaaucaaaccuucuugauagacgggccagagacagcagaauguccaaacaccaacagggcauggaacucauuggaaguagaggacuacgguuucgguguuuuuacuacgaacauuuggcugaaacugagggaaaaacaagauguauuuugugacagcaaacuaaugagcgccgcaauaaaagauaauagggcuguacacgcugauaugggauauuggaucgaaagugcucuaaaugauacauggaaaauggaaaaagcuaguuuuauagaaguaaaaucaugucauuggccaaaaucacauacacuauggaguaacggaguauuggaaucagaaaugauaauaccuaaaaacuucgccggaccuguaagucaacacaauuaucgcccaggguaucacacacaaacagcggguccuuggcaucuuggaaaacuggaaauggauuuugacuucugugaggggacuacuguuguggucacugaggauuguggcaauagaggaccaaguuuaaggacuacuacagcaucgggcaaacuaauuacugaaugguguuguaggucguguacguugccaccucuacgguaucgaggggaggauggauguugguacggaauggaaauccguccacuuaaagaaaaagaggagaaccuuguaaauagcuuaguaacagcaggacacgggcaaauagauaauuuuagccuuggugugcugggcauggcgcuauucuuagaagaaauguuaagaacgagaaucggaaccaaacaugcaauacuccucguagcaguuucguuuguaacguuaauaacagggaauaugaguuuuagggaccuggggagaguaaugguuauggucggagcaacgaugacagacgauauuggcauggggguaacguaucuugccuuguuagcggcauuuaagguucguccaacauucgccgcuggucuuuuauuaagaaaauuaacuucaaaagaauuaaugauggcaacuauuggaauagcuuuacuaucacaaaguacgauuccggagacaaucuuagaacugacagaugcacuugcuuuagguaugaugguauuaaaaauaguuaggaacauggaaaaauaucaacuagcagucacaaucauggcuaucucgugcguucccaacgcugucauauuacaaaaugccuggaaagugagcuguacaauacuggcagcagugagcguuagcccacuguuauuaacaaguagucaacagaaagcagauuggauuccacuugcacuuacuauaaaaggucuuaauccuaccgcgauauuuuuaacuacacucucaagaacuagcaagaaaagaucuuggcccuuaaacgaagcaauaauggcuguugguaugguaucgauucuagcuucgucccuuuuaaagaaugacauacccaugacuggcccuuuaguugcgggaggucuuuuaacuguuugcuauguacuaaccggcaggucggcagaucuugaguuggaaagagccgccgaugucaaaugggaagaccaagcugaaaucagugguucauccccaaucuuaucaauuaccauuagcgaagauggaucuaugaguauuaaaaacgaggaagaagaacaaacuuugacuauacucauccguaccggacuccugguaauaucagguguuuuuccugugucuauccccauaacagcugcagcuugguauuugugggaaguuaaaaagcaaagagccgguguguuaugggauguaccaaguccgccuccaguugaaaaagcggaauuggaagauggcgcuuaccggauuaaacaaagggggauucucgguuauucacagaucggcgcugguguauacaaggaagggacauuucacacaauguggcauguaacccgaggugcaguucuaaugcaucgaggcaaaaggauagaaccaucaugggcggaugucaagaaagaucuaauaaguuauggaggagguuggaaauuagagggagaguggaaggagggagaagaggugcaaguuuuagcacuggagccagggaaaaauccaagggcagugcaaaccaaaccgggaauuuucaaaaccaacacgggaacaauaggagcaguaucucuagauuucucaccaggaaccucggguagcccuauaguugaccguaaagggaagguaguuggucuguacggcaauggcguaguuacaagaucaggagcguaugucucagcaauagcacaaacugaaaagucaauugaagauaauccagaaauagaggacgacaucuucaggaagaaaagauugacaauuauggaccuacacccuggagccggaaaaacuaaacguuaucuaccggcaauaguucgcgaagcgaucaaaagaggccugcguacccucauauuagcaccgacacgcgucgucgcagcggagauggaggaagcguuacgcgguuuaccgauacgcuaucaaacuccugcaauuaaaacagaacauacaggucgagaaauuguugauuugaugugucacgcaacguucacaaugcgucuccugagccccguuagaguaccgaauuacaacuugauaauaauggaugaagcgcauuuuacugauccugccucaaucgcagcgaggggauacauaucgacucgaguggaaaugggugaagcagcggguauauuuaugaccgcuacgccaccaggaagccgugacccauuuccacagucgaacgccccaaucauggaugaagagagggaaauccccgaaaggagcuggaacucuggccaugaguggguuacagauuucaaagggaaaaccgucugguuugucccuucuauaaaggcaggcaacgauauagcggcaugucucaggaaaaauggcaagaaaguuauacaacuuagucguaaaaccuuugauuccgaauacgucaaaacccgugcuaacgacugggauuuuguaguuacgaccgacauuuccgaaaugggagcaaacuucaaagcagagagaguuauagacccaagaagauguaugaaaccagucauauuaacagacggugaagagagaguuauuuuggcagguccuaugccugucacucauucgucagcugcccagagaagagguagaauaggucgaaacccuaaaaaugaaaacgaccaguauauuuauaugggagagccacuggaaaaugaugaggauugugcacacuggaaagaagcgaaaauguugcucgacaauauaaauacaccagagggaauuaucccuucgauguucgagccagagagagagaagguugacgcaauagauggagaauaucgacugcgaggagaagcacggaagacuuucguugaucugaugcguagaggagacuuacccgugugguuggcguauaaaguugcagcugaaggaauaaauuacgcugaccgaaaauggugcuucgauggcaucaaaaacaaccaaauccuugaagaaaauauggaaguagaaauauggaccaaagaaggcgagagaaagaaacuaaagccaagauggcuugacgcccguauauacucugacccacuagcgcuaaaagaauuuaaagaauuugcagcaggucguaaaucguuaacucucaaccucauaacggagaugggacgauuaccuaccuuuaugacacaaaaggcccgaaacgccuuggacaaucucgcggucuuacauacggcagaagccggcggucgcgcuuauaaccaugcauuaagugagcuaccagagacuuuagaaacguuauuauuguuaacacuccuggccacaguaaccggcgguauauuccucuucuuaaugagcgguaaggguauagggaaaaugacgcuugguaugugcuguauaauaacagcuaguauauuauuaugguacgcacaaauucaaccccacuggaucgcagcgaguauaauucuagaguucuuccuuauagucuuacucauacccgaacccgaaaaacaacggacaccgcaagacaaucaauuaacuuacgugguuauagccauuuuaacaguaguugcagcaaccauggcaaaugaaaugggcuuccuggaaaagaccaagaaggaucuaggacuaggcucgaucacaacacaagagucagaaaguaauauacuugacauagaucugagaccagcaucugcauggacgcucuaugcgguggcaacaacuuuuguaacucccaugcuaagacauucaauugaaaacucaucaguaaacguaucuuuaacugccauagcuaaucaagcaacaguacucaugggauuaggaaaaggguggccucugucgaaaauggacauuggaguaccacuacuagcaauagguuguuacagccagguuaauccaauaacacucacagcagcacuccugcuccuaguggcccauuaugcaauuauaggcccuggucuucaagccaaagcaacacgagaagcacagaaaagagcugcugcaggaauaaugaaaaacccaacuguagacggaauaacggucaucgaucuagagccaauaccauaugauccaaaauuugaaaagcaauugggacaaguuaugcuacucauacuuugcguaacucagguauuaaugaugcgcacgacaugggcuuugugugaagcccuaacacuggcgacaggcccaaucuccacauuaugggaaggcaacccuggacgauuuuggaacacaacgauugcggucuccauggcgaacauauuucgagguaguuaucuugcuggcgcaggcuuacuuuuuagcauuaugaaaaauacgacuagcacccgaaggggaacaggcaauauaggugagacacuaggugaaaaauggaaaagucgacuaaaugcacuugguaagucugaguuucagauauauaagaaaucuggcauacaggagguagaccguacucuagcgaaagaaggcauaaaaagaggcgaaacggaccaucacgccguaucacgaggaagugcaaaacucaggugguuuguggaacgaaauaugguuacgccugaagggaagguagucgaucuaggcugcggacgugggggauggucauauuauugugguggucucaaaaacguacgggagguuaaaggccuuaccaaaggaggcccaggccaugaagaaccuauacccaugagcacauacggauggaacuuaguaagauuacaaucaggaguugaugucuuuuucacaccaccugaaaaaugugauacucuguuaugugacauaggugaaucaucuccgaauccuacaauugaagccggcagaacccugcguguauugaacuuaguggaaaauugguuaaauaacaauacacaauuuugcauuaagguucuuaauccauauaugccaucaguaauagagaaaauggaggcacuccaacggcaguauggaggggcacuuguucguaauccucuaucacgaaauucaacucaugagauguacuggguaucaaacgcaaccggcaauaucguaaguucugucaauaugauaucgcgaaugcucauaaauagauuuacgaugaaacauaagaaagcgacuuacgaaccagacguggacuugggaagcggaacgcggaauauagggauagaaagcgagauaccaaacuuagauauaauuggcaagcguaucgaaaagaugaaacaagaacacgaaaucuccuggcauuacgaccaagaucaucccuauaaaacuugggcauaucacggaucguaugagacuaaacaaacugguagcgcaucgucgaugguaaaugggguuguuagauuacuuacuaagcccugggaugucguaccuauggucacacaaauggcgaugacugauacaacccccuucggacaacaaagagucuucaaagaaaaaguagacacaaggacacaagaacccaaagagggaacaaagaaguuaaugaagauuacugccgaauggcucuggaaagaauuaggcaagaagaaaaccccacguaugugcacaagggaagaauuuacuaggaaaguuagaaguaacgcggcccuaggagcuauuuuuacugaugagaauaaauggaaaucagccagggaagcaguggaggauggacguuuuugggaacucguggacagggaacggaauuugcaucuagaaggcaaaugcgaaacauguguuuacaauaugaugggcaaaagggagaagaaauugggcgaauuugggaaagcaaagggcucaagggcgauaugguacaugugguugggagcgagauuccuagaguucgaggcucucgguuuucugaaugaagaccauugguuuuccaggggaaauucccuaucagguguugagggcgagggacuacaucgcuuaggcuauauauugcgcgacgugggaaagaaagaagggggagcuauguacgcugaugacaccgcaggaugggacacucgaauuacccuagaggaucugaaaaaugaagaaauggucacuaaucauaugaagggcgaacacaagaaacuagcagaagccaucuucaaauugacuuaucaaaauaaaguuguucgaguucaacgucccacgccaaggggaacaguaauggauauuaucuccagacgcgaccagcgagggagcggucagguuggaacguauggauugaauacuuucacaaacauggaggcucaauuaaucagacaaauggaaggugaggguauauucaaauccauacaacaucuaacagcaaccgaagaaauagcuguacaaaacuggcuugcaagaguaggacgugaaagauuaagucgcauggcgauaucuggagaugauugcguuguaaaaccaaucgacgauagauucgcuucugcacugacggcccuaaacgacaugggaaaaguaaggaaagauauacagcaaugggaaccaucgcguggcuggaaugauuggacgcaggucccuuuuugcagucaccauuuucacgaauuagucaugaaagacggaagaguauuaguuguuccauguaggaaccaagaugaauuaauagggagagcgagaauaucucaaggggccggauggucucucaaagaaacagccugucugggcaaaagcuacgcacaaauguggacccugauguauuuucauaggagagauuugaggcuugcggcaaaugcaauauguucagcaguuccaucacacuggguaccaacaagucgaacuacauggucaauucacgcaaaacaugaauggaugacuaccgaagacauguuggcgguauggaauagaguuuggauccaggaaaacccauggauggaagacaagacaccaguagagucuugggaggaagugccauacuuaggaaaaagagaagaucaauggugcggaucauuaauagguuuaacaucaagagcaacaugggccaagaacauacaggccgcuauuaaucagguuagguccuuaaucgguaaugaagaauauacagacuauaugccaaguaugaaaagguuucggcgggaagaagaggaggcaggcguauuaugguaa

SEQ ID NO: 22456 - RNA, 9876 nt, Artificial Sequence
  derived and/or modified CDS sequence (opt6) from DENV-2__EU482688__SS-prME
acugcgggaguuauagucaugcugauaccuacagcaauggcuuuucaccucacuacaagaaauggggaaccacauaugauuguaggccgacaggaaaaaggcaaaagcuuguuauuuaagacagaagaugggguaaauaugugcacuuuaauggcuauagacuugggagaguuaugugaagauacaaucacuuauaaaugcccucuacuucgacaaaaugaaccugaagauauugauugcugguguaauaguacaucuacuuggguuacuuauggaacgugcaccacuacaggagaacauagaagagaaaaaagauccguagcguuaguaccccacgucggaaugggauuagaaacacguacagaaaccuggaugucaucggaaggugcguggaaacaugugcaacgaauagagacauggauacuaagacacccuggcuucacaauuauggccgcuauacuugcguauacaaucgggacuacccacuuccaaagagcauuaauuuuuauccuauuaaccgcgguagcuccaucaaugacaaugagguguauuggcauuaguaauagggacuucguagaaggaguaucagggggguccuggguggacauaguauuagagcaugggucuugcguaacaacuauggccaaaaauaaacccacauuagacuuugaauugauaaaaacagaggcuaagcaaccagcaacacucaggaaauauuguauagaggcgaaacuaacuaauaccacuaccgaaucucgcuguccgacucaaggagaaccgaguuuaaaugaggaacaagauaaacgauucauuuguaaacauucgaugguugauagggguuggggcaacgggugcgguuuauucggaaagggagggauugucaccugugcaauguuuacguguaaaaaaaacauggaagguaagguaguucaaccagaaaaccuagaauauacaauaguaauaacaccccacucgggggaagagcaugcgguaggaaacgacacugggaaacacgguaaagaaauaaaaaucacgccacaaucaucuaucacagaagcagaguuaaccggcuacggcaccgucaccauggaaugcucuccaagaaccggccuagacuucaaugagaugguucuguugcaaauggaagauaaagcaugguuaguacacaggcagugguucuuagauuugcccuuaccaugguuaccgggagcugacacucaaggcagcaacuggauacaaaaagaaacguuaguaacauuuaaaaauccacacgcuaaaaagcaggauguuguaguauugggaucucaagaaggggcgaugcauacagcccuaacuggggcaacagagauacagaugucgucuggaaauuuguuauuuaccggucacuuaaaaugucgauugagaauggauaaacuucaauuaaagggaaugucguauucaauguguacggggaaguuuaagauuguaaaagaaauagccgaaacccagcaugguacaauagucauccgcguacaauaugagggggaugguucaccuuguaaaauacccuucgaaauaacggauuuagaaaaaaggcauguacugggccguuugauuacgguuaacccaaucgugauugaaaaagauagcccagucaauauagaagcugaaccuccuuucggagacucauauauaauuaucgggguagagccuggacaguuaaaauuaaacugguuuaagaaaggauccaguauuggccaaauguucgagaccacuaugagaggugcuaaaagaauggcaauacucggugacacugcaugggauuuuggcagucuagguggaguguuuacaagcauaggaaaagcauuacaucaagucuuuggcgcuauuuacggugcggcguucucugguguaucuuggacaaugaaaaucuuaauuggaguuaucauuacguggauuggcaugaacucccgaagcacaucacuaagcgucucccuaguucuggucggcguuguuacacuauaucuuggagccaugguacaggcagauaguggaugcguagucaguuggaagaacaaagaauuaaagugugguucuggaaucuuuauaacagauaauguacauaccuggacagagcaauauaaguuucagccugaaucaccgagcaaauuagcuucugcaauacaaaaagcacaugaggaagggaucugcgguauaaggagcgugacaagauuagaaaaucuaauguggaagcaaauaacucccgaauuaaaucauauauuaucagagaacgaagugaaauugacaauaaugacuggcgacauaaggggaauaaugcaagcuggaaaaagaucacuccgcccucaaccaaccgaacuuaaguauuccuggaaaaccuggggcaaagcaaagaugcugucgacagagucgcacaaccagaccuuuuuaauagacgguccagagacagcagaauguccuaauacaaauagagcauggaauucucuugaaguggaagauuacggcuucggaguauuuacuaccaauauuuggcugaaauuaagagaaaaacaggaugucuuuugugauaguaaguuaaugagugcugcuauaaaggacaacagggcgguccaugcagauaugggguauuggauagagagugcacuuaaugacacuuggaaaauggaaaaggccaguuucaucgaagucaagucuugccauuggccaaaaagucacacacucuggaguaacgggguccuugaaagugagaugauuauaccaaaaaauuucgcaggaccugucagccaacacaauuauagaccuggcuaucauacucaaaccgcugguccauggcaucuugggaaacucgaaauggacuuugacuugugugaggguacaacugugguagucacugaggauuguggaaaucggggucccucuuugagaaccacuacagcaucgggcaaacuuauaacagaaugguguugccgcucgugcaccuuaccaccgcuacguuaucguggcgaagacggaugcugguauggaauggaaauaaggccucuaaaagaaaaagaagagaacuuggugaauaguuuggucacggcaggacauggccaaauagauaauuuuucacuuggcguucucgguauggcacuauuccucgaagagaugcuacgaacaagaaucggaacuaagcacgcaauacucuuaguagcgguaucacuggucacacuaauuacagggaauaugaguuuuagagauuuaggaagaguaaugguuauggugggagcuaccaugacugaugacauaggaaugggaguaacauaucuagcacuauuagcugccuuuaaagugagaccaaccuucgccgcuggucuacuauuaagaaagcuaacaucgaaagaacuaaugauggcaacaauagggauugcauuauuaucucaaaguaccauaccggagacuauacuugaacucacggaugcacuugccuuaggaaugaugguucugaaaauaguuagaaacauggaaaaauaccaacuggcaguuacgauaauggcaauauccugcguaccaaacgcgguaauauuacagaacgccuggaaagucuccuguacuaucuuagcagcaguuuccguuaguccauuacucuuaacuuccagccaacaaaaggcggauuggauuccccuagcuuuaacgauaaaggggcuaaauccaaccgcgauuuuuuugacaacucuaucacgcacaucgaaaaagcgaucguggccguuaaaugaagcuauaauggcaguaggaaugguaaguauauuagcuucaagucuuuuaaaaaaugacaucccaaugacugguccuuuaguagcugguggauuacuaaccgucuguuacguacucaccggaaggucagccgaccuagaguuagagagggccgcagauguaaaaugggaagaccaagcagaaauuaguggcucuagccccauacuaucaauaacaauuucagaggacggcucaaugucaauuaaaaaugaagaagaagaacaaacucuaacuauccuaauaagaacaggauuauuaguuaucucagguguauuuccggugaguauuccaauuaccgcggcagccugguacuuaugggagguaaagaaacaacgagccggaguacucugggaugucccuuccccaccuccuguugaaaaggcugaauuagaagauggcgcuuacaggaucaaacaaagagggauucuagguuauucucaaauaggcgcuggaguauacaaagaaggaacauuccacacgauguggcacguaacacgaggagcaguacugaugcauagaggaaagcggaucgaacccucaugggccgacguuaaaaaggaccuaauaaguuauggaggaggcuggaaauuagaaggagaauggaaagaaggagaagaagugcaggucuuagcucuagagcccggaaaaaacccucgggcuguacaaacaaaaccaggaauuuucaagacaaauacagguacaauaggggccguaaguuuagauuuuuccccuggaacuucagguagccccauagucgacagaaaggguaaaguaguuggccuauaugggaaugggguuguuacaagaucaggcgcauacguuagugcaaucgcacaaacggaaaaguccauagaggauaaccccgaaaucgaagaugacaucuuuagaaagaaaagauugacaaucauggaucuucauccuggugcagggaaaacuaagagauauuuaccugcaauuguacgagaggcgauaaagcgaggacugcguaccuuaauauuagcaccuacaagggucguagcugcugaaauggaagaagcucuacgaggauugccgaucagguaccaaaccacagcgauuaagacugaacauaccggacgcgaaaucguggauuuaaugugucaugcuacuuucacuaugcgauuauuaagcccuguaagagugccaaauuacaaucuuauuauuauggacgaggcacacuucacagauccugcuucuaucgcagcucgaggcuacauaucaacuagggucgaaaugggugaagcugcgggaauuuuuaugacugccacuccgccugguaguagagaccccuucccucaauccaaugcgccuauaauggaugaagagcgcgaaauucccgaacgaagcuggaauucaggacaugaauggguaacagauuucaaaggaaaaaccgugugguuuguaccgucuauaaaggcgggcaacgauauugcggcuugucucaggaaaaauggaaagaaaguaauucaacuuagccgaaaaacauucgauagugaauaugugaagacgcgagcaaaugauugggacuuuguaguaacaacugacauuucagagaugggagcaaacuuuaaggcagaaagagugauugauccuagaaggugcaugaagccaguaauacuuacugauggcgaagaaaggguaauauuagcuggccccaugccaguuacacacucauccgcugcgcaacgacgugguagaauaggaagaaacccuaaaaacgagaaugaucaauauauauacaugggugagccccuugaaaacgaugaagacugcgcucacuggaaagaagcaaaaauguuacuugacaacauaaauacucccgaaggaauuauaccaagcauguuugagccagagagagaaaaaguugaugcaaucgacggggaauaucgauuaagaggcgaagcuaggaaaacauuuguugacuuaaugcgacgaggagaucucccaguauggcucgcguacaaaguugcagcggagggcauaaacuaugcagaccgaaaaugguguuuugacgguauaaaaaauaaucaaauauuggaagaaaacauggaggucgagaucuggacaaaggaaggcgagaggaaaaaacuuaaaccaagauggcuggaugcacguauuuauucagacccgcuagccuuaaaagaguuuaaagaauucgccgcugggcguaaaaguuuaaccuugaacuugauuaccgaaaugggaagacuaccaaccuucaugacacaaaaggcccggaaugcauuagacaauuuagcaguucugcauacugcagaagcgggagggcgugcuuacaaccacgcauuguccgaauugccggagacauuagaaacgcuucuauuacucaccuugcuggcgacuguaaccggagguauuuuucuauuccuaaugucaggaaagggaauuggcaaaaugacucucggaauguguuguauuaucaccgcuucaauacuauugugguacgcgcagauacaaccucauuggauagcagccucaauuauuuuagaauuuuuccucaucgugcugcuuauuccagaaccggaaaagcaacgaacaccucaggauaaucagcucaccuauguuguaauagcuauacugacgguuguugcagcaaccauggccaaugaaaugggguuccuugagaaaacaaaaaaagaucucggauugggguccauaacaacgcaggaauccgaaaguaauauacuggacauagaucuaagacccgccagugcguggacacucuacgcuguagccacaacauuuguaacgccuaugcuacgccauucaauugagaacuccucaguuaauguaucauuaacagcuauagcaaaccaagccacuguguuaaugggucuggguaaaggcuggccguugucaaagauggacauugguguaccauuauuagcaauuggguguuacucucagguaaacccaauuacacucacagcggcccuacuccuucucguggcacauuaugcaauuauaggcccaggacuucaagcaaaagcgacgagagaagcacaaaagagagcggcagcgggaaucaugaagaauccaacgguugaugguaucacaguuaucgaucuagaaccaauucccuacgacccgaaguuugagaaacaauuaggucaaguuaugcuuuuaauauuaugugucacucaaguacugaugaugagaacuacaugggcacuaugugaagcucuaacacuagcgaccggaccgauuaguacccucugggaagggaauccaggccgguucuggaacacaacuauagccguaucgauggcaaauauuuucagagguuccuaccuggcuggcgcuggacuacuuuuuucaaucaugaaaaauacaacuaauacaagacgcgggaccggaaacaucggugaaacacugggagaaaaauggaaaucuagacugaacgcccugggaaaaagcgaauuccaaauauauaagaagaguggcauucaggaaguagaucguacccuagcuaaagaaggaauuaaacgaggggaaacugaucaccacgcggucucaagaggcucagcgaaacuacgcugguuuguagaaaggaacaugguaacucccgaggggaaggucguagaucuggguuguggaaggggcggcuggucauauuacuguggaggacugaagaaugugagagaagugaaaggguuaaccaaagggggaccuggccaugaggaacccaucccuaugaguacauaugguuggaaccugguuagauugcaaagugguauagauguauuuuuuacgcccccugaaaaaugcgacacacugcucugugauauuggggagagcagccccaauccaacgauagaagcggguaggacgcuaagagugcuaaauuuagucgagaacugguuaaauaacaacacacaauucuguaucaaaguuuugaauccuuacaugccaucagugaucgagaaaauggaagcucuacaacgaaaauaugguggggcacuuguucgaaauccgcuaagucgaaauucaacccaugaaauguacugggucucgaacgcaacugguaauauagucucgagcgugaauaugauuucaaggaugcugauuaacagauucacaaugaaacacaagaaagcuacauaugagccugaugucgauuuggguagcggaacaagaaacaucgggauagaaucugaaauucccaauuuagacaucauagggaaacgcauugaaaaaaucaaacaagaacaugaaacguccuggcauuacgaccaagaucauccauauaagacaugggcauaucauggaucguacgaaacaaaacaaacaggauccgccaguuccauggucaaugguguagugcgacuucuuacaaaaccuugggacguugucccuauggugacacagauggcgaugacugacacaacaccauuuggacaacaacgagucuucaaagaaaaaguagauacaaggacacaggagccaaaggagggaacuaaaaaauugaugaaaauaacagcggaguggcucuggaaagaacuagggaagaaaaaaacacccagaaugugcacuagagaggaauuuaccagaaagguaagauccaacgccgcuuugggugcaaucuucacugaugaaaauaaguggaagucagcucgggaggcaguagaagauggacgauucugggaauugguagacagagagagaaaccuacacuuagagggaaagugcgagaccuguguauauaauaugaugggcaaacgugaaaaaaagcucggagaauuuggaaaggcaaaagggaguagagcaauaugguacauguggcucggagcgagauuucucgaauuugaggcccuaggguuuuuaaacgaagaucacugguuuucaagaggaaacagcuuaagcgggguugaaggagaaggguuacaccgucugggguacaucuuaagagacguaggaaaaaaagaaggaggugcuauguacgcugacgauacagcuggcugggacacgcguauuacauuggaagacuuaaaaaaugaagaaauggucacuaaucacaugaagggcgagcacaaaaaacuugcagaagccaucuucaaauuaaccuaucaaaauaagguuguccgaguucaaagacccaccccacgcggcacgguuauggauauuauuucgcgcagagaccaaagaggcucaggacaaguugguaccuacgggcuaaauacuuuuacaaauauggaagcccaauuaauaagacagauggaaggagaaggcauuuuuaagucaauccaacacuuaacagcgacugaggaaauugccguacaaaauuggcucgcacgggucggaagagaaagguuaaguagaauggcaauuucaggagaugacugcgucgugaaacccauagaugauagauuugcaagcgcuuuaacugcacucaaugauaugggcaagguacguaaagacauacagcagugggaacccucuagaggauggaacgauuggacacaaguuccuuuuugcucacaucauuuucacgaguuaguaaugaaagacgguagaguacuaguugugccuugccgcaaucaagacgaacuaauaggaagagcaagaauaucacaaggcgcaggauggucuuuaaaagagaccgccuguuuagggaagagcuaugcgcaaauguggacacugauguacuuccacagaagggaucuaagacuugcagcgaacgccauauguagugcuguucccucucacugggugccaacgucaaggacaaccuggucuauacacgcaaaacaugaauggaugaccacugaagacauguuggcagucuggaacagagucuggauacaagaaaauccauggauggaagauaaaacccccguugaaagcugggaagaagugccguaccuaggaaagcgggaagaucaguggugugguucuaugaucggucuaacuagcagggcaacuugggcaaagaacauccaaacugcaauaaaccaaguucgaucucuuauaggaaaugaagaguauacugacuacaugccgucuaugaaacgauuucguagggaggaagaagaagccggcgugcuuugguga

SEQ ID NO: 22457 - RNA, 9876 nt, Artificial Sequence
  derived and/or modified CDS sequence (opt6) from DENV-2__EU482691__SS-prME
accgcaggagugauagucaugcugauuccuacagcaauggcauuccaucuaacaacacgaaacggagaaccacauaugauaguaggaaggcaagaaaaagguaaaucauuguuauucaaaacagaagacggugucaauauguguacuuuaauggcgauagaucuuggagaauugugcgaagauacaauuacauauaaaugcccauuauuaagacagaaugaaccagaagauauugauuguugguguaauaguaccucuacaugggugacuuacggaacaugcacgacaacuggggaacauagacgagagaaaagaucaguagcauuagucccgcaugucggaaugggauuagaaacucgaacggaaaccuggaugucauccgaaggagcguggaaacauguccaacguauugaaacuuggauacuaaggcacccugguuucacuauaauggcugcgauauuagccuauacuauaggcacaacccauuuccaacgcgcauuaauauuuauccugcuaacugcaguagcaccaagcaugacuaugagaugcauaggcauuucuaaccgcgauuucguggaagggguuucaggagguucauggguugauaucgucuuagaacauggcagcuguguaaccacaauggccaaaaauaaaccaacgcuugauuucgaacuaauuaaaacugaggcuaaacaaccagcgacccuacgaaaauauugcauagaagcgaaauuaacgaacaccacaacagaaaguagauguccaacucaaggagaacccagccuaaaugaggagcaggauaaaagauuuauuuguaaacacagcauggucgacagaggguggggaaacggcuguggauuguuugguaaaggagggauuguuacuugcgcuauguuuacauguaagaaaaauauggagggcaaaguaguccaaccagaaaaccuagaauacacgauaguaauaacaccgcauuccggagaggaacacgcagucgguaaugauaccggaaaacaugggaaagaaauaaaaauaacuccgcaguccaguauuacagaagcagaauugacuggauacggcacuguaacaauggaaugcucaccccgaacaggacucgauuuuaacgaaaugguuuuauugcagauggaagauaaggcuugguuagugcauaggcaaugguuccuggauuugccauuaccuuggcuacccggggcggacacacagggaucuaauuggauacaaaaagaaacucuuguaaccuuuaaaaauccucaugcgaagaaacaagauguaguuguucucggaucucaggaaggugcaaugcauacggcgcucacaggagcgaccgaaauucaaaugucuucaggaaaucuucuauucacaggucacuuaaaaugccgauuacgaauggauaaauuacagcuaaaagguaugucuuauucaauguguacaggaaaauucaaaaucguuaaagagauagcugaaacacaacacggcaccauaguaauucgaguucaauaugagggugacggaagucccuguaaaauuccauucgagauuacggaucuagaaaaacgccauguccuagggcgacuaauuacaguuaauccuauuguaacagaaaaagacucaccaguaaacauugaggcugagccaccuuucggagauucauauauaauaauaggaguugaaccuggacaauugaaacuaaacugguucaagaaagggucaucuauuggacagauguucgagaccaccaugaggggugcaaaaagaauggcuauacucggcgacacagcuugggacuuuggaucguuaggcgguguguuuacaucaauugguaaagccuuacaucaaguguucggugcuauuuauggagcagcuuuuaguggagugucauggacaaugaaaauauuaauaggggugauaauuaccuggauuggaaugaauagucggaguacaagccuaagcguaucacucguguuaguggguguagucacuuuauaccuuggagcagugguccaggcggacucggguugcguagugagcuggaaaaauaaagaauuaaaaugcggaagcgggauuuuuauaacagauaacguucauacauggacagaacaauauaaauuccaacccgaaucccccaguaaacuagccucagcuauacaaaaagcucaugaagagggaauauguggaauaagaucaguaacaagauuagagaaccuaauguggaaacagauaacuccagaauuaaaucauauacuaagugaaaaugaaguaaaacugacgauaaugaccggggauauaaaaggcauaaugcaggcaggaaaacgaagucugcguccacaacccacggaauuaaaauacagcuggaaaacguggggaaaagcaaaaauguuaucaacggaaagccauaaucaaacuuucuugaucgaugguccugagacugcagaaugcccaaacauuaaucgagcuuggaacagccuagaaguagaagauuauggauuuggcguauucacuaccaauauaugguuaaaauugcgagaaaaacaggauguauuuugugauaguaaauuaaugagugcagcaaucaaagauaaucgugcuguacaugccgauaugggauauuggauagaauccgcccuuaacgacacauggaaaauggagaaagcuagcuuuauagaaguaaaaucgugucacuggccaaaaucucauacucucugguccaaugggguacuggaauccgagaugauaauacccaaaaauuucgcgggaccaguuucccaacacaacuaucggcccggauaccacacucaaacugcaggacccuggcaucuggggaaacuggaaauggacuuugacuucugugaagguacuacugugguagucacggaagacuguggcaaccgagguccuucacuaagaaccacuacugcgucugggaaacugaucacggaaugguguugccgaagcuguacacuaccaccgcucagauauagaggugaagauggcugcugguacggaauggaaauacgaccccuaaaagaaaaagaagaaaacuuaguuaacagccuggucacugcaggucauggccaaaucgacaauuucucauuaggaguucuaggaauggcccuauuucuugaagaaauguuaagaacaaggauaggaacaaaacacgcaauuuuguuagucgcugucaguuucguuacuuuaauaacaggaaauaugucguuuagggaccucgguagagugaugguaauggucggggcuacaaugacggacgauauagguaugggugugacuuaucuugcccuucucgcagcuuucaaaguucggccaacauuugcugccgggcuauuacucagaaaauugacuuccaaagaauuaaugauggcaacgauuggcauugcucuacucagccagucgacaauaccagaaacaauucuagagcuaacugacgcuuuagcacuggguaugaugguccuuaaaauagugaggaauauggagaaguaccagcuggcaguaacaauaauggcaauuucuugugucccgaacgcugugauacuacagaacgcauggaaagucaguuguacaauacuggcagccguaagcguaucaccauugcucuuaacaagcagccaacaaaaagccgacuggauaccucuagcccuaacaauuaaaggacucaacccaacggcuauauuuuugacaacucuuagucggacaaguaagaaacgaaguuggccacugaaugaggccauuauggcaguaggaaugguaagcauacuagcauccucccugcucaaaaaugauaucccaaugacaggaccccugguugcaggcggccuguuaaccguaugcuaugugcuuaccgggcgcucagccgacuuggaguuggaacgugccgcagacgugagaugggaggaucaagcugaaauauccggaagcucacccauacuaucaauaacuauuucggaagauggaucaaugucaauuaaaaaugaagaagaggaacaaacucuaaccauucuuauucguacagguuuauugguaauuagcgggguauuccccguuucgaucccuaucacagcagcagcgugguacuuaugggaaguuaagaaacagcgagccggaguccugugggaugugccauccccuccgccgguagaaaaggcagaacuagaggacggagccuacagaauuaaacaacgcgguauuuuggguuacagccagauaggagcaggagucuacaaggaagguaccuuucauacuauguggcaugucacaaggggagcuguuuuaaugcacagagggaagagaauugaaccaucgugggccgaugucaagaaagaccugauuaguuauggaggaggauggaaauuagaaggcgaguggaaggagggggaagaaguccaaguccuagcacuugaaccuggcaaaaaucccagagcaguacaaacaaagccuggaauuuuuaaaacgaauaccggaacaauuggcgcaguuagucuagauuuuucaccagggaccuccgguucaccuauaguggacaggaaggguaaaguagugggacuuuacggaaauggcguugucacuagaaguggggccuacguaucugccauagcacaaacagaaaaaucaauugaagacaacccagaaaucgaagaugauauuuuuagaaagaaacgacuuacuauaauggaucuccauccuggugcagggaaaacuaaaagguauuuaccggcgaucguuagggaagcgauuaaaagaggacugcggacauuaaucuuggcaccaacacggguaguagcugcagaaauggaggaagcacuaaggggauuaccuauccgcuaccagacaccagcgauaaaaacagaacauacaggacgggaaauuguagacuuaaugugucaugcaacuuucacaaugagacuacuaaguccgguuagggugccaaacuauaaucugauaauuauggacgaggcucauuuuacagaucccgccagcauagcagcgcgggguuauauaucuacacgcguagaaaugggugaagcugcaggaaucuuuaugacugcaacaccaccagguuccagagauccguuuccacaaaguaaugcuccuauaauggacgaagaaagggaaauuccugaaagaucauggaacucugggcacgaauggguaacugauuucaaaggaaagacaguaugguuugugccgucaauaaaagcaggaaacgacauagcugcuugucugcgcaaaaauggaaagaaaguaauacaauuaucucgaaaaacauucgauagugaauacguuaaaacaagagccaaugauugggauuucgucgugaccaccgauauuucagaaaugggggcgaauuucaaagcggaacgagucauugauccccgaagguguaugaaaccagucauacuaacugauggagaagaaagaguuauccuggcuggaccuaugcccguaacacacaguagugcugcccaaaggagggguagaaucggacggaaucccaaaaaugaaaacgaucaauauauauauaugggagaaccccuggaaaacgaugaagauugugcacauuggaaagaagcaaagauguuacuggacaauauuaauacgcccgaggguauaauuccgagcauguuugaaccugaacgagaaaaaguagaugcgauugauggagaauauagacuacgaggagaagcuaggaaaacauuuguugacuugaugagaagaggagaccuacccgucuggcuggccuauaaaguagcugcagaaggaaucaauuauacggaccggaaauggugcuuugacggaaucaaaaauaaccagauauuggaagaaaacauggaaguggaaauuuggaccaaagagggagaacguaagaaacuaaagccacgaugguuagacgcgagaauauauucggacccccuagcacuaaaagaauuuaaggaauuugcagcugggagaaaaucauuaacacucaauuugauaaccgaaaugggacgccucccuacguucaugacacagaaagcccgaaaugcguuagacaacuuagcuguuuuacauacugcugaagcagggggacgagcuuauaaccaugcguuauccgaauuaccagaaacucuagaaacacuacuccuccuuacguuacuagcgaccguaacugguggaauauuccuauuuuuaaugucggguaaaggaauaggaaaaaugacguuaggaauguguuguaucauaacugccagcauucucuuaugguacgcucaaauacaaccucauuggaucgcagcuucuauaauauuagaguucuuucuaauagugcugcuaauuccugaaccugaaaagcagcgaacaccucaagauaaucaacuuacuuacguagucauagccauuuuaacaguaguagcugccaccauggccaaugagaugggauuucuagagaaaaccaaaaaggacuuaggauuagguucuauuacaacgcaggaaucagagaguaauauauuggauauugauuuaagaccggcgucggcguggacacuuuacgccguagcuaccacuuuuguuacuccaauguugagacauucuaucgaaaauucaucggugaauguaucacucacagcaauugccaaccaagcaacaguuuuaaugggauuaggaaaaggguggccguuaucaaaaauggacauuggcguaccacugcuugcaauuggaugcuacucucagguuaacccaauaacacucacagcugcacuucugcuauuaguagcgcauuaugccauuauugguccaggacuccaagcgaaagcgacaagagaagcccaaaagagggcugcugcaggaauaaugaaaaacccgacaguugacgguauaacagugauugauuuagaaccaauucccuaugauccuaaauuugaaaaacaguuaggacaaguaaugcuauuaauuuuaugcguaacgcagguucuuaugaugagaacaacaugggcauuaugcgaagcguuaacacuagcgacaggaccaauaucaacauuaugggaggggaacccuggaagauuuuggaacacaacuauagcuguauccauggccaauauauuuagagguucuuaccuggcaggagcaggucugcuguucucgauuaugaaaaauacaaccucuacaaggagaggcacagggaauaucggggaaacgcuaggagaaaaguggaaaucuagacuaaaugcuuuggguaaaagcgaauuucaaauauauaagaaaucagguauccaggaagucgauagaacacuggcgaaggaaggcauaaaaaggggagagacagaucaccacgcgguaucaagggggucagccaaauuacgaugguuuguugaaaggaauauggucacaccugaaggaaagguaguugaucuggguuguggcagaggagguuggucuuauuauugcggcggccucaaaaauguccgcgaggugaaaggauugacgaaaggugggcccggacacgaagaacccauaccuaugagcacuuacggauggaaccucguuagacuucaaucaggaguugacguuuucuuuacgccuccagaaaaaugcgauacuuuacuuugugauauuggggaaaguuccccaaaccccacuauagaagccggaagaacguuacguguauuaaaccucguugagaacuggcucaacaacaauacacaauuuugcguuaagguacugaacccauauaugcccaguguuauugagaaaauggaagcgcuacaacgacaguauggcggcgccuugguacgaaacccguugagcagaaacucaacucaugaaauguauuggguaaguaaugcuaccgguaauauaguauccucuguuaauaugauaagucgcauguugauuaaucgguucaccaugaaacauaagaaagcuacuuaugagccggacguagaccuaggaucagguacaagaaauaucggcauagaaucugaaauaccaaacuuagauauaauagguaaaagaauugagaaaauaaagcaagaacaugaaauaucauggcacuacgaucaggaucaccccuauaaaacaugggcguaucacgguucuuaugaaacaaaacaaacggguucagcgagcucuauggucaaugguguaguacguuugcugaccaaaccaugggacguuguaccuaugguaacucagauggccaugacagauacuacucccuucggacaacagaggguauuuaaagaaaaaguagauacccguacccaagagccaaaagaaggaaccaagaaauuaaugaaaauaacagccgaguggcuauggaaagaauuagguaagaagaaaacaccucgaaugugcaccagggaagaguucacaagaaaagugcgaucaaacgcggcguuaggggcaauauuuacggaugaaaauaaauggaaguccgccagggaagcagucgaagauggccgauuuugggagcucguagauagggagagaaacuuacaucuggaaggaaagugugaaacaugcguuuauaacaugaugggaaaacgugagaagaaacucggggaauuuggaaaagccaagggcucccgagcuauuugguauaugugguuaggagcaagguuucuugaauuugaggcauuaggguuuuuaaaugaagaccauugguucucaagagguaacagucuuucagguguagaaggggaaggacuccauagguuaggauauauacuucgcgauguagguaaaaaggaagguggugcuauguacgcugaugacacagcuggaugggauaccaggauaacauuggaagaucuuaaaaacgaggagauggucacaaaucacaugaaaggcgaacacaaaaaguuagccgaagccaucuucaagcucacauaucaaaacaaagugguaagaguacaaagaccuacuccaagaggcacaguuauggauauuauuucgaggagggaucagcgaggaucaggucaaguuggcaccuacgggcuaaauacauuuaccaacauggaagcccaauuaauaagacaaauggaaggugaaggaauauucaagagcauucaacauuuaacagcuacugaagagaucgcaguucaaaauuggcuagcucguguaggaagggaacgacuaucuagaauggcgauaucaggagacgacugugucgugaaaccaauagaugaucgauucgcaucugcccucaccgcucugaaugauaugggaaaaguucgcaaagauauucagcaaugggaaccaucgcgaggguggaaugacuggacacaaguaccguucuguucgcaccacuuucacgagcuaguuaugaaagauggucguguauugguagucccauguaggaaucaagacgaauugauuggacgugcucgaauaucacaaggagcaggauggagccuaaaggaaacggcuugccuuggaaaaucauacgcgcagauguggacacugauguauuuccauagacgggaucuucgacuagcugcaaaugcaaucuguagugcugugccgagccauuggguacccacuucuagaacuaccuggucgauucacgcgaaacacgaauggaugacgacagaagacaugcuugcagucuggaaucggguguggauucaagagaauccauggauggaggauaaaacccccguagaaagcugggaagaaguacccuacuuaggaaaaagagaagaucaauggugcggcucacuaauaggauuaaccucgagggcaacuugggcgaagaauauucaaacugcaauaaaucaaguacgcucauuaauuggcaaugaagaguauaccgacuauaugccaucaaugaaacgauuuagacgagaagaggaggaggccgguguucucugguaa

SEQ ID NO: 22458 - RNA, 9876 nt, Artificial Sequence
  derived and/or modified CDS sequence (opt6) from DENV-2__EU482693__SS-prME
acagcgggagucauugucauguugauaccaacagcaauggcauuccaccucaccacacggaauggugaaccucauaugaucguaggaagacaagaaaagggaaagucguuguuauuuaaaacggaagacggaguaaauauguguacauugauggcaauagacuuaggcgaacuaugugaggauaccaucacauauaaauguccauuauugcggcaaaacgagcccgaagacauugauuguuggugcaacucgacgaguacauggguaacauaugguacauguaccacuacgggggaacaucgacgggaaaagcguaguguggcauuagucccacauguggggaugggcuuagaaacuagaacugaaaccuggaugucaucagagggugccuggaaacauguucaaagaauugagacuuggauauuacgacacccuggcuuuacaauaauggccgcgauucuagcguacacgauuggcacaacacacuuucaaagagcauugauauuuaucuuacugacagcugucgcuccuucaaugaccaugagauguauaggcauaagcaaccgggauuucguugaaggugucaguggcgguagcuggguugacaucguguuggaacaugggucaugugucacaacuauggccaagaauaagccuacccuugacuuugaacucauaaagacagaggcuaaacagccagcuacucucaggaaauauuguaucgaagcaaaacuaacaaacacaaccaccgaaucacggugcccaacucaaggugaaccaagucuuaacgaagaacaagacaaacgauucauuuguaagcauaguaugguagauagaggaugggggaauggaugcggauuauucggcaaaggugguauaguuacaugugcuauguuuacgugcaaaaagaauauggagggaaaaguuguacagccagaaaacuuagaauauaccauugucauuaccccccauucgggagaggaacaugccgucggcaaugacacagguaaacauggcaaagagauaaaaaucacgccgcaaaguaguaucacagaagcagaguuaacaggcuacggaaccguaacuauggaauguucuccuagaacaggauuagauuuuaaugaaauggugcuucuacaaauggaggauaaagcuugguuggugcaucggcaaugguuccuugaucuuccuuugcccugguuaccaggcgcggauacacaagggagcaauuggauucaaaaagagacucuaguaacuuuuaaaaauccccaugcuaagaaacaagauguaguagucuugggaucucaagagggggcaaugcacacggcguugaccggcgcaacugaaauacagaugucuucaggcaaucugcuuuucacuggacaccuaaaaugcagacuuaggauggauaaacuacaauuaaaggggaugaguuauagcauguguacugguaaauucaaaauagugaaagaaaucgccgaaacacaacauggcacaauugugauaaggguacaauaugaaggugaugggucgccguguaaaaucccauuugagauaacggaucuggaaaaaagacauguucuaggacgguuaauaaccguaaacccaauugucaccgaaaaagacagcccagucaacauagaggcggaaccuccuuuuggugauagcuauauaaucauugguguagagccaggacaacuuaaauuaaacugguucaaaaagggaucaucaauaggacaaauguuugagacgacaaugagaggugcaaagagaauggcaauauuaggugauacagcaugggauuucggcucauuagguggaguauuuacuagcauuggcaaagcauuacaccaaguauucggcgcaauauacggagcggcuuuuucaggcguaagcuggacaaugaagauucuuaucggugugauuauuacuuggauuggaaugaauucuaggaguacgucucuuucugugagucuuguacuugucgguguuguuacauuauaucugggagcuguugugcaagcagauagcggauguguaguaaguuggaaaaauaaagagcucaagugcgguagcggaaucuucaucacagauaaugugcauacauggacggaacaauauaaguuucaaccagaaaguccaucaaaacucgcaucagcaauacaaaaggcccaugaagaagguauuugcggaauaagaucuguuacuagguuagagaauuugauguggaaacaaauaacccccgaauuaaaucacauucucagugaaaaugaggucaaauuaacaauuaugacaggcgacaucaaagguauuaugcaagcaggaaagagaucuuuaagaccacaacccacggagcuaaaguauagcuggaaaacuuggggaaaagcaaaaauguuauccacugagucgcacaaucaaaccuucuuaauugacggaccugaaacagcugaauguccgaauacaaaucgcgcguggaauucacuagaaguggaagacuauggcuuuggaguauucaccaccaauauauggcuaaaacuuagggaaaaacaagacguauuuugcgauaguaaacuaaugucagcagccauuaaagauaacagagcaguacaugcagacaugggcuacuggauagagagcgcucugaaugauacuuggaaaauggagaaagcgaguuuuauugaagucaagucgugucauuggccaaaaagucauacguuguggucuaacggcgucuuagagucagagaugaucaucccgaaaaacuucgcuggcccaguaucgcagcauaacuaucgccccgguuaucauacacaaacugccggaccauggcaucucggaaaauuagaaauggauuuugauuuaugugaagggacaacggugguagucacugaggacugcgguaacagagguccuagucugcguacgacaacagcaagcgggaaacuuauaaccgaauggugcugcaggucauguacgcuuccaccgcugcgguacagaggugaagacggauguugguacggcauggaaauuagacccuugaaagaaaaagaagaaaaccuggugaauucacuggugacggcgggccauggucagauagacaauuuuucauugggcguacuuggaauggcacuauuucuugaagaaaugcuuagaacacggaucggaacaaaacacgccacucuguugguagcuguuuccuuugucacacugauaacagggaauaugucguuuagggaucucgguaggguuaugguaaugguuggagcaacuaugacggaugacauuggaaugggcguaacauauuuagcacuacuagccgcauuuaaagugaggcccacuuuugcagccggguuacucuuaagaaaacugacuucgaaagaacugaugauggcuacaaucgguauagcauuguuaagucagucaaccaucccugaaacuauacuagagcuaacugacgcacuagcauuaggaaugaugguuuuaaagauuguacgaaauauggaaaaguaucaacuggcaguaaccauaauggcuauaucaugugugccaaaugcaguaaucuuacaaaacgcguggaaaguaaguuguacuauuuuagcugcuguuucaguaucgccccugcuuuugacuaguucacaacaaaaagccgacuggaucccauuagcguugacaauuaagggacuaaauccaacagcaauauucuuaacgacuuuaucucgaacuucaaagaaaaggucauggccacuuaaugaagcgauuauggcaguugggauggugagcauacuagcuaguucuuuacuaaagaaugauauuccaaugacaggaccauugguagcgggggguuugcuaacagugugcuauguguugaccggaaggagugcagaucuggaacuagaaagagcggcugacgucaaaugggaggaccaagcagaaaucuccggaaguucuccaauacuuucaaucacaauuuccgaagauggaucaaugaguauaaagaacgaagaagaggagcagacauuaacaauucugauacgaaccggcuuacuagugauuagcgggguauuuccuguaaguauuccaauaacggcggcggcuugguaccuaugggaagugaaaaagcaacgcgcagggguauugugggauguaccaagucccccuccugucgaaaaagcggaacuugaagacggggccuaucgcauaaaacaacgcgguauucucggcuacucccaaaucggugcuggggucuacaaagaggguacauuucacacaauguggcauguuacaagaggagccguuuuaaugcacagagguaaaagaauagaaccaucgugggcugacgucaagaaagaccuuauaucauaugggggaggauggaagcuugaaggggaguggaaagagggugaagaaguucagguauuggcauuggaaccaggaaaaaauccacgagccguucaaaccaaacccgggauauuuaaaacuaauacggguacgauaggagcaguaucacuggauuuuucaccggguacaagcgguaguccgauaguggauaggaagggaaaaguaguuggccuauacgggaacggaguagugacacgcagcggagcauauguuucagcuauagcgcaaacagagaagaguaucgaggauaauccugaaauugaagacgauaucuucagaaagaaaagauugacaaucauggaccugcauccaggugcuggaaaaacaaaacgauacuuaccagcgauuguacgcgaagccauaaagcgaggccucagaaccuuaauuuuggcgccaacgagagucgucgcagcggaaauggaggaagcgcuucgaggauugccaauacgauaucagacaccggcaauaaaaacugaacauacuggcagagagauaguagacuuaaugugucaugcaaccuuuacaaugcgucuauugaguccgguaaggguaccgaauuacaauuuaaucauaauggaugaggcacacuuuacagacccagcuagcauagcagcgagaggguauauuagcacucggguggagaugggagaagcagcaggaaucuucaugaccgcgaccccacccggaucaagagaccccuuuccacaaaguaacgcuccuauaauggaugaagaaagggaaauuccggaacgaucauggaacucuggccaugaauggguaacagacuuuaaggguaaaacaguaugguuuguuccaucuauuaaagcugguaacgacauagcagcuugucuacgaaagaauggaaaaaaaguaauucagcucucaaggaaaacauuugacucugaauacguaaaaacgagagcuaaugauugggacuuuguggucaccaccgauauaagcgaaaugggcgcaaacuuuaaagcugagcgcguaauagaccccagaagauguaugaaaccaguuaucuuaacggauggagaagaacgaguuauucuagcuggccccaugccuguuacucauucuucagcugcucaacgacgaggucguauuggcagaaaucccaaaaaugaaaacgaccaguauauuuauaugggugaaccauuagagaaugacgaggauugugcgcauuggaaagaagcaaaaauguugcuagacaauauuaauacucccgaaggaauaaucccgaguauguuugagccggagcgcgagaaaguugacgcaaucgauggugaauauagacuccgaggagaggcaagaaaaacauuuguagauuugaugaggaggggagaucuaccgguauggcuagcauauaaaguagcugcagaggggaucaauuaugcggauagaaagugguguuucgauggaaucaaaaacaaccaaauacuugaggagaacauggaaguugaaauauggaccaaagaaggcgaaaggaagaaacugaaaccaagauggcucgaugcccguauauauagugauccacuagcauuaaaagaguuuaaagaauuugcagccggacguaaaucacucacacuaaacuuaauuacagaaaugggaagacuaccaacauuuaugacacaaaaggcccguaacgcuuuggacaacuuagcugugcugcacacagcggaagcggggggaagagcuuacaaccaugcauuauccgaacuuccugaaacauuagaaacauuguuacuuuuaacacuacuagcaacaguaaccggaggaauauuucuauuccuaaugagcgguaagggaauuggcaaaaugacgcuaggcauguguugcauaaucacggcaucaaucuuguuaugguaugcucagauucaaccucacuggauagccgcuucaauuauacuagaguuuuuucuuauuguacuacuuauuccagaaccagaaaaacaaagaacaccucaagauaaucagcugaccuacguagucauagcaauacugacaguaguagccgcaaccauggccaacgaaauggguuuccuugagaaaacgaagaaagaucugggacuagguagcauaaccacacaagaaucugagucgaauauauuagacauagauuugcgcccagcaucagccuggacacuuuaugcaguagcgaccacauuuguuaccccaauguuaagacauaguaucgagaacaguuccgugaacgucucacuuacagcgauugcgaaccaagccaccguucugauggggcugggaaaaggguggccauugucaaagauggauauagggguaccuuuguuggcaauaggguguuauucacaaguuaauccaauaacguuaacagccgcauuauugcuguugguagcacacuacgcgauuaucgguccaggauugcaggccaaagcaacgagagaagcacagaagagagcagcggcugguauaaugaaaaauccgacaguagaugggauaacuguaauagaccuagaacccauaccuuacgauccgaaguuugaaaaacaauuaggacagguuaugcucuugauacucugugugacucaaguacugaugaugagaacuacuugggcacucugcgaagcguuaacacuagcaaccgguccaauaagcacguuaugggaagggaauccaggcagauucuggaauacaacaaucgcagugucgauggcuaacauauuuagaggcagcuaccuagcaggagcuggguuguuauuuaguauaaugaaaaauacgacaucaacucgcagaggaacagguaacauaggggaaacauuaggggaaaaguggaaaucaaggcugaaugcacuagguaaaucagaauuucaaauauauaaaaaaucuggaauacaagaaguagauagaacucuggcaaaagagggaauaaaacgaggagaaacugaccaucaugcaguuagucgugguagcgcgaaguuacggugguuuguagaacgaaauaugguaacuccagaggguaagguaguagaccuggguuguggacgaggcggguggucauauuauugugguggacucaaaaauguacgagaagugaaagggcuuacaaaaggagguccgggucaugaagagccuaucccaaugagcacuuauggauggaacuuagucagauugcaaucgggaguagauguuuuuuuuacaccgccggaaaaaugcgacacacuacucugugauauaggagagaguaguccaaacccaacaauugaagcaggacgaacccuuagaguccuaaauuuaguggaaaauugguuaaauaauaauacucaauuuugcaucaagguccucaauccuuauaugcccagcguaaucgaaaaaauggaagcccugcagagaaaguaugggggagcauuagucaggaauccuuugagucgcaauaguacacacgaaauguacuggguuucaaaugcgacagggaauauuguaucaagcguaaauaugauaagcaggaugcugauaaaucguuucaccaugaaacauaaaaaagcgacuuaugagccugauguagacuuaggaaguggaacccguaacauuggaauugaauccgaaaucccaaauuuggacaucauugggaagagaaucgagaagauaaagcaagaacacgagaccagcuggcacuacgaucaagaucauccauauaaaacaugggcguaucacgguucauacgaaacaaaacaaacuggaucggcuaguagcaugguaaauggugucguacgacugcucacaaaaccaugggauguuguuccuaugguuacacaaauggcaaugacagacacaacgccuuuuggacagcaaagagucuuuaaggaaaaaguagacacccgcacccaagagccaaaagagggaacuaagaaguugaugaaaaucacggcagaguggcucuggaaggaacuaggcaagaaaaaaacuccaaggaugugcacaagagaagaguuuaccagaaaaguucgaaguaaugcagcgcuuggagcaauauuuacagacgaaaauaaauggaaaucagccagagaagcaguagaagauggacgguucugggaacugguugacagagaacgaaaucuacauuuggagggaaaaugugaaacaugugucuacaacaugauggguaaaagagagaaaaagcuaggcgaauuuggaaaagcaaaaggcuccagggcuaucugguauauguggcuaggugcaagauuucuggaguucgaggcauuaggguuucucaaugaagaccauugguucucucgaggaaauagucuaucagguguugagggagaaggacuacacagacuuggauacauacuacgugaugugucaaaaaaagagggcggagcaauguaugcagaugauacagccggaugggacacccguauaacacuagaagacuuaaaaaacgaagaaauggucacaaaucacaugaaaggagagcacaaaaaauuagcugaagcgaucuuuaaacuuacauaucaaaauaagguagugcgaguacaacgacccaccccgcgagggacuguaauggauauaaucagucgccgagaccaaagaggaucugggcaaguuggaacauauggcuuaaauacuuuuacuaacauggaagcgcagcuaauaaggcaaauggaaggggaaggaaucuucaaaaguauucaacacuugacagcagccgaggagaacguugugcaaaauugguuagcucggguggggagggagagacuuucaagaauggcaauauccggugaugacuguguaguuaagccgauagaugauagauuugccucugcacuaacagcguugaaugacaugggaaaaguaaggaaggauauacaacaaugggaaccaucuagagguuggaacgauuggacccaaguaccauuuugcucucaccacuuucaugagcuaguaaugaaggauggcagggugcuuguagugccaugcagaaaucaagaugaacuuauagguagagccagaauaagucagggugcuggauggagccuaaaggagacagcaugccuaggaaaauccuaugcucagauguggaccuuaauguacuuccaucgaagagaucugcguuuggcagcgaaugcaauuuguagcgcagucccaucacacugggugccaacuucaaggacuacauggaguauacaugcaaaacacgaguggaugaccacggaagauauguuggcaguuuggaauagggucuggauccaagaaaauccuuggauggaagacaagacaccaguagaguccugggaagaagugccguaucuuggaaaaagagaagaucaauggugcgguucacuaauuggguuaacgagucgagcuaccugggcuaaaaacauucagacugcuaucaaucaaguaagaucucucauagggaacgaggaguacaccgauuacaugccauccaugaaacgguuucgcagggaagaagaggaagccggcguccucugguga

SEQ ID NO: 22459 - RNA, 9876 nt, Artificial Sequence
  derived and/or modified CDS sequence (opt6) from DENV-2__EU596483__SS-prME
acagcugguguuauugugauguuaauaccaacagcaauggcuuuucaucuuacgacaagaaacggggaaccucacaugauaguuggucggcaagaaaaagguaaaucguuauuauucaaaacugaagauggagucaauauguguacacuuauggcaauagaucuaggugaauuaugcgaagauaccauaacauauaaaugcccccuauuaagacaaaaugaaccugaagacauagauuguuggugcaauuccacaucuaccugggucacauacggaacauguacaacuacaggugaacaucgucgugaaaaacgaagcguagcccuuguuccucacgucggaaugggacucgaaacgcgaacugaaacuuggaugucaucugaaggggcuuggaaacacguccaaagaaucgaaaccuggaucuuacggcacccuggauucacaauaauggcagcgauauuagcauacacgauagggacuacacauuuccaacgagcauugauauuuauacuuuugaccgcuguagcaccaagcaugaccaugcguuguauaggaauuaguaaucgcgacuuuguugaaggcguguccggugguagcuggguagacauuguauuggaacaugguagcuguguuacaacuauggcgaaaaacaaaccaacguuagauuuugaacuuaucaaaacagaagcuaaacaacccgcaacauuaagaaaguacuguauugaagccaaauuaacaaauacaacgacagaaaguagaugcccaacacagggagagccuucccucaacgaggaacaagauaaaagauuuauaugcaaacacaguaugguagaccgagguuggggaaaugguuguggcuuauuugggaaagguggcauuguaacgugugcaauguucacauguaagaagaacauggaagguaaaguuguacaaccugaaaacuuagaauauacaauuguaauaaccccacauuccggagaggagcaugcaguaggaaacgacacaggaaaacacggcaaagaaaucaagaucacaccgcaaucgucaauaacagaggccgaacuaacggguuauggaacaguaacuauggaaugcucaccgcgaaccggacucgacuucaaugaaaugguguuauuacaaauggaggauaaagcgugguugguacaucgacaaugguuucuagaccugccccugccgugguuaccuggcgcagacacacagggcagcaacuggauccagaaggaaacccuaguuaccuucaaaaauccgcaugccaagaaacaggauguugugguguugggcucacaggaaggagccaugcacaccgcacuaacuggggcuacggagauucaaaugagcaguggaaaucuauuauuuacaggccauuuaaagugucgauuacguauggauaagcuacaacugaaagggauguccuacagcauguguacgggaaaauucaagaucgucaaggaaaucgccgaaacacaacacggcacaauuguaauaagaguccaauacgaaggugacggaucuccaugcaagauaccuuuugaaauaacugaccuggagaaaagacacguucuagggcgguuaauaacuguuaauccuaucguaaccgagaaggacucgccaguaaacauugaggcagaaccaccuuucggagacuccuauauuauaauugggguagaaccaggacagcuaaaauugaauugguuuaagaaaggaucaucaaucgggcagauguucgaaaccacaaugagaggugccaagcgaauggcaauucuuggugacaccgcgugggacuuugggagccucggaggcguauucacgaguauuggaaaagcauugcaucaaguguuuggagcaauauacggugcggcuuuuaguggggucaguuggacgaugaaaauucuuauuggaguaauuauaacauggauuggaaugaacucucgcagcacuucauuaucaguaucucuaguguuaguuggaguugugacuuuauauuuaggagccguuguccaagcagauucugguugugugguuuccuggaaaaacaaagaauugaaguguggaucaggaauuuucaucacagacaauguucauacuuggacggaacaauauaaguuccaaccagaaucaccuucaaaguuggcaucagcuauacagaaagcacaugaagaagguauuuguggcauacguagcgucacaagacuggaaaaucucauguggaaacagauaacgcccgaacuuaaccauauauuaucagagaaugagguaaaacuuacaauaaugacgggggauauaaaaggcauaaugcaagcgggaaagagaucgcuaagaccucaaccaacugaauuaaaguauucauggaaaacgugggggaaggcaaaaauguuaucuacagaaagucauaaucagaccuuucuaauugauggaccagaaaccgcagaaugccccaacacuaauagagcguggaauagcuuagaaguagaagacuacggauuuggugucuuuacuacaaacauauggcuaaagcuacgcgaaaagcaagacguauuuugcgacuccaaauugaugucagcggcgauaaaggauaauagggcgguacaugcagauaugggauauuggauggaguccgcguugaacgacaccuggaaaauggaaaaggcuagcuuuauagaaguaaaaucgugccacuggccuaaaagucacacguuauggucaaaugggguauuagaauccgaaaugauaauaccgaagaauuucgcagguccaguuucacaacacaauuaccguccuggauaucauacucagacugcaggaccauggcauuuaggaaaacucgaaauggauuucgacuucugugaaggaacaacaguuguuguaacagaagacugugguaacagaggcccgucacuaaggacuacuacggccucaggaaaacucauaacagaaugguguuguagaaguuguacccucccuccgcuucguuacagaggagaagacgguuguugguauggcauggaaauuaggccuuuaaaggaaaaagaagaaaaucuaguaaacagcuuaguaacagcagggcacggacagauugacaacuuuuccuuaggaguucuugggauggcccucuuucucgaagaaaugcuaaggacacgcauagguacaaaacacgcaauccuguuaguugcuguuaguuuuguaacuuugauaacggguaauaugagcuucagggaucugggaaggguaaugguuaugguaggagccacuaugacggaugauauuggaaugggugucacuuaucuugcauugcuagcagccuucaaaguaagacccacuuucgcggcaggacuucuacuucggaaauugacuucuaaagaauuaaugauggcuaccauagguauagcucuuuuaagccaaaguacuauaccagagacaauauuagaguuaacagaugcacuugccuuaggaaugauggugcugaagaucguaagaaacauggaaaaguaucagcuagcggugaccauaauggccauaaguugcgucccaaaugcaguaauauuacagaacgcuuggaaagucucaugcacgauccucgcagcgguuucaguaucaccgcugcuccuuacaucaagccaacagaaggcagauuggauaccacuagcacuaacgaucaaaggacuuaauccaacagcaauauuucuaacgacgcuuucgagaaccaguaagaaacguaguuggcccuugaacgaagcuauaauggccguaggaaugguaucuauuuuagccaguagcuugcugaaaaaugauauaccuaugacuggcccguuaguggcggguggccucuuaacuguauguuauguguuaacuggacgaucggcagauuuagaguuagaaagagcagcagacguuaaaugggaggaccaagccgaaaucucgggaaguucaccgauuuuaucgauuacaauaucagaagauggaucaaugaguaucaaaaaugaagaagaagaacagacauugacaauucuaaucagaacuggucuccuagugaucaguggcguauuuccagucucuauaccaauaacugcagcagcgugguaccuaugggaaguaaagaaacaacgugcgggcgucuuaugggauguaccaaguccaccuccaguagaaaaagcagaauuagaagauggugcguauagaauaaaacaaagagguauauuaggauauagucaaauuggugcggggguguauaaagagggcacuuuucauaccauguggcauguaacucguggugcaguauuaaugcauagagggaaaaggaucgagccuaguugggcagaugucaagaaggauuuaauuucuuauggaggcggauggaaacuggaaggagaauggaaagaaggcgaagaaguacagguauuagcguuagaaccuggaaagaauccaagagcaguacaaaccaaaccuggaauauuuaaaacuaacacgggaacaauaggggcuguuagucuugacuuuuccccggggacaucaggaagucccaucguagauagaaaaggcaaaguuguaggacuuuauggaaacggagugguuacccgaagcggagcguacgugucagcuauagcacagacagagaaaagcauagaagacaacccagaaauugaagacgauaucuuuaggaagaaaaggcuaaccaucauggaucuccauccgggugcugggaaaacaaaacguuaccuaccggcaauuguuagagaggccauaaaacgcggucuaagaacuuuaauuuuggcaccaacaaggguaguugcagcggaaauggaagaggcacuacgaggccuacccauucgguaucaaacaccagcaauuaaaacugaacacacuggucgagaaauuguggaucuuaugugccaugcgacuuuuacaaugagacuuuuaucccccguaagaguaccuaauuacaaccuuauaauaauggaugaagcacauuucaccgaucccgccaguauugccgcaagaggauauauaaguacacgugucgaaaugggagaagcugcaggaaucuuuaugacugcgacuccaccagguucaagagaccccuuuccacaaucaaaugcccccauaauggaugaagaaagagaaauuccggaacguucuuggaacucaggccacgaauggguaacugacuucaagggaaaaacgguaugguucguaccuucaauuaaagccgggaaugauauugcagcguguuuaaggaaaaauggcaagaaaguuauacaacucucacgaaaaacuuuugacucugaauauguaaaaacccgugcaaacgauugggacuucguaguuacaacggacaucucagaaaugggagcuaauuuuaaagcagagcgcguaaucgauccuagaagguguaugaaacccgucauuuugaccgauggagaggaaagaguuauucuugcaggcccaaugccaguuacacauucaagcgcagcucaaagaagagggagaaucggucgaaaccccaagaacgaaaacgaucaauacaucuacaugggggaaccacuagaaaaugaugaagacugcgcgcauuggaaagaagcaaagaugcuucucgauaacauaaauaccccugagggaauaauuccaaguauguuugaaccagaacgggagaagguagacgcaauugacggagaauaccgacuucgaggagaagcgcgaaaaacauucgucgauuuaaugagaagaggagaucuaccaguuugguuagcguacaagguagcggccgaaggcauuaauuauaccgauagaaagugguguuuugaugguauaaagaauaaccaaaucuuagaggaaaauauggaaguugaaauauggacgaaagagggagagcgaaagaaauuaaagcccagguggcuugacgcuagaaucuauucggacccauuggcacuaaaggaguucaaagaauuugcugcuggccguaaaucacuaacauuaaacuuaauaacggaaaugggcagacuaccaacauuuaugacucaaaaagcacguaacgcacuagacaaccuugcaguccugcauacagcggaggccggugggagggcguauaaccacgcgcuuagugaacuaccagaaacgcuagaaacauuauuauuauuaacucuauuagcaacugucaccggcggaauauuuuuguuuuugauguccggaaagggaauaggaaagaugacauuagguaugugcugcauaaucacugccucuauacuacuuugguaugcgcagauucaaccccauuggauagcagcaaguauaauucucgaauuuuuccuaauaguacuacuuauaccugaaccggaaaaacaaagaacaccacaggacaaucaacuaacuuauguagugaucgcgauacugacuguuguggcagcgacaauggcgaacgaaauggguuuucucgagaaaacaaagaaagaccucggguuaggcaguauaaccacacaagagucagaaucuaauauccuugauauagauuuaaggccggcgagugcuuggacauuguaugcuguugcaacaacuuucguuacuccaauguuacgacauucaauugaaaauucgucugucaauguuucuuuaacagcaauugcaaaccaagcaacaguacuaaugggguuaggaaaagguuggccacuuaguaagauggauauuggugugccacuucuggcuauagguugcuauagccaagucaauccgauaacucuaacggcggcuuugcuuuuauuaguagcccacuaugcaauaauuggaccgggauuacaagcuaaagcaaccagagaagcccaaaagagagcugcagcgggaauuaugaaaaauccgacuguagauggaauuacaguaauagauuuagagccaauaccuuacgacccgaaauuugagaaacaacuugggcaaguuauguuauuaauacuauguguaacccaaguauuaaugaugaggacuacuugggcccugugugaagcccuaacauuagcaacuggacccauuucaacgcucugggagggaaauccuggucgcuuuuggaacacgacgaucgcgguaagcauggcaaauauuuuuagaggcuccuaucuggcaggcgcaggauuacuauuuucaaucaugaaaaacacuaccucgacaagacgagggacaggaaauaucggagaaacacuaggagaaaaguggaagucuaggcuuaacgccuuaggaaaaagugaguuucaaaucuacaagaaaagcggcauacaggaaguagaucgaacauuagcaaaggaagguauaaagagaggagaaacugaucaccaugcagucucaagaggcagugcaaaguugagaugguucguagaaaggaauaugguaacuccagaaggcaagguagucgauuugggaugugggagaggaggauggucuuauuacuguggugggcucaaaaaugucagggaaguuaaaggacugacuaaaggaggccccggucacgaggaaccgauaccaaugucgacauauggauggaacuugguuaggcuccaaagugggguugacguauuuuucacuccaccugaaaagugcgauacccuauuaugugauauaggagagucgaguccaaauccaaccauagaggcagguagaacucugcgagugcuaaaccugguagagaacuggcuaaauaauaauacccaguucugcaucaaagugcuuaauccuuacaugccuaguguuauugagaagauggaagcccuucaacgccaauacggaggugcgcuggucagaaauccucuaagccguaacucaacacaugaaauguauuggguaucaaacgcuacaggaaauaucguuagcaguguaaauaugauaagcaggaugcuaauaaacagguucaccaugaaacauaagaaagcuaccuacgagccagauguagacuuggggucaggaacucguaauaucggcauagaaagcgaaaucccaaacuuagacauuauugggaaaagaauagaaaagauaaaacaggaacacgaaauuagcuggcacuacgaucaggaccaccccuacaaaaccugggccuaccacggcaguuaugagaccaaacaaaccggaagugcaucaucaaugguuaauggcgugguuagauuauuaacaaagccgugggauguaguuccuauggucacacaaauggcaaugacagacaccacaccuuuuggacaacaaagaguuuuuaaagaaaaaguggauacaaggacacaggagccaaaagaagguacuaagaaacuaaugaaaauaacggcggaauggcuauggaaagaauuagguaagaagaaaacuccacgaauguguacucgagaagaauuuacaaggaaaguacggaguaaugcagcacugggcgcaauauuuacagaugaaaauaaauggaaaagugcaagggaagcgguugaggaugguagauuuugggaguugguagaucgugaacgaaaccuucaccuggagggcaaaugcgaaacgugcguauauaauaugauggggaaaagagagaagaaacuaggagaguucgggaaagccaaagguaguagggccaucugguauauguggcuuggugcccgcuucuuggaauuugaagcauugggguuucuaaacgaagaucauugguucucucgcgggaacagccuauccgggguugaaggagaaggguugcaucgacuuggcuacauacuacgggacgucggcaagaaagaaggaggcgcgauguaugcugaugauacggcagguugggacacacguauaacgcucgaagauuugaaaaaugaagagauggucacaaaucauaugaaaggagaacauaaaaagcuggcugaggcgauauuuaaacuuacguaucagaauaaaguuguucgcguccagcggccuacgccuagaggcacuguuauggauaucauaagucgucgugaucaacgcgguaguggacaaguaggaaccuacggauuaaauacauucacaaauauggaagcgcaauuaauacgccaaauggaaggugaagggauauuuaaaaguauacaacaucuuaccgcuaccgaagagauugcuguucaaaacugguuggccagggucggucgcgaaagauuaagcagaauggcaauaagcggcgacgauuguguuguaaaaccaauugacgacagauuugcaagugcuuuaaccgcacuaaaugacaugggaaaagugagaaaagacauucaacaaugggaacccucuagggguuggaacgacuggacccaaguccccuuuuguagucaucacuuccaugagcuuguaaugaaagacggucguguacugguaguacccugcagaaaucaagacgaacuaauaggcagagcaagaauaucucagggcgcagguuggaguuuaaaagagacggcauguuugggaaaaucuuaugcacaaauguggacacuaauguacuuucaucgacgagaucuucgacuugccgcgaaugcaaucugcagugcuguaccuucccauuggguuccaacaucaagaacuacauggagcauccaugccaaacaugaauggaugaccacugaagacauguuagcaguguggaaucgaguuuggauacaagagaaucccuggauggaagacaagaccccugucgaaucaugggaagaagucccauaccuaggaaagagggaagaucagugguguggaucacuuaucggauuaacaucucgggcaacaugggcgaaaaacauucagacugcuaucaaucaaguuaggagcuuaaucgggaaugaagaauauacagauuacaugccaucgaugaaacgguuucgaagagaggaggaggagacugggguacuuugguaa

SEQ ID NO: 22460 - RNA, 9876 nt, Artificial Sequence
  derived and/or modified CDS sequence (opt6) from DENV-2__EU482597__SS-prME
accgcugguguuauagucaugcuaauaccgacugcaauggcauuucacuugacuacucguaacggagaaccucauaugauaguuggucggcaagaaaaaggaaaaucgcuacuauuuaaaacugaagacggugucaauaugugcacacuaauggcuauagaccucggggaauuaugcgaagauaccauaacguacaaauguccacuauugcgacaaaaugaaccggaggacauugacugcugguguaacucaacaaguacuuggguaacauauggaacauguaccacaacaggagaacauagaagagagaaaagaagcguagcccuagugccgcacguaggaauggguuuggaaacgagaacagaaacauggaugucuucagaaggagcauggaaacacgugcaaagaauugaaacauggaucuugcgccacccuggauucacaauuauggcugcuauuuuggcauauaccauuggaacuacucauuuucaaagagcacugauauuuauauugcuaacagcaguggcaccgucaaugacuaugcgauguaucgguauuuccaauagagacuuuguggaagggguaucagggggauccuggguggacauaguauuagaacauggaucuugcguaacaaccauggccaaaaauaaaccaacguuggauuucgaauugauuaaaacggaggcaaaacaaccagcaacuuuaagaaaauauugcauagaagcaaaauuaacaaauacuacgacagaaucccgcugcccgacucaaggcgagccuucguuaucagaagaacaagacaaaagauuuauauguaaacacuccaugguugacagagggugggguaauggaugcggguuguuuggaaaaggcggaauugucacaugugcaauguucacaugcaagaagaacauggaggggaaaguaguucagccagaaaauuuagaauauacaauaguaaucacgccgcacucgggagaagaacacgcggugggaaaugacacagguaaacacggaaaagagauaaaaauaacuccacaaaguagcaucacagaagcagaacuuacggguuauggcacaguuacuauggagugcuccccaaggacggggcuagauuuuaacgaaaugguacuguuacagauggaagacaaagccuggcuugugcauagacagugguuuuuggaucuccccuugccguggcuuccaggcgcggacacacaaggaucaaauuggauucaaaaagagacucuaguuaccuuuaaaaauccacaugcuaagaaacaagauguaguaguauuaggaucacaagaaggugcaaugcacacggcauuaacaggagcaacugaaauucaaaugucaaguggcaaucuauuauuuacaggacaucuuaagugccgcuugcgaauggauaaauuacaacuaaaggguauguccuauuccauguguacugggaaauuuaagauaguuaaggaaaucgcggaaacucagcacggcacuaucgucauaagagugcaauaugaaggcgauggaucacccugcaaaauuccuuucgaaauaacagauuuagagaaacgacacguauuaggaagguuaauaacaguuaaccccauuguuacagaaaaagauaguccgguaaacauagaggcagaaccgccuuucggcgauaguuauauaaucauaggaguugaaccuggucaacuuaagcucaauugguuuaagaaaggcucaagcauaggucaaauguuugaaacaacuaugaggggugcuaaacgaauggcaauauuaggcgacacagcgugggauuuuggaucacuuggcgguguauuuacuucgauugggaaagcccuacaccaagucuuuggggcuauauauggagcagcauucucaggagugucuuggacgaugaagauacuaaucggugugauuauuaccuggauaggcaugaauagccgaaguacuucauugaguguaagucuuguucuaguagguguuguuacguuauauuuaggagcaaugguccaagcggacucgggcuguguggugucauggaaaaacaaagaauuaaaaugcgguucuggaauauuuauaacagauaacguacauacauggaccgaacaauauaaauuucaaccagagaguccaucuaaauuggcgucagcgauccagaaggcgcacgaggaaggaauaugugguauucggagcgugacccgguuagaaaaccucauguggaaacagauaacaccugaacuaaaucauauccuaucggaaaaugaagugaaguuaacaauaaugacaggugacauaagggguauaaugcaagcgggaaaaagaaguuuaagaccacaaccuacugagcucaaauacaguuggaaaacaugggguaaagcuaaaauguuaucgacagaaagucacaaccaaacauuucuaauagacgggccagaaacugcagaaugccccaauacaaaccgagcuuggaacucccuugaaguagaagauuauggauuugggguguuuaccacaaacauuuggcuaaaguuaagggagaagcaagauguauuuugcgauaguaaacuaaugagugcugcuauuaaggacaacagagcgguucaugccgacaugggcuauuggauagaaagugcacuaaacgacacguggaagauggaaaaggcaucuuucauagaggugaaaucaugucacuggccaaagucucauacccuguggucaaauggcgucuuagaaagcgaaaugauuauaccaaagaauuucgcuggaccuguaagccaacauaauuaccgaccaggauaccauacucaaacggcaggaccguggcauuuagggaaguuagaaauggacuuugaucuaugugaagggaccaccgucguaguuacugaagauugcggaaaucgcgguccuagucuuagaacgacgacagccagugggaaacucaucacugaaugguguuguaggagcugcacgcuuccaccauuaagauauagaggggaagacggauguugguacggcauggaaauacgacccuugaaggaaaaagaagaaaauuugguuaauagcuuagugacggcuggucacggacaaauugauaauuucucuuugggcguauuggguauggcgcuauuuuuggaagaaaugcuaagaacaagaauuggaacaaaacacgcuauacuucuaguugcagucucuuucguaacauuaauaacagguaacaugucuuuucgagauuuagguagaguaauggucauggugggagccacgaugacggaugauaucgguaugggcguaacuuaucuugcacuguuagcugcauucaagguacgaccaaccuucgcagcuggucuacuuuuaagaaaauuaacgaguaaggaacuaaugauggcaacaauaggcauagcguuauugucgcagucgacaauaccagaaacaauucuugaacucaccgaugcuuuagcacuugggaugauggugcucaaaaucguucguaauauggaaaaauaucaacuagcaguaacaaucauggcaauauccugcguuccaaacgcuguuauauugcaaaacgcauggaaagugucauguacaauuuuggcggcggugagugucagcccuuuacuauuaacaaguagucaacagaaggcugacuggaucccguuagccuuaacaaucaaaggauuaaauccgacggcuauauucuuaacaacauugucaaggacuagcaagaaacgaagcuggccucugaacgaggccauaauggcuguaggaaugguuuccaucuuagcgagcucacugcuuaaaaaugauaucccaaugacuggaccauuagucgcugguggguuacucacaguguguuacguccugacgggaagaucugccgaccuagagcuugagcgagcggccgaugugaaaugggaagaccaggcggaaaucucgggcagcagccccauauuaucaauuacuauaagcgaagacgguucgaugucuaucaaaaaugaagaggaagaacagaccuuaacaauccuuauacguacagguuuguuagugauuagugguguauuuccagugagcaucccgauaaccgcagcugccugguauuuaugggaagugaaaaagcaaagagccgguguuuuaugggacguaccaucaccgccaccaguggaaaaagccgaacuagaggauggggccuaucgaaucaaacaacggggcauauuagguuacagucaaauaggugcuggcguauacaaagaaggcaccuuccacacuauguggcauguuacccgcggugcaguauugaugcauagggguaaacguauagaaccuucuugggccgaugucaagaaagaccuuauaaguuacgguggaggcuggaagcuagaaggagaguggaaggaaggagaggagguccaaguuuuggcauuggaaccagguaaaaaucccagagcuguacagacaaaaccaggaaucuuuaaaacuaauacaggaacgauuggagcagugucacuugauuuuaguccaggcacaagcgggagucccauaguagauaggaaaggaaaagucgugggccuguauggaaaugggguaguaacgagaucgggagcuuauguuagcgcaaucgcacaaacagaaaaaucuauagaagacaacccagaaauagaggaugauauauuuaggaagaaaagauugacgauaauggaccugcaucccggagcaggaaaaacaaaaagauauuuaccugcgauagugagagaggccaucaagcgaggauugagaacccuaauacuugcaccaacaagggucguagcagcugaaauggaagaagcccuacguggucuuccgaucagauaucaaacgacugcaauaaaaacagagcacacaggacgugaaauaguagaucucaugugucaugcaacauucacaaugagauuacuaagucccguacguguuccaaacuauaaccuaauaauaauggaugaggcgcacuuuacugauccagcaagcauugcggcacgcggauauauaucaacgagaguggaaaugggggaagcagcaggaaucuuuaugaccgcuaccccuccagguagcagagauccauucccgcaaaguaacgcgccuaucauggaugaagaacgugaaauuccggaaagaucuuggaacucaggucaugaguggguuacagauuucaaaggaaagaccguuugguuugucccaagcauaaaggcaggaaacgacaucgcugcgugccucaggaaaaaugguaagaaagugauccaacuuagcagaaaaacuuucgauucugaauaugucaaaacucgugcuaaugacugggacuucguagucacgaccgauauaucagaaaugggagccaauuuuaaggcugaaagagucaucgauccuaggcgauguaugaaaccagucauucuaacugauggagaagaaagaguuauacuagcugguccaaugccgguuacccacaguagugcugcccaaaggagaggacggaucggacgcaauccuaaaaacgaaaacgaccaguauauuuauaugggugaaccucuagaaaaugacgaagauugugcccauuggaaggaagcaaaaauguuacuugauaauauuaauaccccugaagggaucauaccaaguauguucgaaccagagcgggagaagguagaugcaauagauggugaauacagauuaagaggugaggcaagaaaaacuuuuguagacuuaaugaggcgaggagacuuacccguaugguuagcuuauaaagucgcagccgaaggcauaaauuaugccgauagaaaauggugcuucgaugggaucaaaaauaaccaaauucuggaagaaaauauggagguagaaauauggaccaaggaaggagagaggaagaaauuaaaaccacgguggcucgacgcaagaauauacagugauccauuagcguugaaagaauuuaaagaauuugcugcagguagaaaaucucugaccuuaaaccuaauaacagagaugggaagguugccgacauuuaugacacaaaaagcaagaaacgccuuagauaaucuagcgguguuacacaccgccgaagccggcggacgagcuuacaaccacgcgcugagugaacuacccgaaacucucgaaacauuacuacugcucacguuacucgcaacagugacaggagggauauuuuuguuccugaugagcgggaaaggcauagguaaaaugacacuaggaaugugcuguauuauuacagccagcauuuuacuaugguaugcgcagauacagccacacuggauagcggcaucaaucauacuggaguucuuucuuauuguauuauugauuccagagccagaaaaacaacgcacgccccaagauaaucaguuaacguauguagugauagcaauauuaacuguuguugcagcuacuauggcaaaugagaugggguuccuagagaaaacgaagaaagaccucggguuaggcucaauuacaacgcaagagagcgaauccaauauauuagacauagaccuacguccagcaucggcguggacacuuuaugccgucgcuacaacuuucguaacaccaaugcuuagacacucaauagagaacucaucagugaauguuucacuaacugcaauagcaaaucaagcaacgguguuaaugggauuagguaagggauggccucuaagcaagauggacauugguguaccauugcuugcaauaggguguuauucccaagugaauccaauaacguuaacagcagcguugcuucuccuagucgcucacuaugccauaauaggccccggccuacaagcaaaagcuacuagagaggcacagaaaagagcggcagcuggaauuaugaaaaacccuacaguggaugguauaaccgucauugaccuagagccuauaccguacgacccaaaauuugaaaaacaacucggccaaguaaugcuauuaauacuaugcguuacacaagugcuaaugaugcggacaacgugggcauugugcgaagcguuaacgcuagcuacagguccgauaucuacucucugggaggggaauccagguagauuuuggaauacaacuauagcaguaucgauggcuaauauuuucagggguucauaccuugccggcgcuggacuuuuauucucuauaaugaaaaauacgacuaauacaaggagagguacagguaacauaggugaaacacuuggagaaaaauggaaaucacgccugaaugcacuuggcaagucggaguuucagaucuauaagaaauccgguauucaggaggucgaucgcacgcuagcaaaagagggaauaaaaagaggagaaacugaucaccacgcaguaucgcgugggucugcaaaacuuagaugguuuguagagagaaauauggucacaccagaaggaaagguaguugaccuuggaugugguaggggcgguuggucguauuauuguggcggucuuaagaauguaagagaaguaaaaggccuuacaaaaggagguccuggacacgaagaacccauuccuaugucaaccuacggauggaaucuaguucgucuucaaagugguguagacguguucuuuacacccccagaaaaaugugacacgcuacucugugauauuggugaaaguucaccaaauccuacgaucgaagcugguagaacacuacguguacuaaauuuaguagaaaauuggcugaauaacaauacacaauuuuguauuaaagugcuaaacccguacaugccaaguguuaucgagaagauggaagcacuucagaggaaauauggaggggcguuaguacgaaauccacuauccaggaacaguacacaugagauguauuggguaucaaaugccacagggaauaucguaucauccguaaacaugauaucacgaauguuaaucaaccguuuuacuaugaagcacaagaaagcgacguaugaaccagauguugaucuggggaguggaacucgaaauauagggauagagucagaaaucccaaaucucgacauuauuggcaaaaggauugaaaagaucaaacaggaacacgaaacaucuuggcacuacgaccaagaucauccauacaaaacuugggcauaucauggaucauacgaaacuaagcagacgggaucagcaucuucaauggucaauggaguugucagacuccuuacgaaacccugggauguugucccgaugguaacucagauggcuaugacggauaccaccccauucggccaacagcgugucuuuaaagaaaaaguugacacgagaacacaggaaccgaaagaggguacgaagaaauugaugaagauuaccgcagaguggcuauggaaggaacuagggaaaaagaaaacgccuagaauguguacucgugaagaauuuacuagaaagguacgcucaaaugcugcacucggugcuaucuuuacagaugaaaauaaauggaagucagcucgcgaggcuguggaggauggaagauuuugggagcucguugaucgugaaagaaaccuacaccuggaaggcaagugugaaaccugcguuuacaauaugauggguaaacgcgagaagaaacugggcgaauuugguaaagcaaaaggaucaagggcaauaugguacauguggcuaggagcacgcuucuuagaguucgaggcuuugggauucuugaaugaggaucauugguuuagcagagguaauucgcuuucaggaguugaaggugaaggauuacacagguuagguuacauauuaagggacgucgggaagaaagaaggcggggcgauguacgcagaugacaccgccggaugggacacuagaauaaccuuggaagaccuuaaaaaugaggaaaugguaacaaaccauaugaaaggagaacauaagaaauuagcggaggccaucuucaaguuaacauaucaaaacaaaguuguuagagugcagcgaccgacuccacgagguacaguaauggauauuauaucacgacgagaccaacgugggucuggacaagucggaacauauggccuaaacacguuuacaaauauggaagcccaacuaauccgacaaauggaaggugaaggaauuuuuaaaaguauccaacaucuaacggcgacagaggagauugcuguucaaaacuggcucgcacgaguuggccgugaaagauuaucgagaauggccauuucaggagacgacugugucgucaaaccuauugaugauagauucgcgucagcacuuaccgcccuuaacgauaugggaaaaauacggaaggauauacaacaaugggaaccaucaagaggauggaaugauuggacucaaguaccguuuugcucccaccauuuucacgaacuuguuaugaaagacggcagagugcucguagugccuugucgaaaucaagaugaacuaauagguagagcccgcauaucacagggcgcaggcuggucauuaaaagaaacugcuugcuuaggcaaaucuuacgcgcaaauguggacacuaauguacuuucacagacgagacuugcgacuugccgccaaugcgauaugcucugcgguaccaagucauuggguuccgacaucaaggacgacuuggucaauucaugcuaaacacgaauggaugacaacagaggauauguuggcaguauggaauagaguuuggauucaagagaauccguggauggaagauaaaacuccaguugaaaguugggaagaaguacccuaucuuggaaaacgagaagaccaauggugcggaucuuuaaucggucuuaccucaagagcaacgugggccaaaaauauucaaacugcuauaaaucaagugaggagucuaauagggaaugaggaauacaccgauuacaugccaagcaugaaacgauuccguagagaggaagaagaagcuggaguguuaugguaa

SEQ ID NO: 22461 - RNA, 9876 nt, Artificial Sequence
  derived and/or modified CDS sequence (opt6) from DENV-2__EU482598__SS-prME
acugcagggguuauuguaauguuaauaccaacagcaauggcauuucaucuaacuacaaggaacggagaaccccauaugauuguggggcgccaggaaaaagggaaaagccuuuuauucaaaacugaagauggaguuaauauguguacacuaauggcaauagaucuaggagaauugugugaagacacaauaaccuauaaaugcccauuauuaagacaaaacgaaccagaagacauagacugcugguguaauagcacaaguacaugggugacuuaugggacgugcacuacaacuggagaacauagacgggagaaacgaaguguggcacuggugccccaugucggaaugggacuugaaacccguacagaaacauggaugaguucagaaggagcauggaaacacguucagcgaaucgaaacuuggauacugaggcauccuggauuuacgauuauggcggcaauauuagcguacacaauuggaaccacucauuuucaacgagcauugauuuucauccuucuuacggcaguggcaccaaguaugacgaugagauguauuggaauuucuaaucgagauuucgucgaaggaguuucuggaggaaguuggguggacaucguacuugaacaugguagcuguguaacaacaauggcgaaaaauaaaccaacccucgacuucgaauuaauaaaaacagaagcgaaacaaccugcaacuuuacgcaaauacugcaucgaagcgaaacucacuaauacaacaacagaaagcagaugcccaacacagggugaaccgagucuaaacgaagaacaagacaagcgauucauuugcaaacacaguaugguugauagaggauggggaaauggaugcggucuauuuggaaaaggcggaauaguaacuugcgcaauguucaccuguaagaaaaauauggaaggcaaaauagugcagcccgagaacuuagaauauacuauaguaaucacaccgcauagcggagaagaacacgcaguaggaaacgauacagggaaacaugguaaagaaauuaaaauaacuccccaaaguucaauuacagaagcggaacuaacuggcuauggcaccgugacaauggaauguucaccgcguacuggauuggacuucaaugaaauggucuuauuacaaauggaagauaaggcaugguuaguacaccgacaaugguuucuagaucuacccuugccauggcugccuggagcugauacacaaggaucaaauuggauucagaaagaaaccuuagucacguucaaaaacccacacgccaagaaacaagacguuguaguacuagggagucaggaaggugcuaugcauacggcucuaacgggugcaacugaaauacaaaugucgagcgguaaucuuuuguucacugggcaucuaaaaugccgacuacgcauggacaaacuacagcuuaaaggaaugucuuauuccaugugcacggggaaauuuaaaauaguaaaagaaauugcugaaacacagcacgggacuauugucauacgcguacaauaugaaggggacggaucccccugcaaaauacccuucgaaauaacggaccuugagaaaaggcauguccugggcagacugauaacagugaaucccauagucacagaaaaagauaguccaguaaauauagaagccgaaccgccuuuuggugauucguauauaauuaucgguguggaaccaggucaauuaaaauugaauugguucaagaaaggcagcagcauaggacagauguuugaaacaaccaugagaggggcuaaaagaauggccauacugggagacacagcaugggacuuugguagcuuaggaggaguauucaccaguauuggaaaagcccugcaucaagucuuuggagcgaucuacggcgcagcauucaguggugugucguggacuaugaaaauccuaauagguguaauuauuacauggauaggcaugaacucgaggucuacaucucugucagugucauuaguacuugucggaguuguaacauuguaucuuggugcuaugguacaagcugauucugguugcguuguuucauggaaaaauaaggaacuaaaaugcgggagcggaauauucauuacagauaacguccauaccuggaccgaacaauauaaauuucaaccggagaguccgagcaaacuugcaucugcaauacagaaagcucacgaggagggaauaugcgggaucagaucagugacgaggcuagaaaaucuuauguggaaacaaauuacaccagaacuaaaucauauccuaagugagaacgaaguaaaauuaacgauaaugacuggggacauaagaggaauaaugcaagcugguaagcgaaguuugcgaccucaaccaacugaauugaaguauuccuggaaaacauggggaaaagcaaagaugcuaucaaccgaaucucacaaccagacguuucuaauagauggcccugaaacugcugaauguccuaacacaaaucgagcauggaacaguuuagagguugaggauuacgguuuugggguguucaccacaaacauauggcugaaauuaagggaaaaacaagacguauuuugugauaguaaauuaaugucggcggccauuaaagauaauagagcgguacacgcagacaugggauauuggauagaaucagcauuaaaugacacguggaaaauggaaaaagccucauucauagaaguuaagucuugucacuggcccaaaagucauacucuauggucaaaugguguguuggagucggaaaugauuauccccaaaaauuuugcagguccuguuucccaacauaacuauaggcccgguuaucacacacagaccgcuggaccauggcacuuagguaaauuagaaauggacuuugaucucugugaaggaacuacaguagugguaacagaagacuguggaaauagagggccuagcuuaagaacuacgacggcuucuggcaaacugauaacagaauggugcugccgaaguuguacacuaccuccauuaagauauagaggugaggaugguuguugguauggaauggaaauacgcccguuaaaagaaaaagaagagaaccuuguaaauuccuuaguuacagcagggcauggacaaaucgacaauuucucccuagguguauugggaauggcauuauuccuagaggaaauguuaagaacuagaauugggacaaagcaugccauacuacuugucgcggucagcuuuguaacgcugauaacggguaauaugucuuuucgagacuugggacgcguaaugguuauggucggagcuacgaugacagaugauaucggaaugggcguuacuuauuuagcacugcuagcugcauuuaaaguuagaccgacuuucgcagccggccuauuguuacgaaaauuaacgagcaaagaauuaaugauggcgacuauugguauugcacuacuaucucaauccacuauucccgaaacuauccuagaauugacugacgcccuggcuuuaggaaugaugguauugaagaucguacggaauauggaaaaauaucaacuugcagucacuauuauggccauauccugcguuccgaaugcgguuauucuacaaaacgcuuggaaaguuuccugcacaauacuugcagcaguaucagugucaccccuccuuuuaacaucaucacagcaaaaagcagacuggaucccacuggcguugacaauaaaaggucucaaucccacagcuauauucuuaacuacauuaagucgaacaaguaaaaagagaucuuggccgcuaaacgaagcuauaauggcugucgggaugguuucaauacucgcuuccucccuauuaaagaacgauauaccuaugacaggaccacugguggcaggggguuuacuuacuguguguuauguucuuaccggaagaucugcugacuuggaacuagagagagcagcugacguaaagugggaagaucaagcagaaauaaguggaucaucaccuauacucaguauaacaaucucagaagacgguaguaugucaaucaaaaaugaggaagaggaacagacccuuacaauauuaauacgcacugggcuucuaguaauuucgggaguuuucccagugucaauaccuaucacagcggcugcuugguauuugugggaaguuaaaaagcaaagggcagggguccugugggauguaccaagcccaccgccgguagaaaaggcggaacuagaagauggagcauaucguauaaaacaaagagggauccuaggguauagccaaauuggagcugggguguauaaagaaggaacguuucauaccauguggcaugucacuaggggagccguacuuaugcaucgcggcaaacgaauagagcccucuugggcugaugugaaaaaggaccuaauaucauacggcgguggauggaagcuagaaggagaauggaaggagggagaagaaguacagguuuuagccuuagaaccgggcaaaaaccccagagcaguccaaaccaaaccaggaauauucaaaacaaauacuggaaccauaggggccgucaguuuagacuuuuccccagguacuagcgggucacccaucguugauagaaaagggaaaguagugggauuauacggaaauggaguaguaacccgcucuggagcauacguuagcgccauugcgcaaacagagaaaaguauugaggauaacccugaaauagaggacgauauuuuccggaagaaaagacugaccauaauggacuuacacccaggggcagggaaaaccaaaagauaucucccagccauaguaagagaagcgauaaaacguggucugcggacacugauacuggccccuacaagaguuguugccgccgagauggaggaggcuuuacgaggcuuacccauaagauaucaaacaacagcaaucaagacagaacauacuggucgugagauaguagaucuaaugugucaugcuacauuuacuaugcgcuugcucagcccuguacgagugccaaacuauaauuuaauuauaauggaugaagcucauuuuacugacccugcaucuaucgcagcacgaggcuacauauccacucgggucgagaugggagaagccgccgguauuuucaugacugcuacaccgccagggucgagagaccccuucccacagucgaaugccccuaucauggacgaagaaagagagauuccugagcgaucuuggaacucaggucaugaauggguaacagauuucaaaggcaaaacuguaugguuuguuccaucaauaaaagcagguaaugauauugcugcuuguuuacguaagaaugggaaaaagguuauccaacucucuagaaagacuuuugauagcgaauauguaaaaacaagagcaaaugauugggauuuuguagucacaacagacauaucagaaaugggagcaaauuuuaaggcagaaagagucauugaucccaggcgauguaugaaacccguaauccucacagauggggaagaacguguaauucuugcugggccaaugccgguaacgcauuccagcgcggcacagagaagaggacgaaucggucgcaaucccaaaaaugagaacgaucaauacauauauaugggagaaccucuagaaaaugaugaggauugcgcucacuggaaagaagcgaaaaugcugcuggacaauauuaauacaccugaaggaauuaucccuucuauguucgaacccgaaagagagaagguagaugcaaucgauggugaauauagacuacgaggagaagcaaggaaaaccuuuguggaccuuaugagaagaggggacuuaccgguuugguuagccuauaagguagcggccgaaggaauuaacuacgccgaccgaaaauggugcuucgaugggaucaaaaacaaucaaauuuuagaagaaaauauggaaguugaaauuuggacgaaagaaggagaaagaaagaaauugaaaccacgauggcuagaugcuaggauuuauagcgauccucuugcucucaaagaguuuaaagaguucgcugcuggaagaaaauccuuaacguuaaauuuaauuacagagaugggcagacuaccaacauucaugacucaaaaagccaggaacgcucuugacaacuuagcaguccuccacacugccgaagcaggagguagagcuuacaaucaugcacuauccgaacuacccgaaacguuagaaaccuuacuauuacuaacauuacuggcuaccguaaccgguggcauauuuuuguuuuuaaugaguggcaaaggaauugguaaaaugacccuaggaaugugcuguauaauuacugcauccauacuccuaugguaugcccagauacaaccucacuggauagcugcaagcauaauauuagaauuuuuccuaauagucuuacuuauaccagaaccagaaaagcagagaacgccucaagauaaucaacucacauaugucguaaucgccauuuugacagucguagccgccacgauggcaaaugagaugggcuuucucgaaaagacgaagaaggaccuuggccuagggaguauuacaacgcaagagucugaaaguaacauuuuagauauagaccuacgaccagccucggcauggacccuuuaugcaguugcaaccacuuuuguuacacccaugcuuagacauucgauagaaaauucuagcgucaaugucucuuuaacagccaucgcaaaccaggcaaccguucuaaugggacuaggaaaaggauggccacuaaguaaaauggauauaggaguaccacuuuuggcaauaggaugcuauucacaagugaauccaauuacauugacggcagccuuauuacuuuuggucgcgcacuacgcaauaauugguccuggauuacaggccaaagcuacaagagaggcucagaaaagggccgccgcaggaauuaugaagaacccuacuguagauggaauaacaguaauagaucuagaaccaauccccuaugauccgaaauucgagaaacaguuaggucaaguaauguuauuaauucuuugcgucacacagguucuaaugaugagaacgacaugggcacugugugaggcuuuaacacuagcaacgggucccauaucuacacucugggaaggaaauccugggcgauucuggaacaccacgauagcaguuaguauggcuaauaucuucagaggaucuuauuuagcaggagcaggguugcuuuucaguauuaugaaaaauacuacuaauacuaggagagggacuggaaauaucggugaaacucucggcgaaaaauggaaaaguaggcugaaugcacuggggaaaucagaguuucaaaucuacaagaaaucuggaauacaggaaguggaccgaacauuagcuaaagaaggcaucaaaagaggagagacggaccaucacgcggucucacggggaucugcuaaauuacgaugguuugucgagaggaacaugguaacuccggagggaaaaguaguugaccucggcuguggacgaggaggcugguccuauuauugcggaggucucaaaaacgugcgugagguaaaaggucuaacuaaaggaggacccggucacgaagaaccgauuccaaugaguaccuaugguuggaaccucguaagauuacaaucaggaguggaugucuucuuuacucccccagaaaaaugugauacauuacuuugugacauaggugagucaagcccaaauccuacaauagaagcggggagaacuuuaagaguacuaaauuuaguggagaauugguuaaauaacaacacucaguucuguauuaagguucuaaacccauauaugccuagcguaauagagaaaauggaagcccuucaaagaaaguauggaggggcacugguucgaaacccucuaucaagaaauucuacacaugagauguauuggguauccaaugcaacagggaauauaguuucaucaguaaacaugauaucuagaaugcugauuaaccgauuuacgaugaaacauaagaaagcaacauaugaaccugacguggaccucgguaguggaacccgaaacauaggaaucgaguccgagaucccuaacuuggauauaaucggcaagcgaauagaaaagauaaaacaagagcacgaaaccucuuggcacuaugaucaggaccauccauacaaaacaugggcauaucaugguucguaugagacaaagcagacugguucagcaucuagcaugguaaauggagucguccgccucuuaacaaaaccuugggauguggucccaauggucacccaaauggcgaugacugauacaaccccauuuggacaacaacguguuuuuaaagaaaaaguagauacacggacccaagaaccaaaagaagguacgaagaaauuaaugaagauaacggcagaauggcuauggaaagaauuaggcaagaagaaaacccccagaauguguacuagagaggaguuuaccaggaaggucagaaguaaugcugcccuuggugccaucuuuacagaugaaaauaaauggaaaucugcuagggaagcuguggaggaugggagguucugggaacucguugauagggagaggaacuuacaucuagaagguaaaugcgaaaccugcguguauaauaugaugggaaaacgagagaagaaauuaggagaguucgguaaagcaaaagguagccgcgcaauaugguauauguggcuuggugcaagauucuuagaguuugaggcuuuaggauuuuuaaaugaagaucauugguucagcaggggaaacagccuuuccggaguagaaggugagggauugcacagacuagguuacaucuugcgugacguugguaagaaagaaggaggagcgauguacgccgacgauacggcuggaugggauacccgcauaacuuuagaggacuuaaagaaugaagaaaugguaaccaaccacaugaaaggcgagcauaagaaauuagcggaagcgauauucaaacuaaccuaucaaaacaaagucgugagaguacaaaggccaaccccuagaggaacagucauggauaucauuagucgacgugaccaaagaggaaguggucaggucggaacauauggacuuaauacuuuuaccaacauggaggcacagcucaucagacaaauggaaggggaagguauauuuaaaagcauccagcauuuaacagcaacugaagaaauagcuguucagaauuggcuagcgagagugggaagggaacgacucuccagaauggcaauaucaggagaugacugcgugguaaaaccuauagacgacagauuugccucggcuuuaaccgcgcugaacgauauggguaaaguacgaaaagauauacaacaaugggaacccaguagaggauggaacgauuggacccaaguuccguuuuguucacaucacuuccacgagcuagugaugaaggauggucgaguauuaguugugccaugcagaaaucaagaugaguuaauaggaagggcgaggaucucacaaggagcuggauggucuuuaaaggaaacagccugucuaggaaaaucauaugcacaaauguggaccuuaauguauuuucaucgcagagauuuacgucuugccgcaaacgcgauauguagugcaguaccuagucauugggucccgacaucgagaacaacguggucaauccacgcaaaacaugaauggaugacgacagaagacaugcuugcaguguggaaucguguauggauucaagagaacccauggauggaggacaaaacuccaguugagucuugggaagagguaccguauuuaggcaaaagagaggaucaguggugugggucacuuauaggccuaacaagucgagcgacaugggccaaaaauauucagacagcuaucaaucaaguuaggagcuugaucggaaacgaagaauacacagauuauaugcccaguaugaaaagauuccgaagagaggaggaagaagcgggaguauugugguaa

SEQ ID NO: 22462 - RNA, 9876 nt, Artificial Sequence
  derived and/or modified CDS sequence (opt6) from DENV-2__EU482603__SS-prME
acagcggguguaauagucaugcuuauucccaccgcaauggcuuuccauuugaccacucguaauggugaaccucauaugauuguuggaagacaggaaaagggaaaaagcuuauuguuuaaaacugaagacggaguaaacaugugcacucuaauggcaaucgauuuaggagaauuaugugaagacacuauaacauauaaauguccuuuauuacgccaaaaugagccagaggauauagauugcuggugcaauucaacuaguacuuggguaacguaugguaccugcaccacaacgggagagcacagaagggaaaaacgaucaguggcuuuaguuccccacguaggcaugggucuggagacaagaacagaaacauggaugagcagugaaggcgcuuggaaacacguccaaagaauagaaacguggauauugagacacccaggguuuaccaucauggcagcaauuuuagcguauacuauagggacaacucauuuucaaagagcacugauauucauccuguuaacagcgguagcgcccuccaugacuaugcgaugcauuggaauaucaaaccgggauuucguugaagguguaucagguggaucauggguggauauaguucuugagcacgggagcugcguaacuaccauggcaaagaauaaaccuacacuagacuucgaauugauuaaaacagaggcaaaacaaccugccacacuucgaaaguacuguauugaagcuaaauuaacaaauacuacaacggaaucuagguguccuacgcaaggggaaccaucuuuaaacgaagaacaagauaaacgguuuauaugcaaacacaguaugguagacagaggaugggguaauggcuguggcuuauuuggaaaaggagguauuguaacaugcgcaauguuuacaugcaagaaaaacauggaagguaaaguaguacaaccagaaaaccuggaguacacaauaguaauaacaccacacucgggagaagaacaugcagugggaaaugacacgggcaaacacgggaaagagauaaagauuacuccacaaagcagcauuaccgaagcugaauuaacaggauauggcacuguaaccauggaaugcucgccucgaacuggacucgauuuuaacgaaauggugcuuuuacaaauggaagacaaggccuggcuaguacacagacaaugguuccuugaucuuccauugccaugguugccuggggccgacacccagggaucaaauuggauucagaaggagacccuaguaacuuucaaaaacccgcaugcuaaaaagcaggauguaguagucuuggggucucaggagggagcuaugcacacggcucuuacgggggcgacggaaauucaaaugucaaguggaaaucuacuuuucacaggccaccugaaauguagauugagaauggacaagcuacaacucaagggcaugucauauagcauguguacuggaaaauuuaaaauuguaaaagagaucgcggaaacacaacauggaacaauaguuauccggguucaguaugagggggacggcucuccuuguaaaauacccuuugaaauuacagaucuagaaaaacgccauguauuggggcgucuuauuacagucaacccaauagucacagaaaaagauucacccguaaacauagaggcagaaccgccauucggagauucauauauaauaaucggaguagagccuggacaauuaaaauugaacugguucaaaaagggauccucaauuggucaaauguuugaaacaacuaugcguggugcaaaaagaauggcaauccugggugauacagcgugggacuuuggaucacugggaggggucuuuacuucaauagggaaagcgcugcaccaaguguucggcgcaaucuauggggcagcauucucaggagucucuuggacgaugaagauccuuauaggaguuaucaucacguggauagguaugaauagucguucgaccagccucagcguuucgcucgugcuagugggugucgucacacuuuacuuaggggccaugguacaagcagauuccgggugcguaguaaguuggaaaaacaaagaauuaaaguguggaucugguauauucauuaccgauaauguccauacauggacugaacaauacaaguuucaacccgaaucuccgucgaaauuggcgucagcuauacaaaaggcccaugcugaaggaauuugugggauuagaagcguuacccgacuagaaaacuuaauguggaagcaaauaacacccgaacuaaaucauauacugucagaaaaugaagucaaguuaacaauuaugacuggagacauaaaagggauaaugcaggcagggaagaggagucuucguccacagccaacggaacucaaauauagcuggaagacauggggaaaggcaaaaauguuaaguacugaaucacauaaucaaacguuucuuauugaugguccagaaacugccgaauguccgaacacuaaccgagcuuggaacagccuagaaguagaagauuaugguuucggugucuuuacuacuaauauuugguuaaaguuaagagaaaaacaggacguuuuuugcgauucuaaacuaaugagugcagcaauaaaggacaaucgcgccguucacgcugauaugggauacuggauagaaucagcauuaaacgacacauggaaaauggaaaaagcgucauuuaucgaaguaaaaucaugccacuggccuaaaagucauaccuuauggagcaauggaguguuggagucggaaaugauuaucccgaaaaauuuugcgggacccguuagucaacauaauuauagaccgggauaucauacucagaccgcuggaccuuggcaccugggaaaguuagaaauggauuuugaucuaugugaggguacaacuguugugguaacugaagauugcggcaauagaggaccaucacuccgaacuacaacugcauccgggaaacuuauaaccgagugguguugcagaucguguacuuuaccgccauuaagauauagaggagaagacgguuguugguaugggauggagauucggccuuuaaaagaaaaagaagaaaacuuagucaauaguuuagugacagcaggucacggucaaaucgauaauuucucacuaggagugcuuggaauggcacuguuuuuagaagaaaugcuaagaacccguauugguacuaaacaugcgauacuuuuaguagcagucaguuuuguaacauuaauuacaggaaacaugucuuuucgagaucuaggacgaguaaugguaaugguuggcgcaacuaugaccgacgacauaggcaugggagucacauauuuagcgcuuuuagcagcguuuaaaguucgaccaacauucgcggccggacuauuacugagaaaguugaccaguaaagaacugaugauggcuacuauuggaauagcacuacugucucagagcacgauuccagaaacaauacuugaauugacagaugcacuagcauugggcaugaugguauuaaagauaguccgggacauggaaaaauaucagcuugcuguaaccauaauggcuauuaguuguguaccgaaugcugucauccuacaaaaugcuuggaaaguaucaugcacuauacuggcugcaguuaguguaagcccuuuauugcuaaccaguucacaacaaaaagcagacuggaucccucuggccuugacgaucaagggacuuaacccaacugccaucuuucucacgacauuaagucgaacaucuaaaaaacgcaguuggccuuuaaacgaagcgauaauggcaguaggaauggugaguauacucgcuucuagcuuacuaaaaaacgauauccccaugaccggcccacuaguagcagguggacuucuaacuguuuguuacguauuaacuggaagaagcgcagauuuagaacuagaaagagccgcugauguaaaaugggaggaucaggcggaaauuucagguagcaguccaauacucuccauaacuauaagcgaagauggaagcaugucaauaaaaaaugaggaggaggaacagacauuaaccauucugauaaggaccggauuacuaguaauaaguggaguauucccaguuaguauaccuauaacugcggcagcaugguauuuaugggaagucaaaaaacaaagggcaggaguuuuaugggaugucccuucuccgccaccaguggaaaaggccgaauuagaagacggagcuuacagaaucaagcagaggggaauucuugguuacucacaaaucggagcaggaguauacaaagagggaacauuccacacgauguggcauguuacucguggugccguacuaaugcaucguggaaaaagaauagagccuucgugggcugauguaaaaaaagacuuaauuucauacggaggugguuggaaacuagagggagaauggaaggaaggggaggaaguucaaguccuggccuuggaacccgggaaaaacccaagggcgguacagacgaagccuggcaucuucaaaaccaauacuggaacgauaggggcuguaucacucgacuuuaguccaggaacaagcggaucucccaucguagauagaaaaggaaaaguaguaggacuuuauggcaauggcguaguaacacguucaggagcguacguaucagcuauagcacaaacagaaaaaaguauagaagauaacccugaaaucgaagaugauaucuuucgaaaaaaacgucugacaauaauggaccuacauccuggagccgguaaaaccaaacgauauuuaccugccauaguacgagaggccauaaaacgcggguuaagaacacuaauacucgcgccaacuagggugguagcggcagaaauggaagaagcauuacgcggcuuaccaauacgguaucaaacuccagcaauuaaaacagagcacacagggcgcgaaaucguggaucugaugugccaugccacuuuuacaaugagguuguuaagcccagucaggguaccaaauuacaauuuaauaauaauggaugaagcucauuucacugacccagcaaguauugcagcgagggguuauauaucaacuagaguggaaaugggugaagcggccggcauauucaugacugccaccccgccagguucccgugauccuuucccacaaagcaaugcucccauaauggaugaagagagagagaucccagaacgaucauggaauagcggacaugaauggguaacagauuuuaaaggaaaaacugugugguucguuccauccauaaaggccgguaacgauaucgcggcgugcuuaagaaaaaacggaaaaaaagucauacaacuaagucgaaaaacauucgacagugaguacguuaaaaccagagcuaaugacugggauuucguugugacuacagacauaucagaaaugggagcuaacuuuaaggcugagcgugugauagacccacgacgaugcaugaaaccaguaauccuaacugauggugaagaacggguaauuuuagcaggacccaugccaguaacacacucauccgcagcucagaggcgggguagaauuggaagaaaccccaaaaaugaaaaugaccaguauauauauaugggggaacccuuggaaaacgacgaagacugcgcgcacuggaaagaagcuaaaaugcuguuagacaauauuaauacaccggagggaaucauacccaguauguuugaaccggaaagggaaaaaguugaugcuauugacggugaguaucgauuaaggggugaagcuaggaaaaccuuuguagauuugaugagaagaggagacuuaccggugugguuagcauauaagguggccgcagagggaaucaacuaugcagaccguaaaugguguuuugacggaauuaaaaauaaucaaauacuggaagaaaauauggaaguggaaauuuggaccaaagaaggcgaaagaaagaaauuaaagccgcgauggcuagaugcuaggauuuauagcgauccucuagcuuuaaaagaguuuaaagaauuugcagccggaagaaaaagucuaacucuaaaccuaauaacggagaugggaagacugccuaccuuuaugacucaaaaagcccgaaaugcucuugauaaucuugcaguuuuacacacugcggaagcagguggucgugcauauaaucaugcguuaucagaauuaccggaaacacuagagacgcuguuauuauuaacuuuguuagcaacagucacggggggaauuuucuuauuccuaaugagcggcaaggggauaggaaaaaugacgcugggaauguguuguaucaucacagcaagcauuuuacuaugguacgcccaaauacaaccacauuggauagcggcaagcaucauauuggaauuuuuuuuaaucguauuguuaauaccagaacccgaaaaacagaggacgccucaagauaaucaacucacguauguaguaaucgcaaucuugaccgugguagcagcgacaauggcgaaugaaaugggguuucuugaaaagacaaaaaaagacuuggguuuaggaaguaucaccacacaagaaucagagaguaacauuuuggacaucgaccuccgacccgcaucagcuuggacucuuuacgcaguggccacgacauucguuacgccgaugcucaggcauucaaucgagaauucuucaguaaaugucucccuuacagccaucgcuaaucaagcuacagucuugaugggccuagggaaaggguggccauuaaguaaaauggacauaggaguacccuuacuggcuauugguugcuauucacaagucaauccaauaacuuuaaccgcagcguugcuucuuuuaguagcacacuaugcgauuauaggcccaggcuuacaagcuaaagcaacgagggaagcucaaaagagggcagcugcaggcaucaugaaaaacccaacaguagaugguauuacagugauagaccuugaaccgauuccauacgacccgaaauuugaaaaacaguuaggccaaguuaugcuacuuauauuaugugucacucaaguauuaaugaugcgcacaacgugggcauuaugugaggcccucacucuggcaaccggaccgauaucgacacuaugggaaggaaacccaggacgcuuuuggaauacuacgauagccguaagcauggccaauaucuuccggggaucuuaucuugcgggggcagguuuacucuucagcaucaugaagaauacaacgagcacacgccgcggaacugguaacauaggagaaaccuugggagaaaaguggaaaucuagguuaaaugcgcucggaaaaagcgaauuucaaauauauaagaaaucuggaauacaagagguggaucguacgcuagcuaaagaaggaauaaaaagaggagagacagaucaccaugcaguaucacgcggaucagcaaaacuaagaugguucguugaaagaaauauggucaccccugaggguaaagucguagaccucgguuguggaaggggcggcuggagcuauuacugcggugguuugaagaacguucgggaaguuaaagguuugacaaaaggcgguccaggacacgaagaaccuauacccauguccacauauggauggaacuuaguaagacuacaaucugguguagacguauuuuuuacuccaccagaaaaaugugacacauuacuaugcgauauaggcgagagcucuccgaaucccaccauugaagcuggacgaacauuacguguacuuaacuugguagaaaauuggcugaauaauaauacgcaauuuuguauuaaaguacuuaacccuuauaugccuagcguuauagaaaaaauggaagcacuacaaagaaaauacggcggggcacugguuagaaacccccucucgaggaauagcacccacgagauguauugggucucuaaugcaacuggaaauaucgucaguucgguaaacaugauaagucgaaugcucauaaauagguucacaaugaaacauaaaaaaacuacauaugaaccagacgucgaccuaggaagcggcacgagaaacauagggauugaaagugaaaucccaaaucuugacauuauagguaaaaggauagaaaaaauuaaacaagaacaugaaacuucauggcauuacgaccaggaucaccccuacaaaacgugggccuaucaugggucauacgaaacaaaacaaacagggucagcgaguucuaugguaaacgguguaguucgcuuguuaacgaagccaugggacguaguuccaaugguaacccagauggcaaugacggauaccacaccauucggccaacaaagaguauucaaagagaagguugacaccaggacacaagagccgaaagaggguacgaaaaaacuaaugaagauaacagcugaguggcuauggaaggagcuaggcaaaaaaaaaacgccaagaauguguacacgggaggaauuuacuaggaaaguaaggagcaacgccgcacuaggugccauauuuacagaugaaaauaaauggaagucagcaagggaggccguagaagauggaagauucugggagcuaguagauagagaaaggaaccuacacuuagaagguaaaugcgagaccugcguguauaauaugaugggaaaacgcgaaaagaaacugggagaauucggcaaagcuaaaggcucgcgagccauuugguacauguggcuaggagcgagauucuuggaauuugaggcucucggcuuuuuaaacgaagaccauugguuuagucguggaaauucucucagugguguggaaggagagggccuacauagauugggauauauucuuagggauguuucaaaaaaggaaggaggagcuauguacgcagaugauaccgccggaugggauacgaggauaacuuuagaagaucucaaaaacgaagagaugguuacuaaccauaugaaaggagaacacaaaaaauuggcugaggccauauuuaagcuaacuuaucaaaacaaaguaguacguguucaaaggccgacuccacguggcacaguaauggauaucauaucgaggagagaccagagagguucggggcaaguuggaacguacggucucaacacauuuacaaauauggaagcucaacucauacgacagauggagggggagggaauauuuaaaucaauacagcaccuaaccgcaacggaagaaauaguagugcaaaauuggcuugcacgagugggcagagaaagacuuucccgcauggcgauauccggugaugauuguguuguuaaaccuaucgaugaucguuucgcgucugcucugacagcucugaaugauauggguaagguaagaaaggauauccagcaaugggaaccaagucgaggauggaacgauuggacacaaguaccauuuugcucgcaucauuuucaugagcucguaaugaaggauggccguguccuaguugugccgugccgaaaucaggaugaacugauuggacgugcaagaaucucccaaggugcgggguggucccuaaaagaaacugccugccuugguaaaaguuaugcacaaauguggacauugauguacuuucauaggagagaucuucgauuagcggcaaaugcaauuuguagcgcgguaccgagucacuggguaccgaccucacguaccacauggucuauacacgcuaaacacgaauggaugacaacugaagacaugcucgcaguuuggaauagagucuggauccaagaaaacccauggauggaggauaaaacucccguugaaucgugggaggaaguaccuuauuugggaaaaagagaagaccaauggugcggaucacuuaucggacucacaucacgggcaaccugggcuaaaaacauacaaacugcuauaaaucagguccgaucuuuaauagguaaugaagaauacacagauuauaugcccaguaugaagagauuucgaagagaggaagaggaggccggaguucugugguag

SEQ ID NO: 22463 - RNA, 9876 nt, Artificial Sequence
  derived and/or modified CDS sequence (opt6) from DENV-2__EU482599__SS-prME
acugccggaguuauaguaauguuaauacccacagccauggcuuuccaccuuacaacaaggaauggugaaccgcacaugauaguggggcgccaagaaaaaggaaaaucauuacuuuucaaaacugaagaugguguaaauauguguacuuuaauggccauagacuuaggagaacucugcgaagacacgauaacuuacaaauguccauuauuaaggcaaaacgaaccggaagauauagacugcugguguaauaguacauccacuugggucacuuauggaacgugcacaacgacgggugaacauagaagagagaaaaggucaguggcgcucguaccacaugucgggaugggacuagaaacuagaacugagacguggaugucaucagaaggagcauggaaacauguacagcgaauagaaacguggauauuacgacauccuggcuucacaauaauggcugccauacucgcauauacaaucggcaccacucauuuucaaagggcccuaauauuuauccuuuuaacagcuguagcgccaucuaugacgaugcggugcauaggaauaucuaauagagacuucgucgaaggaguaucaggcgguaguuggguagacauagugcuagaacacgggucauguguuacgacuauggcgaaaaacaaaccaacauuagauuucgaauuaauaaaaacagaggccaaacaaccagcaacauugcgaaaauauuguauugaagcaaaacuaacaaauacgaccacagaaaguagauguccuacucaaggcgaaccgucucuaaaugaagaacaagacaaacgcuuuauauguaaacacaguaugguagauagaggcugggguaacgguuguggauuauuuggcaaaggagguaucguuacaugugcaauguuuacaugcaagaaaaauauggaaggaaaaguaguacaaccugaaaaucuagaauauacaaucguaauuacaccacauucaggagaagaacaugcaguugggaacgauaccggaaaacaugguaaagaaauuaaaauaacuccacaaucaucaauaacggaagcagagcuaacugguuacgguacagucaccauggaauguucaccgcgaacaggguuagauuuuaaugaaaugguacuacuucagauggaggauaaagcaugguuaguccacaggcaaugguuccuagaucuaccguugcccuggcuaccgggggcugacacacaaggcucuaacuggauacaaaaagaaacgcuggucacauucaaaaacccacaugccaagaaacaagauguaguuguacuaggaucucaagaaggagcuaugcacacggcuuuaacaggagccacagagauucaaaugucuucaggaaaucuccuuuucaccggacaucucaaaugucgccugagaauggacaaacuucaacuaaaaggaaugucuuacucaaugugcacggggaaauuuaaaauuguaaaagagauagcagaaacccaacauggcacuauuguaauaagaguucaguacgaaggugaugguucuccauguaaaauaccauuugaaauaacagacuuagagaaaaggcauguauuaggacgauuaauaacuguaaacccaauaguaaccgaaaaagauucuccggucaauauagaggcugaaccaccauuuggcgauuccuauaucauuauagggguggagccuggccaauuaaaacugaacugguucaagaaaggaaguucuauaggccagauguuugagacaacaaugagaggcgcaaaaagaauggcaauacucggcgacacagccugggauuuuggcucacucggaggcguuuuuaccucuauaggaaaggcuuuacaucaaguauuuggcgcaauuuacggggcagcguuuucagguguaagcuggacgaugaaaauuuuaauuggagucauaauaacuuggauaggaaugaacagccgcucgacaucacuuucaguaucauuaguacugguagguguagucacccuauaccuaggagcaaugguucaagcagauucgggguguguuguaucauggaaaaauaaagaauuaaaaugcgguucaggaauuuuuauaacagacaaugugcacacguggacagaacaauauaaauuucaaccagaaagcccaucuaaauuggcgagugcaauacaaaaagcccaugaagaagguauaugcgguaucagaaguguuacaagacuagaaaaucuaauguggaagcaaauaacaccggagcucaaucauauacuuucagaaaaugaggugaaacuuacaauuaugacaggcgauauuagggggauaaugcaagcaggaaagagaucacuccguccucaaccuacagaacuaaaguacucauggaaaacguggggaaaagcgaagauguuaaguacggagagucauaaccaaacuuuucuaauagacggaccagaaacagcugaauguccuaacacaaaucgagcauggaauagucuugaaguggaagauuacgguuucggagucuuuaccacaaacauaugguuaaagcucagggaaaaacaagauguauuuugugauaguaaacuaaugucagcagcaaucaaggacaauagagcagugcaugcggacaugggauauuggauugaaucagcacucaaugacacauggaagauggaaaaagccucauuuauagaagucaaaucaugccauuggccaaagucccauacacuuuggagcaauggagugcuugaaucagagaugaucauucccaaaaacuuugccgggcccguuucgcaacacaauuacaggccaggauaccauacacagacugcaggaccguggcauuuagggaagcucgaaauggauuucgauuuaugugaagguacuacagucguaguaaccgaagauugcgguaauagaggaccuucuuuaagaacuacaacggcuucugguaaguuaauuacugaauggugcugucguagcuguacuuuacccccauuacgauaucguggggaagauggcugcugguacgguauggaaauuaggccccuaaaagaaaaggaagaaaauuuagucaauucauuaguaacugcuggccauggucaaaucgacaacuuuagucuaggggugcuggggauggcacucuuucucgaggaaaugcuaagaacaagaaucgggacaaagcaugcgauuuuguuaguugcaguuucauuugugacccugauaacagguaacaugucauuuagagaucuaggacgcguaaugguaaugguaggugcuacaaugacagacgacaucggaauggguguuacauauuuagcauuacucgcggccuuuaaaguccgucccacauucgcagcgggucuacuucugcggaaacuuacaucaaaagaauugaugauggcaaccauugguauugcucuguuaagucagaguaccauacccgaaacgauauuagaacuaacugacgcguuggcauuaggaaugaugguucugaaaauuguacgaaacauggaaaaauaucaacuagcagugacuauaauggugauaucaugugugcccaacgcagucaucuuacagaaugcguggaaagugaguuguaccauauuagcagcagugucaguaaguccacuacuauuaacgucuucucaacaaaaagcugauuggauacccuuggcauuaacgauaaaaggucugaauccgacggcgauauuuuugacuacacugaguagaacgagcaagaaacggucguggccgcucaaugaggcgauuauggccguggguauggugaguauccuugccucaagucuucuaaagaacgacauucccaugacaggcccacucguugcaggaggccuuuuaacuguaugcuauguucuaacgggacggucugcagacuuagaacuagagagggcagcagauguuaaaugggaagaccaggcggagauaucaggaucuucaccaauauuguccauaacgauaagugaggaugguucaaugucaaucaagaaugaggaagaggaacagacuuuaacaauacuaauacgaacaggucuccuaguuaucagcggaguauuuccaguuagcaucccgauaaccgcugcggcuugguacuuaugggaggucaagaaacaaagagcgggcgugcuaugggacguuccuucaccacccccgguagaaaaggcagagcuugaggauggugccuauaggauaaagcaaagagggauuuuaggauauucccaaauaggagcaggcguuuauaaggaaggcacauuccacacgauguggcauguuacacggggagcgguucuaaugcaucgaggaaaaagaauagaaccaaguugggcagaugucaagaaagaucugauaucuuacggaggaggguggaaauuggaaggggaauggaaagaaggagaggaaguacaaguacuagcauuagagccagguaaaaacccgcgagcaguacaaacuaagccugggauuuucaagacgaauacuggaacgaucggggcgguaagucuagauuucucaccgggaacaagcgggucgccaauaguggacagaaaaggcaaaguaguggggcuauaugguaaugggguagugacacgcucuggugcuuacguuucagcaauugcacagacagaaaaaucgaucgaagauaauccagaaaucgaagaugauauuuuuagaaagaaacguuuaacaauuauggaccuacauccaggugccggaaaaacaaaaagauacuuaccagcaaucgugagggaagcuauaaagcgcggacucagaacguuaauuuuggcaccuacacgaguagucgccgcagaaauggaagaagcacugcgaggacuucccauaagauaucagacaacagccauaaaaacggaacauacaggaagagaaauaguugaucuuaugugccaugcaacuuuuacuaugagguuacugucacccguacgcguaccgaacuauaacuuaauaauaauggacgaggcacacuuuaccgacccggccucaauagcagcuagaggauauaucaguacucgaguagagaugggagaagccgccggcauauucaugacugcaaccccgccuggaagucgcgaccccuuuccacaaaguaaugcaccuaucauggaugaggaacgagaaauaccagaacgaucauggaauaguggccaugaauggguuaccgacuucaaaggcaagacagugugguucgugccaucuauuaaagcaggaaaugacauagccgccugccuaagaaagaauggcaagaaaguaauucaauuauccagaaagaccuucgauucggaguacgucaaaacaagagccaaugauugggauuuugucgugacaacagacauuucugaaaugggcgcgaacuucaaagccgagcgcguuauagauccucgaagguguaugaaaccagugauuuuaacagauggagaagaaagaguaauacuagccgguccuaugccaguaacacacucaagcgcugcacagcggcguggaagaauuggaagaaauccuaaaaacgaaaacgaccaauauauauauaugggcgaaccacuggaaaaugacgaagauugugcacauuggaaagaggcaaaaaugcucuuagacaacauaaauaccccugaaggaauuaucccuagcauguuugaaccagaaagagagaaaguggacgcaauagauggggaauaccgauuaaggggugaagcgaggaagacguucgucgauuugaugaggagaggggaucuacccguuugguuagcauauaaaguagccgcugaagguauaaacuacgcagaucgaaaaugguguuucgaugggaucaaaaacaaccaaauccuagaggaaaauauggaagucgaaauauggacuaaagaaggggagcgaaagaaauugaaaccaagguggcucgaugcucgaauauauucugacccccucgcauuaaaggaguuuaaagaguucgcagcuggaagaaaaucgcuaacucuaaauuuaauuaccgagaugggccgucuuccaacauuuaugacgcagaaagcaagaaaugcucuagauaauuuagccguauuacacacggcggaagcuggugggagagcauauaaccacgcuuuaagugaauuaccggaaacacuggagaccuuacugcuguuaacauuauuagcuacaguuacgggagggauuuucuuguuucuaaugagcggcaaaggaauaggaaagaugacccugggcaugugcuguauaaucacugccucgauucuucuaugguacgcacaaauacagccacauuggauagcagccaguauaauucuggaauuuuuccugaucguuuuauuaauaccggaaccggagaaacaaagaacuccacaagacaaccaauugaccuaugucgugauugcaaucuuaacggucguugccgcgacaauggcaaaugaaaugggauuucucgagaaaacaaagaaggaucuuggguuaggaagcauaacaacucaagaaucagaauccaauauauuagacauagaccucagaccagccucggccuggacacuguaugcuguugcaaccaccuuugugacccccaugcuucggcacucaauagaaaauuccucggucaacguaagccuuaccgcaauagcaaaccaagcaacaguauuaauggguuuaggaaaaggauggccucucucaaaaauggacauugguguaccgcuauuagcgaucggaugcuauucgcagguaaauccgauaacacuaacagcggcacuacuucuauugguggcgcacuaugcuauuauaggccccgguuuacaagccaaagcuacaagagaagcucaaaagcgagcugcggcaggaauaaugaaaaauccgacaguagauggaauuacagucauagaccuagaaccaauaccauaugauccaaaauucgaaaagcaacuaggacagguuauguuacuuauacugugcguaacccaagucuuaaugaugcgaacuacuugggcguuaugugaagcucucacacuugccacaggaccaauuaguacgcuaugggaaggcaaucccggucgguuuuggaauacuacaauagcaguauccauggcgaacauauucagaggaagcuauuuagcuggagcuggcuuauuauucucuaucaugaaaaacacaacaaacacccgucgaggaacagguaacauuggagaaacgcucggagaaaaauggaagucccggcuuaaugcucuaggaaaaucagaauuucagauauacaagaaaagcgggauucaagaggucgacaggacauuagcuaaagaaggaauaaaaagaggagagacagaucaucacgcaguaucaaggggaucugcuaaguuaagaugguuuguggaaaggaacaugguaacgccugaaggaaagguaguagaccuuggauguggacgugguggcuggaguuacuacugugguggccuaaagaacguacgggagguaaaaggccucacaaaaggagguccaggucacgaggaaccuauaccaauguccacguauggguggaaucuuguuagauugcaaucaggagucgacguauucuuuacaccaccagagaagugugauacacuacuuugugauauaggcgaaucuucuccuaaucccaccauugaagcagggcgaacgcuacguguacuaaacuugguagagaauuggcugaauaauaauacucaauuuuguauuaaaguacuuaacccuuacaugccauccgucauagagaaaauggaagcacuccaaaggaaguacggaggggcauuaguccgcaacccauuaucuagaaacagcacacacgaaauguacugggucucaaaugcaacaggcaacaucguaaguucuguuaauaugauaagcagaauguugauaaaccgauuuacgaugaaacauaaaaaggcaacauaugaacccgauguagaucuuggaagugggacuaggaauaucgggauugaaagugaaauuccuaacuuggauauaauagguaagagaauugagaaaauuaaacaagagcaugagacgucauggcauuaugaccaggaucauccauacaagacaugggcauaucauggauccuacgaaacuaagcaaacggguucagcaagcagcaugguaaacggaguaguacgcuuacuaacaaaaccaugggaugugguuccuaugguaacccaaauggcuaugacugacacuaccccauucggccagcaacgcguauucaaagaaaaagucgauaccagaacacaagaaccaaaagaagguaccaagaaauuaaugaaaaucacugcagaaugguuauggaaagaauuaggcaagaagaaaacaccgaggauguguacccgcgaagaguucaccaggaaaguccgaucaaacgccgcacucggagcuauauuuacugaugagaacaaguggaaaucugcuagagaagcgguugaagauggacgcuuuugggaacuggucgaucgggagcgcaaccuacauuuagaaggcaaaugugagacauguguauauaauaugauggguaaaagggagaagaaauuaggagaauuugguaaagcaaaaggaucucgugccaucugguacauguggcuuggcgcuagguuccuggaguucgaggcacucggauuucuaaaugaagaccacugguuuuccagagggaauaguuuaagcggagucgaaggcgaggguuuacaucgcuuaggauacauauuacgugacgugggcaagaaagagggaggagcuauguacgcagacgauacagcaggaugggauaccagaauaacacucgaagaucuuaaaaaugaggaaaugguuacaaaucacaugaaaggagaacacaagaaacuagcggaagcuauauuuaaacuaacauaucaaaauaaagugguaagagugcaaaggccaacaccaagagguacgguuauggacaucauuucccgccgugaucaacgagguucaggucaagucggaacauauggccuaaacacauuuacaaacauggaggcccaguuaauccgacagauggaaggagaaggaauuuucaaaucaauccaacauuuaaccgcuacagaagaaauugccguacaaaauuggcuagcacgagugggacgugagcgccuaucccguauggcuaucaguggggacgauugugucguuaagccaauagaugaucgauucgcaucggcacuaacagcccuaaacgauaugggaaaaguuagaaaagauauucaacagugggaaccuucuagagguuggaaugacuggacacaaguaccauuuuguucccaucauuuucacgaauuaguuaugaaagacgggagaguccucguaguaccaugcaggaaccaagaugaacugauugguagagcacggauaucucaaggcgcaggauggucccuuaaggaaacagcauguuuaggcaaaagcuacgcucagauguggacuuuaauguacuuucacagacgcgaucuacgacuagcggccaaugcuauuuguagcgcugugccaagucacuggguaccgaccagccgcaccacaugguccauacaugcuaaacacgaauggaugaccacagaggacauguuagcugucuggaaucgaguauggauccaagaaaacccguggauggaagauaaaacaccuguagaauccugggaggaaguuccauaccuaggcaaacgcgaagaccaaugguguggaucgcuaauaggcuuaacaucacgagcgacaugggccaaaaacauucaaacggccauaaaucaaguucggagucuaaucgggaacgaagaauacacugauuacaugcccagcaugaaacguuuccggagggaagaagaagaagcaggaguacuaugguaa

SEQ ID NO: 22464 - RNA, 9876 nt, Artificial Sequence
  derived and/or modified CDS sequence (opt6) from DENV-2__FJ898436__SS-prME
acugcgggaguuauugugauguuaauaccuaccgcuauggcauuucacuuaacuacacgaaauggugaaccucauaugauaguaggacgacaagaaaaagggaaaucccuucuauuuaaaaccgaagaugguguaaauaugugcacucugauggcuauugaccuuggcgaacuuugugaagauacgauaaccuauaaauguccguuauuaagacaaaaugaaccagaagacauagacuguugguguaauucgaccucaacauggguaaccuacgguacaugcacaaccacuggggaacauagaagagagaaaagaucaguagcucugguaccgcacguagggaugggacucgaaacccguacagaaacauggaugucuucagaaggagcauggaaacacguccaacgaauagaaacuuggauccuaagacacccuggauuuaccaucauggcagcaauucuugcauauacaauaggaacaacgcacuuucaacgagcucugauauucauacugcuuaccgcuguggcaccuucaaugacaaugaggugcauuggaauaaguaaucgagauuuuguagaaggcguaagcggaggaaguuggguugauauuguucuagaacacggaucuugcguaacaacgauggccaaaaauaaaccaacccucgauuucgaacuaauuaaaacugaagcaaaacaaccagcuacccuaagaaaauacuguauugaagcaaaacucacuaauacuacuacggaauccagauguccaacccagggugagccuucauuaaaugaagaacaagauaaaagauuuaucugcaaacauucaaugguagauagaggauggggaaauggcugugguuuguuugguaaaggugguaucguuacgugcgcaauguucacuugcaagaaaaauauggaagguaaaguaguccagccugagaaucuagaauauacaauaguaauuaccccgcauagcggugaggaacaugcagucggcaacgacacuggaaaacauggaaaggaaauuaaaaucacaccacaaaguaguaucacagaagcugaauuaaccggauauggaacagugaccauggaauguucaccaagaacuggacuagacuucaacgaaaugguacuucuacaaauggaagacaaagcaugguuaguccaucgacagugguuccucgacuuaccuuugccuuggcuuccaggcgcugauacacaaggcucaaacuggauucaaaaggagacauuagugacauuuaagaacccacacgccaagaaacaagauguagucguacucgggucacaagaaggugcuaugcacacggccuuaacaggagcgaccgaaauucagauguccucaggaaacuuacuuuucaccggucaccucaaauguagauuacgaauggauaagcugcagcuaaaagguaugucuuacucgaugugcacuggcaaauuuaaaauaguuaaagagauugcugaaacucagcacggcacuauugucauaaggguccaguacgaaggagauggaagcccaugcaagauaccuuucgaaauaacagaccuagagaaaaggcacguccuaggaagauuaaucacaguaaauccaauaguuacugagaaagacucgccugucaacauagaagcggaacccccauucggagauucauacauuauuauugggguagaaccuggacaguuaaagcuaaauugguucaagaagggaucgaguauagggcaaauguuugaaacuaccaugcgcggagccaagagaauggccauauuaggggacacagcaugggacuucggcagcuuagguggaguuuucaccaguauaggaaaagcacuucaccaagucuuuggugcaauauacggggcagcuuucucgggcguuagcuggacaaugaaaauccuaaucggcguaauuauaacauggauuggaaugaauaguagaaguacaagucuaaguguauccuuaguuuuagugggcguuguuacauuauaccuaggagccaugguacaagcugauucuggcuguguaguaaguuggaagaauaaggaguugaagugugguagcgguaucuuuauuacagauaacguucauacauggacagaacaauacaaauuccagccugaaaguccaucaaaacucgcuagcgccauccaaaaagcccacgaagaggguauuuguggcaucagaucgguaacgcgauuagagaaucugauguggaaacaaauuacucccgaauuaaaucacauucuaucugagaaugaaguaaaacuuacaaucaugacaggagauauucgaggaaucaugcaagcggguaaaagaucacuucgaccucaaccuacagaauugaaguauucuuggaaaacauggggaaaagcuaaaaugcuuucaacagaaucacauaaucagaccuuuuuaauagauggaccugaaacagcugaaugccccaacacuaacagagcauggaacucauuagaaguagaagauuauggguuuggggucuucacgacuaauauuuggcugaaacuacgcgaaaaacaagacguauucugugauucaaaacuaauguccgcagcuaucaaagauaauagagcggugcaugcugauaugggauauuggauugaaucagcauuaaaugauacauggaagauggaaaaggcuucauucauugaaguaaagaguugccauuggccgaaaucacacacgcuauggucuaacggcguacuagaaagugagaugauuauccccaaaaauuucgcuggcccuguuucccaacauaauuacagaccaggcuaucacacccaaacagcagguccguggcaucucggaaaacucgaaauggacuuugaucucugcgaagguacuacagucguaguaacggaagauugcggaaacagaggacccucacuaagaacaacaacagccaguggaaaacuaauaacggaaugguguugcaggucaugcacacuuccaccucugcguuaccgcggugaagauggaugcugguacggaauggaaauucgaccauuaaaagagaaagaagaaaauuugguaaacagcuuaguaacagcaggccauggucaaauugauaacuuuagcuuaggcguccugggaauggccuuauuccuagaagaaaugcuacgcaccagaaucggaacuaagcaugccauccugcucgucgcaguaaguuuuguaacccugauuacggggaacaugaguuuccgugauuugggcagaguaaugguaauggugggagcuacgaugacugaugauauuggaauggggguuacuuaccuggccuuacuagcagcuuucaaaguuagaccaacauuugcagcaggucuauuauugaggaaauuaacaaguaaggagcuaaugauggcuacaauaggaauagcccuucugucccaauccacaauacccgaaacuauacuugaacucacagaugcucuugcauuaggaaugaugguuuugaagauuguaagaaauauggaaaaauaucagcucgcuguaaccauuauggccaucuccugcguaccaaacgcaguaaucuuacaaaaugcauggaaagucucauguaccauucuagcggcaguuucaguaagcccauugcuacuuacaagcagccaacaaaaagcagacuggauuccuuuagcgcugacgauaaagggacuuaauccaacagcuauuuucuuaacuacucuaagcagaaccagcaagaaaagaucuuggccuuuaaacgaggcuauaauggcgguaggaaugguuucuauacuagcuagcucacuccugaagaacgauauaccaaugaccgguccgcuagucgcgggaggacuacucacagucuguuacguacucacaggccguucggcagaucuagaacuagaaagagcagcugaugugaaaugggaggaccaagcugaaauauccggcagcucaccgauacugaguauuacaauaucugaagauggcuccaugucaaucaaaaaugaagaagaggaacagacgcuuacgauccuuauaagaacugguuugcuuguuauaagugguguguucccuguuucaauaccuauuacagcagccgcuugguacuuaugggagguuaagaaacaacgggcuggaguauuaugggauguuccaagucccccuccuguugaaaaagcagaacuagaagauggugcguauagaaucaaacaaaggggcauucuaggauauagucaaauuggugcaggagucuacaaagaggguaccuuccauacaauguggcaugugacuagaggcgcaguucuuaugcacagaggaaaaagaauagaaccgucgugggcugacgucaagaaagauuuaauauccuaugggggaggauggaaacuugaaggagaguggaaagaaggcgaagagguacagguccuagcacuagagccggguaagaacccgagagcggugcagacuaaaccuggcauuuuuaaaacaaauacgggcacaauaggugcagucagcuuggacuucucaccgggaacaucggguucacccauuguagaucguaaaggaaaaguagucggucuuuaugguaaugggguaguaacccgaucgggcgcauaugucagugcgaucgcucaaacugagaaaagcaucgaagauaauccagaaaucgaagaugacauauuuaggaagaaacggcuaacuauuauggaccugcacccaggggcgggaaagacuaaaagauacuugcccgcuauagugagagaagcuauaaagagaggacuacgcacccuaaucuuagcacccacuaggguuguugcagcagaaauggaagaggcuuuaagaggguuaccgauaagauaucaaacaacagcgauaaaaacggaacacacagguagagagauuguugauuuaaugugccaugccacguuuacaaugaggcuccuaucgccuguaagagugccaaacuauaauuugauuauaauggaugaagcccacuuuacagacccggcauccauugccgcaagaggauacaucuccacacggguugaaaugggagaagcagcugguauauuuaugacagcgacaccgccagggagccgggacccuuucccucagucaaaugcuccgauuauggaugaagaaagagaaauacccgaaaggaguuggaacucgggccacgaauggguaaccgauuuuaagggaaagacgguuugguuuguuccaagcauaaaggcuggcaacgacauagccgcaugccuaaggaaaaacgggaaaaaggucauccaacuuucaagaaaaacguuugacucagaguaugucaaaacaagggccaaugauugggauuucgugguaacgaccgauaucagcgagaugggagcgaacuuuaaagcagagcgaguaaucgaucccagaaggugcaugaaaccuguuauauuaacagauggcgaggaaaggguaauuuuagcaggucccaugccagucacacauuccuccgcggcacagagacggggaagaauuggaagaaaucccaaaaacgagaacgaucaauacauuuacaugggugaaccacuagaaaaugaugaagacugugcccacuggaaggaagcaaaaaugcuucucgauaacauaaauacaccagaaggaauaauaccaagcauguucgagccugaacgcgaaaaggucgacgcgauagacggugaauaccgacuuagaggggaagcuagaaaaacauuuguagaucuuaugcgcaggggagauuugccagugugguuggcauacaaaguugcagcugaagggauuaauuaugcggauaggaaauggugcuuugacgguauaaagaacaaucaaauacucgaagaaaacauggaaguagaaauauggacaaaagaaggugaacgaaagaagcuaaagccaagauggcuugacgcacggauauacucggauccacuugcacuaaaagaguucaaagaguuugcagccggacgaaagagucugacccugaaucuaauaacagaaaugggacgucuaccaacauucaugacgcaaaaagcgaggaacgcacuugauaaucuagccguuuugcauacugcugaagcgggagggcgggccuacaaccaugcacuaucggaauugccugagacguuagaaacacuuuuguuauugaccuuacuagcaacgguaacaggaggcauauuccucuuuuuaaugaguggaaaaggaaucgguaagaugacacuuggaaugugcugcaucauaacagcaagcauauuacuaugguaugcccaaauacagccucacuggauugcagcuuccauaauccuugaguucuuccuuauaguccuccuuauacccgaaccagagaaacaacgaacaccacaagauaaucagcucaccuacguaguaauagcuauucuaacaguuguagccgcaacgauggcaaaugagauggguuuccuugagaagacuaagaaagacuugggcuuagguuccauuacuacucaagagagugagaguaauauccuagauauagaucuacggccagcuucggccuggacucuguacgcuguggcgacaacauuugugaccccgaugcuucgacauucaauagaaaauucaagcguaaacguuucucuuaccgcaaucgcuaaccaagcaaccguacugaugggacuagggaaaggauggccccucucgaaaauggauauugguguaccucuacucgcgauuggaugcuauucacagguuaacccaauuacucugacagcagcucuacuacuccuaguagcucauuacgcuauuauaggacccggccugcaagccaaagcgacacgcgaagcucagaaaagagccgcagcugguauaaugaaaaauccgaccguagacgguauaaccguaauugaucuugaaccuauaccuuaugaucccaaguucgaaaaacaacuaggucaaguaauguuauuaauauuaugcguuacccaaguuuuaaugaugagaacgacuugggcacucugugaagcauugacacuagcaacagggcccauuucgacacuuugggaagggaacccaggacgauucuggaacacaacaauugcagucaguauggccaauauuuuuagaggaucauauuuagcgggugcaggacuguuauucucgaucaugaaaaauacaaccaacacuaggagagguacagggaacaucggugaaacucugggagaaaaauggaaaucacgucugaaugcauuaggaaagucggaguuccaaauauacaagaaaucggggauccaagagguagauagaaccuuagcgaaagagggaauaaaaagaggagaaacggaucaucacgcgguuagucgugguagcgcuaaacuaagaugguucguagagagaaacaugguaaccccagaaggaaaaguaguggauuuaggcugugguagggguggauggucauauuauugcggaggcuugaaaaauguacgagaaguuaaaggauuaacuaaaggagguccaggucacgaggaaccgauaccaaugucaaccuaugguuggaaccugguaagauugcaaucagguguagacguauuuuucacaccuccagagaaaugcgauacauuacuuugugauauaggagaaucaucaccaaauccaaccaucgaagcagguagaacucuacguguacugaaccuuguagaaaauuggcuaaauaauaauacacaauucuguauaaaaguacucaauccuuauaugccgagugucaucgagaaaauggaagcguuacaacgcaaguacggaggcgcauugguaagaaauccuuugucaagaaacagcacgcacgaaauguacuggguaucaaaugcuacagggaacauuguaaguucaguaaacaugauaaguagaauguuaauuaauagguuuaccaugaaacacaaaaaggcuacauaugaaccugauguugaccucggaucagguacaagaaauauuggaauugaaucagaaauuccaaaucuggauauaaucggcaaacgcauagaaaagauaaaacaagaacacgaaaccucguggcauuaugaucaagaucaccccuauaaaacuugggcuuaccauggcucuuacgagaccaaacaaaccggaucugcaucaucuaugguaaauggaguaguacgacuacuaacaaagccaugggauguaguaccaauggugacccaaauggcuaugaccgauaccacuccauuuggacaacagagggucuucaaagaaaagguugauacacggacucaagaaccuaaggaaggaacaaagaaauuaaugaaaauuacagcugcauggcuuuggaaagaauuggguaagaagaagacccccagaauguguacuagagaagaguucacccgcaaaguaaggaguaacgcggccuuaggugcaaucuuuacugacgaaaauaaguggaagagugcccgagaagcuguugaagaugguagguucugggaauuaguugauagagaaagaaaccugcacuuagaggggaagugugaaacguguguauauaauaugauggggaaacgagagaagaaauugggagaauuuggaaaagcuaaagguagccgagcaauuugguacaugugguuaggggcacgauuucuagaauuugaagcacucgguuuucucaaugaagaccauugguuuaguaggggcaauucauuaucuggagucgaaggagagggccuccauaggcuugguuauauacugagggaugucggaaagaaagaaggaggggcgauguaugcagacgauacugcaggaugggacacucggaucacgcuagaagaccugaaaaaugaagaaaugguaaccaaccacaugaaaggagaacauaagaaauuagcugaggcuauauuuaaauugacguaucaaaauaaggucguaagaguacaacgcccaacgccgagaggaacgguaauggauaucaucucucguagggaccaaagaggauccggacaagucgguacauacggauuaaauacguuuacuaauauggaagcacagcuuauuagacaaauggaaggggaagggauauuuaaaaguauacaacaucuaacagcaaccgaagaaauagcgguacaaaauuggcucgcuagaguuggucgagagagacucucucgaauggccauaagcggggacgauuguguuguaaagccuauagaugauagauuugcaucggcauuaaccgcacuaaaugauauggguaaaguacguaaggacauccaacagugggaaccgucucguggauggaaugauuggacacaagugccauuuuguucacaccauuuucacgaacugguaaugaaagauggaagagucuuggucguaccuugccggaaccaagaugaauuaauaggucgagcaaggauaagccagggagccgguuggagucuaaaagaaacugcuugucuugggaagucguaugcacaaauguggacacugauguauuuccaucgccgugaccugagauuagcggcuaaugcgaucugcucugcagugcccucgcacuggguaccuacaucuagaacaacuuggucgauacacgcuaagcacgaauggaugacaacggaagacauguuagcaguauggaaucguguauggauacaagagaauccauggauggaggauaaaacaccgguggaguccugggaggaaguaccauaucugggaaaaagggaagaccagugguguggcagucugauaggacuuacgagccgagcuacuugggccaaaaauauacagacggcaauuaaccaaguucgaucacuaauagguaacgaggaauauacagauuacaugccgucgaugaaaagauuucguagggaagaggaagaagccgguguacuaugguaa

SEQ ID NO: 22465 - RNA, 9876 nt, Artificial Sequence
  derived and/or modified CDS sequence (opt6) from DENV-2__EU482634__SS-prME
acagcgggaguuaucguaaugcugauucccacagcuauggcauuucaucugacaacaagaaauggugaaccccauaugauugucgggagacaagaaaaaggaaaaucauuacuuuucaaaacugaagacggaguuaacaugugcacauuaauggcuauagauuugggagaacuaugugaagauacaaucaccuauaaauguccgcuacuaaggcaaaaugaacccgaagauauugauugcugguguaauucuaccagcacauggguaacauauggaacguguacuacaaccggugaacauagacgagagaaaaggagcguggcguuaguuccucaugugggaaugggauuggaaacucgaacugaaacuuggaugucuagcgaaggagccuggaaacauguucaacgaauugaaacguggauauugagacauccagguuuuacuauaauggcggcaauuuuagcauauacaauagggacaacccauuuccagcgagcuuuaaucuuuauucuacuaacggcuguagcaccaaguaugacgaugcguuguauaggaauaagcaaucgagauuucguugaaggagucuccgguggaucauggguugauauuguucuugaacacggaucuuguguuacaacuauggcgaaaaacaaacccacauuagacuucgaauuaauaaaaacagaagcuaaacaacccgcaacacuacggaaauauugcauagaagcaaaauuaacaaacacuacaacagaaaguagaugcccgacucagggggagcccagucugaacgaagaacaagacaaaagguuuauaugcaaacacucaauggucgaccgaggaugggggaacgggugugguuuguuuggaaaagguggaauuguaacaugcgcuauguucacuuguaagaaaaauauggaaggaaaaguaguccaaccugaaaaucuggaauacacaauugucauuacgccacacaguggagaagaacaugcaguaggcaaugacacugggaagcauggcaaggaaaucaagaucacgccccagaguaguaucacagaagcggaauugacgggauaugggacggugacaauggaguguagcccacguacuggccuugacuucaaugaaaugguuuuacuacaaauggaagacaaggcuugguuaguacaucgucaaugguuucuagauuugcccuugccauggcuaccaggugcugauacucaggguaguaauuggauacaaaaggaaacgcuugugacauucaagaacccccaugcuaagaaacaagacguaguuguauuggggucgcaggaaggcgcaaugcauacugcacuaaccggcgcuacugaaauucagaugucaagcgguaaucuccucuuuacuggucaucuuaaaugucgacuaaggauggauaaauuacaauuaaagggaaugucuuacuccaugugcacaggcaaauuuaaaaucgucaaagaaauugcagaaacccaacacggcacuauagugauaagaguucaguacgagggcgauggaagcccauguaagaucccguuugaaaucacagauuuagaaaaacgccacguauuagguagacuaauaacaguuaauccaauugucacagaaaaagauaguccgguaaauauagaagcagagccuccauuuggugauucguauauaauaauuggcgucgagcccgggcaguuaaaacuaaauugguuuaagaaagguaguucuaucgggcagauguucgagacaacgaugcggggagcuaaacgaauggcaauuuugggcgauacggcuugggauuucgggucacuaggcgguguuuuuacuagcauaggcaaagcccuacaucaaguauuuggcgcaauauacggagcagccuucucugguguaucauggacaaugaaaauucucauaggaguaauaauaaccuggauagguaugaauagucguucuacgucgcuaucugucucacucgugcucgugggaguugugacccuauaccuuggugcgaugguacaagcugauucaggguguguaguaucauggaaaaauaaagaacuuaaaugugguucagggauauucauaacggauaacguucauacauggacagagcaguacaaauuucaaccggagaguccaaguaaacuagcgucugcaauacagaaagcucacgaagaaggaauaugugguauaagaucggugaccagguuggagaauuuaauguggaaacaaauaacgccggagcuaaaucauauccuagcagagaaugaagucaaguuaacuauaaugacuggugauauuaaaggcauaaugcaagccgguaaaaggucguugagaccucaacccacugagcuaaaguauagcuggaaaaccuggggaaaagccaagauguugucuacagaaagucacaaccaaacguuucuaauagaugggccagaaacagcugaaugcccaaauacaaauagagcuuggaacucccuagaaguugaagacuauggauuuggaguuuuuaccacgaauaucugguuaaaguugagggaaaaacaagauguauucugugauucaaaacuaaugucugccgccauaaaagacaacagagcuguacacgcggacaugggauauuggauugaaucugcucuaaacgacacauggaaaauggagaaagcgucauuuauugaaguuaagagcugccauuggccaaagucacauacacucuggucaaaugguguucuagaaucugaaaugauaaucccaaagaauuucgcuggaccagucucacaacauaacuaucgaccgggguaccauacacaaacggcugguccauggcacuuaggaaagcucgaaauggacuuugauuuaugugaaggcacaacuguugucguaacggaagauugugguaacagaggucccucacuacguacaacuaccgccucagguaaacuaaucacugaaugguguuguaggucauguacacucccgcccuuaagauauagaggggaagacgggugcugguacggaauggaaauaagaccgcugaaagaaaaagaagaaaaccuagucaauucgcugguaacagcuggucauggccaaauagacaauuuuucucuaggugugcuuggaauggcucuguuuuuagaagaaauguuaaggacacgaauuggaacaaagcaugcgauuuuguuaguagcuguaaguuuuguaacucucauuacugguaauaugagcuuccgcgaucuaggucgcguaauggucaugguaggagcuacaaugacugaugacauaggaaugggagugacuuaucuagccuuacuggcagcauuuaaagugcgcccgacuuucgcugcaggccuucuucucagaaaacuaacaaguaaagagcuuaugauggcaacuauaggaauagcauuacuaagucaaagcacaauuccagaaacuauauuagaacuaacagacgcgcuagcccuugguaugaugguuuuaaagauagugcgcaacauggagaaauaccagcucgcuguaacaauaauggccauaagcugugucccgaaugcugucauacuucaaaaugcauggaagguuucguguacuauucuggcagccguuucaguaucaccgcuacuucuaacuucaagucaacagaaagcugacuggauaccauuagcuuuaacaauaaaaggcuuaaauccaacugcaauuuuucuuacuacuuuguccagaacgaacaagaaacguucauggcccuuaaacgaagcuauaauggcaguaggaauggugaguauacuagcuucaucuuuacugaaaaaugauauuccuaugacgggaccauuaguugcaggcggacuccuaacaguuugcuauguucuuacagguaggagcgccgaccuugagcuggagcgugcugcagaugucaaaugggaggaucaagcugaaaucuccgguucaucuccaauacuaucgauaacuauaagugaagacgguagcaugucaaucaagaacgaagaagaagaacagacucuuacaauacugauacgcacaggguugcuaguaauaagcggggucuucccagugagcauucccauuaccgccgcagcaugguacuugugggaagucaagaaacaacgagcuggagugcuaugggauguacccucaccaccaccaguagagaaagcggaauuagaagauggagcuuauaggauaaagcaaaggggaauuuugggguauucacaaauuggagcugguguuuauaaagaaggcaccuuccauacaauguggcauguaaccagaggagcgguauugaugcaucgcgggaaacggaucgagcccucaugggccgacguaaagaaagauuuaauuucauauggaggaggauggaaauuagaaggagaguggaaagaaggugaggaagugcagguucuagcacuugagccaggcaaaaauccccgcgcagugcagacaaaaccaggaauuuucaagacgaacacaggaaccauuggagcugugagccuugauuucucaccagguacaaguggcagcccaaucguggaucgcaaaggaaaaguggucgguuuauacgguaaugguguaguaacucgauccggugcguauguaucugcaauagcacagacugagaaauccauagaggauaauccagaaauagaggaugacaucuucaggaagaaacgauuaacaauaauggauuuacauccaggagcagggaaaaccaagagguaccucccggccaucguaagagaagcaauaaaaaggggauuaaggacccuaauauuagcuccuacgagagugguagcggccgagauggaagaagcacuucggggauuaccuauaagauaccaaacacccgcgaucaaaacggaacauacagggagagaaauaguugacuuaaugugccacgccacauuuacaaugagacuccugucaccaguaagaguaccgaauuacaauuugauuaucauggacgaagcacacuucaccgauccagcaucuauagcggcaagaggcuacauaagcaccaggguagagaugggugaggcagcugguauuuucaugacugcuacacccccuggguccagggauccguuuccacaaagcaaugcacccauuauggaugaggaacgagaaauaccugaaaggaguuggaauaguggacacgaauggguaacggacuucaagggaaaaacuguaugguucgucccgucaaucaaagcuggaaacgacauagcggcguguuugcggaagaaugguaagaaaguuauacaacuuagcagaaaaacauuugauagugaguauguaaaaacucgcgccaaugauugggauuucguaguaacaaccgauauaucagaaaugggugcaaauuuuaaagcugagagaguuaucgauccgagaagguguaugaagcccguuauacuuacugauggggaagaacgggucauauuagcuggaccaaugccagucacgcauagcuccgcagcacaacgaagagggaggauaggaagaaacccuaaaaaugagaaugaucaauauaucuacaugggcgagccccuagaaaaugacgaagauugugcgcauuggaaagaggcgaagauguuauuagauaacauaaauacaccagaagguauaauuccuucuauguucgaaccagaacgagaaaaaguagacgcuauagauggcgaauaccguuuaagaggagaagcccguaaaacuuucguugauuuaaugaggcguggggaccuuccaguuuggcuugcuuacaagguagcggcagaagguauaaacuacgcggaucgaaaaugguguuuugaugggaucaaaaauaaccagauccucgaagaaaacauggaaguagaaauuuggaccaaggagggagaacgaaagaaacuuaaaccgagauggcuugacgcaagaauauacuccgauccuuuagcacucaaggaguucaaagaguucgcagcaggcagaaaaucauuaacucuaaaucugauaacagaaaugggccgacuccccacguucaugacacaaaaagcuagaaacgcacucgauaaucuagccgugcuccauacagccgaagcuggcggucgugcuuacaaccacgcacuaucggaauuacccgaaaccuuagaaacacuacuacucuugacuuuguuggcuacaguuacaggggguauuuucuuauuuuugaugucaggaaaagggaucggaaaaaugaccuuaggaaugugcuguauaauuaccgccucuauccuccugugguacgcgcaaauucaaccacacuggauagccgcgucuaucauucucgaguucuuucuaauaguauuauugauccccgagccagaaaagcagcgaacuccucaagacaaucaacuaacuuacgucgucaucgccaucuuaacuguaguagcugcaacaauggccaaugaaaugggauuucuagaaaagaccaagaaagaucuuggacuaggaucaauuacaacacaggaaucagaaaguaauauucuugauauugaccuuagaccggcuagugcauggacuuuauacgcagucgcaacuacauucguaacacccaugcuuagacacucaauagaaaauagcucuguaaauguuagucuaaccgcuauugcuaaucaggcaacagucuugaugggacuugguaaaggcuggccuuuauccaaaauggauauagggguaccacuauuagccaucgguugcuacucacaaguuaauccgauaacacugacagcagcauuacuauuacuuguagcucacuacgcuauuaucggaccggggcuacaagccaaagcaaccagggaagcacaaaagcgggcagcggcuggaauuaugaaaaacccuacagucgacggaauaacaguaaucgauuuagaaccuauaccauacgacccuaaauucgaaaaacaauuggggcagguaaugcuacuaauauuauguguuacacaaguacuuaugaugagaacaacuugggcuuuaugugaagcacuuaccuuggccaccggaccuauaucaacgcuaugggaagguaacccgggaagauuuuggaauacgacaauugcaguaucgauggcaaacauuuuucgggggucguacuuagcuggagcaggauuauuguuuucaauaaugaaaaacaccacaucaacaaggagagguacgggaaauauuggugaaacucuaggggaaaaauggaaaucuagacuuaaugcauuaggaaaaucugaguuucaaaucuauaagaaaucugggauccaagaaguggaccgaacucuagcuaaagaaggaauaaaacgaggagagacugaccaucaugcgguaucaagaggcuccgcaaaacuuagaugguuuguagagagaaacauggucacacccgaagguaaaguagucgaccuuggaugcggcagaggaggauggucauacuacugugguggucuuaagaauguucgugaaguaaaaggacuuacaaaaggugguccaggacacgaagaaccaaucccgaugucaacguauggauggaauuuaguacgccuacagagcggcguagacgucuuuuucacaccaccagaaaagugcgauacacugcuuugcgauauaggagaaucgucacccaauccaacuauugaagcaggacguacacugagaguauugaauuuaguugaaaauuggcuaaauaacaacacuaaauuuugcauuaaaguucuuaauccguauaugcccuccgucauugagaaaauggaggcuuuacagaggaaauaugggggcgcucuuguaagaaauccguuaagccggaacucaacacaugagauguacugggugucaaaugcgaccgggaacauaguaucguccguaaauaugauaucgagaaugcuaauuaacagauuuacaaugaaacauaagaaagcaaccuacgaaccagauguggauuuaggaagcggaaccagaaauaucgguaucgaauccgagauaccaaacuuagauaucauagggaaacguauagagaaaauaaagcaagaacaugaaacaucuuggcacuaugaccaagaccacccuuacaaaacgugggcauaccacgggagcuacgaaacaaaacaaacuggguccgcaaguucaauggucaauggggugguucgccuuuuaacuaaaccaugggauguaguacccaugguuacgcaaauggcgaugacagacaccacucccuuuggccagcaacgcgucuuuaaagaaaaaguagauaccagaacgcaagaaccgaaagaagguacaaagaaacuaaugaaaauaacugccgaauggcuauggaaagaauuagguaaaaagaaaacucccaggauguguacuagagaagaauuuacuagaaaagucagaucgaacgccgcauuaggagccauauuuacagacgaaaauaaauggaaaagcgcuagagaggcaguugaagauggaagauuuugggaacuuguugaucgugaaaggaauuuacaccuagaaggaaaaugcgagacguguguauacaauaugaugggcaaaagagaaaagaaauugggggaauuugggaaagcuaaagggucucgugcaauaugguauauguggcuaggagccagguuucuugaauuugaagcacugggauuucuuaaugaagaccauugguuuucaagagguaauucauuaucagguguugaaggagaaggauugcauagguuaggauauauucuaagagauguaagcaagaaggaaggaggagcgauguacgcugaugacacagcaggcugggauacaagaaucacucuggaagaccucaaaaaugaagaaaugguuacuaaucacaugaagggggaacacaagaaacuggcugaagcaauuuucaaguuaacauaucagaacaagguaguacguguacaaagaccgacuccgcgcggaacgguaauggauauaauaucacgcagagaucagcgaggcucuggucaaguugguaccuacgguuugaauacauucacaaacauggaagcucaauuaauaaggcaaauggagggagaagguauauuuaaaagcauacaacacuuaacugcaaccgaagaaaucguaguacaaaacugguuagcaagaguggggcgugaacgccuuucgcgaauggcaauaucaggcgaugauugugucguaaaacccauagaugauagauucgcaagcgcccucacggcauuaaacgauauggggaaaguacguaaagauauacaacaaugggagccuucgcggggguggaacgacuggacccaagucccuuuuuguagccaucacuuucacgaauuggucaugaaagauggacgcguucugguagugccuuguagaaaucaggacgaauuaauaggccgcgcccgcauuucacaaggugcaggcuggagccuuaaagagacugcaugucuaggcaaaaguuaugcacaaauguggacuuuaauguacuuucaucggagagaucuacgcuuagcagcuaaugccauuugcuccgcagugccaucucauuggguuccgacaagcagaacaacuuggaguauucaugcaaaacaugaauggaugacaacagaggauaugcuagccguguggaauagagucuggauacaagaaaauccauggauggaggauaaaacuccuguagaaucuugggaagaggugccuuauuuaggaaaacgugaagaucagugguguggaagccuuaucggauuaacgucaagagcaaccugggcgaaaaauauacagacugccauaaaucagguccgaucucuaauuggaaacgaggaauacacagauuauaugccuaguaugaaaagguuuagaagggaggaagaggaagcuggaguucuuugguaa

SEQ ID NO: 22466 - RNA, 9876 nt, Artificial Sequence
  derived and/or modified CDS sequence (opt6) from DENV-2__EU482635__SS-prME
acagcaggcguaauagucauguugauccccacagcaauggcauuccaucuuacaacgaggaauggggaaccccacaugauuguggggcgucaagaaaaagggaaaaguuuguuauuuaaaacugaagacgggguaaauaugugcacacucauggcuauugauuugggggaacucugcgaagauacuauaacuuauaaauguccccuucuucgucaaaacgaaccugaagacauugacuguugguguaauucaacgagcacauggguaacuuaugguacuuguacaaccacuggcgaacaccgaagagagaaacgaaguguggcguugguaccucaugugggaaugggccucgaaacucgaaccgaaacauggaugucguccgaaggugcauggaaacacgugcaacggauagaaacauggauacuacgacauccaggauuuacuaucauggcagcaauauuagcguauaccauagggacgacucauuuucaaagagcacucauuuuuauauuauuaacagcggucgcaccgagcaugaccaugcgaugcaucgguauaucgaaucgggauuucguggaaggaguuuccggagggucguggguagacauuguacucgaacacggcaguugugucacaacgauggccaaaaacaaacccacucuagauuuugaauuaauaaaaacggaagcaaaacaaccagcaacacuccguaaauauugcauugaagcuaaacuuacuaauacuacgacggaaagcagauguccgacacaaggugaaccgucauuaucggaagaacaagacaaaagauucaucugcaaacacucaaugguugauagaggguggggaaauggauguggacucuucgggaaaggcggaauaguuacaugugcuauguuuacaugcaagaaaaacauggagggaaaaguaguucaaccagaaaaccuagaauacacgauagugauuacaccucauuccggagaagaacacgcaguaggaaacgacacugguaaacaugggaaagaaauaaaaaucacuccacaaucaucgauuacugaggcagaacuuacaggauacgggacggugacuauggagugcucaccucgaaccggccuagacuucaaugaaaugguuuuacuucaaauggaggauaaagcauggcugguucaucgacaaugguucuuagacuugccgcuaccuuggcucccaggagcugacacacaaggaucuaauuggauacaaaaagaaacauuaguuaccuuuaaaaauccacaugccaagaaacaggacguuguagugcuaggaucucaagaaggggcuaugcauaccgcauugacaggagcaacugaaauucagauguccagcggaaaucucuuauuuacaggacaccuaaaauguagacuuagaauggacaaauuacaacucaaaggaauguccuacagcauguguacaggaaaauucaaaauaguuaaagaaauugcagaaacucaacaugguacuauaguuauacgcguacaauaugagggcgaugggucgccuuguaaaaucccauucgaaauaaccgaucucgagaaaagacauguuuuagggagauuaauuacggucaauccaauuguaaccgaaaaagacucgccaguaaacauagaagcagaaccucccuuuggagauagcuacauuauaauaggaguugaaccaggucaacuuaaacucaauugguuuaagaaaggaucuuccaucggccaaauguucgagacaacgaugaggggcgcaaaacgaauggcuauacucggggauacagcgugggauuuuggaagccugggaggugucuuuacguccaucggaaaagcgcuccaucagguuuuuggagcaauauacggugcugcguuuucagguguuuccuggacuaugaaaaucuuaaucgggguuauuauaacauggauaggaaugaacuccagaucaacaucacucagugugucgcuaguccuagugggaguggugacauuguauuuaggcgcuauggugcaagcugacuccgggugugucguaaguuggaaaaacaaagaacuaaaaugcggaucaggcaucuuuauuacugacaauguucauacuuggacagaacaauauaaauuccaaccugaaucgccuucgaaacucgcgagcgcaauacagaaagcacaugaagaaggaaucugugguauuaggaguguaacgcggcuugagaaccuaauguggaaacaaauuacaccagaacuaaaucauauuuugucagagaaugaaguaaaacugacgauaaugacgggagauauuagggguaucaugcaagccggcaaacggucacuucgaccgcaacccacagaacuaaaauacagcuggaaaacauggggcaaagcuaaaaugcucucuacagaaucccacaaucaaacauuucuaauugacgggccagaaaccgcugaguguccaaacacuaaucgagcauggaacucacuugaagucgaagauuauggcuuuggcguauuuaccacaaacauauggcuaaaacuccgcgagaaacaagauguuuucugcgauaguaaauugaugagcgcugccauuaaagacaauagagcuguucacgcugauauggguuauuggauagaaucggcucucaaugauacauggaaaauggaaaaggcuuccuucauugagguaaaaaguugucauuggccuaaaucgcacacacucuggucaaaugggguuuuagaaucagaaaugaucauaccuaaaaauuuugccgguccuguaucacagcauaacuacagaccuggauaucacacacaaacagcaggaccuuggcaccuaggaaaacuagaaauggacuucgauuuaugcgaagguacgacuguuguagucacugaggacuguggaaaucggggacccucacuucguacaacgaccgcuucaggcaaauuaauaaccgaauggugcugucgaagcuguacacuacccccauuaagauauaggggagaggaugguuguugguaugguauggaaauacgaccauugaaagagaaagaagagaaccuaguaaauucucuaguaacagcaggacauggacaaauugauaauuuuagucuuggcgugcucggaauggcauuguuucucgaggaaaugcucagaaccagaauuggaacaaaacacgcaaucuugcucguugcugugaguuuugucaccuuaauuaccgggaauaugagcuuucgugaccuagggaggguaaugguuaugguuggugcuacaaugacugacgacauaggaaugggaguaacuuaccuugccuuacuugcagcuuuuaaagugcgucccacauucgcagcaggucugcuucuacgaaaguuaacuucaaaagaauugaugauggcuacuaucggaauugcucuguugagccagucaacuauaccugaaacaauccucgaacuuacugacgcgcuagcucuaggaaugaugguuuuaaaaauaguacggaauauggaaaaauaccaacuugccguaacaauuauggccauaucaugcguuccaaaugcgguaaucuugcaaaaugcuuggaaagugucuugcacaauacuagcagcuguuucagugaguccccuucugcuaacaucaagucaacaaaaggcagacuggaucccuuuggcauugacaauaaaaggucuuaauccaacagcaauuuuccucacuacguugagcagaacgagcaagaaacgaucauggccacucaacgaagcgauuauggccguugguauggucagcauacuugcuucuucuuuacuuaaaaaugauauacccaugacaggaccauugguagcuggcggcuuacuaacgguauguuauguauuaacuggccggucggcugaccuggaacuggagcgagcugcugaugugaaaugggaagaucaagcagaaauaucaggcuccucuccuauucuuaguauaaccauaagugaagaugggagcaugucaauaaagaacgaggaagaagaacaaacccugacuauacugauuaggacaggacuccuuguuauauccggcguuuucccggugucgauacccauaacugcagcugcuugguauuuaugggagguaaagaaacagcgugcuggaguuuuaugggaugugccaucaccaccgccuguugaaaaagcagaauuggaagauggagcauaccggaucaaacaacgagguauauuaggauauagucaaauaggcgcgggcguauauaaagaaggaacuuuccacacgauguggcacgugacaagaggugccguucuaaugcaccgaggcaagagaauagaaccauccugggcagauguaaagaaagauuuaaucucauaugggggaggauggaaauuggaaggagaauggaaagagggugaagagguccaagucuuggcauuggaaccuggcaaaaauccccgugcaguccagacaaaaccuggcauuuuuaaaaccaacacagguacuauuggugcaguaucauuggauuuuucgccaggaaccucugguagucccauagucgauagaaagggcaaggucguaggcuuauacggaaacgguguuguaacucguagcggagcuuauguuucugcgauagcacaaacagagaaaagcauagaagacaauccggaaauugaagacgauauauuuaggaagaaacgccucacgauaauggaucuucauccgggagcugguaaaacgaaaagauaucuaccagcaaucguuagggaagcgauaaaacgaggccuaagaacacugauauuagcucccacuagagucguugccgccgaaauggaagaagcauuacguggccuaccaauacgauaccaaacaacagccauaaagacagaacacacugguagggaaauuguugaucuuaugugccaugcaacauuuacuaugcguuuacuaucaccugugagaguaccuaauuacaacuugauaauaauggacgaagcucauuuuacggauccagcaucuauugcugcgcggggauacaucuccacaagaguagaaaugggcgaggcugcagguauuuuuaugacagcuacgccaccagggucgcgugacccguuuccacaaucaaacgcaccaauuauggaugaagagagagaaauaccagaacgaaguuggaacucaggucaugaauggguaaccgauuuuaaagguaagacagucugguucgucccaucuaucaaagcagggaaugauauagcggcauguuugcguaagaaugguaagaaaguaauccaacuuagcagaaaaacauuugauagcgaauauguaaaaacgagagcaaaugauugggauuuuguaguuacgacggacauaagugaaaugggugccaauuucaaggcugaaagaguaauagauccaagacgauguaugaagccaguaauccuaacagauggggaagagaggguuauauuagccggacccaugccuguaacacauucuucagccgcucagagacgggggagaauaggacgaaauccuaaaaaugaaaacgaucaauacauauauaugggcgagccacucgaaaacgaugaagauugcgcucauuggaaagaagcaaaaauguuauuagauaacauuaacacaccggagggcauuauaccaagcauguuugaaccggaaagggaaaaggucgacgcgaucgacggagaauaucgucugaggggcgaggcgagaaaaacauuugucgauuugaugagaagaggagaccuaccuguauggcuggcguauaaagucgcggcagaaggcaucaauuacgcagaucgcaaauggugcuuugacggaaucaaaaauaaccaaauucuagaggaaaacauggaagucgaaauauggacuaaagaaggggaaagaaagaaacuaaagccuagguggcuugacgcccgaauuuacucugauccucucgcacuaaaagaguuuaaggaauuugcagcaggucgaaaauccuugaccuuaaacuugauuacagaaaugggaagacuuccuacuuucaugacucaaaaagcuaggaaugcucuugauaacuuagcuguacuacacacggcagaggccgguggacgugcauacaaccacgcucugucagaacuuccagaaacauuagagacccuuuuguuauuaacacuuuuggcuaccguuacaggaggaauauuuuuauucuuaaugucagggaaaggaauaggaaaaaugacuuuaggaaugugcugcauuaucacugcguccauacuucuuugguaugcccagauacaaccacacuggaucgcagcaaguauaauccuagaguucuuuuuaaucguacuauuaauaccagagccggaaaaacaaagaacuccacaagacaaucaauugacguauguaguaauugcaauacuuacaguuguagccgccacaauggcaaacgaaaugggguuucucgagaaaacuaagaaagaucuuggacucggaagcauuacaacucaagagucagaaaguaauauuuuggacauagaucuacgacccgcaucugcauggacacuauaugcagucgcaacaacuuucguaacaccgauguuacggcauaguauagaaaauucuagugugaauguuagccuaacagcuauagcaaaucaggcuacaguucuaaugggguuaggaaagggauggccucuauccaaaauggauauugguguaccucuucuugcaauaggguguuacagccaaguaaacccuauuacacucacggccgccuugcuacuauugguagcucauuaugcaauuauagguccaggauuacaagcgaaagcaaccagagaggcccagaaaagagcagcggcaggcauuaugaaaaacccuacuguagauggaauuacuguaauagaucuagaacccauaccauaugauccaaaguuugaaaaacaacucggccaaguaauguuauuaauauugugcgugacacaaguuuugaugaugagaacuaccugggcguuaugcgaggcuuuaacccuugcuaccggaccuauaaguaccuuaugggaaggcaauccaggaagguucuggaauaccaccauagcgguuuccauggcaaauauauuucgcggaucuuaucucgcaggagcuggguuauuauuuucuauaaugaagaacacaaccagcacacgcagagggacuggaaacaucggagagacccuuggagaaaaauggaaaagcagacuaaacgcucuuggaaaaucagaguuccagauauacaagaaaucuggcauacaagaaguugaucgaacccuggcaaaagaaggaauuaaaagaggagagacggaccaccaugcagugagccgcggaucagcaaagcuacgcugguuuguugaaagaaauaugguuacacccgaagggaaaguaguugacuugggcuguggcagagguggauggagcuacuauugcggagggcugaagaauguucgggaagucaaaggacugacaaagggcgguccugggcacgaagaaccaauacccauguccacguacggcuggaaccugguccgucuacaaagugggguagauguguucuuuaccccuccugaaaagugugacacgcuccucugugacauaggugaaagcucgccaaaccccacaauugaagcaggucguacacugagaguguugaaccuugucgagaacugguuaaacaauaauacccaauuuuguauaaagguuuuaaacccauauaugccaagugugauagaaaagauggaagccuuacaacguaaguacgguggagcccuaguuaggaauccacugaguagaaauuccacacaugaaauguacugggucucaaaugcuacaggaaauauuguauccucagucaauaugauaagccgcauguuaaucaacagauuuacaaugaagcauaagaaagcgacuuaugagccagacguagaccucggcucugguaccagaaauaucggaauugaauccgaaauaccuaaccucgauaucaucgggaaaagaauagagaaaauuaaacaagagcaugagacaucauggcacuaugaccaagaucauccauauaaaacaugggccuaucauggaaguuaugaaacuaaacagacuggauccgcuagcucaaugguaaacggaguggugagauuauugacuaaaccaugggaugugguccccaugguaacgcaaauggccaugacugacacuacaccguuuggucaacaacgaguauuuaaggaaaaaguggacacuagaacacaagaaccuaaagaaggcaccaagaaauuaaugaaaaucacagcugaauggcuauggaaggaacuugggaagaagaaaacuccacguaugugcacucgugaagaguuuacuaggaagguaagaaguaaugcggccuuaggagcaauauuuacugaugagaauaaauggaaaucagcaagagaggcgguggaagauggaagauuuugggaauuagucgauagagaaagaaacuuacacuuggaagggaagugugagacgugcguauacaacaugaugggaaaaagagagaagaaauuaggagaguucggaaaagcaaaaggaucacgugccauuugguacauguggcucggggcuagauucuuagaguucgaagcucucgguuuccuaaacgaagaccauugguuuagcagaggaaacucauuguccggaguggaaggugaggggcuacacagacucggguauauccuucgagaugugucgaagaaagagggcggcgcaauguacgcugacgacacagcuggaugggauacucgaauaacccuagaagauuugaagaacgaggagaugguuacgaaucauaugaaaggggagcauaagaaacuugccgaagcaauauuuaaauuaacauaucaaaacaaaguugugagaguacaaagaccuacgccuagaggaacaguuauggacauaauaucgcgccgugaucagagaggaucuggucaaguagggaccuacggucugaauacuuuuacaaauauggaagcacagcuaaucagacagauggaaggagaaggaauauuuaaaaguauccaacaucucacugcaacagaagagauagcagugcaaaauugguuagcuagaguaggcagagaacguuuaucaaggauggcaauaucaggggaugauuguguugugaagccgauagaugaccgauucgccagcgcccuaacugcacuuaacgauaugggaaagguacguaaggauauacaacaaugggagcccucccgaggauggaaugacuggacacaagucccauuuugcucacaucacuuccaugagcuagucaugaaagacggacggguuuuaguugugccaugcagaaaccaagacgaacugauagggagagcucguauaagccaaggugcgggauggucauuaaaggaaaccgcaugucugggaaaaaguuaugcgcaaauguggacccugauguacuuucaccggagagaccucagacuugcagcuaacgcaaucugcagugcaguccccucacauugggugccaacgucacgaacaaccuggucuauacacgccaaacaugaauggaugacaacagaagacaugcuggcuguauggaauagagucuggauacaagaaaaucccuggauggaggacaagacaccgguagaaagcugggaagaggugcccuaucuuggaaaacgugaagaucaauggugcgguaguuugauuggauuaacauccagagcaacaugggccaaaaacauacaaacggcaauuaaucagguaaggucauugauaggaaacgaagaguacaccgacuauaugccaucaaugaaaagauuuagaagagaagaagaagaagcgggaguacucugguga

SEQ ID NO: 22467 - RNA, 9876 nt, Artificial Sequence
  derived and/or modified CDS sequence (opt6) from DENV-2__GQ199874__SS-prME
acugcaggaguaauuguuaugcuuauaccaacggccauggcauuccaucuaacgaccagaaauggagaaccacacaugaucguuggacgacaagaaaaaggaaaaucucuucuuuucaaaacugaagauggaguuaacaugugcacgcucauggcgauggauuugggugaacuuugugaagauacuauaacuuauaaaugcccucucuugagacagaaugaaccugaagacauugauuguuggugcaacaguacuuccacgugggugacauauggaaccuguacgacaacuggugaacauaggcgugagaaaagaucaguagcucuagugccgcauguuggcaugggguuagaaacacguacagaaacauggaugucuagcgaaggggcauggaaacacguacaaagaauugaaacauggauccuaaggcauccaggauuuacuauaauggcagcuauccuugcauauacuauaggcacgacucauuuccaacgagcauuaaucuuuauauuacuaaccgcaguagcccccaguaugacaaugcgauguaucgggauuaguaacagagauuuuguagaaggaguaagcggaggcaguuggguagauaucguguuagaacaugggaguuguguaacgacgauggcuaaaaauaaaccuaccuuagauuuugaacugauaaaaacagaagcaaaacagccagcaacacuuagaaaauauugcaucgaagcuaaauuaacgaauacaacaaccgaaagccgguguccuacccaaggcgaaccaucacuaaaugaagaacaagacaaaagauucauauguaaacauaguaugguagacagaggaugggguaauggcugcgggcuauuuggaaaaggagguauaguuaccugugcgauguuuacuugcaagaaaaacauggaaggcaaagugguucagccugaaaaucuagaauacaccaucguaauuacuccccacaguggugaagaacaugcaguagguaaugauaccgguaaacacggcaaagaaauuaaaauaaccccacagucuucuauuacugaagcagaacucacgggauauggcacagugacgauggaauguucuccucguacaggacuagauuuuaacgagaugguacuccuucaaauggaggacaaagccuggcuagugcauagacaaugguuuuuggaucucccauuaccgugguuaccaggggccgacacucaaggaaguaauuggauacaaaaagaaacgcuggugacauuuaaaaauccgcacgcuaagaaacaagacguaguaguauuagggucucaagagggcgcaaugcauacagccuuaacuggcgcuacagaaauucaaaugucauccggaaacuuguuauuuaccggucaucuuaaaugucgacuuagaauggauaaacuccagcuuaaaggaaugucauauucaaugugcaccggcaaguuuaaaaucguaaaagaaauagcugagacacaacacggcaccauaguuauuagaguccaguaugaaggcgauggaucaccauguaaaaucccauuugaaauuaccgacuuggaaaagagacauguacucgggcgacugaucaccguuaacccaauaguaacugaaaaagauaguccgguuaacauagaggccgaaccaccuuuuggugacucguacauaauaauaggaguagagcccggacagcugaaauugaauugguuuaagaaagggucaagcauuggucagauguuugaaacaacuaugagaggugcgaaaaggauggcuauccuaggggacacugcaugggacuuuggcagucugggcggaguguuuacaaguauaggaaaagcguugcaccaaguuuuuggagcaauauauggugcagcguucuccgguguguccuggacgaugaaaauauuaaucggaguuaucauaacuuggauugguaugaauaguagaaguacaagucugagugucucacugguucuugugggagugguuacucuguauuuaggggcgaugguucaagcagacagugguuguguaguaucauggaagaacaaagaauuaaagugcggaucagguauuuucaucacggauaacguucauacuuggaccgaacaguacaaguuucaaccggagaguccgaguaaauuagcaagugcgauacaaaaggcacacgaagaagggauauguggaauuagaaguguuacacgauuagagaauuuaauguggaaacaaauaacaccagaacugaaucauaucuuauccgaaaacgaagucaaauuaacaauuaugaccggcgauauuagaggcaucaugcaagcuggaaaaagaucgcuacguccacaaccaacagagcuaaaauauagcuggaaaacaugggguaaggcaaaaauguuauccacugaaagucauaaucagacauuuuugauugauggcccagaaacugcagaaugcccgaacacuaaccgcgcauggaauagccuagaaguagaagacuauggauuugguguuuucacuacuaacaucugguugaaacuuagggaaaaacaagaugucuuuugcgacucaaaacugaugucugcagcaauaaaagacaaccgagcugugcaugcugacaugggauauuggauugagucagcccuaaacgauacguggaagauggaaaaagcauccuuuaucgaagugaaaagcugccauuggccaaaaucgcauacccuauggucaaacggcgucuuagaaucugaaaugauaauuccuaaaaacuuugcaggcccgguaucucaacauaauuacagaccaggauaccauacacagaccgcagguccauggcaccuuggcaaauuagaaauggauuuugaucugugcgaaggcacaacaguaguagugacugaagauugcggaaauaggggaccaucucugcguacuacgacagcaagcggaaaacuuauuaccgaaugguguugucgcucuugcaccuugccaccacuacgcuaucggggugaagaugguuguugguauggaauggaaauuagaccuuugaaagaaaaagaagagaaccugguaaauagucuaguaacagcuggacauggacaaaucgacaauuucaguuuaggugugcugggaauggccuuauuucuugaagaaaugcuaagaaccagaauaggaacaaagcaugcaauccuauuaguugcuguaaguuuugucacccuaauaacggguaauaugaguuuccgugaucuagggagaguuaugguaaugguaggcgcaaccaugacagaugauauuggcaugggagucaccuaucuagcacuucuggcggcauuuaaagugaggccaacauucgcagcgggacuauuauuacguaaacuuacaaguaaagaacuuaugauggcaacgauaggcauagcacuauuaucacagaguaccauuccagaaacaauauuggaauuaaccgaugcacuugcgcuugguaugaugguccuuaagaucguaagaaacauggagaaauaucaacuagcuguuacuauaauggcaaucagcugcguuccaaaugcaguaauacuccagaacgccuggaagguauccuguacuauacuugcagcugugagcguaagcccauuacuacuaacaucaagucaacaaaaagcugacuggauaccuuuggcuuuaacgauaaaggguuuaaauccgacagcaaucuuuuuaacaacucuaagccgcaccagcaagaagagaucauggccccucaaugaagcaaucauggcagucggcaugguuaguauucuugcuaguucacuuuugaaaaacgauauuccaaugacuggcccucuaguagcaggagggcuccugacggugugcuacguacuaacagguagaucagcggaccuugaauuagagagagccgcagauguuaaaugggaagaucaagcugagaucagcgguuccucacccauauuaucaauaacaauuucugaagaugguaguaugucgaucaaaaacgaagaagaagaacaaaccuuaacgauacugauaagaacaggauuauugguaauuaguggaguauuuccuguaucaauaccaaucacagcagccgcgugguaucuuugggaggucaagaaacaaagggccggcguucuaugggacguaccaucaccaccgccaguagaaaaagcugaacuugaggacggugcuuaccguaucaaacaaagaggcauauuagguuauucacaaauaggagcugguguauacaaagaagguacguuucacacaauguggcaugucacaagaggagcuguacucaugcaccgagguaaacguaucgaaccaagcugggcagaugucaagaaagaccuuauuucguauggagggggauggaaguuagaaggcgaauggaaggaaggagaagaaguacagguguuagcguuagaaccgggaaagaauccaagagcaguacagacgaagccugguauauuuaaaacaaacacgggaacaauaggagcaguuuccuuggauuuuagcccugggacgagugguaguccuaucguggaccguaaagguaaagucgucggacuauacgggaacggggugguaacgcguaguggcgcuuauguuagugcuaucgcccagacagagaaaucaauagaggauaauccggaaauagaagacgacauuuuuaggaaaaagagacuuacaauaauggacuuacacccgggggcuggcaaaacaaaacgguacuuacccgcuauuguuagggaagcuauaaaaagaggauuaaggacacuuauauuggcuccaacuaggguaguugcugcagagauggaagaggcuuuacgaggucuaccaaucagauaccagacaacugcaauaaaaacugaacacaccggcagggagauaguagauuuaaugugccaugccaccuucacaaugagauuacuaagcccaguacgcgugccaaacuauaaucuaauuauaauggacgaagcgcauuuuacugauccagccagcauagcggccagaggcuacaucucuacaaggguagagaugggugaagcagcagguauauucaugacagccacacccccuggcucccgagauccauuuccacaaucaaaugcaccaaucauggaugaagaaagagaaauaccugaaagauccuggaacucaggccacgagugggucacggacuuuaaaggcaaaacaguuugguucguaccuucuaucaaggcgggaaaugacaucgcugccuguuuaaggaaaaacggcaagaaaguaauucaauugucaagaaaaacauuugacucggaauacgucaagacucgggcaaaugauugggacuucguagucacuacugauaucagugagaugggcgcaaacuucaaagcagagagaguaauagauccuagacguuguaugaaaccuguaauauuaacagacggagaagaaagagugauucucgcuggcccaaugccuguaacacacaguuccgccgcccagagacguggaagaauugggaggaauccaaagaacgagaaugaucaguauauuuauaugggagaaccucuugagaaugaugaagauugcgcacacuggaaagaggcuaaaaugcuucuggacaauauaaacacgccagaaggaauuauuccuagcauguucgaaccagaaagagagaaaguagaugccauagauggugaauauagacuacggggagaggcucguaaaacauucguggaucuaaugagaagaggagaucuacccguguggcuugcguacaaaguggcagccgaaggcauaaacuacgcagaucggaagugguguuucgauggaaucaaaaauaaucaaauccuugaagaaaauauggaaguagaaauauggacaaaagaaggugagcgaaagaaguuaaaaccuagaugguuagaugcucgaaucuauagcgauccuuuagcacuaaaggaauuuaaagaauuugccgcaggacguaagucucuuacuuuaaaccuuauuacagaaaugggacgcuugccaacauuuaugacucaaaaggcacguaaugcauuagauaacuuagcaguccuucauaccgcagaagccggaggcagagcguauaaucaugcgcuauccgaauuaccggaaacccucgaaaccuuacuccuucucacuuuacuagcuaccguaacagggggaauauuuuuauuuuugaugaguggaaagggaauaggaaaaaugacacuuggaauguguugcauaauuacugcuagcauauuauuaugguacgcacaaauacaaccacacuggauagcugccucuauaauucuugaauuuuucuugaucguccuacuuauaccggaaccagaaaaacagagaacuccucaggauaaucaacucacauaugucgugaucgcaauuuugacaguggucgcagcuacgauggcaaacgaaaugggguuucuugagaaaacuaagaaagacuugggcuuaggaagcaucacaacacaagaauccgaaaguaauauucucgacauugauuuacgaccugcuagugcguggacuuuauaugcgguagcuacgacauuuguaacuccgaugcuaaggcauaguauagaaaacagcagcguaaauguuucuuuaaccgcuauagcaaaucaagcgacggucuuaauggggcuuggaaaaggauggccacuaagcaagauggacauuggaguaccgcucuuagcaauagguuguuauagccaggucaacccuaucaccuugacugcagcguuauuauuacuuguugcgcauuacgcuauaaucgguccaggcuuacaggccaaggcuaccagagaagcacaaaagcgagcggcggcaggaauuaugaaaaauccgacgguugauggaauaacagucauugaccuagaaccuauaccauacgaccccaaguuugagaaacaauuagggcaaguaauguuauugauucuauguguaacacaaguauugaugaugagaacaacgugggcccuaugcgaggcuuuaacauuagcaaccgggccaaucagcacuuuaugggaggguaacccuggacgauuuuggaauacuacuauugcuguaaguauggcaaauauauuucgugggagcuaccuugcaggagcuggauuauuguuuucuauaaugaaaaauacaacaaacaccaggagagguacuggcaauauaggagagacucucggugaaaaguggaaaucuagacuuaaugcguuaggcaaaucagaauuucaaauuuacaagaaaucggggauccaggagguagaucgaacgcuagccaaggaaggaauaaaacgcggagagacagaccaccaugcgguaaguagaggcucagcaaaauugagaugguucguagagagaaauauggugacaccugaaggaaagguaguggauuuaggauguggaagaggaggauggucauauuacuguggagggcucaaaaacguuagggaagucaaaggacucacuaaaggagguccgggacacgaagaaccuauaccuaugucaacauauggcuggaauuuagugagauuacaaaguggaguagacguauucuuuacgcccccagaaaaaugugauacauugcugugugauauuggggaaucauccccaaaucccacuauagaggcagguagaacccuaagaguauuaaaucuuguugagaacuggcuaaacaauaacacacaguucuguauaaaaguccuuaauccuuacaugccaagcguaauagagaaaauggaggcuuuacaaaggaaauaugggggugcacugguaaggaacccuuuaucaaggaacaguacccaugaaauguacuggguaaguaacgcaacugggaacauaguaagcucugugaauaugaucucacgaaugcucauuaaucgcuuuacgaugaaacacaagaaggcuacuuacgaaccggauguagauuuaggcaguggaacccgcaacauuggaauagaauccgagauaccaaaucuugauauuauaggaaaacgaauagagaaaauaaaacaagagcacgaaacaucauggcacuaugaucaggaucacccauauaagacuugggcauaccacgguucuuaugagacgaagcaaaccggcucugcaucgucuaugguuaacgguguaguaagacuguuaacgaaaccaugggaugucguacccaugguuacacagauggcaaugacagauacgacuccuuuuggccaacaaagaguguucaaagaaaaaguggacacaagaacacaagaaccgaaggaagguacuaagaaauuaaugaaaauaaccgccgaauggcucuggaaagaguuaggcaaaaagaaaacaccacguauguguacaagagaagaguuuaccaggaaaguuagaaguaaugcugcacucggagccauauuuacggaugaaaauaaauggaaaucagcuagagaagccguagaggauggacgauuuugggaacucguagaucgcgaacguaaucuacaccuagaaggaaagugugagaccuguguauauaacaugaugggaaaacgcgagaagaaacuaggggaguucgguaaagcaaaaggaucaagggccauaugguauaugugguuaggcgcaagauuucuagaguuugaggccuuaggauuucuaaacgaagaucauugguucucgagagggaacucacuauccggaguagagggugaaggccuucauaggcugggguauauccucagggacguuggcaagaaagaaggaggggcuauguaugcagaugacacagccggaugggacaccaggauaacacuagaagacuugaagaaugaagaaaugguaacaaaccacaugaaaggugagcacaagaaacuagcugaggcuauuuuuaaauuaacuuaucagaauaaagucguacgaguacaacggccgacacccaggggaacaguuauggacauaauuucacgaagagaucagcgaggaucaggucaaguugggacauauggguuaaacacauucacaaauauggaagcccaacucauacgacagauggagggagaagguaucuuuaaguccauacaacaucucacagccacggaagaaauugcuguucaaaacuggcucgcucgcgucggcagagagagacucagccggauggcuauaucaggagaugauuguguagugaaaccaauagaugauagguucgcgucggcacuuacggcucuuaaugacauggguaaaguucgaaaggauauacaacaaugggaaccuagcaggggauggaacgacuggacucaagugccguuuugcucacaucauuuucacgagcuugugaugaaagacggccgagugcuagugguaccgugcagaaaucaagaugaguuaaucggucgagcgagaauuucucaaggugccggauggucuuuaaaggaaacagcaugccucgggaagucauaugcucagauguggacccuaauguacuuucaucgacgagauuuaagguuggccgcaaacgcaauauguucugcgguuccuucccacuggguaccuaccucucgaacuacauggagcauucacgcuaagcacgaauggaugaccacagaagauaugcuugccguauggaauagaguguggauucaagagaauccauggauggaagacaaaacaccgguggaaucgugggaggaggugccauauuuaggcaagagggaagaucaauggugcggcucucuaauugguuugacaucuagagccacuugggcuaaaaauauccaaacugcaauaaaucaggugcgcagucucauuggaaaugaagaauacaccgauuacaugccaucaaugaaaagguucagaagagaagaagaggaggcugguguauuaugguag

SEQ ID NO: 22468 - RNA, 9876 nt, Artificial Sequence
  derived and/or modified CDS sequence (opt6) from DENV-2__EU482639__SS-prME
acagccggugucauagugaugcuuauacccacagcuauggcauuccaccucaccacgcguaacggugaaccacacaugauaguagggagacaagaaaaagggaaaucauuauuauuuaaaaccgaagacggcgugaacauguguacccuaauggcuauagacuuaggggaauuaugugaagauacaauuacauauaaguguccacuauugagacaaaacgaaccagaagacauagacugcugguguaauaguacguccacauggguaaccuaugguacauguacaacaaccggcgaacacaggcgcgaaaagcgaucugucgcacuaguaccacauguaggcaugggccucgaaacccgaacagaaacuuggaugucauccgagggugcauggaaacauguacaaaggauagaaacuuggauacuccgacaccccgguuucaccauuauggcugcuauauuagcuuauacaauaggaacuacacacuuucagagagcccuuauuuucaucuuacuuacugcaguugccccaaguaugacuaugcgcuguauugguauaaguaaucgagacuucguugaaggaguuaguggagguucauggguagacauaguauuggaacacgggagcugcgucacuaccauggcuaaaaauaaaccgacauuagauuuugaacuaaucaaaacagaagcaaaacaaccugcaacucuucggaaauauuguauagaagccaaacuuacaaacacgaccacugagucuagaugcccaacucaaggggagccaucuuugaaugaagaacaggauaaacgauucauauguaagcauucaauggucgaucgcgguugggggaaugguugcggacuauuuggcaaaggcggaaucgucacaugugccauguuuacuugcaaaaagaauauggaagguaaagucguccaaccugaaaacuuagaauacacuaucguaauaacaccucauucaggcgaagaacaugcugugggaaaugauacaggaaaacauggaaaggaaaucaagauuacuccccaaucaucuauuaccgaagcagagcuuacuggauaugguaccgucacuauggagugcucgccccgaaccggacuugauuucaaugaaaugguacucuuacaaauggaagauaaggcaugguuaguacauaggcaaugguuucuugaccucccucuacccuggcuaccaggcgccgauacacaagguucgaacuggauccagaaagagacccuaguaacuuucaagaacccacaugcgaaaaagcaagacguaguaguacuggguucgcaagagggugcaaugcacacugcccugacaggagcaacggaaauccaaaugagcagugggaaccuauuguuuacggggcaccuaaaaugucgcuuacggauggauaagcuccaacugaaagggaugucguacaguauguguacaggaaaauucaaaaucgugaaagaaauagcagaaacacagcauggcacaauuguaaucagaguacaguacgaaggagauggcucuccuugcaaaauaccauuugagaucaccgauuuagaaaagagacacguauuaggacgacuaauuaccguuaacccaauaguuacagaaaaggacuccccagucaacauagaggccgaaccacccuuuggagacagcuauauuauaauaggaguggaaccugggcagcuuaaacuaaacugguuuaaaaaaggaaguaguauaggacaaauguucgagacuacuaugagaggagcaaaacggauggccauauuaggagauacugcaugggauuucggaagucuuggaggaguguucacaucgaucgguaaggcacuucaucaaguuuucggcgccauuuacggggcggcauuuuccggaguaaguuggacuaugaaaauucugauaggugucauaauaacuuggauuggcaugaauagcagaucaacaagccuaucagucucucugguguugguugggguuguaacucuauauuuaggagcaaugguucaagcugacuccggauguguuguaucauggaaaaauaaagaauuaaaaugugguagcggaauuuuuauuacagacaacguucacacauggacagaacaguauaaauuccaaccagaaucuccaucgaaacuggcuuccgcgauacaaaaagcacacgaagaagguaucugugguauacgaucuguaaccagacuagagaauuuaauguggaaacagauuaccccagaacuaaaccauauauuaagugaaaaugaaguuaagcugacaauaaugacaggagauauaagagggaucaugcaggcuggaaaaagaaguuuaaggccacaacccacagagcuaaaauacucguggaagacauggggaaaagcaaaaaugcugaguacggagagucauaaucaaacauucuuaauagauggcccugagaccgccgaguguccuaauacuaauagagcauggaacagucuugaaguagaagauuauggguucggugucuuuacgacaaauauuuggcuuaaguuacgagaaaagcaggauguguuuugugacaguaaacucaugucggccgcgaucaaagauaaucgugcaguacaugcagacaugggauacuggauugagucggccuugaaugacaccuggaaaauggagaaagcaucuuuuaucgaaguuaaaucaugucauuggccaaagagucacacucuauggagcaaugguguacuugaaagugagaugauaauuccgaaaaauuuugccgggcccguaucucaacauaacuaccguccaggauaccauacgcaaacugccggaccuuggcaccuaggaaaguuggaaauggacuucgacuuaugugagggcacaacugucguugugacugaggacugcggaaaucguggucccucucuaagaacaacgaccgcguccggcaaacuuauaacagaauggugcuguaggucauguacccucccuccccuaagauauagaggagaggauggcugcugguacggcauggaaauuaggccgcuaaaagaaaaggaagaaaaccuuguaaauucauuagucacggcaggucauggccagauugacaacuuuucacuaggaguguuagguauggcucuuuuucuagaagaaaugcugagaacacguauagguacaaaacaugcaauucuccuuguagcaguaucuuuuguaacccuaaucacugguaacaugaguuucagagaucucgguagaguuaugguuauggugggggccaccaugacagaugauauaggcaugggcgucacuuaucuagcacugcuggcugcuuucaaaguaaggcccaccuuugcagcuggauuacuauuacgaaaacuuacgucuaaagaacuaaugauggccacgaucgguauagcauuacuaagucagucaacuauuccugaaacuauucuagaauuaacugaugcccuagcgcuugguaugauggucuuaaaaauaguacgaaauauggaaaaauaccaauuagcaguaacaauuauggcuaucucuuguguucccaaugcgguaauuuuacaaaacgccuggaaggucuccuguacaauacuagcagcagugagcgucaguccucuacuccucacaucuucucaacagaaagcagauuggaucccucucgcgcucacaaucaaaggacuaaaccccacggcaauauuuuuaacaaccuuaaguagaacaaguaaaaaacgaucuuggccucuuaaugaagcaaucauggccgucgguaugguaucuauucucgccucgucauuacuuaagaaugauauaccaaugacagguccucucguagcaggaggauuacuaacagucuguuacguacugacaggaaggucagcagauuuggaacuagagcgagcagcagauguaaaaugggaggaccaagcugaaauuucuggcucaagcccaauauugucaauaacaauuucugaggaugguucaaugagcauuaaaaacgaagaagaagaacaaacacuuaccauauuaauuaggacagggcuucuaguuauuucugguguauucccagucucgauaccgaucacggcagccgcuugguaucugugggaaguaaaaaagcaacgagcgggaguguugugggauguccccagcccaccaccgguggaaaaggcugagcuggaagauggugcauauagaauuaaacaaagaggcauauugggguauagccagauuggagcaggaguguacaaagaagggacguuccauacgauguggcaugucacuagaggcgcuguauuaaugcaucgaggaaaacgaauagaaccaucaugggcagacguaaaaaaggaccuuaucucauacgguggcggauggaaacuagaaggagaauggaaagaaggagaagaaguucagguccuugcguuagagccugguaaaaacccaagggcaguccaaaccaaaccagguauuuucaagacgaauacugguacgaucggcgcagugagcuuggauuucaguccgggaacuagugggucaccuaucguagaccgaaaaggaaaagucgucggcuuguacgguaacggggugguuacacgaaguggagcguauguuucggcaauugcucaaacagaaaaaucaauagaagauaaucccgaaauugaggacgacauauucagaaaaaagagauuaaccaucauggauuuacacccaggcgcaggaaaaacuaaaagauaccugccagcaauagucagagaagcaauaaagagagguuuacguacguuaauacuugcgccgacgcggguaguggcggccgaaauggaggaagcacugagaggacuuccaauucgcuaucaaacgacagcuauaaaaaccgagcauaccggucgugagauuguagauuuaaugugccacgccacguucacaaugcgccuuuuaagccccgugcgggucccuaacuauaaucuuaucauaauggaugaagcccacuucaccgacccugcuaguaucgccgcaagggguuauauaucgacccguguagagaugggagaggccgcaggaauauucaugacugcuacgccaccggguucccgcgauccauuuccgcaauccaacgcgcccaucauggaugaagaacgagaaauaccugaacgaagcuggaauucgggucacgagugggugacggauuuuaagggaaaaacuguaugguucguuccgaguauaaaagcuggaaaugauauagccgcaugccugcgaaaaaaugguaagaaaguuauacaauuaucacgaaaaacuuuugauagcgaauauguaaaaacucgugcaaaugauugggacuuuguggugacuacugauauuagcgaaaugggugcuaacuucaaggcugagagaguaauagaucccaggagauguaugaagcccgugauucuuacagauggugaagaaagaguaauuuuggcaggcccaaugccaguaacacacagcucugcugcacaacgacggggacgaauuggacggaaucccaaaaaugaaaaugaucaauacaucuauaugggugagccauuagaaaacgaugaagauugcgcucauuggaaagaagcgaaaaugcuacucgauaauauaaacacuccggaaggcauuauaccgucgauguuugaaccagaaagggaaaaaguagacgcaauagacggcgaauauaggcuacgaggagaagcaaggaagacauuuguagaucuuaugagacgcggagacuuaccaguaugguuagcuuacaaaguugcugccgaagguauaaacuaugccgacagaaaguggugcuucgauggaaucaaaaauaaccagauauuagaggagaacauggaaguagaaauauggacaaaagaaggugaacguaaaaaacuuaaaccaagaugguuagaugcgcgaauauauucagauccccucgcucugaaagaauucaaggaauucgcagcaggaaggaaaucauuaacacuaaaccuuaucacagaaaugggaagauugccaacauucaugacgcagaaagccagaaaugcucucgauaauuuggcuguuuugcauacugcggaagcuggaggcagagcauacaaucaugcauuaucagaacuuccagaaaccuuagaaacauuacuuuuacuaacucuucuagcuacuguuacgggcggcauuuuccucuuucucaugucuggaaagggaauaggcaaaaugacauuaggcaugugcuguauaauaacggcuucuauacuccuuugguaugcacagauucagccacacuggaucgcugcaucaauaauacuagaauuuuuucuaauuguacugcuuauacccgaaccagaaaaacaaagaacaccacaagauaaucaacuaacauauguagugauagcuauacuuacaguaguugcagcuacgauggcaaaugaaaugggauuccuagaaaaaacaaaaaaggaccucggucuugggucaauaacaacacaagagagcgagagcaacauacuagacauagaccuaagaccggccuccgcuuggacuuuauacgcaguugcuacgacacuaguaacuccuauguuaaggcacaguauagaaaauagcucuguuaauguaagcuuaacagcaaucgcaaaccaagcaacaguacuaaugggcuuggggaagggauggccuuuaucaaagauggauauuggagugccacuacuagcuaucgguugcuauucgcaagucaacccgauaacccuuacggcagcucuucuacugcugguagcgcauuaugcgauaauaggaccuggcuuacaagccaaagcaacaagagaggcccaaaaaagagcagcagcggguauaaugaaaaacccaacaguggauggaaucaccguuauugacuuggaaccuauaccguaugauccaaaauuugaaaaacaacuaggucaagucauguuacuaauacugugcguaacgcagguacuaaugaugagaacaacaugggccuugugugaagcuuuaacucuggcaacaggaccaauuucaacacuuugggaaggaaacccuggucgauucuggaauacaacuauagcaguuucuauggcaaacauuuucagagguagcuaucuagcaggagcaggcuuacuauuuucaaucaugaaaaauaccacuaauacucgacgagggacaggaaauauaggugaaaccuuaggcgagaaauggaaaucaagacucaaugcauuagguaaauccgaauuccaaaucuauaaaaaguccgguauucaagaaguagaccguacacuagcaaaagaaggcauaaagaggggagagaccgaccaucacgcuguaucccggggaucagcaaaacuacgaugguuugucgagcguaauaugguaacuccagaaggaaaaguuguugauuuaggcuguggucgaggcggguggucuuacuacugcggaggccuaaaaaauguaagagagguaaaagggcuuacaaaaggggguccaggacaugaagaaccuauaccaaugagcacauacgguuggaacuugguacgguuacaaucugguguagacguauuuuuuacaccaccagaaaaaugcgagacacuguuaugugauaucggagaaagcucuccgaauccaacaauugaagcuggaagaacauuacgaguacuaaaucuaguagaaaauuggcuuaauaacaacacucaguucugcauuaaaguucugaauccauacaugccuaguguaauugaaaaaauggaagcucuucaacgaaaauacgguggugccuuggucaggaauccauugaguagaaacucuacacacgaaauguauuggguuuccaacgcaacgggaaacaucgugaguucaguuaauaugauaucgagaaugcuuaucaauagauuuacuaugaagcacaaaaaagcgacguacgagccagaugucgacuuagguucaggaacccggaauauugguaucgaguccgaaauuccaaaucuggacauuauaggaaaacguauagaaaaaauaaaacaggagcacgaaaccucauggcauuaugaucaagaccacccuuauaagaccugggcguaccaugguagcuaugaaaccaagcaaacggguagugcaucaaguaugguuaauggcgugguacgccuucuuacaaaaccaugggauguagugccaaugguuacgcaaauggcuaugacagacacuacaccauucggacaacagagagucuucaaagaaaaagucgauacuagaacucaggaaccuaaggaggggacaaaaaaauuaaugaagauaaccgcagaaugguuauggaaagagcuggggaagaaaaaaacuccacgcauguguacacgagaagaguucacacgaaagguucguucaaaugccgcauugggagcuaucuuuacugacgaaaacaaauggaaaagugccagagaagcagucgaggacgguagguuuugggaauuaguggaucgugaacggaaucuucaucuugagggcaaaugcgagacaugugucuacaacaugaugggaaaaagagaaaaaaaauuaggcgaauucgggaaggcaaaagggucuagggcgauaugguauauguggcuuggggcacgguuuuuagaguuugaagcucuggguuuccuuaaugaagaucauugguuuucaaggggaaauucgcuaucaggaguagaaggcgaaggccuacacagauuaggauauauacuaagggauguggguaaaaaagaaggcggggcuauguaugcggacgauacugcagguugggauacacguaucacguuagaagaucucaagaacgaagaaaugguuacaaaucauaugaaaggugagcauaaaaaauuagcagaagcaauuuuuaaacugacguaucagaacaaaguaguacguguccagaggccaacgccaagggggacuguaauggauauuaucagccgaagggaccaacgagguagcggucaaguaggaacauacgggcucaauacauuuacuaauauggaagcgcaacuaauacgccaaauggaaggugagggcauauuuaaaagcauucagcaucuaacagcgacagaggaaauagcuguacaaaauugguuagcgagaguagggagagagagauuaucaagaauggcgauaaguggagaugacuguguaguaaaaccaauagacgaucgauuugccagcgcccuaacugcguuaaaugauauggguaaaauuaggaaagacauucaacaaugggaaccuagucgagguuggaaugacuggacucaaguaccuuucuguucucaccauuuccaugaacugguaaugaaagaugggcgcguucuaguagucccgugucgaaaucaagaugaauugaucggcagggcaagaauaucacaaggugccgguuggagcuuaaaagaaacggcuuguuugggaaagucguacgcacaaauguggacucugauguauuuucauagaagagacuuaaggcucgcagcuaaugcuauauguucggccgugccuucacacugggugccuacaucaagaaccacauggucaauccaugcuaaacacgaguggaugacuacugaggauaugcucgcuguguggaauagagucuggauacaagaaaaucccuggauggaagauaaaacuccuguagaauccugggaagaagugccuuauuuaggaaaacgagaggaucaauggugugguucuuugaucggacuuacuucaagagcaacgugggcaaaaaauauccaaaccgccauuaaccagguccggucacucauaggaaaugaggaauacacugauuauaugccauccaugaaacgauuucgaagagaagaagaagaagcagguguauuaugguaa

SEQ ID NO: 22469 - RNA, 9876 nt, Artificial Sequence
  derived and/or modified CDS sequence (opt6) from DENV-2__EU482766__SS-prME
accgccgguguuauuguaaugcuaauuccaacggcuauggccuuucaucuaacaacuagaaacggugagccacacaugaucguaggaagacaagaaaaaggcaagucucuacuauuuaagacagaggauggggucaauaugugcacuuugauggcuauugaucuuggagaacuaugugaggauacgauaacguauaaaugcccauuacucagacaaaaugagccugaggauauagacuguugguguaacagcacaucaaccugggugaccuacgggacaugcaccacaaccggggaacaccgccgugaaaagagaucaguugcacucguaccacacgucggcauggggcucgaaacucgaacagaaacauggaugagcagugaaggggcguggaaacauguucaacgaauugaaaccuggauauuaagacacccaggauucacaauaauggcugccauauuggcuuacacgauagggacgacacauuuucaacgagccuugauuuucauucuacugacugcaguggcucccagcaugacuaugagaugcauaggaauuaguaaccgcgauuuuguggaaggaguaucaggaggguccuggguagauaucguacuagaacauggcucaugcguaacaacaauggcuaaaaauaaaccaaccuuagauuucgaauuaaucaaaacagaggcaaaacaacccgcuaccuugagaaaauacuguauugaagcuaaacuuaccaacacaacuacggaaaguagauguccgacacagggagaaccaagucuaaacgaagaacaagauaagcguuucauaugcaaacacucaaugguugaucgaggaugggggaacggcugcgguuuauuugggaaagggggaaucgugacgugcgcuauguucacuuguaaaaaaaauauggaaggaaaaguagugcagccugaaaaucucgaauacaccauaguuauaacaccucauucuggcgaagaacaugcaguuggcaaugacaccgguaaacacggaaaagaaaucaaaauuaccccgcaaagcagcauaaccgaagccgaauuaaccggguacggaacaguuacaauggaauguagcagcagaaccggacucgacuuuaacgaaauggugcuucuacaaauggaggacaaagccuggcuaguacauagacaaugguuccuugacuuaccuuuaccguggcuaccuggugcugacacacaaggaucaaauuggauacaaaaagagacacuaguaacuuuuaaaaauccccaugcuaaaaaacaagauguagucguguuaggaagucaagaaggagcaaugcauacagcauuaaccggcgcuacggaaauacaaaugucgucaggaaacuuacucuucacgggucauuugaaaugucgauuacgaauggacaaacugcaacuaaaaggaauguccuacaguaugugcacagguaaauucaaaauagugaaggaaaucgcggaaacacaacauggaacuauugugauacgggugcaauaugaaggagaugggucgccuuguaagauccccuuugaaauaaccgacuuagaaaaaagacauguacucggcagguugauaaccgugaacccaauugugacugagaaggauaguccaguuaacauagaagcggaaccaccuuucggggacaguuauauaauuauuggcguagaaccgggucaauuaaagcuaaauugguucaagaaaggaaguaguaucggacaaauguuugagaccacuaugagaggagcaaaaagaauggccauucugggagauaccgccugggacuuuggcucucugggaggagucuucacguccaucgguaaagcacuacaccaaguuuucggagcaauuuauggugccgcauucucuggugucucuuggacaaugaaaauauugaucggggucauaauaacguggauuggaaugaacucgagaagcacaucacuaucaguaucauugguacucguugguguuguaacccuguaccugggagccguggugcaagcggauaguggauguguugugagcuggaaaaauaaggaacugaagugcggaucgggaauauuuauaacggauaauguccauaccuggacugaacaauauaaauuucaaccugaauccccuucuaaauuagcgucagcaauacaaaaagcacaugaggaaggcauauguggaauacgaucagugaccagacuagaaaauuuaauguggaaacaaaucacaccagaguuaaaucacauacuguccgaaaaugaaguaaaauugacgauuaugacaggagauauuaaagggaucaugcaagcuggaaagcgaagucuacgaccacaaccaacugaauuaaaguacucuuggaaaacaugggguaaagccaagauguuaucuacugaaagccauaaucagaccuuuuugauugauggaccggagacggcagaaugcccuaauaccaaucgagccuggaauagcuuggaaguggaagacuacggauuuggcguuuuuacgaccaauauauggcuuaaguuaagagaaaaacaagacgucuuuugcgacucuaaacucaugucugcggcgaucaaagacaaccgcgcuguccaugcugauauggguuauuggauagagucggcccuuaaugacacauggaaaauggagaaagccaguuucauagaagucaaaaguugccauuggccuaaaucacauacauuauggaguaacggugugcuagaauccgaaaugaucauacccaagaacuucgcaggaccuguaucacaacacaacuaccguccaggauaucauacucaaacggcaggaccauggcaccucgggaagcuggaaauggauuuugauuucugugaagguacgacggucguuguuacugaggauuguggaaaccguggcccuagucuacgcacaacgacagccucgggaaagcuuauaaccgaguggugcuguagaagcuguacauuaccgccauugcgauaccguggagaagacggauguugguauggcauggaaauaaggccauuaaaagagaaagaagaaaaucucguaaacucauuaguuacagcagggcacggucaaauagacaauuuuucucugggaguacucgggauggcgcuauucuuagaagaaauguugagaacaagaauaggcacgaaacaugcaaucuuauugguagcugucagcuuuguuacucuuaucacagguaauaugagcuuuagagaucuuggcagagugauggucaugguuggagcaacuaugacugacgauauagguaugggggugaccuacuuggcccuguuagcagcauuuaagguccgcccuacauuugcugccgggcuauuguuaagaaaacugacaagcaaagaacuaaugauggcuacgauuggaauagcacuauuaucgcaaaguacaauaccagagacgauuuuggaguuaacugacgcccuagcccuagguaugaugguacuaaagauagucagaaauauggaaaaauaccaguuagcaguuacuauaauggcaauuucauguguaccuaacgcggucauccuucaaaacgcuuggaaaguaucuuguacaauucuagcagccguuagcgugucaccucuguuguuaacaucaucacaacaaaaagcggacuggauaccccuagcauugacaauaaaagggcuuaaccccacagcuaucuuccuaacaacucuaucacgaacuagcaaaaagagaagcuggcccuuaaacgaagcaauaauggcaguggggaugguaaguauucuagccuccucguuauuaaaaaaugacauuccuaugacaggaccuuuggucgcugguggacuguuaacgguauguuacguauuaacugguaggagcgcagaucuagaauuagaacgagcugcagauguaaaaugggaagaucaagcagaaaucucuggaucgaguccgauucuuucaauaacuauuagugaagacgggucaaugucaauaaaaaacgaagaagaagaacaaacucuuacuauacucauuagaacuggucuucuagugauaagcggaguguuucccguuuccauuccaaucacagcagccgccugguacuugugggagguaaaaaagcaacgugccgguguauuaugggacguaccaaguccaccaccaguugaaaaagcggaacucgaggauggggcauaucgaaucaaacaaagaggaauacuggguuauucccaaaucggugccgguguuuauaaagaagguacuuuucacacaauguggcaugucacccguggagcgguauuaaugcacagagggaaaagaauagaaccaaguugggcagacgugaagaaagauuuaauaucuuauggaggagguuggaaacuagagggagaauggaaagagggcgaagaaguacaaguacuugcauuagaacccgguaaaaaucccagagcggugcaaaccaaaccaggaauuuucaagacaaacacaggcaccauuggagcgguaagucuugauuuuuccccugggacgaguggaucccccauaguagaccguaaaggaaagguggucggacuuuauggaaauggaguaguuacaagaagcggagcuuauguauccgcaaucgcacaaacagaaaagucuaucgaagacaauccugagauagaggacgacauauuucgaaaaaaaagauugacaauaauggaucuacacccuggagcugguaaaacaaaaagauacuuaccugcaaucgugcgagaagccauaaaacgaggguuacgaacccuaaucuuggcgccgacuagaguaguagcugcagaaauggaagaggcauuaagaggauuaccuaucagauaucagacaccugccaucaaaaccgagcacacaggacgagagauaguagaucuaaugugucacgcgacauucacaaugcgacuucuuagcccgguacgugugccaaauuacaaucucauuaucauggaugaagcgcauuucacagacccagcgagcauagcagccaggggauauaucuccacacgaguagaaaugggugaagcagccggaauauucaugaccgcaacuccaccagguucacgggaccccuucccucagagcaaugcuccuauaauggaugaagaaagagaaauacccgaacgaucguggaacucaggacaugaguggguaacagauuucaaagggaaaacaguuugguucgucccuucgauuaaggcagguaaugacauugcagcauguuugagaaaaaaugggaaaaaagugauacaacugagucggaagacauucgauucagaguaugucaaaacuagggcaaaugauugggauuuuguagucacaacagauauauccgaaaugggagccaacuuuaaggcugaaaggguuauagauccccggagauguaugaagccuguaauauuaacggacggagaagagcgggucauucucgcaggaccgaugccaguuacacacucuagcgcggcacagagaagagguagaauaggcagaaauccgaagaaugaaaaugaucaguauauuuacaugggggaaccguuggagaacgaugaagauugugcgcacuggaaagaggcaaagaugcuucuagauaacauaaacacgcccgaagguaucauuccuucgauguuugaaccagagcgugaaaaaguugacgcaauugacggagaauaucgacuaaggggggaggcacgcaaaacauuuguugacuuaaugcguagaggagaccuaccgguaugguuggcauauaaaguagcagccgaaggaauaaacuaugccgacaggaaguggugcuucgaugggauaaaaaacaaucaaauacuggaggaaaauauggaaguugaaauuuggacgaaggaaggagaaagaaaaaagcuaaaaccgcgcugguuagacgcacgaauauauucagacccuuuggcauugaaggaauuuaaagaauuugcagccggucgcaaaucucuuacauuaaaccuaauaacagaaaugggccgucuucccaccuucaugacccaaaaagcacgaaacgcgcuggauaaccuagcaguuuuacauacggcagaagcuggcggacgugcauacaaucaugcauuaucugaguuaccagaaacacuagagacguuauuacugcucacccuacuagcgaccguaacuggaggaauuuuucuauuccugaugucaggaaagggcaucgguaaaaugacgcuaggcauguguugcauaauuacugcaucaauacucuuaugguaugcucaaauucagccucauuggaucgcggcaucuauuauucuggaauucuuucuuaucguauuacuaauuccugagccggaaaaacagaggacuccucaagacaaccaauuaacauauguaguaaucgcgauuuuaaccguuguagcagcaacgauggcuaaugaaaugggauuucuagagaaaacgaaaaaggaccugggcuuaggcaguauaaccacgcaagaaagcgaaaguaacaucuuggacauagaucucagacccgcaucagcauggacacuuuaugcaguagcuacaacuuucguaacuccgauguugcgacacagcauugaaaauucaucagugaauguuucgcuaaccgccauagccaaucaagcgacuguucuaaugggucucgguaagggguggccuuugucgaaaauggacauuggaguacccuuacuugccauagguugcuauucccaagugaaccccaucacacugacagcagcauuacugcuauuaguagcacauuaugcuauaauuggcccuggacuucaggcaaaagcaaccagagaagcacagaaaagggcagcagcuggaauaaugaagaauccgacaguagaugguauaacagugauugaucuggaaccaauaccauaugauccgaaguucgagaaacaauuaggacaggucaugcuauugauacuaugugugacgcaaguacucaugaugcggacaaccugggcauuaugcgaagcacugaccuuagcuacggggccaauaaguacacugugggaaggcaauccaggaagauucuggaauacuacaauagccguauccauggcaaacauauuucgaggcucuuaccucgcaggugcaggauuauuauuuuccauuaugaaaaauacaacauccacucgaagggguacaggcaauauuggggaaacucuaggugaaaaguggaagucacgauuaaaugcauuagguaaaucagaauuccaaauauacaagaaaucugggauacaagaaguagaucgaacguuagcaaaagaagguauuaaaagaggggaaacggaucaucacgccguaagccguggaucagccaagcuaagaugguuuguagagcggaauaugguaacaccagaaggaaaaguaguagauuuagguuguggacgcggcgguuggaguuacuacugcggagguuuaaaaaacguaagagaaguaaaaggguuaacaaaaggggggcccggacaugaggaaccaauaccaaugagcacauacgguuggaauuuaguccgacuucaaucagguguagaugucuucuucacaccucccgaaaaaugugacacacuucuaugugacauaggcgagucaucuccuaacccuacaauagaagcgggacguacacuaagaguacuuaauuuagucgaaaauugguuaaauaauaauacacaguuuuguauuaagguccuaaauccuuauaugccgaguguaauagaaaaaauggaggcacugcagagacaauacggcggggcccuaguuagaaauccauuaucaagaaauaguacgcaugagauguacuggguuaguaacgcgacaggcaauauuguuucuucaguaaauaugauaagucgaaugcuaauaaaccgauucaccaugaagcacaaaaaagcgacauacgaaccagaugucgacuuaggauccgguacaagaaauauaggaauugaaucggagauuccaaaucuggacauaaucggaaaacgaauagaaaaaauaaaacaggaacacgaaauaagcuggcauuaugaucaagaucauccauacaaaacgugggcauaucacggaucauaugagacaaagcagacuggaucagcuaguaguaugguaaacggcguuguuagacuauugacaaaaccgugggacgugguaccgaugguaacacaaauggccaugacagauacuaccccauuuggucaacaacgcguuuucaaagaaaagguugacacuaggacacaagagccaaaggaaggcaccaaaaaauuaaugaaaaucacagcugaaugguuauggaaagaacucgggaagaaaaaaacaccaagaauguguacaagggaagaauucacuagaaagguaagauccaaugcagcacugggagcaauuuuuacagaugagaauaaauggaaaucagcacgugaggcaguugaggacgguagauucugggaguuggucgacagagagagaaauuuacacuuagaaggcaaaugcgagacaugcgucuacaauaugauggguaaacgcgaaaaaaaauuaggugaauucgggaaggcaaaaggaaguagagcuauuugguauaugugguugggagcaagauuucuugaauucgaagcacugggauuucuaaacgaagaccacugguucucacgcgguaacucucuauccggcguggaaggagagggacuacauagacucgguuauauccugcgagauguagguaaaaaagaaggcggagccauguaugcagacgacacagcaggcugggauaccagaaucacauuggaggaucuaaaaaaugaagaaauggucaccaaccauaugaaaggugagcauaaaaaauuagcagaagcgauauucaaauugacauaccaaaauaagguaguaagaguccaaagaccgacuccaagaggaacgguuauggacauaauaucaagacgagaccagcgagguucuggacaaguugguacuuauggccuaaauaccuucacaaauauggaagcucaacuuauucgccaaauggaaggugaagguauauuuaaauccauacaacaccuaacugcaacagaggaaauugcuguucaaaacugguuggcuagagugggccgagaaagacuuagcaggauggcuauaucaggggacgauugcgucguaaaaccaauagaugacagauucgcaucugcacugacagcgcuuaacgacauggguaaaguacgaaaagacauucaacaaugggaacccaguagagguuggaacgauuggacgcaaguaccauuuuguucccaucauuuucaugaauugguaaugaaagauggccguguauuaguugugccaugcaggaaucaagaugaauugauaggucgugccagaauaagccaaggagcagguuggagucuaaaagagacagcuuguuuaggcaaguccuacgcccaaauguggacucuaauguauuuucaucggcgugauuuaagauuagcagcgaaugcuauauguucggcaguaccaucucauuggguaccgaccagucgcacuacuuggucaauacacgcaaaacaugaauggaugacuacugaagacaugcuugcaguauggaaucggguauggauacaagaaaacccguggauggaagacaaaacuccagucgaaaguugggaggaaguaccauaucuugguaaaagagaagaccaauggugugggucccucauaggucuaacuuccagagcuaccugggcaaagaacauacaaacugcuaucaaccaaguacgaucccucauagguaacgaagaauauacggauuauaugccgucgaugaaaagauucagacgugaagaagaggaagcaggcguacuuugguga

SEQ ID NO: 22470 - RNA, 9876 nt, Artificial Sequence
  derived and/or modified CDS sequence (opt6) from DENV-2__EU482695__SS-prME
acugcaggcguuaucguuaugcuuauuccuaccgcaauggcauuucacuuaaccacacgcaauggagagccucauaugauuguugggcgacaagaaaagggaaaaucccuacucuuuaaaacagaagacggggugaauaugugcacauuaauggcaauagaccugggcgaauuaugcgaagacacaaucacauauaaauguccacuauuaagacaaaaugaaccggaagauauugacugcuggugcaauaguacuaguacauggguuaccuauggaacuuguacaacaacaggagaacaccggagggaaaaacggaguguggcauuagugccucacguagguaugggucuagaaaccaggacagaaacauggauguccucugaaggagcauggaaacauguucagagaauagaaaccuggauacugagacauccuggauuuaccauuauggccgcaauuuuagcauauacaaucggaaccacgcauuuucaaagagcacuaaucuuuauauuauugacggcgguggcaccuucgaugacaaugcgcuguauaggcauaaguaacagagauuuuguagaagggguaagcgggggaucauggguagauauaguacuggaacacgguucuugcguaacaacuauggcaaaaaacaaaccuacacuagauuucgaacuuauaaagacugaagcuaaacagccugcaacacucagaaaauauugcauagaagcuaaauugaccaacacuacgacggaaagccguuguccaacacagggagaaccgagucuuaaugaagaacaggauaaacguuuuaucugcaaacauagcaugguugauagagguugggggaauggauguggauuguuuggcaaaggagggauuguuaccugcgccauguuuacguguaaaaaaaacauggaggguaaaguugugcaaccugagaauuuggaauacacaaucguuauuacuccccauucaggugaagaacacgccguagguaaugauaccgguaaacauggcaaagagauaaagaucacaccacagucgucaauuacggaggcggaacuaacaggguauggaaccgucacaauggaauguucacccagaacgggcuuagacuucaacgaaaugguauuacuccaaauggaggacaaagcauggcuugugcaucgacagugguuuuuagacuugcccuuaccuuggcuaccaggcgcagacacucaagguagcaacuggauacaaaaggaaacguuaguaacuuuuaaaaauccccaugcaaagaaacaagauguaguuguauuaggcagccaggaaggugcuaugcacacggcauuaacaggagccacugagauucaaaugucuucagguaaucuauuauucaccggccaucuuaaaugccgguuaagaauggauaagcuucaauuaaaagguaugucuuauagcauguguacuggaaaauuuaaaaucgugaaagaaauagcugaaacacagcacggcaccauaguaauucgugugcaauacgaaggugacggaucaccuuguaaaauaccguuugaaaucaccgauuuagaaaaaagacauguauugggacguuugauuacuguuaacccaauaguaacugaaaaggacagccccguaaauaucgaagcagaaccaccauuuggcgauucauauauuauaauaggagucgaaccuggacaauuaaaauuaaacugguucaaaaaaggaaguucaaucggccaaauguucgaaacuacaaugcguggggcuaaaagaauggcaaucuugggagacacagccugggacuucggaucucuagggggaguauuuacaagcauuggaaaagcguuacaucaagucuucggagcgaucuauggagcagccuucucaggcguaagcuggacaaugaagauauuaaucggaguaaucaucacuuggauaggaaugaauucgcguaguacaagucuauccgucucacuaguguuaguuggcguuguaacgcuauaucuaggagcaaugguacaagcugacucaggcugugugguaaguuggaaaaauaaagaacuuaaauguggguccggcauauuuauaacggauaacguacauacauggacugaacaguauaaauuccagccggagucaccaucaaaguuagccucggcaauccagaaagcgcaugaagaaggcaucuguggcauacggagcguuacuagacuugaaaaccuaauguggaaacaaauuaccccagaguuaaaccacauacucagugagaacgaggugaaacuaacaaucaugacuggggauauacgagggauaaugcaggcuggaaagcguucacuaagaccccagccaacggaacuaaaguacucguggaagacguggggaaaggccaaaauguuaucuaccgaaucacauaaucaaacauuucugaucgauggcccagaaacagcagaaugccccaauaccaacagagcguggaauagcuuggaggucgaagauuacgguuucgguguuuucaccacaaauauuuggcuaaaacuacgggaaaagcaagauguuuuuugugacucaaaacuuaugucagcugcaauaaaggacaaccgagccgugcaugcagacaugggauauuggaucgaaagugcauuaaacgauacauggaagauggaaaaagcuuccuuuauugaaguaaaaucaugucacuggccaaaaucgcauacuuuauggucaaacggagugcuagaaucagaaaugauaaucccgaagaauuuugcaggcccggugucgcaacauaauuaccggccaggauaccauacccaaacagcgggaccuuggcauuuaggaaaauuagagauggacuuugacuuaugugaaggaacgaccgucgucgugaccgaagauugugguaaccguggaccuucacuacgaacaacaaccgcaucugggaaacuuauaacugaaugguguugcagaucguguaccuuaccaccccuucgauaccguggagaagacggcuguugguauggcauggaaauaagaccuuuaaaagaaaaggaagaaaaucuuguaaauucauugguuacugccggccauggucaaauugauaauuuuucacuugguguuuuagguauggcuuuauuuuuagaagaaauguuacggacaagaaucgggacgaagcaugcuauucuauugguugcugucucuuuuguaacuuuaauaacuggaaauauguccuuccgggauuuagguagggucaugguaauggucggcgccaccaugaccgaugauauaggaaugggcguaacauaccuagcuuuauuggccgcguuuaaaguccgcccaacguuugcugccggccuacuuuuacgaaaacuuacgucgaaagaacuuaugauggccaccauugguauugcucuacuaagccagaguacaauaccagaaacgauacuugaacugaccgaugcauuagcauugggaaugauggucuugaagaucguuagaaacauggagaaauaccaguuagccguuacaaucauggcuaucagcugcguaccaaaugcugucauacuacaaaacgcauggaaagucucuuguacaauauuagcggccguuucaguuucaccccuacuccucacaaguagccagcagaaagcagauuggaucccauuagcauuaacuauaaagggucuaaaccccaccgcaauauuucuaacuacacuuucaagaaccucaaaaaagagaagcuggccauuaaaugaagcuauuauggcgguuggaaugguaucuauucuagcaucuaguuuauuaaaaaaugacauuccuaugacaggucccuuaguggcaggaggacuucuuacgguauguuauguacugacagguagaagcgcugaucuggaacuugaaagagcagccgacgugaagugggaggaccaagcggaaauaagcgguaguucgccgauauugaguauaacuauaucagaagacggaucuaugucaaucaaaaacgaagaagaggagcaaacacuaacaauacuaaucagaacaggucuccuaguuauuucagguguauuuccuguaagcauaccaauuacugcagccgcaugguauuuaugggaaguaaagaaacaaagagcgggugugcuaugggauguuccgucuccaccgccgguugaaaaagcggaauuggaagauggugcuuacaggauuaaacagcgaggcaucuugggguauucgcaaauaggugcagggguuuauaaagagggaaccuuucauacaauguggcauguaacucgaggggccguacucaugcaucguggaaagcguauugaaccuucaugggcagacguuaagaaagaccuaauuucuuauggaggcggauggaagcuagagggggaguggaaagaaggagaagaaguccaaguuuuggcccuggaaccaggaaaaaacccaagagcagugcaaacgaaaccaggaauauucaaaacaaauacaggcacaauuggggcgguuucacuugauuucaguccugguacaaguggaaguccaauuguugauagaaaagggaaaguuguuggucuauauggaaauggaguaguaacaagguccggggccuaugugucggcaauagcucaaacagaaaaaaguauagaagacaacccggagauagaagaugauaucuucagaaaaaagcgccuaacaauaauggaucuacauccuggcgcaggaaaaaccaaacgauaccuaccagccauuguucgagaagcaauaaaacggggacuaagaacgcucauccuagcgcccacccgugucguagcagccgagauggaggaagcucucaggggguugccaauccgauaucaaacaacugccauaaaaacagaacauacaggacgagaaauuguugaucugaugugucaugcaacauuuacaaugaggcuucugagccccguuagaguaccuaauuacaaccucauaauuauggaugaagcccauuucaccgaucccgcgaguauugcagcgcgagguuauaucagcaccagaguggagaugggugaggcagcugguauuuucaugacagcuacgcccccggggucucgugauccauuuccucaaucaaacgccccuauaauggaugaagaaagagaaauucccgaaagauccuggaacuccggacaugaauggguaaccgacuuuaaggggaaaacaguaugguucgucccaaguaucaaagcaggaaaugacauugcagcgugccuaagaaaaaaugguaaaaaaguuauacaauuaaguaggaagacauucgauagugaauauguaaaaacacgagcuaaugauugggacuuuguuguaacaacagauauuagcgaaaugggagcuaauuucaaagcggagagagucauagauccaagaagguguaugaaacccgugauucuuacggauggagaagaaagagucauauuagcaggaccaaugccggucacacacuccucagcugcucaacggcgaggacgaauaggccgaaauccuaagaaugagaacgaccaguauauauacaugggcgaaccauuagaaaacgacgaagauugugcccauuggaaagaagcgaaaaugcucuuagauaauauuaauacaccagaaggaauaauucccucaauguucgaaccagaacgagagaaaguugacgcaauagauggagaauaccgccuaagaggagaagcucguaaaacauucguagaccugaugcgaagaggugauuuaccuguguggcuagcuuacaaaguugccgcagaaggaauaaacuacgccgauagaaaauggugcuuugacgguauaaaaaauaaucaaauauuagaagaaaacauggaagucgaaauauggaccaaggaaggggaaaggaaaaaacuuaaaccccgcugguuggaugcucgaauauauuccgacccccuagcacucaaagaauuuaaggaauuugcagcaggaagaaaaagucugacucuaaauuuaauuacagaaauggggagacucccaacuuuuaugacgcaaaaagcacguaacgcacuugacaaucuugcgguauuacauaccgcagaagcaggcggaagggccuauaaucacgcccuuucagaauugccagaaacguuagaaacauuauuauuacuuacguuacuagccaccguuaccggcgggauauucuuauuccugaugucugguaaaggaauuggcaaaaugacuuugggaauguguugcauuauuacugccagcauccuuuugugguacgcucaaauucagccgcauuggauagcugcaucaauaauucucgaguucuuucuuauaguccucuuaauaccugaaccagaaaaacaaagaacuccacaagauaaucaauuaacauaugugguuauagccauuuuaacagucguagcagcuacaauggcaaacgagaugggcuuccucgaaaagacgaagaaggauuuaggacucggcaguauaacaacacaagaaagcgagucuaacauuuuggauauagauuugaggccugcuagugcguggacacuauaugccguagcaacuacuuuuguaacaccaauguugaggcacuccauugaaaauucuucggugaacguaaguuugacugccauugcuaaccaagccacaguccuaaugggacugggcaagggguggccccuaucaaagauggauaucggcgucccacuccucgcuauuggauguuacucucaaguuaacccgauuacauugaccgcugcccuccugcuacugguugcgcauuacgcaauaauagguccggguuuacaagcaaaagcgacacgcgaagcccaaaaaagagcagcagcuggaauuaugaaaaacccaacaguagaugguauuacaguuauugauuuagaaccgauaccuuacgauccaaaauuugaaaaacaacuagggcaggugauguuauuaauuuuaugugucacucagguacuaaugaugagaacaacaugggcucuaugugaggcacuaacccucgcgacaggucccaucaguaccuuaugggagggaaacccagggagauucuggaacaccacaauagccguuucaauggcaaacauuuucaggggaaguuacuuagcaggugcugguuuacuauuuagcauaaugaagaacacaacaaacacaagaagaggaaccggaaacauaggagaaaccuugggcgaaaaauggaagagucgguuaaaugcgcuaggcaaaucggaguuccaaauuuacaagaaauccgggauucaagaaguagaucgaacucuugccaaggaagggauaaaaagaggggagacugaccaccacgcggucucgcgagguagugcaaaauuaagaugguucguugaaagaaauaugguuacaccagaagggaaagugguagauuuaggcugcgggaggggaggguggucauauuacuguggaggucuaaaaaauguaagagagguaaaaggcuugacuaaaggaggccccggucacgaagaaccuauccccaugucgacguacggauggaaucuuguuagacugcaaaguggaguagacguuuuuuuuacgccaccagaaaaaugcgauacauuauuaugugacauaggggaaagcucgccuaaccccacaaucgaggcuggacggacauuaagaguacucaaccucgucgaaaauuggcugaacaacaauacacaguucugcauaaagguccugaauccauacaugccgagugucauugaaaaaauggaagcauugcaaaggaaguaugggggagcacuaguacgcaaccccuuaagcagaaauucaacacaugaaauguauuggguaaguaacgcaacugggaacauaguaucauccguuaauaugauuaguagaaugcucauaaacagauuuacaaugaaacauaaaaaggcgacauaugaaccugacguggaccuggguucgggcacacgaaauaucggaauugaaucugaaaucccuaaucuagauauaauaggaaagcgcaucgaaaaaauaaaacaagaacaugagacuaguuggcacuacgaucaagaucauccauauaaaacaugggcauaccauggaucguacgagacaaagcaaacaggaucggcgucuucaaugguaaacgguguugugagauuacuuacaaaaccaugggaugucguuccuaugguuacacagauggcaaugacagauaccacucccuuuggacaacaaagaguguuuaaagagaaagucgacacacgaacacaagagccaaaagaaggaacaaaaaaacuuaugaaaauaacugcggaauggcuauggaaggaguuaggcaaaaaaaaaacacccaggauguguacaagagaggaguuuacuagaaaaguacggucaaaugccgcguugggcgcaauauuuacagacgaaaacaaguggaaaagcgcccgcgaagcugucgaagaugggagauucugggaguuaguagaccgugaacgcaaucuucaucuagaaggcaaaugcgaaaccugcguuuauaacaugaugggaaaacgggagaaaaaguuaggagaauuuggaaaagcaaaaggaagucgcgcgauaugguauauguggcuaggugcgagauuuuuagaauuugaggccuuagguuuucuuaacgaagaccacugguuuucuagaggcaacucauuaucggggguagaaggagaaggauugcaccgacuuggauauauccuaagagacguggguaaaaaagaggggggagcgauguaugcagaugacaccgccggaugggacacacgaauuacucuagaggacuuaaagaacgaagaaauggugacuaaucauaugaaaggagaacacaaaaaacuagcggaagccauuuuuaaacuuacguaccaaaacaaagugguucgggugcaaagaccuacgccgaggggaacugucauggacaucauaucucgccgagaccaaagggguucgggccaaguaggaacauacggucuaaauaccuuuacaaauauggaagcucaauuaaucagacaaauggaaggagagggaauauuuaaaucuauccaacaccucacagcgacugaggaaauagcaguucaaaacugguuagcaagggugggacgcgaacguuuaucacggauggcgauaaguggugacgauuguguuguuaaaccaauugaugaccgcuucgcaagugcgcuaacagcauugaacgacauggguaaaguacggaaagacauccaacaaugggagccaucucgugguuggaaugauuggacucaagucccauucuguagucaucauuuucacgaauugguuaugaaggacgggagaguguugguuguuccauguagaaaucaagacgaacugauaggaagagcacguauuagccagggagcaggauggucuuuaaaggaaacggcuugccuuggaaagaguuaugcucaaauguggacauuaauguauuuccaccgacgugaucuccgucucgccgcaaacgcaauauguagugcgguaccaucacauugggucccaacgagccgcacuacuuggucuauccaugcaaaacacgaauggaugacaacugaagacauguuagcaguuuggaacagaguauggauacaggaaaacccauggauggaggacaaaacuccuguagaaucaugggaagaggucccguaucuagguaagcgugaagaucaauggugcggcucucugaucggauuaacaucaagagcaacaugggcuaaaaauauucaaacggcuauuaaccagguucgaucccucauagggaaugaagaauauaccgacuacaugccuucaaugaaaagauuucgcagagaagaagaagaagccggcguguugugguaa

SEQ ID NO: 22471 - RNA, 9876 nt, Artificial Sequence
  derived and/or modified CDS sequence (opt6) from DENV-2__EU482769__SS-prME
acggcgggaguaauaguaaugcuaauuccgacugcaauggccuuucaccuuacuacucgaaauggggaaccacauaugauaguaggacgucaggaaaaaggaaaaagucuccuguucaaaaccgaagauggaguaaauauguguacacuaauggcaauugaucucggagaacuuugugaagauacgauaaccuauaaaugcccacuuuugagacagaacgaaccagaagauaucgauuguuggugcaacuccacuucgacgugggugacuuacggaacgugcaccaccacaggggaacaccgaagagaaaaacgcucuguagcgcucguaccgcauguuggaaugggauuggaaacuagaacagaaacguggaugagcucugaaggagcauggaaacacguacaacgaauagaaacauggaucuuaagacauccggguuucacaaucauggcagcaauacuggcguacacgauaggaacaacucacuuucaaagggcccuaaucuucauucuacuaacggcaguagcaccaucaaugacaaugaggugcauagguaucucuaaccgcgacuuuguggaaggcguuucaggagguucguggguagauauaguccuagaacaugggucauguguaacuacaauggcgaaaaauaaaccaacgcuugacuuugaauuaaucaaaacugaagcaaaacaaccagcaacauuaagaaaauacugcauagaagcaaaauuaaccaauacgacaaccgagucaaggugcccaacacaaggagaaccaucccuaaacgaggaacaggauaaaagauucauuuguaaacauucaaugguugaucguggauggggaaaugguugcggguuauucgggaaaggcggcauuguaacgugugcuauguuuacuugcaagaaaaauauggaaggaaaaguaguacaaccugaaaauuuggaguauacgauaguaauaacaccacacagcggggaagaacaugcagucgggaacgauaccgguaaacaugguaaagagauaaaaauuacaccucaaagcucaaucacagaagcagaauuaacaggauauggcacaguaacaauggaguguucuccuaggacuggucucgauuucaacgaaauggugcuauugcaaauggaggacaaggcuugguuaguacauaggcagugguuuuuagauuuaccauuaccuugguuaccuggugcugauacacaaggcucgaauuggauccagaaagaaacacuuguuacauucaaaaauccgcacgccaagaaacaggauguuguaguucugggaucccaggaaggugcaaugcacacagcacuaacaggggcuacggaaauucagaugucuucaggaaaucuacuauuuacaggacacuuaaaaugucgacuacgaauggacaaacugcaauuaaaagggaugaguuacaguaugugcacagguaaauucaaaauaguaaaagaaauagccgaaacacagcacggaacaauaguaauaagaguccaguaugagggcgacgguucgccuuguaaaauaccauucgagaucacugaccuagaaaaacgucacgucuuaggucgucuaaucacaguuaacccgauuguaacugaaaaagacagcccuguaaauauagaagccgagccgccauuuggagauaguuacauuauaaucgguguagaaccgggacaacuaaaacugaauugguucaagaaaggaucgaguaucgggcaaauguuugaaaccacgaugaggggcgccaaaagaauggccauuuuaggagauacggcaugggacuucggguccuugggcggaguguuuacaaguauagguaaagcauuacaucaaguauuuggggcaauuuauggagcagcuuucucuggagugucauggaccaugaaaauauugauagggguuauuauaacuuggauuggcaugaacucaagaucaaccagucuaucaguaucgcuuguacuugucgguguaguaacauuauauuuaggcgcgaugguucaagcugacucgggcuguguagucucauggaaaaauaaagaauuaaaaugugguucgggaauauucaucaccgauaauguccacaccuggacugaacaauacaaauuucagccagagucuccaaguaaacuagcaucagccauacaaaaagcacacgaagaagggauaugcgguauaagaagcguaacuagacucgaaaaucugauguggaaacaaauaacaccugaacuuaaccauauauuaucagaaaaugaaguaaaacuaacuauaaugacgggggauauucguggaaucaugcaagcaggaaaacguucauugcgaccacagccaaccgaacuaaaauacucuuggaaaacauggggaaaagcuaaaaugcuaucgaccgaaagucauaaccaaacauuucuaauagaugguccugagacugcagaaugccccaacacaaauagagcuuggaacagccuagaaguggaagauuauggcuuuggcguuuucacaacaaauauuuggcucaaauuaagggagaaacaagaugucuuuugugauucaaaacuaaugucggcagcaauaaaagacaaucgagcgguucacgccgauaugggguauuggauugaaagugcacucaaugauacuuggaaaauggaaaaagcaucuuuuauagagguaaaaucaugucacuggccuaaaagccacacuuuauggaguaacgguguucucgagagugagaugaucauaccuaaaaauuuugcaggcccaguaucccagcauaauuacagaccaggauaucacacucagacugccggaccauggcaucuuggcaaacucgaaauggauuucgacuugugcgaaggcacuacgguuguuguaacugaggacugcgguaauagaggcccaagccuacgcacaacaacagcauccgggaaguuaaucaccgagugguguugucguaguugcacgcuuccaccucugagauacagaggggaagacggauguugguacggaauggagauacguccucuuaaggagaaagaagaaaacuuaguaaacagcuuagucacagcaggucacgggcaaaucgacaauuuuucccucggagugcuaggaauggcccuauucuuagaggaaaugcuaagaaccaggauuggcacaaaacacgccauuuugcuugucgcaguaaguuucgugacauuaauuacgggaaacauguccuuucgagacuuagggagagugauggugauggugggagcuacaaugacagacgacauaggaaugggaguaacauacuuagcauuauuagcagccuuuaagguacgcccgaccuucgcggcaggccuccugcuuagaaaguuaaccaguaaagaacuaaugauggccacgauaggaauagcuuuacucucgcagucaacgauucccgagacgauacuugaguuaacugacgcauuggcguuagguaugaugguccuaaaaauaguaaggaauauggagaaauaccaacuagcagucacaauaauggcaauaucaugcguacccaaugcaguuauuuuacaaaaugcauggaaagucucaugcacgauauuagcugcagucagcgucagcccauuauuacuuacuucuucucaacaaaaagcagauuggauuccauuagcccuaacuauaaaaggucuaaauccaacagccauauucuuaacaacacuaagucgcacuagcaagaaaaggagcuggccgcuuaacgaagcaaucauggccguugguauggucagcauacuagcuuccaguuuacuuaaaaaugauauuccaaugacgggaccguuaguugcaggaggauuguuaacaguaugcuauguuuuaaccggcagguccgcugaucuggaacuagaacgcgcggccgacguuaaaugggaagaccaagcugaaauaucagguucgagcccuauucucagcaucacaauauccgaagaugggaguaugucuauaaagaaugaggaggaagaacaaacguugaccauucuuaucaggacaggccuauuaguuauaaguggagucuucccaguaaguauaccuauuacugccgcggcaugguaucuuugggaggucaagaaacaacgagcugguguauuaugggaugucccuucuccaccuccaguggagaaggcugaacuagaagauggggcuuauagaauaaagcaaagaggaaucuuaggguacucacaaaucggcgcugguguauauaaagaaggaacuuuucacacaauguggcacgugacaagaggugcugugcuaaugcaucgggggaaaagaaucgagccuucgugggcggauguuaaaaaggaucuaaucucauauggggguggauggaaacuagaaggcgaauggaaggaaggugaagaaguacaaguauuggcgcuagagccaggcaaaaauccgagagcaguucaaacuaaaccgggcauuuuuaaaacuaauaccgguacgauuggagcuguaucguuagauuuuagcccugguacuucuggauccccaaucguggaucgaaaagguaaagucgugggccuauauggaaacggggucgugacuaggucaggagcguauguaagugcuauugcucaaaccgagaaaaguauagaggacaaucccgaaauagaggacgauauauuuagaaagaaacgucuuacaauuauggaucuacacccaggagccggcaagaccaagcgauaccuacccgcuauuguuagagaagcaauuaaaagaggccuaagaacccuaauacuggccccgacccguguuguagcagcagaaauggaggaggcauuaagaggucuaccgauccgauaccagacgacugcaauaaaaacagaacauaccggaagagaaauaguugaucucaugugucaugccaccuucacuaugagacuauuaucuccaguaagaguacccaacuauaacuugauaaucauggaugaggcacauuucacagauccagcguccauugcagcacggggauauauuucaacuaggguagagaugggugaagcagcaggaaucuucaugaccgcgaccccuccgggaucaagagauccuuucccccaguccaaugcaccaauaauggacgaggaacgugagauacccgagcgaucauggaauaguggccaugaaugggugaccgauuuuaagggcaagacaguuugguucguaccuaguauaaaagcagguaaugauauugcugccugucugaggaaaaauggcaagaaaguaauccaauuaucgcgaaagacauucgauagugaguacguuaagacaagagcaaaugacugggacuucgucgugacaacagauauaucagaaaugggugcuaacuuuaaggccgaacgugucauagauccaagacgcuguaugaaaccaguuauuuugacugauggagaagaacgaguaauauuagcaggaccgaugcccguuacucacaguagcgcugcacaacgcagggggcgcauaggcagaaaccccaaaaacgagaacgaccaauacauauauaugggagaaccucuugaaaaugaugaagacugcgcgcacuggaaagaggccaagaugcucuuggauaauaucaauaccccggaaggaauaauacccucuauguucgaaccugaacgagaaaaagucgacgcuauugacggcgaguaucgucugagaggggaagcucgaaaaaccuucguggaccugaugcgcagaggggaccuuccuguuugguuagccuauaaaguggcugcagaagguauaaauuaugcagauaggaaaugguguuuugacgggauuaaaaauaaucaaauuuuagaggaaaacauggaagucgagauauggaccaaggagggagaacgaaagaaauugaaaccccgauggcucgaugcaaggauauauucggacccuuuggcauuaaaagaguucaaggaauuugcggcugggagaaaaucccucacauuaaaccuaauaaccgagaugggucgcuugccuacauuuaugacacaaaaagcucgaaaugcacuugauaacuuagcuguauuacauacugcugaagcaggggguagggccuauaaucaugcacuaagugaauuaccagaaacucuggaaacuuugcuauuguuaacgcucuuagccacagucacuggaggaauauuuuuguuucuuaugucaggcaaaggaauaggaaagaugacucuagggauguguuguauaauuacagccucaauacucuuaugguaugcacagauacaaccacacuggauugcugcaaguaucauacuagaguuuuuccuaauuguucuauuaaucccugaaccggaaaaacagcgaacgccacaagacaaucaauugacguacguaguaauagcgauucucaccguaguagcugcaacaauggcaaaugagaugggcuuuuuagaaaagacgaagaaggacuugggauuagguaguauaacaacgcaagaaucagaauccaauauacuggauaucgauuuaagaccggccucagcauggacacuauacgcaguagcaacgacuuuuguaacaccuaugcuuagacauaguauagaaaauucuagugugaaugucagcuugacugcaaucgccaaccaagcgacgguacucaugggacuaggcaaagguuggccucucaguaagauggauaucgguguucccuuauuagccaucgguugcuauucacagguuaauccuaucacauuaacagcagcucuauugcuucuuguagcucauuaugcuauaauugguccaggacuacaggcaaaagccacaagggaagcucaaaaacgcgcggcugcaggcaucaugaagaacccaacaguagaugguauuacggucauugaccuagagcccauaccauacgauccuaaauucgagaagcaacuagggcaagugaugcuguuaauauuaugcguaacacaaguauuaaugaugagaacuacaugggcucuaugcgaggcacugacauuggcuacagguccuauuucaacauuaugggaaggaaauccugguagauuuuggaacacaacaauagcaguaucaauggcuaauaucuuuagggguucauaucuugcaggagcuggacuauuauucucaaucaugaaaaauacaacaaacacacgaagaggaacgggcaacauuggagaaacauuaggugaaaaguggaaaucaagacuaaaugcccuugguaagucagaauuucaaauuuacaagaaaucuggaauccaagaaguagaucguacccuagcgaaagaaggaauaaaacguggugaaacagaccaccacgccguuucucggggcuccgcaaaauugcggugguuuguagaaaggaauaugguaacuccagagggaaaaguaguugaccuagguuguggcagaggcgguuggaguuauuauugcggaggauuaaagaacgugcgugaagugaaaggauuaacaaaagguggacccggacaugaagaaccaauuccaaugaguaccuaugguuggaaccuaguucgacuccagagcgggguugaugucuucuuuacuccaccagagaaaugugauacucuucuaugcgacaucggagaaagcucgccgaacccuaccauagaagcuggacgaacauuacgagucuuaaaucuuguugagaacugguuaaauaauaauacacaauucugcaucaaaguacuuaauccuuauaugccgaguguaauugagaaaauggaagcccuccaaagaaaauauggaggggcacuuguacggaauccuuugaguagaaauaguacccaugaaauguacuggguuucaaacgccacagguaauaucguaagcaguguuaauaugauaagccguauguugauaaacagauucaccaugaagcacaagaaagcgacuuacgaaccagacguggauuugggguccggaacuagaaauauaggcaucgagagcgaaauccccaauuuagacauaauagguaagaggaucgagaaaauuaagcaagagcaugaaacaaguuggcauuaugaucaggaucacccuuacaaaacgugggcuuaucacggaucuuaugaaacaaaacaaacaggcucugcaagcucuaugguaaacggaguagugcgauuguuaacuaaaccaugggacguaguucccaugguuacucagauggcaaugacggacacuacuccauuuggacagcaacgugucuucaaagaaaaaguagacacgcgcacccaagagcccaaggaaggaacuaagaaauuaaugaaaauuacagcagaauggcucuggaaagaauuaggcaaaaagaaaacuccgcggauguguacucgagaagaguucacuagaaaaguccgaucaaacgcugcgcuuggggcuauauuuacagaugaaaauaaauggaaaagcgccagagaagcuguagaggacggaagauuuugggaacucgucgauagggaaagaaacuuacauuuagaagggaaaugugaaaccuguguauauaauaugauggguaagagagagaagaaacuaggugaauuugguaaagcgaaagguucaagagcuaucugguacauguggcuuggagcacgauucuuggaguucgaagcucuaggcuucuuaaaugaggaccauugguuuagcagggguaacucauuaucgggugucgaaggagaaggucuacauaggcuaggauacauacuaagagacgucggcaagaaagaagguggggcuauguacgcagaugacacagcagguugggauacacgaauaacguuagaagaucuaaagaacgaggaaaugguaacaaaucauaugaaaggugagcauaaaaagcuagcugaggcaaucuucaaacuaacuuaucaaaacaagguuguuagaguacaaagaccuacaccuagagggacuguuauggauaucauaagccgacgugaucaaaggggcucaggucagguuggaacuuacggacuuaauacauuuacaaauauggaagcacaguugauaaggcaaauggaaggggaggguauauuuaaaaguauccagcaucuaacagcuaccgaggaaauagccguacaaaacuggcuugcuaggguagguagagaacggcuuucgcguauggcuauaaguggugaugacuguguugucaaaccaauugaugacagguucgcaucagcguuaacugcucugaacgacaugggaaagguuagaaaggacauacaacagugggaaccaucgagaggauggaaugauuggacgcaaguaccguuuugcagccaucacuuucaugaauugguaaugaaagacggaagggucuuaguaguaccaugucgaaaucaagaugaauuaauaggucgagcacguauaagccaaggggccggguggagccuaaaagagacagcgugucugggcaagaguuaugcacaaauguggacauuaauguacuuccaucgaagagauuuacgauuagccgcuaacgcuauauguucagcgguacccucucauuggguuccuacaaguaggacgacuuggagcauucaugccaaacaugaguggaugacaacggaagauauguuagcaguuuggaaccgcguauggauacaagagaauccguggauggaggacaaaacgccgguugaaaguugggaggagguuccauacuuagggaagagagaagaccaguggugcggaucaaugaucggauuaacgagucgagcaaccugggcgaaaaauauucaaacagcuauuaaccagguaagaagucuaauaggaaaugaagaauauauagauuauaugccaagcaugaagcgcuuuagaagagaagaggaagaagccgggguacuaugguaa

SEQ ID NO: 22472 - RNA, 9876 nt, Artificial Sequence
  derived and/or modified CDS sequence (opt6) from DENV-2__EU482696__SS-prME
acugcaggggugauuguaauguuaauaccaacugcuauggcauuucauuuaacaacaaggaauggcgaaccgcauaugaucguagguaggcaggaaaaaggaaagagcuuacuuuuuaaaacagaagacggggugaauauguguacguuaauggcaauugaccuuggggaauuaugugaagauacuauaacuuacaaauguccauuacuucgucaaaaugaaccagaagauauagauuguuggugcaauaguacuuccacauggguaacauauggaaccugcacaacaaccggagagcacagaagagaaaagagaagcguugcccuuguaccccaugugggaaugggacuagaaacccguacagaaacauggaugucuagugaaggggcauggaaacacguccaaagaaucgaaacauggauauuaagacacccagguuuuacaauuauggcggcaauacuagcuuauacaaucggaacgacucauuuucaacgagcucugauuuuuauacuuuugacagcuguugccccaucuaugacaaugcgaugcauaggcauuucaaauagagacuucguugaaggcguuucagggggaucuuggguugacauaguucucgaacaugggagcugcguaacaacaauggccaaaaauaaaccgacgcuugauuucgaauuaauaaaaacugaagccaaacaaccagcaacacuaagaaaauauugcauugaagcgaaacucacgaauacaacuacugaaucacgcuguccgacccaaggagaaccuucacugaacgaggaacaagacaaacgauucauauguaaacacucuaugguagaucguggcugggguaacgggugugggcuauucgguaaaggaggcauaguuacuugugcuauguuuacauguaagaaaaauauggaaggaaaagucgugcaaccagaaaauuuagaauacacgauaguuauuacaccgcauuccggagaagaacacgcaguaggaaaugacacaggaaaacacggaaaagagauaaaaauuacaccgcaauccaguauaacagaagcagaguuaacaggguaugggacaguaacaauggaauguaguccgcgaacuggauuagacuuuaaugaaaugguucuacuccagauggaagauaaagcgugguuaguucauagacaaugguucuuagauuuaccacucccaugguugccuggggcagauacucaaggaucuaauuggauacaaaaagaaacuuuaguaacuuuuaaaaacccgcacgccaagaaacaagaugucgucguacucgguagucaggagggagccaugcauacagcucuaacgggugcaacagaaauacaaaugucuucaggcaaucuucuuuucacaggucaucugaaauguagacuuaggauggacaaacuucaacuaaaaggaauguccuauagcaugugcacagguaaauucaaaauagucaaagaaauagcugagacacagcaugguacaauuguaauacgugugcaguaugagggggaugguaguccguguaaaauaccauuugaaauaacugaucuugagaaaagacaugucuugggaagacuaaucacgguaaacccgauaguaaccgagaaagacucuccagucaauauagaagcugaaccuccguucggugauucguacauuaucauagggguugaaccgggucaauugaaauugaauugguucaagaaaggaagcucaauaggacaaauguucgagacaacaaugagaggagccaaaagaauggcaauacuaggagauaccgccugggauuuuggcucacuagggggcguguucacuuccauagggaaagcacuucaucaaguauucggagcgaucuauggugcggccuuuucaggaguuucguggaccaugaaaauucuuauaggaguuauuauaacauggauagggaugaacagcagaucaacuucauugaguguaucgcuaguauuagucgguguaguuacacuuuaccugggcgcuaugguccaagcagauagcggaugcgucgcaaguuggaagaauaaagaauugaaaugcggaucuggcauuuucaucacagacaauguccauacguggacagaacaauauaaguuucagccagaaaguccaaguaaacuugccucugccauacagaaagcucaugaggaagguauauguggcaucagaucugugacgagacucgagaacuugauguggaaacagauuaccccagaguuaaaucacauucugucagaaaacgaagucaaacuuacuaucaugacgggggauaucaaagguauaaugcaggcgggaaagagaagucuacguccacaaccgacggaguugaaauacucuuggaaaacaugggguaaagcaaaaauguuaucaacagagucacacaaucaaacauuuuuaauagauggaccugagacugccgaaugucccaacacaaacagagcauggaauagucucgaaguagaagacuacggguuuggaguguucaccacaaauauauggcuuaaacuccgagagaaacaagaugucuucugcgauagcaaauugaugagugccgcuauaaaagauaacagagccguccaugcggauaugggcuauuggauagagucagcuuugaacgauacauggaagauggaaaaagccucauucauugaaguaaaaagcugucacuggccaaaaucacacacacuauggucuaacggcguauuagaaagugaaaugauuauucccaaaaacuuugccgggccagucucucaacacaauuaucgaccuggguaccauacucagacugcuggucccuggcauuugggaaaacuugaaauggauuuugaucuuugugaaggaacaaccgucgucgugacagaagacugcggaaacagggguccaucauuacguacuaccaccgcguccggcaaguuaauaacugagugguguugucguucaugcacccugccgccccuucgguauagaggugaagauggcuguugguauggaauggaaauuagaccacugaaagaaaaagaagaaaaucugguaaauaguuugguuaccgccggccauggacaaauagauaauuucucacuaggcguacucgguauggcccucuuuuuagaagaaaugcuccggacuaggauagguacuaaacacgcaacucucuuaguagcaguuuccuucguaacucuaaucacaggcaacaugucguuuagagaucuagggcgaguuaugguaaugguaggggcaacaaugacagacgauauaggaauggggguuacauaucuagcccuacucgcugcauuuaaaguacggccgacauuugccgccggucuucucuuaagaaaacuaacaaguaaagaguuaaugauggcaacgauuggaauugcucuuuuaucccaaucaacuauaccggaaacaauucucgaauuaacugacgcauuagcacuaggaaugaugguuuuaaagauaguacgaaacauggaaaaauaucaauuagcaguaacaauuauggcgauuagcugugugccuaaugccguaauccuccaaaaugccuggaaaguaucuuguaccauccuugccgccguaaguguaucaccacuuuuacugaccagcucucaacaaaaggcagauuggauuccauuggcgcuaacuauuaagggacugaaucccaccgcaauauuuuuaacaacucuaucgcgaacaaguaagaaacgaucguggccauuaaacgaagcaauaauggcgguaggcauggugagcauucuagcgucuucacuacuaaagaaugacaucccaaugacgggaccauugguggcaggaggccuauuaacaguauguuauguauuaacuggaaggagugcugaucuugagcuugaacgggcugcagauguaaaaugggaagaucaagccgaaauuucuggaaguagccccaucuuaucaauaaccauaucggaggacggaagcaugagcauaaagaaugaagaagaagaacaaacauuaacaauauuaauaaggacuggacuccuuguuauaucgggaguauuuccuguauccauuccaauaaccgcagcggcaugguaucuuugggagguuaagaaacaacgagcaggcguacuuugggaugugccuucaccgccaccuguagaaaaagcugaauuagaagacggagccuacagaaucaaacagagagguauuuuagguuauagucaaauuggagccggcguuuauaaagaaggaacuuuucacacaauguggcauguuacacguggagcuguuuuaaugcauagagggaaaagaauugaaccaucaugggcagaugucaagaaagauuuaauaaguuauggaggcggcuggaaacuggaaggcgaauggaaggagggagaagagguacaaguuuuagccuuggaacccggcaaaaacccacgugcuguacagacaaaaccgggaacauuuaaaacuaacacgggcacaauaggagcuguaucgcuagauuuuucaccaggaaccucuggcaguccgauuguagacagaaagggaaagguuguaggacuguacgguaacggcgucguaacuagaaguggggccuauguaucagccauagcgcaaacagaaaaaucuauugaggauaacccugagauugaagacgacauauucaggaagaagcguuuaacgauuauggauuuacacccaggcgcgggaaaaacuaaacgcuaccuaccugcuaucguacgggaagcgauuaaaagaggauuaagaacccuuauucucgccccaacgagaguaguagcagcugaaauggaagaagcacuaagggggcuaccgauacgauaucaaacuccggcaauaaaaacagaacauacuggacgagaaauuguugaccuuaugugucacgcaaccuuuacuaugcgauuauuaagcccaguacgaguuccaaauuacaaccuaauaauuauggaugaagcgcauuucacagauccagcgagcauagcagcucguggauacauuucaacacgaguggaaaugggagaagcugcugguauuuuuaugaccgcaacuccuccggguucacgugauccauuuccccaauccaaugcuccaauuauggaugaagaaagggaaauaccugaacgcagcuggaacuccggccaugaaugggugacagacuucaaagguaagacaguuugguuugucccgagcaucaaggcggguaaugacauugcagcauguuuaaggaaaaacggcaagaaaguuauccaauugucucgaaaaacauuugacagugaauaugugaagacaagggcaaaugauugggacuucguagucacaacugauauaagcgaaaugggagcgaacuucaaggccgaacgggucauagacccgcguaggugcaugaaaccuguuauacuaacagacggugaggaaaggguaauauuagccggaccaaugccggugacacauucaucagcagcccagcgcagggggaggauuggcagaaaucccaaaaaugaaaacgaucaauacauauauaugggugaaccauuagagaaugacgaagauugcgcgcauuggaaggaggcaaaaaugcuuuuagauaauaucaacacuccagaggguauaauaccuucuauguucgaacccgaacgagagaaaguggaugcuauagacggagaauauagacuucgaggugaagcccggaaaacuuucguugauuugaugagacguggagauuugccaguuugguuagccuauaagguagccgcagaaggaauaaauuaugccgacaggaaaugguguuuugauggaauuaaaaacaaucaaauacuggaagaaaacauggaaguugagauauggacaaaagaaggcgaacguaagaaauugaaaccuagaugguuagaugcaagaauuuacuccgacccacuagcguuaaaagaauuuaaagaguuugcggccgggagaaagucguugacacugaaucugauaacagaaauggguagacuuccuacauuuaugacacaaaaggccagaaacgcauuagauaaccuggcagugcuccauacagcagaggcgggaggucgagccuacaaccacgcuuuaagugaauuaccagaaacuuuagagacacuucuccugcuaacacuccucgcgacaguaaccggaggcauauuccuguuuuuaaugagugguaaaggaauugggaaaaugacauuggggauguguugcaucauuacggcaucaauauuacuaugguacgcucaaauccagccacauuggaucgcagcuagcauaauuuuggaguucuuucucauaguacuacuaaucccggaaccagaaaagcagagaacuccacaggauaaucaauuaacauauguugugauugcaauauuaaccguaguugcagcuaccauggcaaaugaaaugggauuccucgagaaaaccaagaaagaucuugguuuagguucuauaacuacccaagaguccgagaguaacauccuugauauagauuuaaggccugcaagugcuuggacccuguacgcgguagcuaccacauucguuacuccaaugcucaggcauaguauagagaacaguucgguaaauguaucacuaacagccauagcgaaucaagccacuguacugaugggucuugguaaaggcuggccccuuucaaagauggacauagggguaccacuguuagcaauugguuguuacucacaagugaauccuauuacuuugaccgcugcucuauugcuauugguagcacauuaugcuauaauugggccaggauuacaggcaaaagcaacuagggaagcucagaaaagagcagcagcaggaauuaugaaaaauccgacuguagacggaauuaccgugauagauuuagaaccaaucccuuaugacccgaaauucgaaaaacaacuggggcaagucaugcuacuuauauuguguguaacacaaguacugaugaugagaacuacuugggcauuaugugaggcuuugacauuagcaacggguccuauuuccacacucugggagggcaauccuggccgauucuggaauacuacgaucgccgugaguauggcuaacauuuuccgugggucauaccuagcuggagcagguuuguuguuuucaauuaugaagaauacgacgaguacccgacgagggaccgggaauauaggagagacgcuaggggaaaaauggaaaaguaggcuaaaugcacuaggaaaauccgaauuucaaauauacaagaaaucagguauccaagaaguagauaggacguuagcgaaagaaggcauaaaaagaggggaaaccgaucaucaugcuguaagccguggaagugcaaagcuacggugguuuguagagcguaauaugguaacaccugagggaaagguuguugaccuaggaugcggaagaggagguuggucauauuauuguggcggccugaaaaacgucagagaaguuaagggucuaacaaaaggagggccuggccaugaggaaccuauaccgaugucaacauauggauggaaccuuguuaggcugcaaucgggaguugacguauucuuuacaccaccagaaaaaugugacacccuacuuugugacauaggagaaaguuccccaaacccuaccauagaagcaggccgaacguuaagaguuuugaaucuuguagaaaacugguuaaauaacaacacucaauucuguauuaaaguccuuaacccuuacaugccaagcguuaucgagaaaauggaggccuuacaaagaaaauacggcggagcccuaguaaggaacccacuuucacgaaauucuacccaugaaauguauugggugucaaacgccacaggaaacauuguaucuucaguuaauaugauaagucguaugcuuauaaauagauuuacuaugaaacauaagaaagcgacguaugaaccagauguugaccugggaucaggaacccggaauauugguauugaguccgaaauaccaaaccucgacauaauuggaaaaagaauagagaaaauuaagcaagaacacgagacgaguuggcauuaugaccaagaucauccauacaaaacaugggcauaucaugggucuuaugagacaaagcaaaccggaucagcaaguuccaugguuaaugguguagugagauuguuaaccaaaccaugggacgugguaccgaugguaacacaaauggcuaugacagauacaacaccauucgggcaacagcgaguguuuaaagaaaagguagacacaaggacgcaggagcccaaggaagggacuaaaaagcuaaugaaaaucacugcagaauggcuauggaaagagcuuggaaagaagaaaaccccuagaaugugcacaagagaagaauuuacacguaaaguccguuccaaugcagcuuugggggcgauauuuacugaugaaaauaaauggaagucggccagagaagcugucgaagacgguagauuuugggagcuaguugacagagaacguaaccuccaucucgaggguaagugcgagaccuguguauauaauaugaugggcaagcgcgaaaagaaauuaggagaauuuggaaaagcgaagggaagucgcgcuauaugguauauguggcuuggggcacgauuccucgaauuugaggcguuaggauuuuuaaaugaagaucauugguuuaguagaggaaacucauuaucugggguggaaggggaaggacuacauagacuaggauacauucuuagagacguuucuaagaaagaaggcggagcaauguaugcagaugacacagccggcugggacacgaggauuacacucgaggaccugaaaaaugaggaaaugguaacaaaccacaugaagggagagcauaagaaacuugcagaggcgauauucaaacuaaccuaccaaaauaaagucgugagaguucaacgacccaccccaagaggaauaguaauggauauaauaucuagaagagaucaaagaggcagcggacaaguugguacauauggucuuaauaccuucacaaacauggaagcgcaacuaauucgccaaauggaaggagaaggaauauucaaaagcauacaacauuuaacagcagcugaagaaauuguggugcagaacugguuagcccgaguuggaagggagagauuaucuagaauggccaucucaggugaugauugcguaguaaagccaauagacgauagguuugccucugcucuaacggcccuaaaugauauggguaaaguaagaaaggauauacagcagugggaaccgucacgaggcuggaaugauuggacacaaguuccuuuuuguucucaucauuuccacgaauuaguaaugaaagaugguagagucuuaguggucccguguagaaaccaagacgaguugauagggagagcucgaauaucgcagggcgcugggugguccuugaaagaaacagcgugccuagguaaaucauacgcccaaauguggacccuuauguacuuucaccgaagagaccuacgacucgcagcuaaugcaauauguagcgcugugccgagucacugggucccuacaaguaggaccacguggucaauacaugccaaacaugaauggaugacgacggaagauaugcuagcaguauggaauagaguuuggauucaagaaaacccuuggauggaagauaaaacucccgucgaaaguugggaagaagugccauaccugggaaaaagagaagaccaaugguguggcagccuaaucggucuuacgagucgagcgacgugggcgaaaaauauacaaacagcuaucaaucaaguucggucucuaauuggcaacgaagaguacacugacuacaugccuagcaugaaaagauuucgccgugaagaggaggaagcugguguacuaugguga

SEQ ID NO: 22473 - RNA, 9876 nt, Artificial Sequence
  derived and/or modified CDS sequence (opt6) from DENV-2__KC294207__SS-prME
acagcaggaguuauugucaugcugauaccgacugcgauggcauuucaccugacgacucgaaauggagaaccucauaugauugucgguagacaagaaaaaggaaagagcuuacuuuuuaaaacagaagauggaguuaauaugugcaccuuaauggcaauagaccuuggugaacuuugcgaagauacgauaacguauaaauguccauuauugcgacaaaaugaaccugaagauauagacugcuggugcaauucgacauccacaugggucacauaugggacuuguacaacgacaggugaacauagaagggaaaagcgcagcguugcucuuguuccucacguaggaaugggacuagaaaccagaacugagacauggaugucaucugaaggcgccuggaaacauguccagagaaucgaaaccuggauuuuacgacauccggguuuuacgauuauggcagccaucuuggccuacacuauugguaccacacacuuccaaagggcauuaauuuuuaucuugcuuacugcgguugcuccaaguaugacuaugcgauguauugguauuucuaacagggauuucguagaagguguauccggagggaguuggguagauaucguguuagaacauggcaguuguguaacaacuauggccaaaaauaaaccaacucuggacuucgagcugauaaaaacagaggcaaaacaaccagcuacucuaagaaaauacuguaucgaagcuaaacugacaaauacuacaacagaaagcagaugcccaacccaaggugaaccgucacuaaacgaggaacaggacaaaagguucauuugcaaacacagcaugguugacagggguuggggaaaugggugcggguuguucgggaaaggugguauaguaacgugugcaauguuuaccuguaagaaaaauauggagggcaaaauuguacagccagaaaauuuggaguacacaauuguuauaacaccucacagcggagaagaacaugcagucggaaacgacacaggaaaacauggcaaagaaauaaaaauuaccccucaaucuucaaccacagaagcagaguuaacuggauacggcacuguaaccauggaaugcuccccacgaacuggauuggauuuuaaugaaaugguguuacuacaaauggaagauaaagccugguuagugcaccgucaaugguuucuagaccuaccgcucccuugguuaccaggagcugauacucaagggucuaauuggauacaaaaagagacacucguuacuuucaaaaacccacaugcgaagaaacaggauguaguaguauuaggaagucaagaaggugcaaugcacacagcgcugacuggugcaacggaaauacaaauguccaguggcaacuuacuuuuuacaggucauuuaaaauguagauugagaauggauaaauugcaacuuaaagggaugagcuacuguauguguacaggaaaauuuaaaauaguuaaagaaauagcggaaacgcaacaugguaccauuguaaucagaguacaauacgagggagacgguucgccaugcaaaauuccauuugaaauaacagacuuagagaaaagacauguacuaggacgucuuauuaccgucaauccaauagucacagaaaaagauuccccaguuaacauugaagcggaaccaccuuucggagauuccuacauuauagucggaguagaaccgggucaacuaaaacucaauugguucaagaaaggaucgaguauaggucaaauguucgaaacuaccaugaggggagcuaaaagaauggcgauuuugggugauacugcaugggauuuugggucgcuaggaggugucuuuaccucaauuggcaaggcuuuacaucaaguauucggugcuauuuauggcgcagcuuucucuggcguuucauggacuaugaaaauacuuauuggaguuaucauaacauggauagggaugaacuccagguccacauccuugucuguaucauugguauugguagggguuguaacuuuguauuuaggggccaugguacaagccgauaguggaugcauaguuagcuggaaaaauaaagaguugaaaugcgguucaggcauauucaucacagacaauguucacacuuggacugagcaguauaaauuucaaccugaaucuccgaguaaacuugcaagcgccauacagaaagcacaugaagaaggaaucugcgguauacgaucggucacacgguuagaaaaucugauguggaagcagauaacuccagagcuuaaccauauacugucugaaaaugaaguuaaacuaacaauaaugacuggggauauaaaagguauuaugcaagcgggaaagaggucauugcgaccacagccuacggaacugaaauauuccuggaaaacauggggcaaagccaaaaugcuaagcacagaaucucauaaccaaacauuuuuaaucgacgggccggaaacugcagaauguccuaacacgaaucgggcauggaacucauuagaagucgaggauuacgguuuuggaguauuuacgaccaauauuuggcuuaaacuaagagaaaaacaagacguauuuugcgacuccaaacucaugucagcugcuauuaaggacaaucgagccguucaugcggauaugggauacuggauagaauccgcauuaaaugauacauggaaaauggaaaaagcaucguuuauugaagugaaaagcugucacuggccaaaaagccauaccuuguggucuaaugguguacuggagagcgaaaugauaauaccuaaaaauuucgcuggucccgucucacaacacaauuaccguccagguuaucacacgcagacagcaggaccgggucaucuuggcaaacuggaaauggacuucgaucuuugugaaggaacaacagugguaguaacagaagacuguggcaauagaggucccagcuugcguacuacaacagccucagggaaacuaauaacugagugguguuguagaucgugcacccuuccaccgcugagauauaggggagaagacggaugcugguacggaauggaaauaagaccacuaaaagaaaaggaagaaaauuuaguaaauagucuaguaacugcuggucauggccaaaucgauaauuucucccugggaguacucgguauggcuuuauuucuagaagaaauguuacgaacucgugugggaaccaaacacgcaaucuugcuugucgcucuuagcuuuguuacgcuaaucacaggaaauaugaguuuccgcgauuuaggacguguuaugguaaugguuggagcuacaaugacugacgauauuggcaugggaguaacuuacuuagcacucuuggcugcguuuaaaguacgaccaacauucgccgcaggcuuauuacugaggaaacuaacgucgaaagagcucaugauggccacuauuggcauagcacuacuaagccaaagcacacucccagaaaccauccuugaauuaacagacgcucucgcacuuggcaugauggcguugaaaauaguaagaaauauggagaaauaccaauuagcaguuacgaucauggcuauuucauguguuccgaaugcuguaauacuucaaaaugcauggaaagucagcuguaccauucucgcugcgguaaguguaucuccguuacugcuuacuucaucacaacaaaaagcagauuggauaccacuagcguuaacaauaaagggccuaaacccaaccgcaauuuuccuuacaacauuauccagaacuagcaagaaacgcaguuggccacuaaaugaagcaauaauggcagucgguaugguaaguauccucgcuucaagccuucucaaaaaugauauccccaugacaggaccccuaguugcuggagguuuauuaaccgucuguuacguccucacaggaagaagcgcagauuuagaguuagagcgggcagcagaugugaagugggaggaccaagccgagaucucgggaaguagcccaauuuugaguauuacuauaucagaagaugguucaaugucaaucaaaaaugaagaggaggaacaaacauugacaauacuaaucagaaccggguuacucguaaucucuggugucuucccaguaucaaucccuaucacggcugcagcaugguacuuaugggaaguuaagaaacagcgagcggguguucucugggauguuccaucaccaccaccaguagguaaagccgaacuugaggauggcgcguauagaauaaaacaacgugggauauugggauacucucaaauaggagcaggaguauauaaggaagguacuuuucauacaauguggcauguuacaagaggagccguacuaaugcaucgcggaaaaagaauugaaccaucaugggcggacgugaagaaagauuuaauaucuuauggcggaggcuggaaacuugaaggcgaauggaaggaaggagaagaaguucaaguccucgcccuagagccggguaaaaauccccgagcaguucaaaccaaaccaggaaucuucaaaaccaauacaggaacuauaggagcagugucccuagacuucagccccggcacaucgggaucaccuauuguugaucgaaaagguaaaguaguaggguuguauggaaauggagugguaacgcggagcggugcauauguuucagcaauugcgcaaacugagaaaagcauagaagauaacccugaaauagaagacgacauuuucagaaagaaacgacuuacuauuauggacuuacauccuggagcaggaaaaaccaaacguuauuuacccgcgauaguuagagaagcaauuaagcgaggguuaagaacuuugaucuuagcaccaacaagaguagucgcagcggagauggaagaagccuuaagaggucuuccuauaagauaucaaaccccagcgaucagggcugagcacacaggacgggagauaguagacuuaaugugccaugcuaccuucacaaugagacuuuuaagcccaguacgaguucccaacuacaaucugauaauaauggaugaagcgcauuucacugacccggcuaguauugcagcaagaggauauauuagcacgagaguagaaaugggagaagccgcaggcauauuuaugaccgcgaccccuccgggcucaagagauccguuuccacagagcaaugcgccuauuauggaugaggaacgugaaauaccugaacgaagcuggaacucuggacaugaaugggucaccgauuuuaaaggaaaaacugucugguucgugcccucuauuaaggcagguaaugauauugcugcuugccuuaggaaaaaugguaagaaaguaauucaguuaucgagaaaaacguucgauucugaauacguuaaaacaagagcgaacgauugggauuuugucgucacaacugacauaagugagaugggcgcaaauuucaaagccgaacguguuaucgacccccguagauguaugaaaccggugauccuuacagacggugaggaacgagucaucuuagcugguccgaugccggugacacauucuagcgcagcacaacgcagaggccguauuggaagaaacccuaaaaaugaaaacgaucaguauauauacaugggagaaccacuagaaaacgaugaagauugugcucacuggaaggaggcaaaaaugcugcucgauaauauuaacacgcccgagggcaucauuccauccauguuugaaccugaacgggaaaaaguggacgcaauagacggggaauaccgauuacgcggagaagccagaaagacuuuuguagaucuaaugcgcagaggagauuugccuguauggcuagcauauaaagucgcagcagagggaaucaacuaugccgauagaaaauggugcuucgacgggauaaagaacaaucaaauacuugaagaaaauguagaagucgaaauuuggacaaaagaaggcgaaagaaagaaacuaaaaccgagauggcucgacgcacgcauauauagcgauccauuagcucuaaaagaauuuaaagaguuugcugcugggcgcaaaaguuuaacacuaaaucuuauaacggagaugggacgucuaccuacauuuaugacccaaaaagcuagaaaugcuuuggacaaccuugcagucuuacauacggcggaaguaggcggcaaggcguauacacaugcucuaucagaauuaccagaaacguuagaaacucuccugcuauuaacacuauuggcagcugucacaggaggcauauuuuuguuccuaaugaguggaaaaggaguggggaagaugaccuugggcaugugcugcauuauuacugcuucaauucuuuugugguacgcacaaauacaaccacauuggauagcagcaucgauaauucucgaguucuuuuuaauaguacugcuuauucccgaaccugaaaaacaacgaacgccucaggauaaccaacuaacuuacgucguuauagccauuuuaacuguaguggcagcuacaauggcuaaugaaaugggauuccuugaaaagaccaagaaagaccuaggguucggaaguauaacaacucaagaaagugaaagcaauauauuggacauagaccucaggccagccagugcauggacauuauacgcaguagcuacaacuuucgugacaccuauguugagacauucaauugaaaacuccaguguuaacgugagucuaacugcaaucgcaaaucaagcuaccguuuuaauggguuuaggaaaaggcuggccccuaagcaaaauggacauaggagugccauuguuagccauuggauguuauucccaagugaauccuauuacacugacugcagcacuacuauuacuggucgcacauuaugcgaucauaggaccugggcuccaagcaaaggccacuagggaagcgcagaaacgugccgcggccggaauuaugaagaaccccaccguagacggaauaacugucauagaucuagaaccgauaccuuacgauccaaaguucgaaaaacaacuaggucagguuaugcuacuaauauuauguguaacacaaguguuaaugaugagaacaacaugggccuugugcgaggcuuuaacccuagcgaccggaccgauaucuaccuuaugggaaggaaauccaggacguuuuuggaauacaacuauagcaguaucgauggcgaauaucuuccgggguaguuaucuagccggugcgggauuacuuuucaguaucaugaaaaauacuacgaauaccagaagaggaacaggaaaugugggagagacacuaggagaaaaauggaagucacggcuaaaugcauuagguaagucagaguuucagauauauaagaaaagugguauccaagaagucgacaggacauuagcaaaggaagggauaaaaagaggugaaacggaucaccacgcgguaaguagaggcucugcuaaacuaagaugguuuguggagcguaacaugguaacacccgaagguaaaguuguggauuuaggaugcggaagaggcgguugguccuacuacugcgguggucugaaaaacguaagagaaguaaaaggauugacaaaaggugguccuggccacgaagaaccuaucccaaugucaacguauggauggaaccuaguccgauuacaaaguggcguugaugucuucuucacuccaccggaaaagugcgauacccucuuaugcgacauaggagaaaguuccccgaauccaacaaucgaggcgggaagaacgcugagaguucugaaucuugucgaaaacuggcuaaacaauaauacacaauucugcauaaaaguucuaaacccuuauaugccuucgguaaucgagaaaauggagacacuucaaagaaaguauggaggcgcucucguaagaaauccacuaucaaggaauaguacccaugaaauguauugggucucuaaugcgacgggcaacauaguaucaagcgugaauaugauuagcaggaugcuaauaaaccgguuuacuaugaaacacaagaaagcuacauacgaacccgauguagacuuaggaagcgggacacguaacauagggauagaaagugaaaucccaaaucuggauauugugggaaagcguauagagaaaauuaaacaagaacaugagacaucauggcacuaugaccaagaucaucccuauaagacuugggcuuaccauggauccuaugaaacuaaacaaacaggcucagcgucaucgaugguaaaugguguaguuaggcuccuaacaaaacccugggacguuguacccaugguuacgcaaauggcuaugacagauacgaccccauucgggcagcaacguguauuuaaagaaaaaguugacacuagaacucaagaaccgaaggaggguaccaagaaauuaaugaaaauuacggcagaguggcucuggaaagaauugggaaaagagaaaacaccaaggauguguacucgcgaagaguucacaagaaaggucaggaguaacgcagccuugggcgcaguuuucacggaugaaaauaaauggaaaagugcuagagaagcuguagaagauggacgauucugggaauuaguagauagagaaaggaaucuacacuuagaaggcaaaugcgaaacguguguuuacaacaugaugggaaaacgagagaagaaacugggagaguucggaaaagccaaagguucuagggcuauaugguauaugugguuaggggcgcgguuccuugaauuugaagcacuugguuuucucaaugaagaucacugguucucacggggaaauagccuaagcgggguugaaggggaaggacuacaucgacuaggguauauucuacgagaaguaggcaagaaagaaggaggagcuauguaugcagacgauacagcaggcugggauacuagaauaacauuagaagauuugaaaaaugaagaaauggucacaaaucauaugaaaggagaacacaagaaacuagcagaagcuaucuuuaagcucacauaccagaauaaaguuguaagaguacaacgaccgacuccuagaggcacaguuauggauaucaucucaaggaaagaccaacgugguagcggucaaguaggaacuuaugguuuaaauacauuuacaaauauggaagcacaacuuauucgacagauggagggagaagggaucuucaaaucaauucaacacuuaaccgcaaccgaagaaauugcaguacaaaauuggcuugcgagggugggacgagaacgacuuucaaggauggcaauaaguggagacgacugcgugguaaagcccauugaugacagauucgcuagugcccuuaccgcguuaaaugacaugggaaaaguacgaaaagauauucaacaaugggaaccaaguagagguuggaaugauuggacacagguaccuuucuguucccaccacuuucaugaauuaguaaugaaagacggaaggguucucguuguaccgugcagaaaucaagacgaacuaauuggacgagcaagaaucagucaaggggcagguuggucacuuaaagaaacagcaugucuagguaaaucauaugcccaaauguggacacucauguauuuccaucgacgcgaccuaagacucgcugccaacgcgauuuguagcgccgucccuagucacugggugccaacaagcagaacuacguggucgauccacgcuaagcacgaauggaugacgacggaggacauguuagugguuuggaaucgaguauggauucaagaaaauccguggauggaggacaaaacucccguagaaucaugggaagaaguaccauaucuuggaaaacgagaagaccaaugguguggcagucuuaucggguuaacgucucgagcaacaugggcgaagaauauccagaccgcgaucaaccaaguucggucacuaaucgggaaugagggauacacagacuauaugcccucgaugaaacguuucaggcgugaagaggaagaagcaggaguacucugguga

SEQ ID NO: 22474 - RNA, 9876 nt, Artificial Sequence
  derived and/or modified CDS sequence (opt6) from DENV-2__KC294208__SS-prME
acugcuggugugauaguuauguugaucccaacugcaauggcauuccauuuaacuacacgaaauggugaaccacacaugauaguaggccgacaagaaaaaggaaaaagucugcuuuucaaaacagaagacgguguuaauauguguacauugauggcaauagauuugggagaacuuugugaagauacuaucacauacaaauguccauuacuacgucaaaaugaacccgaagauauagauugcuggugcaauagcacaucuacuugggugacguauggaacaugcacaacaacaggagaacacagacgagagaaaagaaguguagcucuagucccacacgugggaauggguuuagaaacuagaaccgaaacauggaugucuucggaaggugcuuggaaacacguucagaggauugaaacauggauacuucgucauccaggauucacaauuauggcagcaauucuagcauauacaaucgggacaacacacuuucaacgagcguugauuuuuauacuauuaacugcugucgcaccuagcaugacaaugcgauguauugguauaaguaauagagauuuugucgaaggaguaucaggcggaaguuggguugauaucguucuagaacacggcaguugcguaaccacuauggccaaaaauaaaccuacccuugacuucgaauuaauuaaaaccgaagcaaaacaaccagcgacauuaagaaaauauuguauagaagcaaaauuaacaaauacgacaacggaguccagaugucccacacaaggagagccaucuuuaaacgaagaacaagacaaacguuucaucuguaaacauucgaugguggaccgaggcugggguaacggauguggguuauucgggaaaggaggaauaguuaccugugcaauguucacauguaagaagaacauggaggggaagauaguacaacccgaaaauuuagaauacacaauaguuauuacaccccauucaggcgaagaacaugcagugggaaaugauacaggcaaacacggcaaagaaauaaaaauuacuccacagagcucaacaacagaggcagagcugacuggguacggcacgguaacaauggaauguaguccuaggacgggcuuagauuuuaacgaaaugguacuucuacagauggaagacaaagcaugguuaguccaccgucaaugguuccuugaccuuccucucccaugguugccuggagcugauacacaaggauccaacuggauacaaaaagagacccuugugacauuuaaaaacccccacgccaagaaacaagauguuguaguucuuggaucucaagaaggagcaaugcauacagcuuuaacaggagcgaccgaaauacagaugaguaguggcaauuuacuguuuacaggccaucuaaaaugcagacucagaauggacaagcuacaauuaaaaggaaugaguuauucuaugugcacagggaaguucaagauagucaaagaaaucgcugagacgcagcauggcacaauaguaauuaggguccaauacgaaggugacggaucaccaugcaagauaccauuugaaauuacggaucuugagaagcgacacguccuaggacgauugaucacggucaacccuauuguaacggaaaaagacuccccggucaauauagaagcggaaccgccauuuggugauaguuauauuaucguaggcguggaaccuggacaauugaaacuuaauugguuuaagaaagggagcagcaucggccaaauguuugaaacaacuaugcgaggagcaaaaagaauggcaauauuaggcgauacugcaugggauuuuggaucucuuggcggggucuucacaucuauuggcaaggcuuuacaccaagucuuuggagcaauauauggugcagcauucucaggcgugucuuggacuaugaaaauucucauaggagucaucauuacauggauugguaugaacucaaggucuacgucacugaguguaucauuagucuuagugggaguaguaacuuuguaucuaggagcaaugguucaggccgauucugguugcauaguaagcuggaaaaauaaagaacugaaaugcggcaguggaauuuuuauaacugauaaugugcacacauggacagaacaauacaaguuucaaccggagucaccgaguaaguuagcaagcgcaauccagaaggcacaugaagaaggaauauguggaauaagaagcgucacacgacuagaaaauuuaauguggaaacagauaaccccagaacuaaaucacauacugucugagaaugaaguaaaacuuaccaucaugacgggggacauaaaaggaauuaugcaagcaggaaagagaucacuucggccgcagccaacagaacugaaauauucuuggaaaacauggggcaaggcaaaaaugcuaaguacugaaucucauaaccagacauuucuaauagaugggcccgaaacagcugaauguccaaauacuaaucgagcauggaacucccuugaagucgaagauuauggguucgguguauuuaccaccaauaucugguuaaaacuccgcgaaaaacaagacguauucugcgauuccaaauuaaugagcgcagcaaucaaagauaauagagcuguccaugcugacaugggguacuggaucgaaagugcccucaaugauacuuggaaaauggaaaaagcaucauuuaucgaggucaaaucgugucauuggccgaagucucauacccuguggucaaauggcguacuagaaucugaaaugauaauccccaaaaauuuugcuggaccagugucucaacacaacuacagacccggauaccacacgcaaacugcagggccguggcaucuugguaaacuugaaauggauuuugauuuuugcgaaggaaccacugucguagugacugaggacugugguaaccgcggccccucacucaggacaacaacagcguccggaaaacuaauaacugaaugguguuguagaucaugcacacuaccuccacuccgguauagaggagaagacgguugcugguaugguauggaaaucagaccauuaaaagagaaagaagagaacuuggucaauagucuaguaacagcaggccacggacaaaucgacaauuuuucccuggguguacucggaauggcccuauuuuuagaggagaugcuacggacaagaguuggaacuaagcaugcuauauuauuagucgccuuaucauucgucacauuaauaacagguaacaugagcuuuagggauuuagguagaguuaugguuaugguaggggcuacgaugacggaugauauaggaaugggaguuacuuauuuggccuuauuagccgccuuuaaagugagaccaacauucgcugccggauuauuacuacguaaauuaacaagcaaagaacuaaugauggcgaccauaggaauagcuuuacuuucacaaucaacccuuccggaaacgauuuuagaacuaacggacgcacucgcguuagggaugauggcuuuaaaaaucgugagaaauauggaaaaguaucaauuagcaguuacuauuauggcuauaagcuguguucccaaugcggugauacugcaaaacgcauggaaaguguccuguacaauccuagccgcugugagugugagucccuugcuguuaacuagcucacaacaaaaggcugauuggaucccccuggcacuuacaauaaaaggauuaaaucccacagccauauucuugacaaccuuaagcaggacaucaaagaaacggagcuggccacuaaacgaggcaauaauggcaguaggaauggucucaauccuugcaagcuccuuauuaaagaacgacaucccaaugacugggccacuggucgcgggaggauuauuaacgguuugcuauguacuaacgggucgaagcgcggaccuagaguuggaaagagcugcagauguaaagugggaagaccaagcagaaauuaguggcagcucaccgauacugagcauaacaauaucugaagaugggagcaugagcaucaaaaaugaagaagaggagcaaaccuuaacgauacucauucguacuggauuauuaguuauaucgggaguguucccagugucaaucccuauuaccgcugcggcgugguauuuaugggaagucaagaaacaacgagcggggguucucugggaugugcccaguccuccaccuguagguaaagcagaacuagaagauggugcauauagaaucaaacaaagaggaaucuuaggauauucacaaauaggagcgggaguauacaaagaagguacauuccauacgauguggcacguaaccaggggagccgugcugaugcauagggggaagagaauagaaccaaguugggcagauguuaagaaagacuuaauaaguuacgguggaggcuggaaacucgaaggagaauggaaggaaggagaagagguccagguacuggcguuagagccaggcaagaacccuagagcaguccaaaccaaacccggaauuuuuaaaacaaacacuggaacgauuggagcaguaucucucgauuucaguccuggaacaucaggaucacccauuguagacaggaaaggaaaagugguugguuuguauggaaauggagucguaacgagaaguggcgcauauguuagcgcaauugcgcagaccgagaaaagcaucgaagauaaucccgaaauugaggaugacauuuuccgcaagaagagacuuacaauaauggauuuacacccaggggccgguaaaacaaagagauaucucccagcuauaguacgagaggcuauaaaaaggggucuacgcacguugauuuuagcccccacaagaguaguagccgcagaaauggaagaagcauuaaggggucuuccgauaagguaucaaacucccgcaauucgagccgaacauacaggucgggagauugucgauuugaugugucacgcuacauuuacaaugagacuauuaaguccagucaggguaccaaacuauaaccucauaauuauggaugaagcacacuucacagacccagcgucuauagcggccagaggauauauuaguacaagggucgaaaugggggaggccgccggaauauuuaugacagcgacgccuccgggaaguagagaccccuucccacaaucaaacgcaccuauuauggaugaggaacgugaaauacccgagaggagcuggaacuccgggcacgaauggguuaccgacuuuaaaggaaaaaccguaugguucguuccgucaauuaaagcagguaaugauauagcggcaugccuccgaaagaauggcaagaaagucauucaacucaguagaaagacauucgauucagaauacguaaaaacucgagcgaaugauugggacuuugucgugacaacggacaucagcgaaaugggggcaaacuuuaaagccgagagaguuauugauccacguaggugcaugaaaccaguaauacuaacugauggagaagaacgaguaauucuagcagguccuaugccuguaacucacagcuccgccgcgcagagaagaggacgaauaggaagaaauccgaaaaaugagaaugaccaauauaucuauaugggggaaccauuagaaaacgaugaagacugcgcccacuggaaagaagcgaaaauguuauuagauaacauaaacacgccugagggcauuauccccaguauguucgagccugaaagagaaaaaguagaugcuauagacggagaauaucgauugcgaggagaagcucguaaaacauuuguggauuuaaugcguagaggugauuuaccaguguggcucgcauacaaaguugcggcggaagguauuaauuaugccgaccguaaaugguguuuugacgguauuaaaaauaaccaaauccuagaggaaaacguugaaguagaaauauggacaaaggagggagaaagaaagaaauuaaagccuagauggcuugacgcucgaauuuacucugauccacucgcucuaaaagaguucaaagaauuugcggccggaagaaaaagucugacuuuaaauuuaauuacugaaaugggucgucuccccacuuucaugacacagaaagcuagaaaugcguuggauaacuuagcaguauuacauacugcugagguuggagggaaggcuuacacccaugcucuuagugaacugccggaaacgcuagaaacuuuacuucuuuuaacuuugcucgcugcggucacagguggaauuuuucuauucuuaaugagcggaaaagguauagguaagaugacauuggguauguguugcaucauaacggcaucgauauuacuaugguaugcccaaauacaaccacauuggauagcagcuucuauuauucuagaauuuuucuugauagugcugcucauaccagaaccagagaagcaaaggacaccacaagacaaucaauuaacguauguaguuauugcaauuuuaacaguaguggcugcaaccauggccaaugaaaugggauuucuugagaaaacaaagaaagaucuuggcuuugggaguauaacaacucaagaaucagaaucuaacauacuggacaucgaucuacgaccggcaucugcuuggacacuauaugcaguugcaacaaccuuugucacaccuauguuacgacacucaauagaaaacucuuccguaaacguaucucuaacagcaaucgcaaaucaagcgacaguucucaugggacuaggaaaaggauggccguuaucaaaaauggauauuggagugccucuucuagcaaucggauguuacagucaaguaaauccaauuacgcuaaccgccgcacuacucuuauuaguggcucacuacgcgauuauaggcccggguuuacaggcuaaagcaacaagggaagcucaaaaacgggcagcagcagggaucaugaaaaauccgaccguugauggaauaacugucauugauuuagaaccgauaccauacgauccaaaguuugaaaaacagcuaggucagguaauguuauuaauccucugcgugacgcaaguccucaugaugagaacuacuugggcguugugugaggcuuuaacauuagcuaccggaccaauaucaacgcucugggaaggcgaucccggcagauuuuggaauacaaccaucgcuguaucaauggcgaauauauuuagaggcuccuauuuggcgggagcugguuuacuauuuaguauaaugaagaacacaacuaacacuaggcgcggcacaggaaacguaggcgagacacugggcgaaaaauggaaaucacgauugaaugcacuaggaaaaucggaguuucaaauauacaaaaagucgggaauacaagaaguugacagaacauuagccaaggaaggcauaaaaagaggggaaacugaucaucacgccguaucgcgaggcagugcaaaacuuagaugguuugucgaacgaaauaugguaacucccgaagggaaagucguagaucuugguuguggaaggggaggauggaguuacuauugcggaggacuuaagaaugucagagagguaaaaggacuaacgaaagggggaccgggccaugaagaaccaauuccaaugucuaccuauggcuggaaccugguucgacugcaaagcgguguggauguauuuuucacgccaccagagaaaugcgacacacuacuaugugauaucggugaaucaucaccuaacccaacgauugaagcgggacguacacuuaggguucuuaaccucguugagaacuggcugaacaauaauacccaauuuuguaucaagguucugaauccauauaugcccagcgugauagagaagauggaaacacuucagcgaaaauaugggggagcauuaguucgaaaucccuuaagucgaaacagcacucacgaaauguacuggguaucaaacgcaacuggaaauauagugucaagcguuaacaugauuucgagaauguugaucaaccgcuucacaaugaaacacaagaaggcuacguacgaaccugauguagaucuuggcaguggcacacgcaacauaggcaucgaauccgagaucccaaacuuggacauuguaggcaaacgaauagagaaaauaaaacaagagcacgaaacaaguuggcacuaugaccaagaccacccauauaagacgugggcauaucauggaagcuacgaaacuaaacaaaccggaucugcauccagcaugguaaaugguguaguacgcuugcucacuaaacccugggauguuguaccaaugguaacucaaauggcuaugacagacacaacaccuuuuggccaacaacgagucuucaaggagaaaguugacacaaggacgcaagagccuaaagaaggaacgaagaagcugaugaaaaucacagccgaauggcucuggaaagagcucgguaaggaaaagacaccacgaauguguacgcgggaggaauuuacccgcaagguaagaucaaaugcggcucuaggagcagucuuuacagaugaaaauaaauggaaaagugcacgugaggcugucgaagacggaagauucugggagcuaguggaucgagaacgaaacuugcaccuugagggaaagugugagacaugcguauauaacaugaugggcaaacgugagaagaaacuaggugaauuugggaaagcaaaaggaucgagggcuaucugguacauguggcucggggccagguucuuagaguucgaagccuuagguuuucuaaaugaagaucauugguuuucaagaggaaacucacuaagugguguagaaggggaggggcuucacagguuaggguauauacugagagaaguggguaagaaagagggaggcgcaauguaugcagaugacacagcagguugggacacaagaauuacccuagaggauuugaaaaacgaggaaaugguaacaaaccauaugaaaggagaacauaagaaauuagcagaagccaucuucaaauuaacguaucaaaacaaaguaguaaggguccagcguccgacaccaagaggaacgguuauggacauaaucagccgcaaagaucaacgagguucgggacagguuggaacguauggacugaacacguuuacaaauauggaagcccagcuaauaaggcaaauggaaggagaaggaauuuuuaaaucuauacaacauuuaaccgcuacugaagagauagcgguucaaaacugguuggcucguguuggacgagagaggcuaucaagaauggcgaucuccggagaugacugcguaguaaaaccgauagaugauagauuugcgucugcacugacagcacuaaaugauaugggaaaaguucgaaaggacauacagcaaugggagccuaguagaggauggaaugauuggacucaaguaccauuuugcagucaccauuuccaugaauuaguaaugaaagacggacgaguauuaguugucccauguagaaaccaggaugaauuaauuggacgagccagaauaucccaaggugccgguuggagucuaaaggaaacagcaugccuagggaaaaguuaugcucaaauguggacgcuaauguacuuucaccggcgagauuuacgguuagcugcaaaugcaauuugcucagcuguaccaucucauugggugcccacuucaaggacaaccuggagcauccacgcaaaacaugaauggaugacaacggaagauaugcuagucguuuggaauagagucuggauacaagagaacccauggauggaagacaaaacuccaguagaaaguugggaagaagucccauaucuaggcaagagagaagaucaaugguguggaucacucauuggucuaacaagucgugccacaugggcuaaaaacauacaaacagccauaaaccagguccgcuccuuaauaggcaaugaaggcuacacagauuacaugccguccaugaaaagauuccggagagaagaagaggaagcaggaguguugugguaa

SEQ ID NO: 22475 - RNA, 9876 nt, Artificial Sequence
  derived and/or modified CDS sequence (opt6) from DENV-2__KC294209__SS-prME
acugcggguguaaucguaauguuaauuccuacagcaauggcauuucaucuuacgacaagaaauggagaaccgcauaugauaguuggaaggcaggaaaaagguaaaagucuauuauucaaaacugaagauggaguaaauauguguacacuaauggcaauagauuuaggugaacuuugugaagauacaauuacauauaaaugcccuuuacuuagacagaacgaaccagaagacauugauugcugguguaacaguacaucgacuugggugaccuaugguacuugcacuacaacgggagaacauagaagagagaaaagaaguguugcauuaguaccucauguaggaaugggauuggaaacaagaacagaaacuuggaugaguagugaaggggcuuggaaacacguucaaaggaucgagacauggauacuucgacaucccggcuuuacaauaauggcagcgaucuuggcauacacuauagggacgacacacuuccagcgagcacuuauuuucauauuauuaacggcaguagcgccaucuaugacuaugcgaugcaucgguaucaguaauagagacuuuguugaagguguaagcggggguucauggguugauaucguacuagaacaugguuccugcguaaccacuauggccaaaaauaaaccaacacuugacuuugaauugaucaaaacggaagcaaaacaacccgcgacccucagaaaauacuguauagaagcaaaauugacuaacacaacaacagaaucuaggugcccgacccaaggagaacccucccuaaaugaagaacaagauaaacgguucauauguaaacauuccaugguagaucgaggaugggguaacggauguggauuguuugguaaagguggaauuguaacaugugcuauguuuacauguaagaaaaauauggaaggcaaaauugugcaacccgaaaaucucgaauauacaaucguuauuacaccacauucaggggaagaacaugcagucggaaacgauaccgggaaacaugggaaagagauaaaaauaacgccacaaucaucaaccacagaagcugaauuaaccgguuacggcaccguuaccauggaauguucgcccagaaccgguuuagauuuuaaugaaaugguuuugcuucaaauggaagacaaagcauggcuaguccauaggcaaugguuuuuagaccuuccacucccaugguuaccuggggcugauacccaaggaucuaauuggauccaaaaagagaccuuagugacuuucaaaaauccacacgccaagaaacaagacguaguugugcuaggcucccaggaaggagcaaugcacacugcguuaacaggagcaacagaaauucagaugucgucgggaaaucuucuauuuaccgggcaccuuaaaugucgauugagaauggauaaauuacaauuaaaaggaauguccuacucuauguguacaggaaaauucaaaaucguuaaagaaauagccgagacccaacacggaacuauagucauccgcgugcaauacgagggcgaugguucaccuugcaaaauaccauuugaaauaacagacuuagaaaagaggcauguucucgggcgacugauaacugucaacccuaucguuacugagaaagacucaccaguaaacauugaagcugaaccucccuuuggugauaguuacauaauuguaggaguugaaccgggccaacucaagcuaaauugguuuaagaaaggcucaaguauaggacaaauguuugaaacuacgaugcgaggugcaaaacgaauggcuauuuuaggugacaccgcuugggacuuugggucguugggaggaguauuuacuucaauaggaaaagcauuacaccaaguauucggagcuauauauggagcagcuuuuagcggagugucauggaccaugaaaaucuugauagguguaauaauuacuuggaucggaaugaacucacgauccacuagcuuaagcguaucucuuguguuaguaggugugguuaccuuguacuuaggagcgaugguacaagcggauagcggguguauuguuuccuggaaaaauaaagagcuaaaaugugguagcgggauuuuuauaacugauaauguucauacuuggacugaacaauacaaauuccagccagaaucacccucaaaacuagcaucggcuauacaaaaagcgcacgaggaagguauuuguggaauuaggucuguuacccgacuugaaaauuuaauguggaaacaaaucaccccagaacuuaaucacauucuaagcgaaaaugaaguaaaauuaaccauuaugacgggcgauauaaaggguauaaugcaagcaggcaagcgcucauuacguccacaaccaacugaauuaaaguauucauggaaaacaugggguaaggcgaagaugcucucaacagaaucccauaaccaaacauuucuaauagauggacccgaaaccgccgaaugcccaaacaccaaccgagcguggaacagcuuagaaguggaagacuauggauucggaguauucacuacaaacauauggcuaaaacuucgagaaaaacaggaugucuuuugugauagcaaacuaaugucagccgcuauuaaagauaauagagcuguucaugcagauauggguuacuggauugagucugcuuuaaacgacaccuggaagauggaaaaagcgucuuuuauagaaguaaagaguugccacuggccgaaaucucacacacucuggucuaauggcguucuggaaucggagaugauuauaccuaaaaacuuugcggggccagucagucaacacaauuacagaccagguuaucacacucaaaccgcagguccuuggcauuuggguaagcuggaaauggauuucgacuuuugcgaaggcacaacuguuguaguaaccgaggacugugguaauagagggccgucacugcgaacaacuacagcaaguggaaaauuaaucacugaauggugcuguagaucuugcacgcuuccaccucuaagauauagaggugaagauggcuguugguacggaauggaaauaagaccuuuaaaagaaaaagaagaaaauuugguaaacagcuuaguuacugcagggcacggucaaauugauaauuucagccucggaguucuuggaauggcacuguucuuagaagaaauguugcguacucgaguagggacuaaacacgcaauacucuugguagcacuuucuuuugucacgcucauaacuggaaauaugaguuuuagagaccuagguagaguaaugguaauggucggagcaacgaugaccgaugauauagguauggguguaaccuaucuagcauugcucgcugcguucaaagugagaccuacuuuugccgcggguuugcuccuacgcaaauugaccagcaaggaguugaugauggcuacaauaggaauugcuuuacuaucucaaucaacucuaccagagacaauuuuggagcucacagaugccuuggcuuuaggcaugauggcgcuaaaaauuguacgaaauauggaaaaauaucaguuagcuguuacaaucauggccaucucuuguguuccgaaugcaguuauauuacagaaugcguggaaagugucuuguacgauacuggcagcaguaagcguaaguccgcugcuguuaacgagcucacagcaaaaagccgacuggauaccauuagcgcuaacgauaaagggauuaaacccaacugcaaucuuucucacgaccuuaucacguacgucuaagaaacgcucuuggcccuuaaaugaggcaauaauggcgguaggcauggugucuauauuggcaucaucacuauugaaaaacgauauaccaaugacagggccccuaguugcuggaggacuacuaacagugugcuacguuuuaacagguagaucagcagacuuagaguuagagcgugcggccgacgugaaaugggaagaucaagcagaaauaucaggauccaguccaauacucaguauaaccauuucagaagauggguccaugucaaucaaaaaugaggaagaagaacaaaccuuaaccauauuaauccgaacuggacugcuaguaauaaguggcguauuccccgugucaauuccaaucaccgcggcugcuugguaucuuugggaggucaaaaagcaacgggcggguguguuaugggaugugccgucaccgccuccuguaggaaaggcggaacuagaagauggcgcuuacagaauuaaacagagaggaauauuaggauauucccaaauaggcgcgggaguuuauaaggaaggaacguuccacaccauguggcacgugacgagaggcgcggugcuuaugcacagagggaagagaauagagccaucgugggccgaugucaagaaagacuuaauuucauauggaggcgguuggaaacuagaaggugaguggaaagaaggugaggaaguacagguacuugccuuagaaccagguaagaauccacgggccguucaaaccaagccagguaucuuuaagaccaacacgggaacaauuggugcagugaguuuggauuuuucuccaggaacaucaggaaguccuauuguagauagaaaaggaaaaguaguuggguuauacgguaacggaguaguuacuaggaguggugcauacgugagugcgauagcccaaaccgaaaaaucaauugaagauaauccggaaauagaagaugacaucuuuagaaagaagcgacuaacuauaauggaucuucauccgggagcugggaaaacgaaacguuaucugccagcaauaguacgugaagccauaaagagaggauuaagaacacuaauacucgcgccaacaagaguagucgcggcugaaauggaagaagccuuacgaggauuaccaauaagguaucaaacaccagcuaucagagccgaacauacaggucgcgagauaguagaccuaaugugccacgcuacauucacgaugcgucuauuaagcccaguaagaguuccgaacuauaaucuaauaauuauggaugaagcgcauuucacugauccagccucuaucgccgcucgaggauauaucucuacuagaguagagaugggcgaagcugcaggaaucuuuaugacugcaacaccaccagggaguagagauccauuuccucaaucuaacgcaccaauuauggaugaggaaagagagauucccgaaagaucauggaacucggggcaugaaugggucacugauuuuaaaggcaaaacgguaugguucgucccaaguauaaaagccggaaacgauauugccgccugcuuaaggaaaaacggcaagaaggucauucaauugucaagaaagacauucgacucggaguaugucaaaacuagagcuaacgacugggauuucguugucacaacagacauaagcgagaugggagccaauuuuaaagcugaaagaguaauagauccaagacggugcaugaaacccguaauauuaaccgauggagaagaacgugugauauuagccggaccgaugcccguaacacauagcucugcagcacagcgucgcggucggauuggacgaaauccgaaaaacgagaacgaccaguauaucuauaugggagaaccacuagaaaacgacgaagauugcgcucacuggaaggaagcaaaaaugcuauuggacaauauaaauaccccagaaggcauaaucccuucaauguuugaaccggagagggagaaaguggaugcuauagacggagaauauagauugaggggagaggcaagaaaaacguuugucgaucuuaugagaagaggagacuuaccaguaugguuagcauacaaaguagcugcagaaggcaucaauuaugcugaccgaaagugguguuuugacggaaucaagaauaaccaaauuuuagaagaaaacguagaaguagagaucuggaccaaagagggcgaaaggaagaaacugaaaccccgguggcucgacgcccgaauuuauagugacccccucgcucuaaaagaauuuaaagaauuugcugcaggaaggaaaucucugacauuaaaucuaauaacugaaauggguagguuaccaacguuuaugacucaaaaagcuagaaaugcacucgauaaccuagcaguauuacauacggcugaaguuggagguaaagcauauacucacgcguuauccgaacuaccggaaacucuggaaacacuucuguuauugaccuuacuggcagcagugacagguggaauauuucuauuuuuaaugucgggcaagggaguaggcaaaaugacccuagguaugugcugcauaauaacggcaucaauauuauuaugguaugcucagauacaaccacauuggaucgcugcauccauuauacuagaguucuuucuaauaguccuguuaauaccugaaccagaaaagcaaagaacuccucaggacaaucaacugacguaugugguuauagcaauccucaccguuguugcugcaacaauggccaaugaaaugggcuucuuagagaaaaccaagaaagaccuuggauucggcucuauuacaacacaagaaucagaauccaauaucuuagauauugaucuaagaccagcauccgcauggacuuuguacgcgguggcaacaacauuuguuacaccuaugcuuagacacaguauugaaaauucaaguguaaacgucucauugacagcuauagccaaucaagcuacuguuuuaaugggguuagguaaaggauggccuuuaaguaaaauggauaucgggguuccacuacuggcgaucggcuguuauagucaagucaauccaauaacuuuaacagcugcuuuauuacuauuggucgcccauuaugcuauaauuggacccggucuacaagccaaagccacaagggaagcucaaaaacgggcggcagcagguauaaugaaaaauccaaccguugaugguauaacaguaauagaccucgaacccauaccauacgacccuaaauuugagaaacaacuaggacaaguaaugcuccuaauuuuauguguuacacagguauugaugaugcguacuacaugggcauugugcgaagcgcuaacauuagcaaccgguccuaucaguacgcugugggagggaaauccuggacguuuuuggaauaccacgauagcuguaucaauggcgaacauuuucagagggagcuauuuagcuggcgcaggucuuuuauuuucaaucaugaagaauaccacuaauacuaggcgcggcacaggaaacgugggggaaaccuugggagaaaaauggaaaucccgcuuaaacgcacuuggcaagucugaguuucaaauuuauaagaaauccgguauucaagaaguggauagaaccuuggcaaaagaaggaauuaagagaggggaaacggaucaccaugcggugagcagaggaagcgcaaaauugcgcugguucguagaacgaaacaugguuacaccagaagguaaaguuguugauuuaggaugcggccgugggggauggucauacuacugcgggggucuaaagaauguaagagagguuaaaggcuuaacaaaaggcggaccaggacacgaagaaccaauuccgaugucaacauacggauggaacuuaguacgacuucaaaguggcguugauguguucuuuacucccccggagaaaugcgacacacucuuaugugacaucggagaauccaguccgaacccaacgauugaggcuggacguacucuucgaguacuaaauuuggucgagaauuggcuaaauaacaauacacaauuuuguauaaaaguguuaaacccuuacaugccuucaguuauugagaaaauggaaacacuacaacguaaauacgguggcgcauugguaagaaauccauuaucacgcaauucaacgcacgaaauguauuggguaucuaaugccaccggaaauauagucucuagugugaacaugauuucgaggaugcuuauuaacagguuuacgaugaaacauaaaaaggcuacauaugaaccugacguagaccuaggaucagguacacguaauauugguauugaauccgaaauaccaaaucuugauauuguugggaaacgcaucgaaaagauaaaacaagaacaugaaacaagcuggcauuacgaucaagaucauccauauaagacaugggcauaucauggcucauaugaaacuaagcaaacaggaagcgcuucguccaugguuaauggagugguaaggcucuuaacuaaaccaugggauguaguuccaaugguuacucaaauggcgaugacagacaccacgccguucggacaacaaaggguauuuaaggagaaaguugauacgaggacacaggagcccaaggaagguacuaaaaaguugaugaaaauuacagccgaaugguuauggaaagaacucgguaaagagaaaacaccccgaauguguacucgugaagaguucacacgcaagguccgaucaaaugccgcccuuggggcaguuuucacggaugaaaauaaauggaaaucugcaagagaagcgguagaggacggaagguuuugggaauuagucgauagagaaagaaaucuacaucuugaaggcaaaugcgaaacgugcguuuacaacaugaugggcaagagagaaaagaaauuaggcgaguucggaaaagccaaaggaucgagggcaauaugguacauguggcuaggggcaagauuucuggaauuugaggcauugggauuucuuaacgaggaccacugguuuucccguggaaauagcuugucaggcgucgagggagaagggcuccacaggcucggauauauucuaagggagguaggcaagaaggaaggaggggcgauguacgcagacgacacagccggcugggauacucggauaaccuuagaagaccuuaaaaaugaagaaaugguuacaaaucauaugaaaggagaacauaagaaacuagcugaagcgauauucaaacuaaccuaccaaaauaaagugguaagaguacaacgaccaaccccucgugggacaguaauggauaucauuucuaggaaagaucagcgcgggucaggacaagucggcacauauggcuugaauacauucaccaacauggaagcucaacuaauaaggcaaauggaaggagaagguauauucaaaaguauacagcauuuaaccgccacagaggaaauagcgguucaaaauugguuggcacggguuggucgggagcggcuuagccguauggccauuucaggagaugauuguguaguuaaacccauagacgauagguucgcgucagcacuuacggcucugaacgauaugggcaaaguucgaaaagacauccaacaaugggaaccaucgaggggguggaaugacuggacacaaguccccuuuugcucgcaucauuuccaugaauuaguuaugaaggaugggaggguccuaguaguaccuugccgcaaucaagacgaauugauagguagagcccgaaucagucaaggagcaggauggucccucaaagaaacggcgugucuagggaaauccuaugcgcaaauguggaccuugauguauuuucaucgaagagaccuuagauuggcagcgaacgcuauaugcucagcagucccaucccauuggguaccaacuagcagaacaaccuggaguauacacgccaaacacgaauggaugacuacugaagauauguuaguaguauggaaucgcgucuggauucaagaaaaucccuggauggaagacaaaacacccguggaauccugggaagagguaccauauuuggggaaacgcgaggaccagugguguggaucccugauaggauugacaucuagagcgacaugggcuaaaaauauacagacagcaauaaaccagguacggagucuaaucgggaacgaaggauauaccgauuauaugccaucaaugaaaagauucagaagagaggaagaagaagcaggaguauuaugguaa

SEQ ID NO: 22476 - RNA, 9876 nt, Artificial Sequence
  derived and/or modified CDS sequence (opt6) from DENV-2__KC294214__SS-prME
acugcaggaguuauaguuauguuaauucccacggcaauggcguuccaccuaacaacuaggaauggggaaccucacaugauaguugguagacaagaaaaagguaaaucacuauuauuuaaaacggaagacggaguaaauauguguacauuaauggcaauagaucugggagaacuuugugaagauacaauaacuuauaaauguccacuauuacgacagaaugaacccgaagauauagauuguuggugcaacaguacaucgacguggguuacguauggaacguguacaacaacaggugaacacagacgagagaaaagaaguguagcgcuugucccucauguugguauggguuuggaaacuagaacggaaacauggaugucaucagaaggugcguggaaacacgugcaacgaauagaaacauggaucuuacgacacccugguuuuacaauaauggcagcaauuuuagcguacacuauaggcaccacccacuuccagagagcauuaauauuuauauugcuuacagcaguagcacccaguaugacaaugaggugcauuggcauaucgaaccgagacuucguagaaggcguaaguggugguucauggguagacauuguguuagaacacggcaguuguguaacaacgauggcuaaaaauaaaccgacucuagauuucgaauugauuaaaacggaagcaaaacagcccgcaacuuuaagaaaauacuguauugaagcaaaauuaacaaauaccacaacagaaucccgguguccuacccagggggaaccaagucucaacgaagaacaagacaaacguuucauauguaaacauaguaugguugaucgcggaugggggaauggaugcgggcucuuuggaaaagguggaauagucacuugugcaauguuuaccugcaaaaagaauauggaagguaagauuguacagccagaaaaccuagaauacacaauagucauaacaccucacaguggcgaagaacaugcuguaggcaacgauacagguaaacaugggaaagaaaucaaaauaacgccacaauccuccacuacugaagcagaacuaacaggauauggaacaguaacuauggagugcucgccacguacgggucuagauuuuaacgaaaugguguuguuacaaauggaagauaaagcgugguuaguucacaggcaaugguucuuagauuuaccacuuccgugguuaccuggggcggauacacaaggaaguaauuggauacaaaaagagacauuaguuacauuuaaaaauccacacgccaagaaacaggacguggugguacuugggagucaagaaggagcaaugcacacagcauuaacgggggcuacagagauacagaugucuagcgguaaccuacuuuuuacgggacacuuaaaaugccgauuacguauggacaaauugcaguugaaagggauguccuauucuauguguaccggaaaauuuaaaaucguaaaagagauugcggaaacacaacacgguacuaucgugauucguguccaauaugagggugaugguucgccauguaaaaucccguuugaaaucacagaccucgagaaaagacauguacuaggaagacuaaucacagugaauccgauagucacugaaaaagauuccccaguaaauauugaagcagaaccacccuuuggcgauaguuauaucauugucgggguagaaccuggccaauuaaaacugaauugguucaagaaagggucuaguauuggacaaauguucgaaaccacuaugcguggagcaaaacgaauggcgauauuaggagacacagcaugggacuuuggaagucuuggaggaguauucacgaguaucgguaaagcacuccaucagguguucggcgcaaucuauggagcugcauuuuccggugucuccuggacaaugaaaauacucaucggaguaauuauaacuuggauuggaaugaauagcagaagcacaucacucucagucagccugguguuagugggugucgucacacucuauuuaggcgcaaugguccaggccgacuccggcuguauugucaguuggagaaacaaagaauugaaaugugggucugguauauucauaacggacaacguucauacuuggacugaacaauacaaguuccagccagaaagucccucaaaacuagcaucggccauacaaaaagcccacgaggaagguauaugcggaauaagaucaguaacuaggcuagagaauuuaauguggaagcaaauaacuccugaacuaaaucacauuuugucagaaaaugaagucaaacucacgauaaugacaggagacauaaaaggaauuaugcaagcugguaagagaucucugcgaccccaacccacugaacuuaaauauucuuggaagacaugggguaaagcgaaaauguugucaacggagucacacaaccaaacauuuuuaauugacggaccagaaaccgcggaauguccgaacacaaauagggcuuggaacucgcuagaaguggaagacuaugguuuugguguauuuacuacuaauaucugguugaagcuccgcgaaaagcaagacguuuucugugauucaaaauuaaugagugcagccauaaaggauaacagagcuguacaugcugauaugggcuauuggaucgaaagugcacuuaaugauacauggaaaauggaaaaggccucauucauagaaguuaagagcugucauuggccaaaaucucacaccuuguggucaaacggaguauuagaaagugaaaugauuauacccaaaaauuucgcgggaccaguaucgcaacauaauuacaggccgggcuaucauacacagacagccggaccauggcauuuagguaaauuagaaauggauuuugauuuuugugaaggcacaaccgugguugugacugaagacuguggaaaccgaggaccaucgcucagaacgacuacugcaucggguaaguuaauaaccgaauggugcugccgcucauguacgcuaccaccacuaagauauagaggggaggauggcuguugguacgggauggaaauaaggccguuaaaagaaaaagaagagaacuugguuaauagccuaguaacagcgggacacggucaaauagauaauuuuucacuagguguacuaggaauggcacuauuucuagaggagauguuaaggacaagagugggaacaaaacacgcaauauugcuaguggcccuaaguuuuguaacucuaauuacaggaaacaugucguucagagaucuugguagaguaaugguuaugguuggagccacuaugaccgacgauauagggauggguguuacuuauuuagcauuacuugcagcauucaaaguaaggccaacuuuugcggccggccuuuugcuccguaaacuaacaaguaaagagcuaaugauggcuaccaucgguauagcacugcuuucgcaauccacgcucccugaaaccauuuuagaauuaaccgacgcuuuggcacuaggaaugauggcauuaaaaauaguacguaauauggaaaaguaccaauuagcaguaacgauaauggcaauaaguugcguaccgaacgcuguuauacuucagaacgcauggaaagucucuuguacaauucuagccgcagucucggugagcccacuucuguuaacaucaagucaacaaaaagcagauuggauaccacuugcuuugacuauuaaaggauuaaauccaacagcuaucuuuuuaacgaccuugucucggaccuccaagaaacgcuccuggccucucaacgaggcaaucauggcugucgggaugguguccaucuuggcaucuucacuccuuaaaaaugauauaccgaugacaggacccuuaguugcugggggauuacuuacggucuguuacguauuaaccgggagaucggcagacuuagaauuagagagagcagcagauguuaaaugggaagaccaggcagaaauaaguggaucaucaccaauauugaguauuacuauuagcgaggauggaucuaugaguauaaagaaugaggaagaggaacaaacauuaacaauuuuaauacgaacaggacugcuaguaauaagcgggguguuccccgucuccaucccaauuacagcugcagcaugguauuuaugggaagucaagaaacaacgagcaggaguuuuaugggacguuccuuccccacccccagucggaaaggcagaacucgaggauggagcguacagaaucaaacagcgaggaauacuuggauacagccaaauaggugccgguguguacaaagaagguacuuuccacacgauguggcacguaacgagaggggcaguucugaugcacaggggaaagagaauugagccauccugggcagacgugaagaaagauuuaauuucauauggcggagguuggaaacucgaaggagaauggaaagaaggagaggaaguucagguauuagcccucgagccaggcaaaaauccuagagcuguccaaacaaaaccaggcaucuucaagacaaacaccgguacgauaggggcaguuagccuugauuuuucuccuggaacaagugguucuccaaucguagaccgcaagggaaaagucguuggccuuuaugggaacggcguaguaaccaggaguggggcguaugucucugcgauugcucaaacggaaaaaucaaucgaagacaauccagaaauagaagacgauauuuucaggaagaaacguuugacaauaauggauuuacacccuggagcuggcaaaacaaaaagauaccucccagccauuguacgagaagccauaaaaagaggacugcgcacuuuaauauuagcuccgacaagagucgucgcagcugaaauggaagaagcccugagaggacucccaauaagauaccaaaccccugcaaucagagcagaacacaccgggcgggaaaucgucgacuuaaugugucaugcaacuuuuacaaugagacuacuaucaccaguacgagugccaaauuauaaucuuauaauuauggacgaagcucauuuuacagaucccgcauccauugcugcacgaggauauauaaguacuagaguugaaaugggcgaagccgcgggaauauuuaugaccgcgacuccucccggaucaagagaccccuuuccacaaagcaaugcaccaaucauggaugaggagcgagaaauuccggagagaucuuggaacucgggucaugaauggguuaccgacuuuaaaggaaaaacugucugguuuguaccgucaauuaaagccgggaaugauauagccgcuuguuugcgcaagaaugguaagaaaguaauacaguuaucgcguaaaacauuugacuccgaauaugucaaaaccagggcgaaugauugggacuuugucguaacuaccgauauaagugagaugggagcaaauuuuaaagccgaaaggguuaucgauccaagaagauguaugaagccagucauccucacggacggugaagaaagaguaauacucgcgggucccaugccugugacgcauaguucugcagcacaacguagaggacgaauuggacgaaacccuaaaaaugaaaacgaucaauauauauacaugggugaaccacucgaaaaugacgaagauugcgcgcacuggaaagaggcgaaaaugcuguuagauaauauaaauaccccagaagguaucauaccaucaauguuugagcccgagagggaaaaagucgacgcaauagauggugaauauagauuacguggggaagcgagaaaaacauuuguagaccugaugcggaggggagacuuaccgguauggcuugccuauaagguagccgcggaggguauaaauuaugcagacagaaaauggugcuucgacgggaucaaaaauaaucaaauacuagaggaaaauguagagguagagauauggacaaaagaaggcgaaagaaagaagcuaaaaccccggugguuagacgcacgaauuuauagugauccauuggcacuaaaagaguucaaggaguucgccgcaggaagaaagucauuaacccuaaacuuaauaacagaaaugggacguuugccaacuuucaugacacaaaaggcaaggaaugcgcuugauaaucuggcaguccuucauaccgccgaaguuggugguaaggcuuauacacacgcacugucggaauuaccggaaaccuuggaaacacuacuuuuguuaacacuccuagcugcaguuacaggagguaucuuucuguuucuaauguccgggaaaggaauagggaaaaugacacuagguauguguuguaucauaaccgcaucuauauuauuaugguacgcacaaauucagccucacuggaucgcugcaucaauuauacuggaauuuuuccucauugucuuauugaucccagaaccagagaaacaaaggacuccacaggauaaucagcugacauacguaguaauugcaauauuaacaguagucgcggcgacuauggcuaacgaaaugggauuuuuagaaaagaccaagaaagauuugggcuucgguaguaucaccacgcaagaaagugaaaguaauauauuggacaucgacuuacgcccagcgagugcuuggacguuguacgcugucgcuacuaccuucguaacgccgaugcuacgacacaguauagaaaacaguagcguuaaugugagccuaacggccaucgcaaaucaagcaaccgucuuaaugggauuaggaaaaggguggccgcucucaaagauggauauaggaguaccacuucuugcaaucggauguuauagccaaguaaacccuauaaccuugacagcagcacugcuucuucuaguagcacauuacgcgauaauaggaccaggacuacaagcaaaggcuaccagagaggcccaaaagagagccgcggcagggauaaugaagaauccaacaguagaugguauuaccgugauugauuuagaaccaauaccguacgacccaaaguuugaaaaacaacuuggucaagugauguuacuaauacugugcgugacucaaguuuugaugaugaggacaacuugggcgcuaugugaagcgcuaacacuugcaacaggucccauaagcacucugugggaagguaacccggggagauuuuggaacaccaccauagcgguaucaauggccaauaucuuuagaggaucauauuuagcuggcgcaggccuguuauucuccaucaugaaaaauaccaccaauacgcgucgaggaacaggaaaugugggugagacucuaggagaaaaguggaaaucacgauugaacgccuugggcaaaagcgaauuucaaauuuacaagaaaucagggauacaagaaguagaucgaacgcuagcaaaggaagggaucaaaagaggagaaacagaucaucacgccguaucacgaggaucagcgaaacuacgaugguucgucgaaaggaauaugguuacuccggaaggaaaagucgucgaucuaggauguggcagaggggguugguccuacuacugcggugggcucaaaaauguuagagaaguuaaagguuugacuaaaggggguccgggacacgaggaacccauaccaaugucaacauauggauggaaccucguacgcuuacaaucagguguagacguauucuuuacuccaccggaaaagugugacacgcuuuuaugugauaucggcgaaucgaguccaaauccaacaauagaagccggaaggacacuccgaguccugaaucuuguggaaaauuggcuaaacaauaacacucaauuuugcauuaaaguucucaauccauacaugccaucaguuauagaaaagauggagacccuacaaagaaaguaugggggcgcccuaguuagaaacccucuaucucgaaauuccacgcaugaaauguacuggguaaguaaugcaacugguaacaucguaaguucaguaaacaugauaucgcguauguuaauaaaccgauuuacuaugaagcacaagaaagcuacauaugaaccggacguugacuuaggaucggguaccaggaauauuggcauagaaucagaaauacccaaucuagauauugucgguaagagaaucgagaaaauaaaacaagagcaugagacuucauggcacuaugaucaagaucaucccuauaaaaccugggcauaucauggaucauaugagacuaaacaaacagguucagcaaguaguauggucaauggaguaguaagacucuugacuaaaccaugggauguaguuccaaugguaacccaaauggcuaugacugauacgacgccauuuggacaacaacgcguguuuaaggaaaagguagauacucgaacacaagaacccaaagaaggcacaaagaaauuaaugaaaauaaccgcagagugguuguggaaagaauuggggaaggagaaaacaccgcgcaugugcacaagagaagaguucacccguaaaguaaggucuaacgccgcauugggcgcaguguuuacggaugaaaauaaguggaaaagugcucgugaagccgucgaggacggacgguuuugggaguuaguagacagagaaagaaauuuacacuuagagggaaaaugugaaacgugcguauauaacaugaugggaaagagggagaagaaacuaggcgaauuuggaaaagcaaaagguucucgagcaauaugguacaugugguuaggugcuagauuuuuagaauuugaagcauuaggauuucucaaugaggaucauugguuuagcagaggaaauucacuaaguggaguugaaggagagggucuucaucgauuagguuacauccuccgugaaguaggcaagaaagaaggcggagcgauguacgcugaugauacggcggguugggauacacguauuacccuagaagaccuuaagaacgaagaaaugguuacgaaucacaugaaaggcgaacauaagaaauuagcugaagcaauauuuaaacuaacuuaucagaacaaagugguaagggugcaaaggccgacuccaagaggaacuguaauggacauaauaucacguaaggaccaacguggaucaggucaaguagggacauauggacucaacacauuuacgaacauggaggcucaacuaauacgacaaauggagggagaggguauauuuaagucaauccagcaccugacaacaacagaagaaaucgcaguccaaaauuggcuugcgagaguggggcgugagcggcucucucguauggcuauaucuggugaugacugcguugucaagccaauagaugaucguuucgccagugcccuaacagcacuaaaugauauggggaaaguccguaaggacauacaacaaugggagccgagucgaggcuggaaugauuggacgcaaguucccuucuguucucaccauuuccacgaauuaguaaugaaggauggccgagugcuagucguuccaugucggaaucaagaugaacuaauaggccgcgcaagaauaucucaaggcgcaggcuggucacuuaaagaaacagccuguuugggcaagaguuacgcacagauguggacauuaauguacuuucacagaagggacuugcgccuagcagcaaaugcaauaugcagcgcagugccgucacauuggguaccgacgucaagaacaacguggucaauucaugcaaagcacgaauggaugaccacggaggauauguuaguaguauggaauagagucuggauacaagagaacccuuggauggaagacaaaacuccuguugagaguugggaagaaguuccauaccucggaaagcgggaggaucaauggugugggucucuuauaggucugacgucacgugccacaugggccaaaaauauucaaaccgcuaucaaucaaguaagaucauugaucgggaaugaaggauauacggacuauaugccaucuaugaagagauucagaagagaagaagaggaagccggaguauuaugguaa

SEQ ID NO: 22477 - RNA, 9876 nt, Artificial Sequence
  derived and/or modified CDS sequence (opt6) from DENV-2__KC294205__SS-prME
acugcuggggucauuguuauguuaauuccuacagcaauggccuuccacuuaacgacaagaaauggugagccucauaugauaguuggacgucaggagaaagguaaaucacuauuauuuaaaacugaagacggcgucaacauguguacauuaauggcgauagauuuaggagaauugugcgaagauacaauaaccuauaaaugcccauuacugaggcagaaugaaccggaagacauagauuguuggugcaacucaacgucaacaugggugaccuacgggaccuguacaaccacaggggaacaucgcagggagaaaaggagugucgcacuggugccacauguuggaaugggauuagaaacuagaacggaaaccuggaugucaucggaaggcgcauggaaacauguucaacgaauugaaacuuggauauuaaggcauccaggcuuuacgauuauggcagcaauauuagcuuauacuauaggaacgacucauuuucaaagagccuugaucuucauacuacuuaccgcgguagcaccuagcaugacaaugagaugcauaggcaucucuaauagggacuucguggaaggaguaucgggugguaguuggguagauauaguccuggagcauggaucuuguguaacgacuauggcaaaaaauaaaccuacauuagauuucgaacuaauuaagaccgaagcaaaacaaccggcuacauugagaaaguacugcauugaagcgaaacuaacuaauacuacgacagaaucuagauguccuacucaaggagagcccucccuuaaugaggaacaggacaaaagauucauaugcaaacauaguaugguugacaggggguggggcaacggcuguggucuauuuggaaaaggagguauaguaacuugcgcgauguucacauguaaaaaaaacauggaaggaaaaauuguccaaccagaaaauuuggaauauaccauaguaauuacaccucacaguggggaagaacaugcagucggaaacgacacaggaaaacauggcaaggagaucaagauaaccccucaaucaucgaccaccgaagcugaacuaacagguuaugguacuguuacgauggaaugcucaccccgcacaggccucgauuucaaugaaaugguacucuuacaaauggaagauaaagcauggcuaguacaccggcagugguuucuggauuuaccccucccuugguugccaggcgcagacacucaaggaucaaacuggauccagaaggaaacacuugucacguuuaagaacccacaugccaaaaaacaagauguaguaguauuaggaagucaagagggggcgaugcauacagcccuuaccggagcgacugaaauucaaaugucaucagggaacuugcuauuuacgggacaucugaaaugcagauuaagaauggauaaacuacaauuaaaagguaugucauacucaauguguacaggaaaguucaaaauuguaaaagaaauagcugagacgcagcacgggaccauaguuaucagaguccaguaugagggugaugguaguccauguaaaauuccuuuugagauaacagauuuagaaaaaagacaugucuuaggccgacuuauaacaguuaaucccaucguuacggaaaaagauucucccguuaauaucgaggcagaaccuccguuuggcgauucuuauauaauuguagggguggaaccaggacagcucaaacuuaauugguuuaagaaagguucguccauaggucaaauguuugaaacgacaaugcgaggagcgaagagaauggcuauucuaggagauacagcaugggauuucgguucucugggagguguauucaccagcauugggaaagcccugcaccagguauuuggugcgauauauggagcagcguucucaggggugucauggaccaugaaaauauuaauaggaguuauaauaacuuggauaggaaugaauagcagauccacgaguuuaaguguuucuuuaguacugguagggguaguuacucuauauuuaggagcgaugguacaagcggauagcggaugcauagugaguuggaaaaacaaagaacugaaaugugguaguggcauauucauuacugauaaugugcauacuuggacagaacaguacaaguuccagccagaaucaccgucgaaauuggcguccgcuauacaaaaagcucacgaagaaggaauuuguggaauuagaucuguuacacggcuugagaaucuuauguggaaacaaaucacgccagaacuaaaucauauacucagugagaaugaaguaaaacuaacaauuaugacaggugauauuaaagguauaaugcaggcgggcaaacgcucguuacgcccccaaccgacggaacuaaaauauaguuggaagaccuggggaaaagccaaaaugcuuuccacugaaagccauaaucagacuuuccuaauagauggaccagagacugcugaauguccgaauacaaaucgggcauggaauucuuuagagguggaggacuauggauucgguguguuuacaacgaacauauggcuuaaauuaagagaaaagcaagacguuuucugugacucaaagcuuaugagcgcugcuauaaaagauaauagagccguccacgcagacaugggcuauuggauagagucagcguuaaaugauaccuggaaaauggagaaagccagcuuuauagaaguaaaaucgugucauuggcccaaaucucauacguuauggagcaacgggguacuagagagugagaugauaauacccaaaaauuuugcagggccggugucucaacacaauuacagacccgguuaucacacccaaacugcgggacccuggcaccucgggaaacuagaaauggacuucgauuuuugugaggguacgacggugguaguaacagaggacugcggaaacagggguccuaguuugagaacgacaacagcaucggggaaacuuauaacggagugguguuguaggucuugcacuuuacccccacuuagauacagaggagaagaugggugcugguauggaauggaaauacgaccguuaaaagaaaaagaggaaaaccuugugaauucucuagugacagccgggcauggacaaauugauaacuucucauuaggaguucucgguauggcauuauuccuggaagaaauguuaagaaccagaguugguacuaaacaugccauccuacuuguagccuuauccuucguaacuuuaauaacagggaacaugucuuuuagggacuuaggccgagucaugguuaugguuggagcaacaaugacagaugauauaggcauggguguaacuuaccuagcacuauuggccgccuucaagguaagacccacuuucgcggccggucuuuuacuaaggaaauugacgaguaaagagcuuaugauggcuacgauaggaaucgcauuacucucacagucaacuuuacccgaaaccaucuuggaauuaacagacgcauuggcauuagggaugauggcccugaaaaucguacgaaauauggaaaaauaucaacuagcggugaccauaauggcuauuucuuguguuccuaaugcagucauuuuacaaaaugcuuggaaagucucgugcacuauauuagcagcagugagugugucuccauuacuguugacaaguucacaucaaaaagcagacuggauucccuuagcguuaacaauaaaagguuuaaauccaaccgcuauauuucugacaacgcuuucaagaacaagcaagaaaagaucuuggccacuuaaugaagcaaucauggcgguuggaauggucucaauauuagccagcucacuuuuaaaaaaugauauaccuaugacaggaccccuaguugcuggaggguuauugacaguguguuaugucuuaaccggaaggagugcggacuuggaacucgaaagagccgcugacguuaaaugggaagaucaagcagagauuucaggaucuagccccauacucucuauaacaaucagugaggaugggucuaugucuauuaaaaacgaagaagaagaacagacucuuacuauacuaaucaggacaggcuuacuuguaauauccgguguauucccaguaaguauuccgauuaccgcugcugcuugguaccuaugggagguaaaaaaacaacgagccggagugcuaugggauguaccuucgccgccuccaguaggcaaggccgaauuagaagauggcgcauaccguauaaaacaacgcggcaucuugggauauucgcaaauuggggcgggaguauauaaagaaggcacuuuucacacaauguggcauguaacuaggggcgcggugcuuaugcacagagguaagaggauugaaccaucaugggcugacguuaaaaaagaucuuauuagcuaugguggugguuggaaacuagagggcgaguggaaagaaggugaagaagugcagguacuagcgcucgaaccaggcaaaaacccuagggcaguacaaaccaagccggguauuuuuaaaacuaauacuggcacaauuggggcagugagccuagauuuuucaccagguaccagcggaaguccgaucgucgaccgcaaagguaagguuguaggucuuuacggcaacggaguaguuacgcgcuccggcgcauauguuagcgcgauugcacaaacggagaaaucaauagaagauaacccagaaaucgaagaugacauauuuagaaagaaaagguugacaauuauggauuugcauccuggggccgguaaaacaaaaagauauuugccagcaaucguuagagaagcaaucaaacgugguuuacggacauuaauccuugcaccaacccgaguaguugcugcugaaauggaggaagcauuaagggguuuacccauaagguaucaaacaccagcaauacgagcugaacauacagggagagaaaucguagaucuuaugugccacgcuaccuuuacaaugcgccuuuuaaguccaguaagaguaccaaacuacaauuuaauaauaauggaugaagcucauuuuacagauccagcaaguauugcggcaaggggguauauaaguacacgaguugaaaugggugaagccgcugggauauucaugacugcaacaccaccgggcucaagggacccauuuccccagaguaaugcaccaauaauggacgaagaaagagagauaccagaacgaaguuggaauaguggucaugaauggguaacggacuuuaagggcaaaacgguaugguuuguuccaucaauuaaagccggcaacgacauugcagcgugccuucgaaaaaaugguaaaaaggugauacaauugagucgaaaaacauucgauucugaguacguuaagacucgggcgaaugauugggauuuugugguaacuacagauauuucugaaaugggagccaauuucaaagcugaacgagugaucgauccaaggcgcuguaugaaaccagugauccuaacagacggcgaagaacgugucauuuuagccggcccaaugccugugacacacagcucugcugcucaacgaagagguagaauaggacgaaacccaaagaacgaaaacgaccaauacaucuauaugggagagccauuggaaaacgacgaagacugugcacauuggaaagaagcuaaaaugcuccuugacaacauaaacacccccgaaggaaucaucccauccauguuugaaccggagcgggagaaaguugaugcaaucgacggagaauaccgucucagaggagaggcucggaagacauuuguagauuuaaugagacgaggggaccuccccguaugguuggcuuacaagguugcggcugaagguaucaauuacgcugacagaaaaugguguuucgauggaauaaaaaauaaccagauucuugaggagaacguggaaguagagauauggaccaaagaaggcgaacguaaaaaguuaaaaccccgauggcuugacgcgaggauuuauagcgacccguuagcacugaaagaauuuaaagaguucgcugcggggcggaaaucucuaacgcuaaaucuaauuacagagauggggcgauuaccaacauucaugacucaaaaggcgagaaaugcguuagauaaucuggcuguuuuacacacagcugaagucggggggaaggcguauacgcacgcacuauccgaacucccugaaaccuuggagacguugcuacuuuuaacccuacuagcugccguaaccggcgggauuuuucuauuccucaugagcgggaaggggauaggcaaaaugacccuugguaugugcugcauaaucacggcaaguauucuacuaugguaugcacagauucaaccccacuggaucgcggcuagcaucauacuugaauuuuuucuaauaguacuacugaucccagaaccggagaagcagaggacuccgcaagacaaccaacucacauauguugucauagccauauuaacggucguugcagcaacuauggcaaacgaaaugggcuuccuagaaaaaacaaaaaaagauuugggauuugggaguauuacuacgcaagaaagcgaaagcaauauuuuggauauagacuuacgaccggcgucggcguggacucuauacgcagucgcgacuacauuugucacaccaauguuaagacacagcauagaaaacaguucaguuaacguaagcuuaacagcgauugcuaaccaagccacaguacuaaugggauuagguaaagguuggccgcuaaguaagauggauauaggggucccacuguuagcaauaggaugcuauagucaaguuaaucccauaacccuaacagcagcccuucugcuuuuaguggcacauuaugcaauaauagguccuggacuucaggcaaaggcaacaagagaagcucaaaaacgugcagccgccgguauuaugaagaauccuaccguagauggaauuacagugauugaucuggaacccauaccuuacgauccaaaguucgagaaacaacucggacagguaaugcuccugauucucugugucacucaaguucugaugaugcgaacaacgugggcacuaugcgaggcucuaacacuagccacggguccaauaucaacauuaugggaaggcaacccuggaagauucuggaacacuacaaucgccgugucaauggcaaauauuuuucgaggaaguuacuuagcuggugcaggucuucuauucucaauaaugaaaaauacaacaaacacgagaagaggaacaggaaacguuggagaaacucuuggcgaaaaauggaaaucucgauugaaugcuuugggaaagagugaguuucaaauauacaaaaaaaguggaauacaggagguggaucgaaccuuagcuaaagaaggaaucaaacgaggugaaaccgaucaucaugcuguuagccgaggcucugcaaaauugcgcugguucgucgaaagaaauauggucaccccggaagggaagguuguugaucucgguugcggacgugguggguggucuuauuauuguggugggcuaaaaaauguaagagaaguaaaaggacuaacgaaagggggcccuggucacgaagaaccuauaccuaugagcacauauggcuggaaccugguaagguugcaaucgggcguagacguauucuuuacgcccccagagaaaugugacacccuauugugcgauaucggagaaaguaguccgaauccaacaauagaagccgggagaacuuugcguguacuuaaucuuguagaaaauuggcuaaacacaaacacucaauucugcauaaaaguacuuaaucccuauaugcccagugucaucgaaaaaauggaaacauuacaacgaaaguacgguggugcacuugugcgcaauccauuaucuaggaauucuacucacgaaauguacugggucaguaaugcuacugguaauaucgucucuucgguaaauaugauaucacgcauguuaauaaaccgguucacgaugaagcauaaaaaagccaccuaugaaccagauguugaucuagggucaggaaccaggaauauaggaaucgagagugagauuccaaaucuugauauaguagguaaaaggaucgaaaaaauaaaacaggaacacgaaacgaguuggcacuacgaucaggaucaccccuacaaaacaugggcauaccacggaucuuaugagaccaagcaaaccggaagcgcuagcuccaugguaaacggcguuguuagacuacuuaccaaaccaugggauguaguaccaaugguuacacaaauggccaugacugacacaacuccauucggucaacaaagaguuuucaaagaaaaagucgacacuagaacacaagagccaaaagaaggcaccaaaaaacuaaugaaaauaacugcugaaugguuguggaaggaacuuggaaaagagaaaacgccaagaauguguacuagagaagaauuuacacguaaaguuagaaguaaugcugcgcuuggcgcaguauuuacagaugaaaauaaguggaaguccgcuagggaggcggucgaagaugggagguucugggaauuaguggaccgagaaagaaauuugcauuuggaaggaaaaugugaaaccugcguguacaauaugauggguaaacgagagaaaaaacuuggagaauucggcaaagcuaaggggucaagggcaauaugguauaugugguuaggagcacguuucuuagaguuugaggcacuaggauuuuuaaacgaagaccauugguuuagcagagguaacaguuugucgggaguugagggugagggucuucauagacugggauauauacuccgagaaguagguaaaaaagaggguggcgcuauguaugcggaugacacugcugguugggacacccgcaucacccuagaagauuuaaaaaaugaagagaugguaacaaaucauaugaaaggagaacauaagaagcuagcagaagccauauuuaaauugacuuaucagaacaaaguuguacgggugcaaagaccaacaccgaggggaacaguaauggacauaauaagcagaaaggaucaacgugggucaggacaaguagguacauacgggcuaaacacguucacuaauauggaagcccagcuuauucgacaaauggaaggggaggggauauucaaaucgauccaacacuuaacagcgaccgaagaaaucgcaguacaaaauugguuggccagaguaggaagagaaagauugagcagaauggcuauuagcggggacgacugugucgugaaacccauagacgacagguuugcaucagcacuaacggcuuuaaacgauaugggaaaagugcgcaaggauauucaacaaugggagccgucacgcggauggaaugauuggacacagguuccuuucugcucccaucacuuucacgaacuaguuaugaaagaugggcguguucuaguugucccuugccgaaaucaagacgaacugaucggaagagcaaggaucagucaaggcgcaggauggucccucaaagagacagcaugccuugguaaaucauaugcucaaauguggacauuaauguacuuucaucgaagggacuuaagauuggcagcaaaugcaauaugcucugcaguaccaucucacuggguaccuaccagucgcacgacauggagcauucaugcaaagcaugaguggaugacgacagaagauauguuaguuguauggaacagaguguggauacaagaaaauccauggauggaagacaaaacaccaguggaaaguugggaagaggucccuuauuuaggaaaacgagaagaccaguggugcggaaguuuaauuggacuuacaucuagggccacgugggcuaaaaacauccagacggcgauuaaucaaguaagaucucuaaucggcaaugaaggauauacggauuauaugccaaguaugaaacguuuuagaagagaagaagaagaagcgggaguauuaugguaa

SEQ ID NO: 22478 - RNA, 9876 nt, Artificial Sequence
  derived and/or modified CDS sequence (opt6) from DENV-2__KC294210__SS-prME
acagcgggagugauagucauguuaauuccaacagcuauggcauuucaucugacaacacgcaacggagaaccacauaugauuguugggagacaggaaaaagguaaaagccuauuguuuaaaaccgaagacggagugaauauguguacacuaauggcuauagauuugggagaacuaugugaagacacgauuacguauaaauguccucuucugcgucaaaaugaaccagaagacauagacugcugguguaacucaacauccacauggguaacauacggaacaugcacaaccacaggugagcacagacgagagaaaagaagcguagcauugguaccacacguugguaugggauuagaaacaaggacugaaacauggaugucaucggaaggcgcauggaaacauguccaaagaauugaaacuuggauauuaagacauccagguuuuacaaucauggcagcgauucuggcauacacgauaggcacuacacacuuucagagagcgcugauauuuauccuauugacagcuguggcaccaucuaugacaaugcgauguaucggcauaaguaaccgugauuucguugaggggguuucgggaggaucuuggguagauauaguacuggaacauggcagcugugugacaaccauggcgaaaaacaaaccgacgcuagauuucgaacuuauuaaaacugaagcaaaacaaccagcuacccuacgaaaauauugcauagaggcaaaacuuaccaauacuacuacagaaucacguuguccaacacagggagaacccaguuugaaugaagaacaggacaaacgguucauauguaagcauucaaugguugauagaggguggggaaauggaugcggguuauucggcaaagguggcauuguuacgugcgccauguucacauguaagaaaaauauggaaggaaaaauaguacaaccggaaaaccuugaauacaccaucguaaucacaccacacucgggcgaagaacacgcuguugggaacgauacagggaaacacgguaaagaaaucaaaauuacaccccaaucgucaaccacugaagcggaauuaacuggguauggaacuguaaugauggaaagcucaccaagaacaggcuuagacuuuaacgaaauggucuuacuucagauggaagacaaagccugguugguacacaggcaaugguuccuagacuugccucuaccauggcuacccggcgcugauacacaaggaucaaauuggauacaaaaagaaacccucgugacuuucaaaaauccacaugccaagaaacaagacgugguuguccugggaagccaagagggagcaaugcacacggcauuaacgggugcgaccgaaauacaaaugucaagcggaaaccuguuguucacaggacaucugaaaugccgauuaagaauggauaaauuacaguuaaaagggaugucauauagcaugugcacgggcaaguuuaaaauaguuaaggagauagcagaaacacaacauggcacaaucguaauacggguucaauaugaaggcgacgggucuccauguaaaauucccuucgaaauuacagacuuggaaaagagacauguucuagggagauuaauaaccguaaaccccauaguuaccgaaaaagacuccccaguuaacauagaagcagaacccccauucggcgauagcuacauuauugucgggguagaaccaggacaguuaaaacuaaacugguucaagaaaggaucaucaauaggucagauguuugagacuacuaugagaggagcaaagaggauggcuauuuuaggagauacagcgugggauuuuggcagccuaggaggcguguucaccucuaucggaaaagcgcuacaccaaguauuuggggcuaucuauggagcugcuuuuaguggcgucucauggacaaugaaaauauugauagguguuauuauaacauggauuggaaugaacucaaggucaaccucgcucaguguaucccuuguucucguuggaguaguaacauuauacuuaggagcgaugguacaagcagauucuggaugcauugugagcuggaaaaauaaagagcuaaagugugguucggguauauuuaucacggauaacguccacacuuggaccgaacaauauaaauuccaaccggaaucaccaagcaaacuugccucugcaauccagaaggcacaugaagaggguauauguggaauacgaagcgugacaagacuugaaaaccuuauguggaaacagauuacaccagagcuuaaucacauucuaagugaaaacgaaguaaaacuuacaaucaugacgggagauauaaaaggcauuaugcaagcuggcaaacgaucuuugagaccccaaccgacggaacuaaaauacagcuggaaaacguggggcaaggcaaaaaugcuuucuacugaaagucauaaccagacguuucuuauagauggucccgaaacugcagaauguccaaauacgaaucgggcguggaacucuuuagaagucgaagauuacggauucggaguuuuuacuacgaauauuuggcuaaaauuacgagaaaaacaggauguauuuugugauuccaaauuaauguccgcagcaaucaaagauaacagggcagugcaugcugacaugggauacuggauugaaucugcacugaacgauacauggaaaauggaaaaagccucauucauagagguaaagucaugucacuggccaaaaagccauacauuauggucuaacgguguccuagaaagcgaaaugaucauucccaaaaauuucgcuggaccaguuucgcaacauaauuauagaccuggauaucacacacagacagcugggccauggcaucuaggcaaacuggaaauggacuuugacuuuugugaaggcacgaccguagugguaacugaagauuguggaaauagaggaccgucguuacgaacgacaacagcuagcggaaaguuaauuaccgaguggugcugcagaucauguacgcuacccccauuacgguauagaggggaggaugguugcugguaugguauggagauucgcccccuuaaagaaaaggaagaaaauuuaguuaacucuuugguaacagcaggucaugggcaaauagauaauuucagcuuaggcguacuagggauggcucuguuccucgaggaaaugcuaaggacgagggucgguacaaagcaugccauucuauuaguggcauugucuuucguaacacuaauaaccggaaauaugagcuuuagagaccuaggucgugucaugguuauggucggcgcaacgaugaccgaugacauaggaauggguguaacuuaucuagcacuucucgcggcauucaaaguaagaccuacauucgcugcuggucuccuguuacgaaaacuuacaaguaaagaacuaaugauggcgacuaucggcauugcauuacuaucacaaagcacauugccagaaacgaucuuggaauugacggaugcacucgcacuuggaaugauggcuuuaaaaaucguaagaaacauggaaaaauaucagcucgcagugacaauuauggcaauaucuuguguuccaaaugcuguuauucuccagaaugcguggaaaguuucauguaccauccuugcugcugucuccguaucaccauuacuacuuaccuccucccaacaaaaggcugacuggaucccgcuugcgcucacgauuaaaggacucaaccccacugcaauuuucuugacgacacuuuccagaacaucgaaaaagagaucauggccucuuaacgaagcuauaauggccguaggaaugguaagcauacuagcuucuagccuacugaaaaaugauauaccaaugacugggccccucguagcugguggucuccugacuguauguuauguguuaacgggacgaagugcagacuuagaauuagagcgcgccgcggauguaaaaugggaagaccaagcagagaucagcggcaguagcccaauauuaucaauuacgauaucagaagaugguucaaugucuaucaaaaaugaagaagaagaacaaacauuaacuauauuaauaagaacaggguuauuaguuauauccggcguauuuccgguaucaauaccgauuaccgcggccgcaugguacuuaugggaaguaaagaaacaaagggcuggcguccuaugggacgugccaaguccuccaccagugggaaaagccgaacuugaggauggagcuuauagaauuaaacaaaggggaauacuuggauacagucaaauuggcgcaggaguauauaaggaaggcacguuccacacaauguggcacgugacuagaggagcaguacucaugcauagaggcaaaaggauagaaccaaguugggcugacgugaagaaggaucuuauuucguauggaggaggauggaaauuagaaggagaauggaaagaaggugaagagguacaaguccuagcuuuagaacccgguaagaauccccgggcuguacaaacaaaaccagguauauucaaaacaaauacagguacaauuggagccguuucucuggacuuuucaccugguacaucuggaaguccaauaguugauagaaaaggaaaaguuguaggauuguaugggaacgguguggucaccaggucaggagcauauguaucugcuauagcucaaacagaaaaaucuauagaagacaauccugaaauugaagaugauaucuucaggaagaaaagacucacaauuauggaucuucacccaggggcaggcaagaccaaacgauaucuuccagcaauuguuagagaggcaauaaaaagaggauuaaggacacuuauucucgcaccgacaagagucguggcugcagaaauggaagaggcucuacgaggacuuccuauacgcuaucaaacacccgcuauacgugcagaacacacuggacgagaaauagucgaucuaaugugccacgcaacguucacaaugcgcuugcugagccccgugagagugccgaauuacaauuuaauaaucauggaugaggcccacuuuacagauccggcgaguauagccgccagaggguauauuucuacaagaguagaaaugggugaagcagcuggaauuuuuaugacugcgacaccaccggggagccgagauccguucccacaauccaaugcaccaaucauggaugaagaaagagaaaucccugaaagaagcuggaauagcggucacgaguggguaacagacuucaaagguaaaacuguuugguuuguucccucaauaaaagcaggaaaugauauagcagcuugucuacguaaaaaugggaagaaagugauucaacuaagucgaaaaacuuuugauagugaauaugugaaaacuagggcaaacgauugggauuuugucguaacgacggauauaagugagaugggagcaaauuucaaggcagagaggguaauugauccaagacguuguaugaagccgguaauacucacagauggagaagaaaggguuaucuuagcaggcccaaugcccgucacucacaguagcgcagcacagcgacguggaagaauaggaaggaacccaaagaaugaaaaugaccaauauauuuauaugggagagccacuagaaaacgaugaagauugugcccacuggaaagaagcaaaaaugcuacuugacaauauuaacacuccagaaggaauuauuccuaguauguucgaaccugagagagaaaaaguagacgcuauugacggagaauacagauuacgaggagaagccagaaaaacauuuguggaucuaaugaggcggggagauuuaccaguaugguuagcauacaagguagcagcagaagggaucaauuacgcggacagaaagugguguuuugaugguauuaaaaacaaucaaauacuagaagaaaacguagaaguagaaauauggacuaaagaaggagaaaggaagaaacuuaaaccucguugguuggaugcacgaaucuauagcgauccccucgcgcucaaagaauuuaaggaguucgcggcuggacguaagagcuuaacguugaauuugauaaccgaaauggguaggcuuccaacauuuaugacccagaaagcaagaaaugcacuugauaaccuugcaguauugcauacagcagaaguaggagguaaagccuacacacaugcccuaagugaauuaccagagacuuuagaaacacuacuauuacucacucuccuggcagcaguuacaggagguauuuuccucuuucuaaugucuggaaaagggauaggaaaaaugacguugggcaugugcuguauuaucacagccucuauuuuacuaugguacgcacaaauacaaccccauuggauagcugcgucuauaauucucgaguucuuccugauaguuuuacuuauccccgaacccgaaaaacagcgaacaccucaggacaaccaauuaacguaugucgucaucgcgauccugacugucguugcagcaacuauggcaaaugaaaugggauuuuuagagaaaaccaagaaagaccucggguuuggauccauaaccacucaagaaucggaaucaaacaucuuggacauugacuugaggccagccagugcauggacucucuaugccguagccacuacauuuguuacaccaauguuaaggcauucuauagaaaauucaucggucaauguuucucuaacagcaauagcaaaccaagcaacggucuuaauggggcuaggcaaaggcuggccgcugucuaagauggauauaggggugccacuguuggcaauaggaugcuauucgcaaguuaauccaauaacgcuaaccgcagcucugcuacuucuuguagcucacuacgcuauaauaggccccggauugcaagcaaaagcaaccagagaagcucaaaaacgagcggcugcugggauaaugaaaaaucccacuguagaugguauaacagugauagauuuggaaccuaucccguacgaucccaaguuugaaaaacagcucggccaaguaaugcucuugauuuuauguguaacacagguucuuaugaugcggacaacgugggcauuaugugaagcccuuacuuuagccaccgggcccauaucuacucucugggagggaaauccaggccguuuuuggaauaccaccauagcagugaguauggcaaauauuuuuagaggaaguuauuuggcaggagccggacuccuuuucaguaucaugaagaauacgacaaauacucguagagggacaggaaaugucggugaaacuuuaggagagaaauggaaaucuagacuuaacgcccuuggaaaaagcgaguuccaaauauacaagaaaucgggcauucaagaaguagaccgcacauuggcuaaggaaggcauuaaaagaggcgagacugaucaccaugcgguaaguagagggagcgcaaaacuuagaugguucguagaaaggaacauggucacaccagaaggaaaagugguggauuuggguugugggcgggguggguggaguuauuauugcggaggccuuaaaaacguaagagaaguaaaaggacuaaccaaagggggcccuggucacgaagaaccuauucccaugucuacguauggcuggaaucuuguacgacuacaaaguggaguagacgucuucuuuaccccucccgaaaagugcgacacauuauuaugcgacaucggagaaucaucuccuaauccgacaauugaagccgguagaacucuuagggugcuuaacuuaguagaaaacuggcuaaauaauaauacucaauuuugcaucaagguuuugaauccuuacaugccgucgguaauagaaaagauggagacucuucaaagaaaguacgguggagcccuaguccgcaauccacugucacguaacucaacucaugaaauguauugggugagcaacgcaacaggcaauauuguuucaagugugaauaugauauccagaaugcuuauuaacagguuuacuaugaaacauaaaaaggcaacguaugaaccagacguagauuuaggaagugggaccagaaauauuggaauagaaagcgaaauuccuaaucuugauauuguaggaaaaagaaucgaaaagauuaagcaagaacacgagacuucauggcauuacgaccaggaccacccauacaaaacaugggcauaucaugguaguuaugaaacuaagcaaacggguucugcaucaaguaugguaaaugguguaguaagauuacuuacaaaaccuugggaugucguuccuaugguaacgcagauggcaaugacugauacaacaccuuucggacagcaaagagucuuuaaggaaaagguagauacacgaacacaggaaccgaaagagggaacaaagaagcuaaugaaaaucacggcagaguggcucuggaaggagcuugggaaagaaaagacaccaagaaugugcaccagggaagaauuuacgaggaaaguucguucaaaugcggccuugggagccguuuuuacugacgagaacaaauggaaaagugcaagagaagcgguagaagacggccgauuuugggagcuagucgauagagaaagaaaccuacaccucgaaggcaagugcgaaacaugugucuauaacaugauggggaaaagagagaagaaauugggagaguuugguaaggcaaaagggaguagagcuaucugguauaugugguuaggagcaagauuuuuagaguuugaagcucuaggcuuccuuaacgaggaucauugguuuucgagagguaauagucuuagcggaguagagggugaaggucuacacagauuaggauacauacucagagaaguagguaaaaaggaagggggugccauguaugcagacgauacggcgggaugggauacccgaauaacacuagaggaucucaagaaugaagaaaugguaacaaaucacaugaaaggagaacacaaaaaguuagccgaggcaauauucaaacucacuuaccaaaacaagguaguucgaguucaaaggccaacgccccguggcaccgucauggauaucauuucccguaaagaccagaggggaucaggacaaguugggacguacgguuuaaauacauucacaaacauggaagcacaacugauucgacaaauggaaggcgagggaauauuuaaaucaauacagcauuuaacagcgacagaggagaucgcaguccaaaacugguuaguucgagucgggagagaacgccuaucaagaauggccaucaguggcgacgacuguguagugaaacccauagaugauagguuugccuccgcacuaacugcucuaaaugauaugggcaaagucagaaaggauauacagcaaugggagccguccaggggguggaaugacuggacucaaguaccauucugcucgcaucacuuucaugaauuaguuaugaaagaugggcgagugcuaguuguaccuuguagaaaucaagaugaauuaauagguagagcucguaucagccagggggcuggauggucccuaaaagaaacagcaugcuuaggaaaaagcuaugcucaaauguggacauuaauguauuuccauagaagagauuuacguuuggcagcaaacgcaaucuguucggcgguaccaagucauuggguaccgacgucgaggacgacauggucaauucacgccaagcacgaauggaugaccaccgaagacauguuggucguuuggaauagaguauggauacaagaaaacccuuggauggaagauaaaacaccaguggagucaugggaagaggucccuuaucuagguaaacgugaagaccaaugguguggcagcuuaauugggcugacuucgcgagccacgugggccaaaaacauccaaacagcuauuaaucagguucguucguuaauaggcaaugaagguuacacagacuauaugccaucgaugaaacgauucagacgugaggaggaggaagcggggguauuaugguag

SEQ ID NO: 22479 - RNA, 9876 nt, Artificial Sequence
  derived and/or modified CDS sequence (opt6) from DENV-2__KC294215__SS-prME
acugccggugucauaguaaugcuaauaccaacugccauggcauuccacuuaaccacaaggaauggggagccacacaugaucguagguagacaggaaaaaggaaaauccuuacuguucaaaacagaagauggagugaauaugugcacacuaauggcaauagacuugggagaacuaugcgaagacaccauaacauacaagugcccucuccuucgacaaaaugagcccgaagauauagauuguuggugcaacucaaccaguacuuggguuacuuauggaacguguacaacgacaggagagcauaggagagaaaagcgaucuguugcacuuguaccgcacgugggaauggguuuggagacucgcacggaaacguggaugucuagcgaaggugcguggaagcacguacagcgaauagaaacguggauacuacgacacccaggauucaccauaauggcagcgaucuuagccuacaccauagguaccacgcacuuccaaagagcuuuaauauuuauauugcuuacagcuguagcaccuaguaugaccaugcgcuguauagguauaaguaacagggauuuuguagaaggcgucucgggagguuccuggguggacaucgucuuagagcacggaagcugcguaacgacaauggccaagaauaaaccaaccuuagacuucgagcugauaaagacggaagcuaagcaaccggcaacguuaagaaaauacuguauugaagcaaaauuaaccaacacaacaaccgaaagcagauguccaacucagggggagccuucgcugaacgaagaacaggauaaaagauucauuuguaaacacucaauggucgauaggggauggggaaacggauguggauuguucggaaaaggugguauugucacuugcgcaauguuuacaugcaaaaaaaauauggaaggaaaaauuguacaaccggagaaucuggaauauacuauaguaauuacgccccauucgggggaagagcacgcggucgguaacgauacuggcaaacauggaaaggagaucaagauaacuccacagagcagcacgacugaggcagaacuuacaggauauggaacaguaacuauggaauguagcccaagaaccgguuuggauuuuaacgaaaugguccuacuacagauggaagacaaggcaugguuaguccauagacagugguuucucgauuugccuuuacccuggcugccuggagccgauacacaagggucuaauuggauacagaaagagacucugguaacuuuuaaaaacccacacgcgaaaaaacaagaugucguuguguuggguucucaggagggagcuaugcauaccgcuuuaacuggugcgacugaaauucaaaugucuaguggcaaucuacuuuuuacgggccaucuaaaauguagauugcgaauggacaaacugcaacuaaaagguauguccuauucaauguguacuggaaaauuuaaaauugugaaagagauagccgaaacacaacauggaaccaucgucaucagagugcaauaugaaggagacgguagucccugcaaaauuccauuugaaauuacugaucuugaaaaacgacauguacuaggacggcugauaacaguaaacccaauaguaacagaaaaagacucgccgguuaauauagaagcagaaccaccauucggggacucuuacaucauaguuggaguggaaccuggacaauuaaaauuaaacugguucaaaaagggcucgaguaucggacaaauguuugaaacaacaaugaggggagcgaagagaauggcuauauuaggggauaccgcuugggacuucggauccuuagguggaguuuuuacgaguauagggaaagcucuacaucaaguguucggagcaauauauggugcagcauucucugguguuagcuggaccaugaaaauacuaauagguguaaucaucacuuggauagggaugaacucgcggagcaccagccuaagcgucucacuaguauuaguagguguugugacucucuauuuaggugcuaugguacaggcagauucuggaugcaucguuaguuggaaaaauaaagaacuaaaaugugggucaggaauuuuuauaacugauaauguacauacauggacagaacaauacaaauuccaaccggagucgcccaguaaauuggccagcgcaauucaaaaagcgcaugaggagggaauaugcggcauuaggagcguuacccggcuugaaaacuuaauguggaaacaaauaacucccgagcuuaaucauauauuaucugagaaugaagucaagcucacuaucaugacaggugacauaaaaggaaucaugcaagccgguaagagaagccuccgaccacaaccaacugaauuaaaauacaguuggaagacuuggggcaaagcaaaaauguuaucaacagaaucccacaaucaaaccuucuugauagauggaccugaaacagcagaaugcccuaacacuaacagggcuuggaacagcuuagaaguagaagauuacggauucggcguauucacgacaaacauauggcucaaacuaagagaaaaacaagaugucuuuugugauuccaaauuaaugagugcagcaauuaaggauaaccgagcugugcaugcagacauggguuauuggauugagucggcccugaaugauacauggaaaauggaaaaggcgucuuuuauagaagucaagucaugucauuggccgaagagucauacacucuggucuaaugggguacuugaaucugaaaugauaauaccaaaaaauuucgcagggccaguaucucaacacaacuaucguccaggguaucauacucaaacugcagguccuuggcaucuaggaaaguuggaaauggauuuugacuucugugaagguacaacuguuguugucaccgaagauugcggcaacaggggaccaucauuaaggacaacaacggcgucagguaaacuuauuaccgaaugguguugccggucgugcacuuugccaccguuacgcuaucggggggaagauggauguugguauggcauggagauacgcccguuaaaagaaaaagaagaaaaccuaguaaauucccuugugaccgcuggacauggucagauagacaauuucucucuaggcguucucggaauggcguuauuccuggaagaaaugcuuagaacucgaguagggacaaaacaugcaauacuucugguggcacucucauuuguuacauugaucaccgggaauaugucauuuagagaucugggcagaguaauggucauggugggugcuacgaugaccgacgauauuggcaugggugugacguaucuugcacuucuagcggcauuuaagguaagaccaaccuucgcugcaggauuauuauuaaggaaguugacauccaaagaauuaaugauggcaacgauaggaauagcucuacugagucaaucaacucugccugaaaccauuuuggaacuaacugaugcauuagccuuaggcaugauggcguuaaaaaucgucagaaacauggaaaaauaucaguuagcaguaacaauaauggcaauuaguuguguaccaaacgccguaauacuacaaaaugccuggaaaguuagcuguacuauauuagccgccguaucugucaguccucuauuguugaccucaucucaacaaaaagcggauuggauuccauuagcacuuaccaucaaagggcuuaacccaacggcgauauuucuaacuacuuuaucgagaacuucuaaaaagcgaaguuggccauuaaaugaagcuauaauggcagucggaaugguaagcauauuggcuaguaguuuauuaaaaaacgauauuccuaugacaggaccacuagucgcaggugguuuacuaacaguauguuacguauuaacugggcgaucugcggaucuagaauuggaacgggccgcagauguuaaaugggaggaccaggcagaaauaucgggguccucaccaauauuaucaauuacgauaucagaagauggcaguaugucuauaaaaaacgaagaggaagaacagacguuaacaauacuaauacgcacuggacuucucgucaucucaggggucuuucccgugucaauaccuauuacugcagcagcaugguaccuuugggagguaaaaaagcaacgugcuggaguguuaugggacguaccaucgccaccaccaguggguaaagccgaauuagaagauggagcguauaggauaaaacaacgaggcauacuaggcuauagucaaauuggugcaggcguauauaaggaaggcacguuucauacuauguggcacguaacgaggggagccguucugaugcacagagggaaaagaauagaaccauccugggcggauguuaaaaaagauuuaauaucauacggaggaggauggaaacuugagggagaauggaaagaaggugaggaggugcagguuuuagcucuagaaccagguaaaaauccccgggcgguccaaacgaagccaggaaucuuuaaaacaaauacggguacaaucggcgccgugagucuugacuucagcccuggaacaagcgguaguccuaucgucgaucgaaaaggaaaaguaguuggcuuauauggaaauggaguagucacgcguagcggagcauauguuagugcaaucgcgcaaacugagaaaucgaucgaagacaauccagagauagaggaugacauauucagaaaaaaacgguuaacaauaauggaucugcacccaggcgcaggaaaaacuaagagauaccuaccugcgauuguacgggaagcuauaaaaagaggucuaagaaccuugauucuugcuccgacaagaguuguggcagcagaaauggaggaagcucugcgcggucuacccauccgauaccaaacuccagcaauuagagcagaacacaccgggagggaaauaguggacuuaaugugucacgcuaccuuuacaaugagguuauuaucaccugugagagucccaaauuauaaucuaauaauaauggaugaagcacauuuuacagauccagcuaguauagcagcgcggggauacauaucaaccagaguugaaaugggugaagcugcaggaauauucaugaccgcgacccccccuggcucaagagauccuuucccacaaucuaaugccccaauuauggaugaggagcgugaaauaccagagagaucauggaauuccgggcacgaauggguuacagauuuuaaaggaaagacagucugguuuguccccagcaucaaggcgggaaaugacauagcagcaugucuaagaaagaacgggaaaaaaguuauacaauugucacguaagacauuugacucugaguacguuaaaacaagagcgaaugauugggauuucguaguaacaacagauauuucagagaugggggcuaacuuuaaggcggagagaguaauugacccgaggagauguaugaagccuguuauacuaacggacggagaagaaagaguaauacuagccggaccgaugccgguuacucacucuagcgcagcucaaaggcggggaagaaucggacguaacccuaaaaacgaaaacgaucaauacaucuauaugggagaaccgcuagaaaaugaugaggauugcgcacacuggaaagaagcuaaaauguugcuugauaauaucaauacgcccgaagguauaaucccgaguauguuugagccagagcgugaaaaaguugacgccaucgauggagaauauagauuaaggggagaggcacgcaaaacauucguugaucuaaugagaagaggagaccuaccaguauggcuugcuuacaaaguagcugccgaagguauuaauuacgcagauagaaaauggugcuuugaugguauuaaaaauaaucaaauacuagaagagaacguagagguugaaauauggacuaaagaaggagaaagaaaaaaauugaaaccucguugguuggaugcgaggauuuauucugacccacuggcacuaaaagaauuuaaagaauuugcggcgggucgcaaaaguuuaacccuaaaccuuauuaccgaaaugggccgacucccaacauuuaugacccaaaaagcaagaaacgcauuagacaaccuugcuguguugcauacagcugaaguuggugguaaagcauauacacaugcacugucagaguuaccagaaacuuuagaaacucuacuacuucuaacacuacuagccgcagugacagguggaauauuucuauuucuaaugaguggcaaagguaucggaaaaaugacauuagggauguguuguauuauuaccgcaaguauauuauuaugguaugcccaaauacaaccacauuggaucgcagcuucaauaauauuggaguucuuccuuauaguauuacuuaucccagaaccugaaaagcaacgcacuccccaagacaaucaacuaacauaugugguaauugcgauucuaacaguaguugcggcgaccauggccaacgaaaugggauuuuuagagaagacgaagaaggauuuaggauuuggauccauuacuacacaagaaucagaaucgaacauauuagacauagacuugcgaccugcaucagcguggacguuauaugcuguggcgacuacauuugugacuccaauguugcgccacagcauagaaaacagcaguguaaauguaagccucacugccauugcaaaccaagcgacaguccucaugggauugggcaaaggguggccacuauccaaaauggauauaggaguaccuuuauuagcuaucggauguuauucgcaggugaauccuauaaccuuaacagcagcacuauuacuacugguugcacacuaugcgauaauagggcccggcuuacaagcaaaagcaacaagggaggcccaaaaacgugcugcagccggaauaaugaagaauccaaccguugaugguaucacugucauagaccuugaaccuauuccauacgacccaaaauuugaaaagcaauuaggacaagucaugcuccucauacucuguguaacucaagucuuaaugaugaggaccacaugggcccuuugcgaagcacucacuuuagcaacuggaccuauuagcacucugugggaagggaaucccggaagguucuggaacacaacuauagcaguuucaauggcgaauauuuuucgcgguucauaucuugccggagcaggauuauuauuuagcauaaugaaaaacacgacuaauacaagaagagguacuggaaacguaggagaaacguugggugaaaaauggaaaucuagacucaacgcguuagggaaaagcgaauuccaaauuuacaaaaaaucaggcauacaagaaguagaucgaacacuggcuaaggaagggaucaagcggggcgagacagaucaucaugccguuucaagaggcuccgccaaacugagaugguucguagagagaaacaugguaacaccagaagguaaaguugucgacuuagguugcgggcgaggugguuggaguuauuauuguggaggacuaaagaauguccgggagguaaaaggacuaacgaaagguggaccuggccaugaagaacccauuccaaugucgacauacggauggaaucuaguaagacuacaaagcgggguagacgucuuuuucacuccuccugagaaaugcgauacauuguuaugcgauauaggcgagaguagcccuaauccgacaauugaagcagggagaacucugcgcguacucaauuuaguggaaaauuggcuaaacaauaauacgcaauucuguaucaaaguucuuaacccauauaugccguccguuauagaaaaaauggagacauuacaaaggaaauacggaggcgcauuaguaaggaauccacuaucgcgaaauuccacacacgaaauguauuggguaucgaaugcuacggggaauauuguaucgucaguaaacaugaucucacguaugcuuauaaauagauuuacuaugaaacauaaaaaagcgacguacgaacccgacgucgaccucggcagugguacaagaaacauagguauagaaucagaaauucccaacuuagauauaguuggaaaacgaauugagaaaauuaaacaggagcacgaaacuuccuggcauuaugaucaagaucacccuuauaaaacaugggcauaccacggaaguuacgagacgaagcaaaccgggucagcaucaaguaugguaaauggagucguuagguuauugacaaaaccuugggacguagugccaaugguaacacaaauggcgaugacagauacaaccccauuuggucagcaaagaguuuucaaagaaaaaguggacacucgaacacaagaaccaaaagaagggacaaaaaaauugaugaaaauaacagcaaaguggcuuuggaaagaauuaggcaaagagaaaacgccaagaauguguaccagagaggaauucacaaggaagguacgcagcaacgccgcgcuuggugcgguauuuacugaugagaauaaguggaaaagugcacgugaagcaguggaggauggacgauucugggaacugguggauagagaacgaaaccuucaccuagaaggcaaaugcgaaacaugcguauauaauaugaugggaaaaagagaaaagaaacugggugaauuuggaaaagcuaaggguagcagagcuauuugguacaugugguuaggagcacgauuccuugaauuugaagcauuaggauuccuaaaugaggaucacugguucagccguggaaauaguuuaagugggguagagggagagggucuacauagacucggguauauucuaagagaaguggggaagaaagaagguggugcaauguaugcugacgauaccgccggaugggauacgagaauaacauuggaagacuuaaaaaacgaagaaauggugaccaaucauaugaaaggggaacauaagaaauuagccgaagcuauauuuaagcuuacuuaucagaauaagguuguacgaguacaacgucccacuccuagaggaaccguaauggacauaaucagucggaaggaccagagggguucugggcaaguggggacuuacggguugaacaccuuuacaaacauggaagcacaacugauucggcaaauggaaggagaaggaauuuuuaagucgauucaacacuuaacagcaaccgaggaaaucgcagugcaaaauuggcuggcuaggguaggcagagaacgccuaucaagaauggcaauauccggugacgauuguguugucaagccaauagacgacagauuugcaagugcauuaacugcguuaaacgauaugggaaaagugaggaaggacauucagcagugggaaccaucuaggggcuggaaugacuggacgcaagugccauuuugcucacaccacuuccacgaauuagugaugaaggacggcagaguucuuguaguacccugccguaaucaagacgaacuuauagguagggcacguauuucgcagggggcaggauggucauuaaaggaaaccgcgugccuaggcaagaguuacgcacaaauguggacauuaauguacuuucaccggcgagacuuacgauuagcugccaaugcgauuuguucagcugucccaucacauuggguaccuaccucaaggacgacuuggaguauacaugcuaaacaugaauggaugacaacugaagauauguuaguaguguggaacagaguauggauacaggaaaaucccuggauggaagauaaaacaccaguggaaaguugggaagaagucccuuaucuaggcaagagagaagaucaaugguguggaagcuuaauaggguuaaccagcagagcuaccugggcuaaaaacauacaaacagcuaucaaucaaguuaggucucucaucgguaaugagggauacacggacuauaugccaucgaugaagagauuuaggcgugaagaagaagaagcagggguucugugguaa

SEQ ID NO: 22480 - RNA, 9876 nt, Artificial Sequence
  derived and/or modified CDS sequence (opt6) from DENV-2__KC294216__SS-prME
acggcuggugugauaauuaugcuaauuccuacagcaauggccuuucaccuaacaacuagaaauggugaaccacauaugauaguugguaggcaagaaaaaggaaaaucguuauuauuuaaaacagaagauggagucaauaugugcacauugauggccauugauuugggugaacugugugaagacaccauuacguacaaaugcccauuauuacgucaaaacgaaccagaagauauagacuguugguguaauucuacgucaacuuggguuacuuauggaacauguacgacgacaggagaacacagaagagaaaaacguaguguugcgcuugucccacacguagguaugggacuagaaacaagaacagaaacauggaugucuagugaaggagcguggaaacacguacaacguaucgaaaccuggauccuacgucacccaggauucgcuauuauggcggcuauucuagcauauacaauuggaacgacucauuuucaaagggcacuaauauuuauacuucuuacagccguggcucccucgaugacgaugagauguauaggaaucucgaaucgagacuuuguagaaggagucaguggugguagcuggguugacauaguucuggaacacgggagcugcguaacaaccauggcgaaaaacaaaccaaccuuggaccuagaacuaauaaaaacagaagccaaacagcccgcaacauuaagaaaauacugcauugaagcuaaacuaaccaacacaacaaccgaaucucgaugucccacacaaggugaaccaagucuuaacgaagaacaagauaaaagauuuauaugcaaacacaguaugguugaucgugggugggggaauggaugcggacuauuuggaaaaggagggauaguaacaugcgcuauguucacuuguaagaaaaauauggaaggcaaaguaguacuccccgaaaaccuagaauacaccauugugauaacaccacacaguggugaagaacaugcuguagggaacgauacuggaaaacauggugaagaaaucaaaauaacaccucagucgucuauuacugaagccgaacuuacaggauacgguacggucacgauggaauguucaccacgaacaggucucgauuuuaaugagaugguauugcuucaaauggaagaaaaagcauggcuuguccaccggcaaugguuccuugacuuaccauuaccuugguuaccgggagccgacacucaagguuccaauuggauacagaaagaaacauuaguaacauuuaaaaacccccaugccaagaaacaagauguagucguacuagguucacaagaaggagcaaugcacaccgcccugacaggggcaacagaaauacaaaugagcucuggaaacuuauuauucacaggccaucuuaaaugcagauugagaauggauaaauuacaacucaaaggaaugaguuauagcauguguacggguaaauucaaaauugucaaagaaauagcggaaacacaacauggaacgauagucauuagaguucaguaugagggugauggaaguccgugcaaaauaccuuuugagauaauggaucucgagaaaaggcauguacuaggaagacugauuacagucaauccgauagugacagagaaagauucaccaguaaacauagaagcggagccgccauucggugacaguuauaucauuauagggguugagcccggacaauugaaacuaaauugguuuaagaaaggcucuaguauuggacaaauguuugaaacuacuaugagaggugcaaaacgaauggcaaucuuaggugauaccgcuugggauuucgguucguugggaggaguguuuacuucuaucgggaaagcgcuccaucaagucuucggagcuauauauggagcugcauuuucaggcgugucauggacaaugaaaauucucauuggugugauuauaacuuggaucgguaugaauaguagaucgacaagucuuucaguuagcuuaguauugguuggaguaguaaccuuguacuuaggcgcgauggugcaagcagauucuggguguguaguaaguuggaaaaacaaggaacuuaaauguggaucugguauauucauuacagauaauguucauacauggaccgaacaauacaaauuccaaccggagucaccaucgaaacuagccucggcaauacaaaaagcgcaugaggaaggcauaugcggaauuagaaguguuaccaggcuugagaacuugauguggaaacagaucacucccgaauuaaaccacauauuaagugaaaaugaaguaaaacuuacaauaaugaccggcgacauaaaggguauaaugcaagcuggaaaacguucgcugagaccgcaaccaacagaauuaaaauacucauggaagacauggggaaaggcaaagaugcuaaguacagaaucacauaaucaaaccuuuuuaaucgacggacccgaaacagcugaauguccaaacacgaacagagcauggaacucucuagagguagaagacuauggauuuggcguauuuaccacgaauauaugguugaaauugcgugaaaaacaagauguauuuugugauaguaagcucaugucagcagcuaucaaggacaaucgagcuguucaugcagauaugggauauuggauagaaucagccuuaaaugacacauggaaaauggaaaaggcuucauuuaucgaagucaaaagcugccauuggcccaagucucacacacuuuggucaaauggaguacuagagagcgagaugauuaucccgaagaauuucgcagguccaguaucucaacauaacuauaggccuggauaucacacucaaacagcugguccuuggcaucuugguaaauuagagauggauuuugauuuuugcgaagggacuacaguaguuguaacagaggauuguggcaacaggggcccuucacugcggacaacgacggcaucaggaaaacuuauaacggaauggugcuguaggaguuguacucugccuccauuacguuauagaggagaagauggauguugguacgguauggaaauacguccucuaaaggaaaaggaagaaaauuuaguuaauucccuuguuacugcaggacacggucaaauagauaauuucagucucggaguuuuaggcauggcgcucuuucuagaagaaaugcuacgaacgagaguggggacgaaacaugcuauucucuuaguagcuguuaguuuucuaacacuaauaacaggcaauaugaguuuccgagauuuaggccgaguaauggucaugguggggguagcaaugacggacgacauaggaaugggaguuacuuaucuagcacuucuggcagcauucaagguaaggcccaccuucgcagcuggacuauuauugaggaaguuaacaucgaaagagcuaaugauggccacuauugguauaacccuacucucacaaucuaccacgcccgaaacaaucuuagagcuuacagaugcucucgcauuaggaaugaugguauuaaaaauagugcgcaauauggagaaguaucaacuugcaguaaccauuaugacgauaucuugugucccaaacgcaaugauuuuaauuaaugccuggaaagucucaugcacaauucuggcaguagucuccguaaguccacuuuuauuaaccucaucccaacagaaaacagauuggauuccguuagcauuaaccauaaaaggauuaaaucccaccgccaucuucuuaaccacguuaucucgaacguccaagaaaagaaguuggccucuaaacgaagcuguuauggcggucggaaugguaagcauucuugcuucaucauuacucaaaaaugauauaccuaugacggguccucuuguugcuggcgguuuacuaacaguauguuacgugcuaaccggacgaagcgcagaccuugaauuagaaagagcagccgacguuaaaugggaggaccaagcagaaauaucagggucaucgccaauuuuauccauaacaauuagugaggauggaucaaugucuaucaaaaaugaagaagaggagcaaacauuaacaauacucauccgcacugggcuauugguaauaucaggaguauuuccaguguccauuccuauaaccgcagcugcgugguauuuaugggaaguacggaaacaaagagcggggguauuaugggauguuccguccccuccuccaguugaaaaagccgaguuagaagacggagcuuaucggaucaagcagagagguauacuagguuacagucaaaucggagccggaguguacaaagaagggacauuucacacaauguggcaugucacaaggggugcugugcuuaugcauagaggaaaaagaauugaaccuaguugggcagacgucaagaaagaccuaauuaguuauggaggggguuggaaacuggaaggagaauggaaagaaggagaagaaguacaaguauuagcccuagaaccugguaagaauccaagagcgguacaaacgaagccgggguuguucaagacuaauacagggacuaucggagcagucucauuagacuuuagcccgggaacaagcggcagccccauaguggaucgaaaaggaaaaguaguaggacuguaugguaaugggguaguaacccgcucgggggccuauguaucugcaauugcacaaaccgagaagucaaucgaggauaauccugaaauugaggacgauauauuucgcaagaaacgucuuacuauaauggauuugcauccuggagcgggcaaaacuaaaagauaccuaccagccauaguuagggaagcaauuaaaaggggccucagaacacuaauucucgcgccaacgagaguagucgcagcagagauggaagaggcucucagagguuuaccuaucagauaucaaacaccagcuaucagagcagagcauacuggucgugaaauaguagauuuaaugugucaugcaaccuuuacgaugagauuauuaagucccguccgaguaccaaacuacaaucuuauaauaauggaugaagcacauuuuacugauccggccucaauagcagcacguggguacauaagcacaagaguagaaaugggagaagcagcgggaaucuucaugaccgccacaccaccaggaucacgggauccauucccucaaucuaaugcuccuauaauggaugaagaaagagaaauaccugagcgaaguuggaacuccggacaugaauggguaacagauuucaaagguaaaaccgucugguucguaccgucaauaaaagcugggaacgauauagccgccugccuucgcaaaaauggcaagaaaguuauucaacuuucaagaaaaaccuucgauagugaauacgugaaaacgagagcgaacgauugggacuuuguugucaccacugauauaucagaaaugggagcgaacuuuagagcagaacgcguuauagacccgagaaggugcaugaaaccaguaauacuaaccgauggagaagaaaggguaauacuugcaggaccaaugccaguaacacauuccagugccgcucaacgacgcggccgaguaggccggaaucccaaaaacgagaacgaccaguacaucuacaugggagaaccuuuagaaaaugacgaagauugugcacauuggaaagaagcaaaaaugcuucuagacaauauaaacacaccagagggcaucauuccaucuauguucgaaccugaaagagagaaagucgaugccauugacggcgaauauagguugcggggagaagcacgaaaaacuuucguagacuuaaugaggcguggagaucuucccguaugguuagcuuaccgaguagccgccgagggcauaaauuaugcagacagaagauggugcuuugauggaaucaaaaauaaccaaauacuagaagagaauguugagguagaaaucuggacaaaagaaggcgaaaggaagaaacuuaagccccguuggcuggacgcaagaauauauagcgacccucuggcguugaaagaauuuaaagaguucgcagcuggacguaaaaguuuaacacuaaaucugauaacagaaaugggccgauuaccaacauucaugacucaaaaagcaagaaacgcccuggauaaucuugcugucuuacauacagcggaagcgggaggacgugcauauaaucacgcacucucugaacuaccugaaacacuugaaaccuuauuauuacuaacacuuuuggcuaccgugacagguggaaucuuuuuauuucuaaugaguggaaaaggcaucggcaaaaugacguuaggaaugugcugcauuauuacugcaucuauauugcuaugguacgcgcaaauucaaccacauuggauugcagcuaguauaauauuggaguucuuuuuaaucguacucuugauccccgaaccagaaaaacaaagaacaccucaagauaaucaauuaacuuauguuguaauugcuauucuuacaguaguggcugcaaccauggcaaaugagaugggauuucuugagaaaacuaaaagggaucucggucuagggucgauaaccacacaagaaucagaaagcaauauccuagacauugacuugcgaccggcuagugcuuggacuuuauacgcgguugcgacaacuuuugugacaccgaugcuccggcacaguauagaaaauucgucgguuaauguuaguuuaaccgccauugcuaaccaagcuaccguacugaugggucugggaaaaggcuggccauugucaaaaauggacauaggagugccacuucuggcgaucgguuguuacucccagguuaauccgauuacacuuaccgcugcauuauuacuacucguggcucauuaugcuauuauaggcccaggauuacaggcaaaagccacaagagaagcgcaaaaacgagcugcugccggcauaaugaagaauccgacaguugauggaauaacaguaauagaucuugaaccaauacccuacgauccuaaguucgaaaaacaacuuggccaagucaugcugcucauacuauguguaacgcaaguuuuaaugaugagaacuaccugggcacucugugaggcucugacguuggcuacuggccccauaagcacguuaugggaggguaauccuggccgguucuggaacacaaccaucgcggugagcauggcuaauauauuucgagguagcuauuuagcaggagccggacuacuauuuucuauaaugaaaaauaccacuaauacuagaagaggaacuggcaauauaggagaaacacuuggagaaaaguggaaaagccgucuaaaugcauuaggaaagagugaguuccaaauauauaagcguucaggcauucaagaagucgauagaacccuagcaaaggaggguauaaaaaggggcgagacagaucaccaugcuguaagucgagguucugcaaagcugcgaugguuuguugaaagaaacauggugacaccagagggaaaaguaguagauuuagggugcgguagaggagguuggagcuacuauugcggagguuugaagaacguccgagaaguaaaaggacuuacuaaaggggguccuggucacgaagaaccaauacccaugucaacuuacggcuggaaucuaguuagacuacaaucugguguagauguauucuuuacaccgccggagaaaugugacacacuucuuugcgauauaggcgaaaguucacccaauccaacaauugaagcgggacgaacacuaagaguguuaaacuuggucgaaaauugguugaauaauaacacacaauuuuguauaaaagucuugaacccuuauaugccuaguguaaucgagaaaauggaaacuuuacagagaaaauauggaggagcguuaguccggaauccccuauccagaaauucaacucaugaaauguacugggucucgaaugcuacggguaacauugugaguagcgugaauaugauuucgcgaaugcuaauaaauagauuuaccaugaagcauaaaaaggcgaccuaugagcccgacguugaccuugguucugguacacgaaauaucggaaucgagucagaaauuccuaaucuugccauaauuggcaaaaggauugagaaaauaaaacaagaacaugagaccucauggcacuacgaccaggaucacccauauaagacuugggccuaucauggaucguacgaaacuaaacaaaccggaagugcaucgucaaugguuaacggaguggucagacuacuaacaaagccaugggauguuguucccauggugacacaaauggcaaugacagauacaacaccauuuggacaacaacgaguguuuaaggagaaagucgauacccgaacccaagagcccaaggaaggaaccaagaaauugaugcgcauaacagccgaguggcucuggaaggaauuggggaagaagaaaacaccacgcaugugcacgagagaggaguucacgagaaaggucagaucaaaugcagcguuaggagcgauauuuacagaugaaaacaaauggaaaucagcuagagaagccguagaggacucgcgauucugggaacugguagaccgcgaacgaaacuuacacuuagaaggaaaaugcgagacaugcguauauaacaugaugggaaagcgugagaagaaacuuggagaguucgguaaggcaaaagguagccgcgcgauaugguacauguggcuuggugcgcguuuucuugaguucgaagcccuaggguuucuuaacgaagaccacugguucucacgagggaacucauuauccggcguugagggagaaggccuacaucgacucggauacauauuaagagauguaagcaagaaagagggcggagcuauguaugcagaugacacagcaggcugggacacucgaauuacccuagaagaccuaaagaacgaagagaugguuaccaaucauaugaaaggagaacauaagaaauuggccgaggcaguauuuaaguuaaccuaccaaaauaaaguugugagaguucagaggccaacaccgagaggaaccguuauggauauuauuucuagaagagaucagagggggagcggucaggucggaacauauggucuaaauacuuuuaccaauauggaagcucaguuaauccggcaaauggaaggagaggguauuuuuaaaucaauucagcaucucacagcuacugaagaaauugcuguacaaaauuggcuagcuagggugggcagagaacgucuaagcaggauggcuauaagcggugaugauugcgucguuaaaccucuagacgaccgauucgcaucugcauuaacugcgcuuaacgacauggggaaaguuagaaaagauauacaacaaugggagccaagcaggggauggaacgauuggacucaagucccuuuuuguucgcaccauuuucaugagcuggugaugaaggacggacggguccuaguagugccaugccgaaaccaagaugaauuaauagguagagcaagaaucucacagggagcaggguggagcuuaaaagaaacagcaugccuagggaaaagcuaugcccaaauguggacccuuauguacuuucaucgucgugaccuaagauuagccgcaaaugcuauauguagcgcaguaccaagucauuggguucccacguccagaaccacauggaguauccaugcaaagcaugaguggaugacuaccgaagauauguuggcagucuggaauagaguauggauucaagaaaauccuuggauggaagauaaaacaccuguugaaucuugggaggaaguaccuuaucuugguaagagagaagaccaauggugcggcagccuuaucggauugacaucgcgagcuaccugggcuaaaaacauucaaaccgcgauaaaucaaguucgaucuuugauaggcaaugaagaauauacagauuauaugccaucaaugaaacgguuccggcgugaagaagaagaagcgggaguccucugguaa

SEQ ID NO: 22481 - RNA, 9876 nt, Artificial Sequence
  derived and/or modified CDS sequence (opt6) from DENV-2__KC294218__SS-prME
acggcgggcgugauagucauguugauuccuacagccauggcuuuucaucuuacgacacguaauggcgaaccacauaugauuguagggcgacaagaaaaagggaaaaguuuacuauuuaaaacagaggacggagucaacaugugcacguugauggcuaucgauuugggcgaauuaugugaagacacuauuacuuauaaguguccacuccuucgacagaaugaaccugaagauauugauugcugguguaacucgacaucgacguggguaacuuacggaacaugcacuacgacuggggaacauagaagagaaaaaagaucgguagcucuaguaccacauguuggaaugggacuagagaccagaacagaaacguggaugucuucagaaggggcuuggaaacauguacagcguauagaaaccuggauauuacgacauccaggcuuuacaauaauggcagcaauauuagcauacacaaucgggaccacacauuuccagagagcauugauauuaauauuauuaacggcaguagcgccgucaaugaccaugcgcugcauaggaaucaguaaucgagauuucguugaaggaguguccgguggaucauggguggauauaguucuugaacacggcucaugcguuaccaccauggcaaaaaacaagccuacauuggauuuugaguuaauaaaaaccgaagcuaaacaaccugcaacucuaagaaaauacugcauagaagcaaagcuaacaaauacgacgacugaaaguaggugucccacucagggggaaccuuccuuaaacgaagagcaagacaaacgauuuaucugcaaacauagcauggucgaccgagguugggguaauggaugcggauuauucgggaagggcggaauaguuacaugcgcaauguuuacgugcaaaaaaaauauggaaggcaagauagugcaaccagagaauuuagaauauacuauugugauaacuccacauagcggcgaagaacacgcaguaggaaaugacacagguaaacauggaaaagaaauuaagauaacuccacaaaguucuacaacagaagcagaguuaaccggauacgguacuguaacaauggaaugcaguccaagaacaggauuagauuucaacgagaugguacuacuccagauggaagauaaagcaugguugguacaucggcagugguuuuuagaccucccgcuucccugguuaccaggggcagacacacaagguuccaacuggauucagaaggaaacuuuagucacguuuaagaacccacacgcgaagaaacaggacguggugguacuagggagccaagaaggugcuaugcacacugcucugacaggagcaacugaaauucaaaugaguucuggaaaucuccuuuuuacuggucauuuaaaaugucguuuacgaauggauaaacuccagcuuaagggaaugucauauuccaugugcacaggaaaguuuaagaucguaaaagagauagcagaaacacagcacgguacgauaguuauucguguacaauacgaaggugacggcaguccauguaaaauccccuucgaaaucacugauuuagaaaagcgacauguacuuggaagauuaauaacaguaaacccgauagucacagaaaaagauucaccuguaaauaucgaagcagagccgccauucggagacucuuacauuauuguuggaguagagccgggucaauuaaaauuaaauugguuuaaaaaagguucgucaauagggcaaauguuugaaacuaccaugcgaggagcaaaaagaauggcgaucuuaggugacaccgcuugggauuuuggaucauuagggggggucuuuacaucuauagguaaagcgcuucaucagguuuuuggugcaauauacggcgcggccuuuucggggguaaguuggacgaugaaaauccuaauaggcguuauaauaacauggauaggaaugaauucgcgcuccacaaguuuaaguguuucuuuaguguuagugggaguaguuacauuguacuuaggugccaugguacaagcagauucuggcugcauaguaaguuggaaaaauaaagaguuaaagugugggucuggaauuuuuauaacagacaacguucauaccuggacagaacaauacaaguuucaaccagagaguccaaguaaguuggccagcgcuauacagaaagcgcaugaggaaggaauaugcggaauuagaucagucacgcgguuagaaaacuugauguggaagcaaauuacuccagaauuaaaccacaucuuaucagagaacgaagugaaacuaacgauuaugaccggcgauauaaaaggcaucaugcaagcggggaaaagaagccugagaccacaaccuacugaguuaaaguauaguuggaaaaccugggguaaagcaaaaaugcucucaacagagucccacaaccaaacuuuucucauagaugguccagaaacggcagaauguccuaauacaaaccgcgcauggaauuccuuggaaguagaagacuacggcuucggugucuucacaaccaacauuuggcuaaagcuaagagaaaaacaagauguguuuugugacucgaaauuaaugagugcugcaauaaaagauaauagggcgguacacgcagauauggguuauuggauagaaagcgcacuuaaugacacuuggaagauggaaaaggccucguuuauagaagucaaaucaugucacuggccgaaaucacauacacuuuggaguaaugggguacuagagagcgaaaugaucauacccaaaaacuuugcugggccaguaucacagcacaauuauaggccagguuaccacacucaaacagccgguccguggcaccuugguaaguuagaaauggauuucgauuucugugaaggaacaacaguaguuguaacagaagauugugguaauagaggaccaaguuuaagaacgacaacagcgaguggaaaacuuauuacagaaugguguuguagaaguuguacacuacccccccucagauacagaggagaagauggcugcugguacggcauggaaauucguccccuaaaagagaaagaggaaaauuuagugaacucgcuagucacagcuggccauggacaaauagauaacuucucacuggguguauuaggaauggcacuauuuuuagaagaaauguuacgaacucgaguagguacaaaacacgcaauacuucuagucgcacuguccuucguaacauuaauaacaggcaauauguccuuuagagaccucggaagaguaaugguuaugguaggcgcuacuaugacggaugauauaggaaugggaguuacguaccuagcuuuauuagcggcguuuaaaguuaggccgacauucgcugcaggauuguuacucagaaaacuuacuucgaaagagcuuaugauggcuacaauuggaaucgcuuuauuaagucaguccacgcuacccgaaacuauucuugaacuaacagaugcguuagcacuagggaugauggcacugaagauagucaggaauauggaaaaguaucaguuagcuguuaccauuauggcgaucaguuguguaccuaaugcuguuaucuuacagaaugcauggaaagugucauguacuauuuuagccgcaguauccgugaguccucuauuauuaacgucaucucaacaaaaggcagauuggauuccguuggcuuuaacuaucaaaggacugaauccaacggcgaucuuucuaacgacacuuagucgaacuucaaagaagcgaaguuggccccucaaugaagcuauuauggcgguaggaaugguaucaauauuggcuucuucacucuugaagaacgauauaccuaugacuggaccacuaguugcuggaggguuauuaacuguuugcuauguucugacaggaagaucagcugaucuggaauuagaacgcgccgcggauguuaaaugggaagaucaggccgaaauaucgggaucauccccaauuuugucaauaacaauuagugaggauggaucuaugucuaucaagaaugaagaagaggaacaaacccugacgauucuuauacgaaccgguuuauuaguaaucagcgguguauucccuguuucuauucccauaaccgccgcagccugguauuuaugggagguaaagaaacaaagagcuggagugcuaugggacguaccgucgccaccuccaguuggcaaagcagaguuagaagauggagcauaccgaauaaaacaaagaggaaucuuagguuacucacagauuggcgcagguguuuauaaagaaggaacauuucauacaauguggcauguaacaagaggcgcaguccucaugcaccgcggaaaaaggauagaacccagcugggcagauguuaaaaaagaccuaauaaguuacggaggagguuggaaauuagaaggagaauggaaagaaggagaagagguacaaguucuagcuuuggaaccaggaaagaacccuagagcgguacaaacgaagccuggaauauuuaaaaccaauacuggaacuaucggugcaguaucccuugacuucucaccgggaacgagcggaaguccaauagucgaccguaaggguaaaguaguuggauuauacgguaaugggguaguaacaagaucaggugcauacguuagugcuauagcccaaacugaaaaaucuaucgaagacaauccugagauugaagaugauauauuuagaaaaaaaagguuaacuauaauggaccuacaccccggugccgguaaaacgaaaagauaucuaccagcaaucguccgagaagcaauaaaaagaggacugcgaaccuuaaucuuagcuccgacacgggugguugcugcagaaauggaggaggcacugagaggccugccuauccgauaucaaacgccugcgauaagagcugaacacacaggaagagaaauaguugaccuuaugugccacgcuacauuuacuaugagacuucuaagcccuguacgggucccaaauuauaacuugauaauaauggaugaggcucauuuuacagauccagcuucaaucgcugcaaggggauacaucuccacaagaguggaaaugggcgaagcugcuggcauuuuuaugacugcuacaccucccggaaguagagaccccuuuccacagucaaacgcuccaaucauggaugaagagcgggaaauaccggagaggucauggaacucgggucaugaauggguaacugacuucaaagguaagacuguaugguuugugccaucaauaaaagcuggaaaugacauagcagcauguuuacgaaagaacgguaaaaaaguuauacaacucuccagaaaaacuuuugacuccgaguacguaaagacgagggcgaaugacugggacuucgucguaacgacagauaucagugagaugggagcaaauuucaaagcagaacgagucaucgacccuagacguuguaugaaaccggucauauugaccgacggggaggaacgcgugauucuagcaggccccaugccaguaacucauucaucugcagcucaacgacguggacgcaucgggcggaacccaaaaaaugagaacgaucaauacauuuacaugggggaaccacuagaaaacgaugaagauugugcgcauuggaaggaggcaaaaaugcuauuagacaauauaaauacgccugaaggaauaauaccgagcauguucgagccagaacgagagaagguugaugccauagacggagaauaucgauugagaggcgaggccaggaagacuuuuguugaccucaugcgaagaggcgaccucccagucuggcuugcauauaaaguagcggcagagggaauaaauuaugcagacagaaagugguguuucgacgguauuaagaauaaucaaauauuagaagagaacguagaaguagaaauauggacgaaggaaggugaaagaaaaaaauuaaaaccaagauggcuggaugcacgaaucuacucagauccuuuggcuuuaaaagaauuuaaggaauucgcugccggaagaaaaucgcucacgcuaaaucuuauaacugaaaugggucgacucccuacuuuuaugacacaaaaggccagaaaugccuuagauaaccuugcaguacuacacacugcugagguaggcgggaaagccuacacacacgcacuaucugaguuaccugaaacacuugagaccuuguuacuauuaacccuacuagcagcggucacagguggaauauuuuuauuuuuaaugagcgggaaagguauugguaaaaugaccuugggaaugugcuguauaauuacugcaucgauacuuuugugguacgcgcagauccaaccgcauuggauagccgcgaguauuauuuuagaauucuuucuaauuguacuguuaauaccagaaccugaaaaacaacgcacuccacaagacaaucaguuaacguacguagucauagcaauauuaacuguugucgcagcgacaauggcaaaugagaugggauucuuagaaaagacaaaaaaagacuuaggcuucgggagcauaacaacacaagaaagugaaucaaacaucuuagauauagauuuaagaccagcaucugccuggacacuguaugcaguggccaccacuuuuguaacaccgaugcuaagacauucaauagaaaauucgucgguaaauguuucacucacggccauugcuaaccaagcaaccgucuuaauggguuuaggaaaaggauggccauuaagcaagauggauauuggagucccauugcuggcaauaggcuguuauucucagguuaauccgaucacacuuaccgcagcuuuauuacuuuugguagcucacuaugccauaauuggaccaggauugcaagcaaaagcuaccagggaagcacaaaaacgcgcagcagcaggcauuaugaaaaacccaacuguagacggaauuacgguaauagauuuagaaccuauaccuuaugauccaaaauuugagaaacaacucgggcaaguuauguuauuaaucuugugcguaacacagguauuaaugaugagaacuacgugggcuuuaugugaggcauuaacucuugcuacgggaccaauuagcacuuugugggaaggaaaucccgguagauuuuggaauacaacuaucgcagucucaauggccaauauauuuagggguagcuaccuggccggcgcuggccuauuauucucgaucaugaaaaacacuacgaacacaagacguggaaccggaaacguaggggaaacacugggugagaaauggaaaucuaggcuaaaugcgcuaggcaaaucggaauuccaaaucuauaaaaagucaggaauacaagaaguugauagaaccuuagccaaagagggaauaaaaagaggagagacagaccaucaugccguauccagggguucagccaaguuacguugguucguggaaagaaacaugguaacgccugaaggaaaggucguugaccucggauguggacgagguggcugguccuauuacugugguggauuaaaaaacguucgugaagucaaaggauuaacaaaagguggaccgggacaugaggaaccuauuccuaugucgaccuauggauggaauuuaguuagacuacaaagugggguagauguauuuuuuacuccuccugaaaaaugugauacacuccuuugcgacauuggugaaagcuccccgaauccgaccaucgaagcaggucgaacauuaagaguauuaaauuuggucgaaaacuggcucaacaacaauacgcaauucugcauaaaaguuuuaaauccguauaugccaagcguaaucgaaaaaauggagaccuuacaacggaaauacgguggugcacuaguuagaaacccguuaucacggaauucaacacaugagauguacugggugagcaacgcaacgggaaacauaguaucuucaguaaacaugauaucacggaugcucauaaauagauucaccaugaaacacaaaaaggcgacuuacgaaccggaugucgaucuaggauccggcacucggaauauuggcauagaaucggaaauuccaaacuuagauaucgucggaaagagaauugaaaaaaucaaacaagaacaugagacaaguuggcacuacgaucaagaccacccauacaaaacaugggcauaucauggaaguuaugaaacaaaacagacugggagugcaaguaguauggugaauggaguuguacgccuauuaacaaaaccuugggacguaguuccaaugguaacucaaauggcgaugacagacacaacaccauucgggcaacaaagaguuuuuaaagaaaaagucgacaccaggacacaagaaccuaaagaagguacuaaaaaacuaaugaaaauaacagcugaauggcuuuggaaggaacuaggaaaagagaagaccccaagaauguguacacgagaagaauucacaaggaagguuaggucaaacgcagcuuugggagcuguauucacggaugagaauaaauggaagucagccagagaggcaguggaagaugguagauuuugggaacuuguagauagagaaagaaaucugcacuuagaaggcaaaugugaaacaugcguuuacaauaugauggguaagagagagaagaaacuaggagaguuugggaaagcuaaaggaucccgggcaauuugguacaugugguuaggagcuagguuccuagaauucgaagccuuaggauuucuuaaugaggaucauugguuuucacgggguaacucacuaaguggagucgaaggcgaaggucugcacagacuugguuauauuuugcgcgaaguagggaaaaaggaagguggagcaauguaugcugacgauaccgcaggcugggauacccggaucacgcuugaagacuugaaaaaugaagaaaugguaaccaaccauaugaagggagaacauaagaaacuagcagaagcaauauuuaaacuaacauaucaaaauaagguagugagaguacaacggcccaccccaagagggaccgucauggacauaaucucaagaaaagaucaaagggguucaggucaaguggguacauauggacuaaacacauuuacuaauauggaagcccaacuaauacgacaaauggaaggagaaggcauuuucaagaguauccaacaccuuacagccacugaagaaauagcgguccagaauuggcuagcuagggugggaagagaacgauuaagcagaauggcaauaucaggugacgacuguguaguaaagcccauagacgauagauuugccuccgcauuaacugcucuaaaugacauggguaagguucgcaaggauauucaacaaugggaaccuaguagaggauggaaugauuggacucaaguaccauuuuguucgcaucacuuucaugaacuagucaugaaagacggacgaguacuuguaguaccuuguagaaaucaggaugaauuaauaggacgcgcgaggauaagucaaggagccggauggaguuugaaagagacugcguguuuagguaaaucuuaugcucagauguggaccuuaauguauuuucaccgaagggauuuacgccuugcugccaaugcuauauguagcgcagucccaucucacuggguaccuacgagccguacaacuuggaguauucaugcgaagcaugaauggaugacgaccgaagauaugcuaguaguguggaaccgcguuuggauacaggagaaucccuggauggaagacaaaacgccuguagaaaguugggaggaaguucccuaccuggguaagagagaggaccaauggugcggaagccucauugguuuaacaagucgagcgacaugggccaaaaacauccagacugcaauuaaucaaguacggagucuaauaggcaaugagggguauacagacuauaugcccucgaugaaaagauuucgucgugaggaagaagaagcagguguuuuaugguaa

SEQ ID NO: 22482 - RNA, 9876 nt, Artificial Sequence
  derived and/or modified CDS sequence (opt6) from DENV-2__KC294220__SS-prME
acagccgguguaauuguuaugcuaauaccuacggcaauggcuuuucaucuaacgacucggaauggggaaccacacaugauaguaggucggcaggaaaaagggaaaucacugcuauuuaaaacggaagaugguguuaauaugugcacacuuauggccaucgauuugggagaacuaugugaagauacaauuaccuacaaauguccuuuacuucgccaaaaugaaccagaagauauugauuguugguguaauucgacuagcacguggguuacuuacgguacguguacaacuacuggugaacauagaagagaaaaacgaaguguagcauuaguaccucacguugguaugggucuagaaacucguaccgaaacauggaugucuucugaaggagcauggaaacacguacagagaaucgaaacauggauuuuacgacacccaggcuucacaauaauggcggcaauauuagcauacacuauagguacuacacauuuucaaagagcucuuauuuucauauuauuaaccgcuguagcgccgucaaugacaaugagauguaucgggauaagcaauagagacuuuguugaaggagugagcgggggaucguggguugauauuguauuggagcauggcaguuguguaacuaccauggcgaaaaauaaaccaacuuuggacuuugaacucauuaaaacugaagcuaaacagccagcaacauuaagaaaauacuguaucgaagcuaaacuuacaaauacgacaacagagagucguugucccacgcagggcgagccgucuuuaaacgaagaacaagauaaacgauucauuugcaaacauucaaugguugaucgaggaugggggaauggauguggucuuuucgggaaaggaggaauuguuacuugcgcuauguucaccuguaagaaaaauauggaggggaaaauagugcaaccagaaaauuuagaauauacuauaguuaucacaccccauucaggugaagaacacgcaguugguaaugauacgggcaaacaugguaaagaaauaaaaaucacaccucaaucgaguaccacagaggcugaacucacgggcuacggaacgguuacuauggaguguucaccgaggacaggauuggauuuuaaugaaaugguacuacuacaaauggaagauaaagccuggcuagugcaucgucagugguuccuggauuuaccacuucccuggcuuccuggugcugauacccaaggauccaauuggauacagaaagaaacuuuggugacuuucaaaaauccgcaugcuaagaaacaagacguuguaguauuagguucgcaagagggagcuaugcauacagcucucaccggggcuacagaaauacagaugaguucaggaaaucuacuuuucacaggacauuuaaaauguagacuacgcauggauaaauugcaguugaaaggaaugaguuacuccaugugcacuggcaaauuuaaaauuguaaaagaaauagcggaaacucaacacggaacuauuguuauaagaguacaauaugaaggagacgguucuccgugcaaaaucccauucgaaauaacagaucuggagaaaagacacgucuuaggacggcuuaucacuguaaaccccauaguaacugaaaaagauaguccgguaaacauagaagcagaaccuccuuucggagacuccuacauuauagucgggguagaaccaggucaacugaaacuaaauugguuuaaaaagggaucgucuauaggucaaauguuugaaacuacuaugcgcggcgcuaaacgaauggcuaucuugggagauacagcaugggauuucgggagucuagggggaguguucacaaguauuggaaaagcacuucaccaaguguuuggggcgaucuauggggcagccuuuucagguguuagcuggacuaugaaaauacuaaucgggguaaucaucacuuggauuggaaugaauagcagaucgacaucauuaagcgugagucucguuuugguaggaguuguaacacuguaccuaggagccaugguucaagcugauucagggugcauuguuucguggaaaaacaaagaauugaaguguggcaguggaauuuuuauuaccgacaacguacauacauggacggaacaguauaaauuucagccagaaagcccuucaaaauuagcgucagcuauccaaaaagcacacgaagaagggauuugcgguauaagaucggucacaaggcuugagaaccuuauguggaagcaaaucacacccgaacuuaaucauauccuaucagaaaaugaagugaaguuaaccauaaugacaggggacauuaaaggaauaaugcaagccgguaagagaucgcuuaggccucaaccaaccgaauuaaaauauucuuggaaaacauggggaaaagcaaagaugcugucaacggaaucacauaaucaaacauuccuuauugauggaccugaaacugccgaaugcccgaauacaaaucgugcuuggaauagcuuagaaguagaagauuauggauuugggguauuuaccacaaauauaugguuaaaacuuagagaaaaacaagacguauucugugacuccaaacuaaugagugcagcaauaaaagauaaccgagccguacacgcugauaugggguacuggauagaaagugcuuugaaugacacguggaaaauggaaaaagccaguuuuaucgaagucaaaucaugccacuggcccaagucacacaccuuauggucuaaugguguauuggaaagugaaaugauuauuccuaaaaacuuugcagggccaguaucacaacacaauuacaggccaggauaucacacacaaaccgcugggccauggcaucuuggaaaacuugaaauggacuuugauuuuugcgaaggaacuacuguaguaguaacagaagacugcgggaauagggguccuaguuuaagaacaacaacagcaaguggaaaacuuaucacugaaugguguugucguucuugcaccuuaccaccauuaagauauagaggugaagaugguugcugguauggaauggaaaucaggccucugaaagaaaaagaagagaauuuaguaaauaguuuagucacagcaggucauggccaaaucgauaacuuuucuuuaggaguauugggcauggcuuuauuucucgaagagauguuaagaacccggguugguacuaagcaugccauauugcuuguugcauuauccuuuguaacucuuaucacgggaaacaugucguuuagagauuuaggccguguaauggucaugguaggagccacaaugacggaugauaucgguauggguguuacauauuuggcuuugcuagcugcguuuaaaguaagaccuacguucgcagcaggacuauuacuaagaaaacuuaccaguaaggaauuaaugauggcuacgauuggaaucgcucuguuaucucaaucuacacuaccagaaacuauccuugaauuaacugacgcgcuagcgcuagggaugauggccuuaaaaauuguuagaaauauggagaaauaucagcuagcagugaccauuauggcgauaagcuguguaccaaaugcuguuauacuucaaaaugcuuggaaaguuaguugcacuauauuagcagcugucucaguaucuccucugcuccucaccucgucucaacaaaaagccgacuggaucccgcuugcccucacaaucaagggcuuaaaccccacagcuauauuucuuacuacucugagcagaaccuccaagaaaagaagcuggccacugaacgaggcaauaauggcaguugggaugguaucaauucuagccaguaguuuauugaaaaaugacauacccaugacagggccacuugucgcgggcggacuauugacaguauguuauguccuaacgggcagaucagccgaccuugaauuagaacgggccgcggauguaaagugggaagaucaagcggaaauuucagggaguagcccaaucuuaagcauuacaauaagugaggauggaucaaugagcaucaaaaaugaagaagaggagcaaacauugacaaucuuaauucgcacugggcuguugguuauaagcgggguguuuccagugucaauacccauuacggcggcagccugguaucuaugggaaguuaagaaacagagggcaggcguuuuaugggauguaccgaguccaccgccuguagguaaggcggaacuagaagauggugcauaucggauaaagcaaagaggaauuuuggguuacucccaaauuggugccgggguauauaaagaaggcacauuucauacgauguggcauguuacuagaggugcaguuuuaaugcaucgagggaaaaggauagagcccucaugggccgauguaaagaaggauuuaauuucuuaugggggagguuggaaacuagaaggcgaguggaaggaaggagaagaaguucaagugcuggcucuugaaccugguaagaacccacgugcaguccagacaaaaccaggaauauuuaaaacgaauacaggaacuauaggagccguuucgcuagauuuuucuccaggaacaagcgggagcccaaucguggauagaaaagggaaaguggugggacuauaugggaauggaguugugacaaggaguggggcguauguaucagcaauagcacaaacagaaaaguccauugaagacaacccugagaucgaagaugacauuuuccguaagaaacguuuaaccaucauggacuuacacccaggagcugguaaaaccaaaagauauuuaccagcuauuguaagggaggcuauaaaacgcggccuaaggacgcucauuuuagcaccuacuagaguagucgccgcagaaauggaagaagcccuaagaggucuuccaauacgauaccaaacccccgccauaagagcagaacauaccggaagggaaauaguugaucuaaugugucacgcuaccuucacuaugcgccuuuuaucuccuguacguguuccgaauuauaacuugauuauaauggaugaagcacauuuuacagauccugcuaguaucgcagcaagggguuauauaagcacacgaguagaaaugggugaggcugcaggcauauuuaugacagcaaccccuccaggcaguagagauccguuuccucaaagcaaugcacccauaauggacgaagaacgugaaauccccgagagaagcuggaacucugggcaugaguggguuacugauuuuaaggguaaaacugucugguucguuccuucaauaaaagcaggcaaugauauugcagcaugccugaggaaaaaugggaagaaaguaauacaguuaagucgaaaaacauucgauucagaguauguaaaaacccgggcgaaugauugggacuucgucguuacaaccgauauaagugaaaugggggcuaacuucaaggcagaacgaguuauugacccaaggcgguguaugaaaccggucauacuuaccgacggugaagaaagggucauacucgcaggaccaaugcccgugacucauagcagugcagcacagagaagggggagaauugguagaaaccccaaaaaugagaacgaucaauacauauauaugggcgagccauuagaaaaugaugaagauugcgcccacuggaaagaggcgaaaaugcuacucgauaauaucaauacaccggaaggcauuauaccgagcauguuugaaccagaacgugagaagguagaugcuauagauggagaauacaggcugaggggugaagcaaggaaaacuuuuguugaucuaaugagaagaggggacuuaccaguaugguuagcauacaaaguagcagcggagggaauaaauuaugcagacagaaaauggugcuucgauggaauaaagaauaaucaaauauuagaagaaaacgucgaaguggagauuuggacgaaagaaggagaaaggaaaaagcucaaaccaagauggcucgaugcucguauuuauagcgacccccucgcgcuaaaggaauuuaaagaguucgcagcaggacgcaagucauugacuuuaaauuuaauuaccgaaaugggacgacuaccuacuuuuaugacucaaaaagccagaaaugcccuugacaaccuagcuguacuucacacugccgaagucggcgguaaagcauauacucaugcucuuagugaauugccagaaaccuuagaaacacuuuugcuuuuaacacuccuggcggcgguuacgggugguauauuuuuguuucugaugucagguaaagguauaggaaagaugacauuaggaauguguugcauaauaacugcuucgauacuguuaugguaugcgcaaauacagccucacuggauugcagcgagcauaauccuggaauuuuuccuaauuguuuuguugauaccggagccagaaaagcagcggacaccgcaagacaaccaauuaacauacguaguaauagcaauucugacuguuguagcugcuacgauggcaaaugaaaugggguuccuggagaagacgaagaaggaucuaggauucgggucgauuacgacgcaagaaagugaaagcaacauccuagauauagaccucagaccggcaucagcauggacucuauacgccguugcaacaacauuugugacgccgauguuaagacacucuauugaaaacaguucaguuaacgucagcuugacagccauagcaaaucaagcaacuguauugauggguuuaggaaaaggguggccguuaucgaagauggauauuggaguuccuuuacuagcgaucggcuguuauagucaaguuaauccuauaacacuuacugcggcgcuauugcuacucguagcccauuaugcgauaaucggaccaggacuucaagcaaaggcgacacgugaagcucagaaacgagcggcggcuggcaucaugaaaaauccuacagucgauggaauaacagugaucgaucuagaaccuauaccuuaugauccgaaauucgaaaaacaauugggacagguuaugcucuuaauauuguguguuacacaaguucuuaugaugagaacaacgugggcguuaugcgaggcuuuaacccuagcuacaggacccauuucaaccuuaugggaaggaaaucccgggagauuuuggaacacgacuauagcugugucgauggcaaacauuuucagaggcaguuaccuugcaggagcaggacuucuauucaguauaaugaagaacacaacaaauacgaggagaggcacaggaaaugucggagaaacuuuaggugaaaaauggaaaucgcgucuuaaugcauuaggaaaauccgaauuucagaucuauaagaagagugggauucaagagguugaccggacucuugcuaaggaaggaauaaagcgaggagaaacggaucaccaugcuguuucgcgagguucggcuaaacuacgaugguuugucgagcgaaacaugguaacccccgaggguaagguaguggauuuaggaugugguagaggaggauggaguuauuauugcggaggccuuaaaaauguacgcgaagugaaaggacuuacuaaagguggaccagggcacgaagaaccuauccccaugucaacuuauggcuggaacuuaguuagguuacagucgggagucgauguguucuuuaccccaccugaaaugugugauacucuucuuugugauaucggagaaagcagcccaaaucccacaauugaagcgggacgaaccuuacgagucuugaaucuagucgaaaauugguugaacaauaauacacaauuuugcauuaagguauuaaacccauauaugccaucaguaaucgagaaaauggaaacauuacaaagaaaauaugguggagcauuaguaaggaauccauugucuagaaauagcacccacgaaauguauuggguaucaaacgcuacuggaaauauaguaucaagcguaaauaugauaucaagaauguuaauaaaucgauuuacaaugaaacauaagaaagcuaccuaugagccugacguagaucugggaucugguacaaggaacaucgguauagaaucugaaauaccuaaccuggauauugugggcaaaagaauugagaaaauaaagcaggagcacgaaacgucuuggcacuaugaucaagaucacccuuacaaaacuugggcuuaucauggaucauacgagacuaaacaaacugguagugcuucgucuauggugaauggagugguaaggcuacucacuaaaccaugggacguuguuccaaugguaacacaaauggcaaugaccgacacaacaccuuuuggacagcagcgcguguucaaagaaaaaguagacacaagaacacaagaaccaaaggaagggacuaagaaauuaaugaaaaucacggcugaaugguuguggaaggaacuaggcaaagagaaaacacccagaauguguacucgagaagaguuuacccggaagguacgcaguaacgcugcgcuuggagcgguguucaccgacgaaaacaaguggaagucugccagagaagccguggaggacgggcguuucugggaauuaguagauagagaaagaaaucuacauuuggagggaaagugugaaacgugugucuacaauaugaugggcaaaagagaaaagaaguuaggugaauuuggcaaagccaaaggaagcagggcaauaugguauauguggcucggagcaagauuuuuagaguuugaggcucugggauucuugaaugaagaucauugguuuucgcgugguaauucgcuaucugguguagagggagaaggauuacauaggcuuggauauauauuaagagagguugggaagaaagaagguggugcuauguacgcagaugauacugcugggugggauacccguauuacauuggaagaucucaaaaaugaggaaaugguuacuaaucauaugaagggugaacacaagaaacuagcagaagcaauauuuaaacuaacauaucagaauaaagugguccguguacagcgacccacaccaagggguacaguaauggauauaaucagcagaaaagaccagcgaggaagcggccagguagguaccuaugguuuaaauacuuucacaaauauggaagcacaauuaauuagacaaauggaaggagaagguauauucaaaagcauacagcacuugacagcaacggaggagauagccguacaaaauugguuagcaaggguuggacgugaaagauuaaguagaauggcaauauccggggacgacuguguagucaaaccuauugacgauagauuugcgucagcguuaacagcacuaaaugacaugggaaaaguaagaaaagacauacaacagugggaacccagucgagguuggaacgauuggacccaaguaccguuuugcagucaccauuuccaugagcuaguaaugaaagauggaagaguguuagugguaccaugccguaaucaagaugaauuaauagggcgugcaagaauaucccaaggugcaggauggaguuuaaaagaaacugcaugucuagggaaaucuuaugcacaaauguggacgcucauguacuuucauagaagggaucuucgccuagcagcaaacgcuaucuguucugcugugcccagucauuggguaccaacaaguagaacgacaugguccauacaugccaagcaugaauggaugacaacugaagauaugcuaguugucuggaaucggguguggauacaggaaaauccuuggauggaagauaagacgccaguugagaguugggaagaaguaccauaucuagggaagagggaggaucaguggugcgguucuuugauaggacuaacaaguagggcuacuugggccaaaaauauacaaacagcuauaaaccaaguacgcaguuuaauaggaaacgaagguuacacagauuauaugccaucaaugaaaagauuuagacgggaagaagaggaagcaggcgucuuaugguga

SEQ ID NO: 22483 - RNA, 9876 nt, Artificial Sequence
  derived and/or modified CDS sequence (opt6) from DENV-2__KC294221__SS-prME
accgcggguguuauaguaaugcugauaccaacagcuauggccuuucaccugacaacacgaaacggagaaccucacaugauagucgguaggcaagaaaaaggaaaaaguuuauuguucaaaacugaggauggagucaauaugugcacacuaauggcaaucgaucuaggagagcucugcgaggauacaauaacuuauaaaugcccucuccuccgacaaaacgagcccgaggauauugauuguugguguaauaguacuucaacguggguaacuuauggcacaugcacuacuaccggggagcacagaagagaaaaacguaguguagcuuuggugccccacguagguaugggucuagaaacccgaacagaaacuuggaugucuucagagggcgcauggaaacacguucagaggaucgaaacauggauauuaagacacccggguuuuacaauuauggcagccauauuagcuuacacaauugggacaacucauuuccagagagcauuaauauucauauuacuuaccgccguagcgccaucgaugacgaugagaugcauaggaauauccaaccgagauuuuguugagggaguaagcgguggaucgugggucgacaucguguuagaacacggcagcugcgugacaacuauggcgaaaaauaagccuacacuagauuuugaacuuauaaagaccgaagcgaagcagccugcaacacucagaaaguacugcauagaagcaaagcuaacuaauacuacaacagaaucccgcugccccacgcaaggggagccuuccuuaaaugaggaacaagauaagagauuuauuuguaagcauaguaugguugaucguggaugggguaauggguguggauuauucgguaagggaggaauugucacaugugcaauguucacuuguaaaaaaaacauggaaggaaaaauuguacaaccagaaaaucuugaauauacuaucguuauaaccccucacucgggggaggaacaugccguaggaaacgauacgggaaaaagaggaaaagaaaucaagauaacuccgcagucaucuacuacagaagcugaauugacaggguacggaacaguaaccauggagugcagcccucggacaggacuggauuucaacgaaauggugcucuuacaaauggaggacaaagcuuggcuaguacaucgacaaugguucuuagaccuuccccuaccauggcuaccuggagcagauacacaggggucaaacuggauccagaaagaaacacuaguuacuuucaagaacccgcacgcuaaaaaacaggacguggugguacuuggaucucaggaaggcgcuaugcauacagcccucacgggggccacagaaauacagaugucaaguggcaaccuacuauuuacuggucaccuaaaaugcagguuaaggauggacaaacugcagcuaaaaggcaugucauauagcaugugcacuggcaaauuuaaaauuguaaaagagauagcagaaacccagcauggaacuauagucauacgaguccaauaugaaggugacggcucaccaugcaaaauccccuuugagauaacagauuuggagaagagacauguuuuagggagacucauaacaguuaaccccaucguaaccgaaaaagacaguccaguaaauauagaagccgaacccccuuuuggugauagcuauauaauaguuggaguugagccaggccaacuaaaauugaauugguuuaagaaagguucaaguaucggacagauguuugaaacaacgaugcgaggggcaaaaagaauggccauacuuggugauacggccugggauuucggcucccuagguggagucuuuaccagcauagggaaagcacuacaccaagucuuuggcgcaauauauggugcagcauuuaguggcguuuccuggacaaugaaaauucuaauuggaguuauaauaaccuggauaggaaugaacucaagaucuacuagcuugucuguaucgcuaguucucguggggguugucacauuguacuugggugcaauggugcaagcagauucggguugcauaguaucauggaaaaauaaggaguuaaagugcggcuccgguauauuuauuacagacaacguccauacguggaccgaacaauauaaauuccaaccugaaaguccaaguaaauuagcaucggcaauacaaaaagcacaugaagagggaaucugcgguaucaggucuguaacacguuuagagaacuugauguggaagcaaauaacaccagagcuaaaucauauacucagugaaaacgaaguuaaacugacaauaaugacaggugacaucaaaggaauuaugcaagcaggaaaaagaagucuacgcccgcagccgacugaauuaaaauauagcuggaaaaccuggggaaaagcgaaaaugcucaguacagaaucgcauaaccagacuuuucuaauagaugguccugagaccgcggaauguccaaauaccaauagagcguggaacagucucgagguugaagacuacggauuugguguauucucgacgaauaucugguuaaaacuccgggagaaacaggauguauucugcgauucaaaguuaauguccgccgcaauaaaagauaacagagcaguucacgcagacaugggguauuggauagaaucagcauuaaacgacaccuggaagauggagaaagcuucuuuuauugaaguaaaaucgugccauuggccaaagucgcauacacuauggaguaacggagucuuagaaagcgaaaugaucauaccgaagaauuuugcggguccuguuucacagcauaacuaccggccuggauaucacacacaaaccgcuggcccguggcauuuaggcaaacucgaaauggauuucgacuucugugaaggcacaacuguuguagucaccgaggacugugggaauagggguccuagucuucguacaacuacggcuucagggaaacuuauuacugagugguguugcagaaguugcacacuaccuccacuuagauaccgaggugaagacggauguugguacgguauggaaauaaggccccuuaaggagaaagaggaaaauuuaguuaacucuuugguuacugccggacauggucaaauugauaauuucucucuaggaguguuggggauggcauuauucuuggaagaaaugcuuaggacuagggucgguacuaaacaugcaauuuugcuuguagcucuuuccuuuguuacauugauaacugguaacaugagcuuucgagaucucggcagaguaaugguuaugguuggcgcaaccaugacggacgacauuggaauggggguaacauauuuggcauuauuagccgccuucaagguucggccuacauucgccgcuggauuguuauugagaaaacugacuucgaaagaguuaaugauggcgacuauaggaauagccuuauuaucacaaaguacccuaccagaaacuauacucgagcugacagacgcacucgcccuaggaaugauggcacuaaaaauaguaagaaauauggaaaaauaucaauuagccgucacaauuauggcaaucucauguguaccaaaugcuguaauauuacaaaacgcuuggaaagucucauguacgauucuggccgcgguuucugucucaccguuacuuuuaacaucaucacaacagaaagcggauuggauaccccuagcauuaaccauaaaaggacuaaauccaacagccaucuuuuuaaccacauuaucacguacuucuaaaaaacgaagcuggcccuuaaaugaagcaauaauggcgguagggaugguuucaauucucgcaucuucauuacugaaaaaugauauuccaaugacaggaccauugguagcggguggauuacuaacugugugcuacguuuugacaggucguucagccgaucuagaacuagagagggcagcggacguaaaaugggaagaucaagccgaaaucaguggcagcagcccuauauuaaguauaacaaucucagaagaugguucgaugucaauaaaaaaugaagaagaagaacaaacuuuaacaauccucauaagaaccggucuguuggugauaagcggagucuucccaguuuccauaccgauuacagccgccgcgugguacuuaugggagguaaaaaaacaacgugcugguguacuuugggacguucccucuccuccgccgguagguaaagcugaauuggaagacggagcauaucguauuaagcaacgcgggauccuuggauauagucagaucggggcgggagucuacaaagaagguacuuuucauacuauguggcacgucacucgcggagcaguucucaugcauagaggaaaaagaauugaaccuucaugggcugacguaaaaaaagaccuaaucucauauggagggggguggaaguuagaaggggaguggaaagaaggugaagaagugcaagugcuagcgcuggagccuggaaaaaauccgcgagcuguacagacgaaacccggaauauuuaaaacaaacacuggaacaauuggggcuguauccuuagauuuuuccccagguacuuccggaagcccaauaguagauagaaaaggaaaaguuguaggccuauauggaaauggagugguaacccgauccggggcauacguaucagcaaucgcucaaacagaaaaaaguauagaggauaauccggaaauugaagacgacauauuuagaaaaaaacgguugacaaucauggaucuccauccuggagccgguaaaacaaaacguuaccuaccagccauuguccgagaggcgauaaaacgagguuuaagaacgcuuauacuagcaccaacacgcgugguugcagcagaaauggaggaagcacuaagaggccuaccaauccgguaccaaacuccagcaauaagagcagagcauacaggacgggaaaucguagauuugaugugccaugcaacauuuaccaugagauuauuaucacccguuagagucccaaauuauaaucuaaucauaauggaugaagcacauuuuacagacccagcuagcaucgccgccagaggauauaucuccacacgcguagaaaugggagaggcagccgguauauucaugacagccaccccaccaggcucaagagacccauucccacaaucuaaugcaccaauaauggaugaagagagagaaauaccagagcggaguuggaacagcggacaugaaugggugacugauuuuaaaggcaagacuguaugguucgugccuaguauuaaagcggggaacgauauugcugcgugccuacguaagaaugguaaaaagguaauccaacugagccguaaaaccuuugauagugaauauguuaagacaagagcaaacgacugggauuuuguaguaaccacagauauuucugaaaugggagcaaauuuuaaagcagaacgaguaauugacccaaggcgauguaugaagccaguaauucuuacugauggcgaagagagaguuauacuugcaggaccaaugcccgucacucauagcucagcugcccaaaggagaggaagaauuggacgaaaccccaaaaaugagaaugaucaguacauauacaugggcgaaccucuagagaacgaugaggacugcgcccacuggaaagaagccaaaaugcuacucgauaauauuaauacuccagaaggaaucauaccuucuauguuugaaccugagagagagaagguagaugccauugauggugaauacagacucagaggagaagcacgaaaaacguucguugauuuaaugaggcguggcgaucucccaguaugguuagcuuauaaaguagcggcagaaggaauuaacuacgcagacagaaaaugguguuucgauggaauuaaaaauaaccagauauuggaagaaaacguagaaguagaaaucuggacuaaagaaggcgaacgaaaaaaauuaaagccgagauggcuagacgcaagaauuuauucagacccacucgcuuuaaaagaauuuaaggaguuugcggcaggacgaaaaucauuaacauuaaauuuaauuacugaaaugggacgucucccaacguuuaugacucaaaaggcacguaaugccuuagacaaccuagcgguuuugcacacugcugaagugggcggaaaagcauacacccacgcacugucagaguugccagaaacccuagagacauuauuauuauuaacucuacuugcggcaguaacagggggaauauuccuuuuccuaauguccggcaaagguaucgguaaaaugacucuaggcauguguuguauaauaacagcaagcauucuuuuaugguaugcccaaauacaaccgcauuggauagcggcuucaauaauauuagaauuuuuucuuauuguucuauugauuccugaacccgagaaacaacgaacaccucaagacaaucaauuaacuuauguaguuauugcaaucuugacaguuguugcugcaaccauggcgaaugagauggguuuucuggagaaaacuaagaaggaucuagguuucggcagcauaacuacucaggaaagugaaucaaauauauuagauauagacuuacguccagcaagcgcauggacgcuuuacgccguugcuacuacuuuugucacaccaauguuaagacauucuaucgaaaauucuucgguaaauguuucacuaacggcuauagccaaucaagcgacaguacuaaugggccugggaaagggauggccauugucgaaaauggauaucggaguaccacuuuuggcaaucggauguuauucgcaagugaauccgauuacacucaccgcugcccuuuuacucuugguagcgcauuaugccauaauuggcccagguuuacaggcuaaagcaacuagagaagcacaaaagagagcggcagcgggaauuaugaaaaauccaacaguugacggaauuacagugauugaccucgaacccauaccauaugauccaaaguucgaaaaacaacugggacaaguaauguuguuaauacuauguguaacacaaguccuaaugaugcgaacuaccugggcuuugugugaggccuuaacauuggcgacgggaccgauaaguacuuugugggaggguaacccaggcagauuuuggaauaccacaaucgcaguuuccauggcaaacauauucagaggauccuaccuggcaggcgcuggcuuauuguuuucuauaaugaaaaauacuacgaauacgaggagagguacugggaauguaggugagacuuugggagaaaaauggaaaucaagacuuaacgcuuuaggaaaaagcgaauuucaaauauauaaaaaaucagguauacaagagguagaccgcacacuagcaaaagaaggaauuaaacgaggcgaaacugaucaucaugcagugucccgaggaucagcaaaauuaaggugguuuguagaacgaaauaugguaacacccgaaggaaaaguaguagaucuugguugcggucgagggggguggagcuacuauugcgggggacuuaaaaacguacgcgagguaaaaggacuuacuaagggaggaccaggccaugaggagccaaucccaaugucaacauacggauggaacuuaguacggcuucaaucgggaguagaugucuucuucacaccccccgagaaaugugauacacuucucugugacauaggugagaguucaccaaacccaacaaucgaagcaggucguacacuaagaguauuaaaucucguagaaaacuggcucaacaacaauacacaauuuugcauuaaaguuuuaaauccauacaugcccagugugauugagaaaauggagacacuccaacguaaguacggaggagcauuaguaagaaacccacuaucuagaaauucaacccaugaaauguauuggguuagcaaugcaaccgggaacaucguaucuucagugaacaugauaucacguaugcuaauaaaucgauuuacaaugaaacacaaaaaagccacuuacgagccugauguggauuuggguucaggcacuagaaacauagguauagaaucagaaauaccuaauuuagauaucguaggaaaacgaauagaaaagauaaaacaggaacacgaaacaucauggcacuaugaucaagaucauccuuauaagacaugggcuuaccaugggucauacgaaaccaagcaaacagguagugcaucgagcaugguaaauggaguggugcggcucuuaacuaaaccaugggacguagucccaaugguuacucaaauggcgaugacugacacuaccccauuuggucagcaaagaguauuuaaagaaaaagucgauacaagaacccaagaaccuaaagaaggaacaaaaaaacucaugaaaauaaccgccgaauggcuauggaaggaacucgggaaagagaaaacuccuagaaugugcacaagagaggaauucacgaggaaaguacgaucgaaugcagcacuuggagcuguauucacugacgagaauaaauggaaaagcgcuagagaagccgucgaagacggcagauuuugggaauuaguugauagagaaagaaaccuacauuuagagggcaaaugugaaacgugcguauauaacaugaugggcaaaagagaaaaaaaauuaggugaauuugggaaagcgaagggaagucgagcuauaugguauauguggcucggagccagauuucuagaauucgaagcucucggauuuuuaaacgaagaucacugguucucccggggaaacagccucuccgggguugagggcgaaggacugcaucgacucggauauauccuuagagaaguugggaagaaagaaggaggggcaauguaugcugaugauacggcuggcugggacacacgaaucacgcuugaggacuuaaaaaacgaagaaaugguaacgaaccacaugaaaggugaacacaaaaaauuagcagaagcaauauuuaagcuaacuuaccagaauaaaguuguuagaguacaacggccuaccccccgagguacaguaauggauauuaucaguagaaaagaccaaagaggcagcgggcagguagguacuuauggacucaacacguuuacaaacauggaggcacaauugauucgucaaauggaaggugagggaauauuuaaauccauccagcacuuaacggcaacggaggaaauagcuguacagaauugguuagcacggguaggacgggaaaggcuuagucgaauggcuaucucuggagaugacugcguugucaaaccgauugaugauagguuugccucagcacucaccgcauuaaacgauaugggcaaaguuagaaaagacauccaacaaugggaacccucaagaggcuggaaugacuggacacaagucccguuuugcucacaucacuuucaugaacuaguuaugaaggacggucguguuuuaguaguaccaugucggaaucaggacgaacuuauaggaagggccagaauuucgcaaggcgcaggauggucgcuuaaagaaaccgcuugucuagggaaauccuaugcacaaauguggaccuuaauguacuuucacagacgugaucuacgucuagcugccaacgcaaucuguagugcagucccaagccacugggucccuacgagcagaacaacauggucgauccaugccaagcaugaauggaugacuacagaggauaugcucgucguauggaaccgaguauggauacaagaaaauccauggauggaggauaaaaccccgguagaaaguugggaagaaguuccauaucuuggaaaaagggaagaucagugguguggaaguuugauuggucuaaccagucgugcaacaugggccaaaaacauacaaacagcgauuaaucaggucagaagccuuauuggaaaugaagguuacacugauuacaugcccagcaugaaaagauuuagacgcgaagaagaagaagcaggaguucucugguga

SEQ ID NO: 22484 - RNA, 9876 nt, Artificial Sequence
  derived and/or modified CDS sequence (opt6) from DENV-2__KC294223__SS-prME
acagcuggugucauuguaaugcuaauaccgaccgcaauggcuuuucaucucacuacucgaaauggagaaccgcauaugaucguuggaaggcaggaaaaagggaaaucgcuauuguuuaaaacugaagauggaguaaauaugugcacuuuaauggcuauagaucuaggcgaauuaugcgaagacacgauaaccuauaaauguccauuauugaggcaaaaugaaccagaagauaucgacuguugguguaauaguacaucaaccugggugacauacgguacauguacuaccaccggugaacaccgacgagagaaaagaagcguugcauuaguaccucaugucgggaugggccuagaaacgcgaacugaaacauggaugucaucagaaggugcuuggaaacauguucaacggauugaaacauggaucuuaagacauccgggguucacaauaauggcugcaauccucgcuuauacaaucggaacaacacacuuucaaagagccuuaauuuuuauuuugcucacagcagucgcaccuucuaugaccaugagauguauagguauaucuaauagagauuuuguugaaggggugucugguggaagcugggucgacauuguuuuagaacacggaucuuguguaacuaccauggcaaagaauaaaccuaccuuggacuucgaacuaauaaaaacugaagccaaacaaccagcgacccuacggaaauacugcaucgaagcgaaacuuacaaauacuaccacugaaucaaggugucccacacaaggagaaccgaguuuaaacgaagaacaggauaagagguucaucugcaaacauuccauggucgaucgaggcuggggaaacggcuguggacuuuucggaaaaggagggauaguaacaugugcaauguuuacuuguaagaaaaauauggaaggaaaaaucguucagccagaaaaucuggaguauacaauugucauuacuccgcauagcggugaagaacacgcuguugguaaugacacaggcaaacauggaaaagagauaaagauaacuccacaaagcuccacuacugaagcagaguugacaggcuaugggacagugacaauggagugcucuccacguacaggucuagauuucaacgaaaugguauuguugcaaauggaagauaaggccugguuaguacaucggcaaugguuucuagauuugccguugccauggcuccccggagcagauacccaagguucgaauuggauacaaaaagaaacccuaguuacauuuaagaauccccaugcaaagaaacaggacguagucguauuagguucacaagaaggcgcaaugcauacagcgcugaccggagcaacagagauccaaaugucgucaggaaaucuuuuauuuacgggacacuuaaaauguagauuaaggauggauaagcugcaacuuaagggaaugaguuauaguauguguacagggaaguucaaaauaguuaaagaaauagcggaaacacagcauggaacgauagucauuagagugcaauaugaaggagacggaucuccguguaaaauaccauuugaaauaacggacuuagaaaaacgacauguacuuggcagauuaaucacagucaacccaauagucacggaaaaagacucuccgguaaauaucgaggcugaaccgccguucggagacuccuauaucaucguuggaguugaaccagggcagcuaaaacuaaacugguuuaaaaaggguucuaguaucggucaaauguuugaaacaacgaugcgcggagcuaaacguauggcaauucuaggugauaccgcaugggauuuuggaucguuaggaggagucuuuacauccauuggcaaagcauuacaucaggucuuuggagcuauauacggggcugcguucucggguguaucuuggacgaugaaaauucuuauugguguaauaauaaccuggauaggcaugaacagccgaagcacuucccuaucagucagucuagugcuuguaggagucgugacucuguauuuaggugcaaugguccaggcugacagcggcugcauuguaucguggaaaaauaaggaguugaaaugcgguagcggaauauuuauaacagacaacguucauacauggacugaacaauacaaauuccaaccagaaucaccaaguaaacuagcaucagcuauccagaaagcgcaugaagagggaauaugcggcauaagaagugugacgagauuagaaaacuugauguggaaacagauaaccccugaguugaaccacaucuuguccgagaaugaaguuaaacuaacaauaaugaccggagauaucaaagggauaaugcaagccggaaaaagaucguuacgaccucaaccuacagaguuaaaauauagcuggaaaaccugggguaaagcaaagaugcuaagcacagaaagucauaaccaaacguuccuuauagaugggccagagacggcagaaugucccaauacaaauagggcuuggaacucucuggagguugaggacuacggauuuggagucuuuacuacuaauaucugguuaaaauugagggaaaaacaagacguauuuugugauagcaaguuaaugagcgcggcaauaaaagacaaucgcgcggugcaugcggauaugggguauuggauagaauccgcucugaacgacacauggaaaauggaaaaggcuucguuuauagaaguaaagucuugccauuggccaaaaucucauaccuuauggagcaauggaguacuugaaucagagaugauaauucccaaaaauuuugcuggaccgguuucacaacauaauuaucggccuggcuaucauacgcaaacagcaggaccuuggcauuuaggaaaguuagaaauggauuuugacuucugugaagguacaacaguagugguaacagaagauuguggcaauagagggccuucucuaagaacuacgacagccagugggaaacuaauuacagaaugguguuguagauccuguacgcuaccaccauuacguuauagaggugaggacgggugcugguauggcauggaaauccggccacucaaagagaaagaagaaaacuugguuaauagcuugguuaccgcugggcauggucaaaucgacaacuuuucccuuggcgucuuagguauggcauuguuccucgaagaaaugcuaagaacacgaguaggcacaaaacaugccauauuguuaguagcguugucauuuguaacuuuaauaacggggaauaugucauuuagggaucuggguagaguaaugguaauggugggcgcaaccaugacugaugauauaggcauggguguuacauaccuugcacuguuagcugcauuuaaaguaaggccgacuuucgcugcgggcuuauuauuaagaaaacuuacauccaaggaauuaaugauggccacgaucgggauagcauuauugucacaaaguacacucccagaaacgauauuagaacuaacagaugcuuuagcacuugggaugauggcacuaaaaauagucagaaauauggaaaaauaccaacuagcaguaacaauaauggcuaucaguugcguuccaaacgcuguaaucuuacagaacgccuggaaaguauccugcaccauucuggcagcaguaucgguuagcccacuucugcuaacaaguucucaacagaaagcggacuggauuccgcucgcguugacaauuaaaggacugaacccuacggcuauauucuugacuacccuuucaagaacgucuaaaaagcgcuccuggccccuaaacgaagcaauaauggccguugguaugguaucgauccuagcuucgucgcuauugaaaaaugacaucccaaugacaggaccacuuguagcggguggauuacuaacugucuguuauguacuaacuggaagaagcgcagacuuagaauuagagcgcgcugcggacguuaagugggaagaucaggcagaaauaucuggaucaagcccuauccuaaguauaacuaucuccgaagaugggucaaugucaaucaagaaugaagaagaagaacaaacauuaacuauacuaauucgaacgggguuacucgugauaagcggugucuucccagucucgaucccaauuacagcagcugccugguaccuaugggaagugaagaaacaaagagcaggaguucucugggauguaccaucuccucccccgguuggaaaggcagaacucgaagauggagcuuauagaauuaaacagagggguauccucggcuacagccaaaucggugcaggaguauacaaagaagguacauuucauacaauguggcacgugacaagaggcgcaguauuaaugcaucguggaaagcgaauagaacccagcugggccgaugugaagaaagaccuuaucucauacggaggaggcuggaaauuagaaggggaguggaaagaaggcgaagaaguccaaguacuagcauuagagcccgguaaaaauccccgugcaguucaaacaaagccaggcaucuuuaaaaccaauacagggaccauaggagcagugaguuuagauuuuagcccaggaacaagcggcucaccuauaguagaccguaaagguaagguaguaggauuauauggaaaugggguaguaacaagauccggagcuuacguaagcgccauugcacaaacugagaaaagcauagaggacaauccagaaauagaagaugauauauuuaggaagaaaagacuaacuaucauggaccuacacccaggagccggaaaaacaaaacgcuauuuacccgccaucguaagggaggccauaaaacgaggacuaaggacuuuaauuuuagcuccaacacgaguaguagccgcagaaauggaagaagcgcuucgaggacuuccaaucagauaccaaacuccggcgauuagggcagaacauacaggacgugaaauagucgacuuaaugugccaugcaacuuucacaaugagauugcucucgccaguuagaguuccaaauuauaauuuaauaaucauggaugaagcccacuucacagacccugcaaguauagcagcaagaggauauauaaguacaagaguugagaugggugaagccgcaggaauauuuaugacagccacaccaccaggaaguagggauccauuuccucaaaguaacgcaccaauaauggacgaagaacgagagauaccagagaggagcuggaacagcggacaugaauggguuaccgauuuuaaaggcaagacaguuugguuugucccaucaauaaaagcaggcaaugauauagcagcuugccuacguaaaaaugguaaaaagguaauucaauuaagccgaaaaacauuugauagcgaauauguaaaaacaagggcuaaugauugggauuucguaguuacuacugauauuucugaaaugggagcaaacuuuaaggcugagcguguaaucgacccaaggcguugcaugaaaccaguaauacucacugacggcgaagagagaguuauucuugcugggccaaugcccguuacacacucuucugcggcacaacggagagggaggauaggcagaaauccuaaaaaugaaaaugaccaauacauuuacaugggggaaccauuagaaaaugaugaagauugugcucauuggaaagaagcuaaaaugcuuuuagacaacauaaacacacccgaaggaauuauuccaaguauguuugaaccagaaagagaaaaaguugacgcaaucgauggagaauaccgacuaagaggggaagcaagaaagacguuuguggaucuuaugagaagaggggaucuccccgugugguuagcguauaaaguagcugcggaagguauuaauuaugcagauagaaaauggugcuucgacgguaucaaaaauaaccaaauuuuagaagaaaauguggaaguggaaauauggacuaaggaaggugaaagaaagaaauuaaaacccagauggcuggaugcucguauuuauucugauccucuagccuugaaagaauuuaaagaguucgcugcggguagaaaaagucuaacgcuaaacuuaaucacugaaauggggagacuaccaacuuuuaugacgcaaaaagccagaaacgcacuugacaaucuugccguacuucacaccgcggaaguaggcggaaaagcauauacacaugcguuaucagaacuaccugaaacccuagaaacguuacuccuucuaacauuacuugccgcaguuacaggcggaauuuucuuauucuuaaugucaggcaaagggauaggaaaaaugacauuagggaugugcuguauaauaaccgcaaguauauugcuaugguacgcucaaauucaaccgcacuggauagcugcgagcauaauuuuggaguucuucuugauuguauuacuaauuccugaaccugaaaaacagcgaacaccccaagauaaccagcugaccuauguggugaucgcgauccuaacagucguugcagcgacaauggcgaacgaaaugggauucuuagagaaaacuaagaaagacuuagguuucgggucaauaacuacccaggaaucagaguccaauauccuagauauugauuugcgacccgcuagugcauggacauuauacgcggucgccaccacuuucguaacuccaauguuacgucacagcauagaaaacaguucaguuaaugugaguuuaaccgccauagcgaaccaagcaacaguccuuauggggcugggaaaaggguggccacuaucaaaaauggacauaggggugccucuacuagcaauaggauguuauucccaggugaauccaauuacuuuaacagcugcacuuuuacuucuaguagcacacuaugccauaauaggcccaggcuuacaagcuaaggcgacucgggaagcgcaaaagcgagcagccgccgguauaaugaaaaacccgacgguagacggaauaacuguuauagauuuggaaccgaucccuuacgacccgaaauucgaaaagcaauuaggccaaguaaugcucuugauccugugcguaacccaagucuuaaugaugaggacgacuugggcauuaugcgaagcguugacucuugcaacagguccuauaaguacguuaugggaaggcaacccggggagauucuggaacacaaccauagccgucucuauggcuaauaucuucagggguucuuacuuagccggugcgggccuucucuuuaguauaaugaagaacacaaccaacacucggagaggcacagguaauguaggggaaacguugggagaaaaauggaaaaguagacugaacgcgcucgguaaguccgaguuccaaaucuauaagaaaucagguauccaggagguugaucguacucuagccaaagaagggauaaaaaggggagaaaccgaucaccacgcaguaaguagggggagugcuaaauuaaggugguuuguagaaagaaacauggugacuccagaagguaagguuguagauuugggaugugggcggggaggguggucauauuacuguggcggccugaaaaauguacgagaaguuaagggacucacaaagggaggaccaggacaugaagaaccuaucccaaugagcacuuauggauggaaucucguaaggcuccaaagugguguugauguauucuuuacaccaccugaaaaaugugauacuuuauuaugcgauaucggagaaucuucgccgaacccuacgaucgaagccgguagaaccuuaagaguauugaaccucguugaaaauugguuaaauaacaacacacaauucugcauaaaggugcuuaacccauacaugcccaguguuauagagaaaauggaaaccuuacaacguaaauauggaggcgcauugguuagaaacccuuuaucaaggaacaguacgcaugagauguauuggguuagcaacgcaacugguaauauaguaagcagcgugaauaugauuagcaggauguuaauuaaucguuucacaaugaaacacaagaaagccacauaugaaccagauguagaucuagggagugguacaagaaacauaggaauagagagcgaaauuccuaaccuugacauaguugguaaacgaauagagaaaauaaaacaagaacacgaaacaaguuggcacuaugaccaagaccauccauacaagaccugggcguaucauggcucauacgaaacaaaacagaccgguagugcuucgucaauggugaacggggucguacgacuuuuaacgaaaccaugggaugucguccccaugguuacucaaauggccaugacggacacgacacccuucggucaacaacguguauucaaagaaaaaguagauacaagaacacaggaaccgaaagaaggaacuaagaaacuaaugaaaauaacagccgaaugguuauggaaagaauuaggaaaagaaaagacaccgagaauguguacaagagaagaauuuacacgcaaaguaaggagcaacgcagcguuaggugcugucuuuaccgaugaaaacaaguggaaguccgcgagagaggcuguagaagacggacgauuuugggaauugguagacagggagcguaauuuacaucucgaaggaaagugcgaaacgugugucuauaauaugauggguaaaagagaaaagaagcucggagaguuugggaaagcuaaaggaagcagggcgauaugguauauguggcuaggugcaagguucuuagaauuugaggcuuuaggguuucuaaaugaagaccauugguucucccgcgguaauucacugagugguguagagggugaagggcugcaccgucuuggguauauauuacgagaagugggaaagaaggaagguggggcaauguaugcagacgauacggccgguugggacacacgcaucacauuagaagaucuaaagaacgaagaaauggucacaaaucacaugaaaggagaacacaaaaaguuagcagaagcaauauuuaaacuaacuuaccaaaacaagguugugcgcguccagaggccgacgccaaggggcacugugauggacauaauuucaagaaaagaccaacgaggaagcggccaggugggcacauacggccugaauacauucaccaauauggaagcccaacuuauacgucaaauggaaggagagggaauauucaaaaguauucaacacuugacagcaacugaggaaauugcaguccaaaacugguuagcacguguggggagggagagacucucaaggauggcuauuaguggcgaugacuguguuguuaaaccaauugacgacagauuugcgucagccuuaacagcguuaaaugacaugggaaaaguaagaaaggacauccagcagugggaaccaucacgcgguuggaaugacuggacgcaaguaccguuuugcagccaccauuuccacgaauuagucaugaaagauggacggguucugguuguaccaugcagaaaucaagacgaacuuauaggacgagcucgcauaucgcaaggugcaggauggagucucaaagaaaccgcgugccucggaaaaucauacgcucagauguggacauugauguauuuucauagaagggacuuaagauuagccgcuaacgcaauaugcagcgcugucccaucucacugggugccuacaaguagaacaaccuggaguauacacgcuaagcaugaguggaugacgacggaagauaugcuuguuguauggaaccgcguauggauacaagaaaauccuuggauggaggauaaaaccccagucgaaagcugggaagagguuccguaccuggguaaacgggaagaucaauggugcggaucacuaauuggacuaacaucaagagcaacaugggccaaaaauauccagacagccauaaaucagguccggucccugauuggaaaugagggguauaccgauuauaugcccaguaugaaaagauuucgaagagaagaagaggaagccggcguauuaugguga

SEQ ID NO: 22485 - RNA, 9876 nt, Artificial Sequence
  derived and/or modified CDS sequence (opt6) from DENV-2__FJ906959__SS-prME
acagcgggaaugauuauaauguuaauaccuacaguaauggcauuucaccugacgacaaggaacggcgaaccacacaugauaguaucacgccaagaaaaagguaaaucccuauuauucaaaacagaagauggaguaaauaugugcacauuaauggcaauggaccuaggagaacugugcgaagauacuauuaccuauaaauguccuuuccucaaacaaaaugaaccagaagauauagacuguugguguaauucaacaaguacguggguaacauaugguacuuguacaacuaccggagaacauaggagagagaaaagaucuguugcucugguuccccauguaggaaugggauuggaaacucguacugaaacuuggauguccagugaaggagcuuggaaacacgcacaacgcauagaaacauggauauuaagacacccuggauuuacaauaauggcggcaauacuagcauacacgauaggaacuacacacuuucaacgugcacuaauuuuuauauuauuaacagcgguagcacccuccaugacaaugcgaugcauuggaauaucaaaccgagauuuuguggaagguguaucagguggaucauggguagacauaguuuuggaacacgguucuuguguuacuacuauggcuaaaaauaaacccacuuuggauuuugaacuuauuaaaacagaagccaaacaaccugcaacucuacgaaaauauuguauagaagcuaaacugacaaauacaaccacagacaguagaugcccaacacaaggcgaaccaucucuaaaugaagaacaagacaaaagauucgucugcaaacauucaaugguagaccggggauggggaaauggcuguggccuguuugggaaaggugguauuguaacaugcgcuauguucacaugcaaaaagaauaugaaggggaaaguaguacaaccagaaaaucuugaauauacaauaguaauaacaccccauucgggugaagaacaugcgguggguaaugauacaggcaaacauggaaaagaaauaaaaaucacaccucaaucgucgauuacggaagcagaacuaacgggguaugggacugucacaauggaauguucuccgcguacaggucucgacuucaaugaaaugguucuccuucaaauggaaaauaaggcuuggcuagugcacaggcaaugguuucuggauuuaccuuuaccaugguuaccaggugcagacacucagggaagcaauuggauacaaaaagaaacccuggucacguuuaaaaauccacaugccaagaaacaggacguagugguauuagguucucaagaaggagccaugcacacggcucuaacaggugcuacagaaauacagaugagcucuggaaaucuuuuauuuacgggccauuuaaaauguagacugagaauggacaaacuccaacuaaaagguaugagcuacaguaugugcacuggaaaauucaaagucgucaaagaaaucgcugaaacccaacacggcacaaucguaauacggguacaauacgaaggcgauggaagccccuguaaaauaccauucgaaaucauggacuuagagaaaagacacguccuaggaagauuaauaaccguuaauccgauagugacagaaaaagacucuccaguuaauauugaagcagaaccaccuuuuggagauucuuauauaauuauaggaguagaaccgggacaauuaaaacuaaauugguuuaagaaaggaaguucaauagggcagaugaucgaaaccaccaugcggggagcaaaacguauggcaaucuuaggggacaccgcaugggauuucggaucucuaggagggguauucaccucaaucgggaaagcacuacaccaagucuucggagcaauauauggugcagccuuuaguggagucaguuggauuaugaaaauccugauuggaguuaucauaacuuggauugggaugaacucaagaaguacauccuuaucuguuagucuuguucuggucggaguaguuacacuguaucucgguguuaugguucaagcggacucuggaugcguuguuaguuggaaaaacaaagaacuaaaaugugguucuggcauuuuuauaacagacaacguacacacuuggaccgaacaauacaaauuucagccagaaaguccgucgaaauuggcgagcgcuauacaaaaggcucaugaagaaggaauaugcggcauuagaaguguaacucguuuagaaaaccuaauguggaaacaaauaacacccgaauuaaaucauauuuuaagugaaaacgaaguaaaacuuacgauuaugaccggagacauaaaaggaauuaugcaagcgggaaagcgcaguuuacaaccacagccgacugaacucaaauauucguggaaaacauggggaaaggccaaaaugcuaucaacagaaucucauaaccagacuuucuuaauagaugguccugaaacggcagaauguccaaauacgaauagagcuuggaacagucuagaagucgaagacuacggguucgguguauuuacuacgaacaucugguuaaaauuaagagaaaaacaagacgucuuuugcgacucaaagcucaugagcgccgcgaucaaggacaaccgggcuguacacgcugacaugggauauuggaucgaaucagcucugaaugauacauggaagauugaaaaggcuucauucauugaagucaaaucaugccauuggccgaaaagccacacacuauggagcaaugguguguuagaaagugaaaugaucauuccuaagaauuucgcagguccuguuucacaacacaacuaucgaccagguuaucacacucagacugcugggccauggcacuuaggcaaauuggaaauggauuuugacuucugugaaggaacuacgguugugguaacggaagacugcggaaacagaggccccuccuuacguaccacaacagccaguggcaaauugauaacagaauggugcugucgauccugcacucugccaccauugagauauagaggugaggacggguguugguaugggauggaaaucagaccauuaaaggaaaaagaagaaaaucucgucaauucgcucguuacugcgggacauggucaaauagacaacuuuagccuaggcguucugggcauggcuuuguuucuagaagagauguugagaacacgaguggggacaaaacacgcgauacuguugguagcaguuucauucguaacauugaucacaggcaacaugucauuuagagaccuuggucgcgucaugguuaugguaggagcaaccaugacagaugauauuggcaugggcguaacauaucuagcgcuauuagccgcauucaaagucagaccaacauucgcugccgggcuacuacuuagaaaacuaaccucuaaagaacuuaugaugacaacuaucggcauaguacuacuuucacaaucgaccauacccgaaacaauacuagagcuuacugaugcccuugcucuagguaugauggucuuaaaaauggugcgcaaaauggaaaaguaucaacucgcaguuacuauaauggcaauauuauguguacccaaugcagugauacuucaaaaugcguggaaaguuucauguacgauauuagcaguagugagcguaucuccuuuauuuuuaacaaguucgcaacaaaaagcggauuggauuccacuggcauugacgaucaagggcuuaaacccgacugcgauauucuuaacaacuuuaucaagaacaaauaaaaagagaucauggccccuaaaugaagcaauaauggcuguuggcaugguaaguauucuagcaucgucacuauuaaagaaugauauaccaaugacagguccccuaguugccggugggcuucugacuguuuguuauguuuuaacaggacgaucagcagaucuagaacuugagagggcagcagauguuaaaugggaagaucaagcagaaauuucgggaucaagucccauuuuaucuauuacuauauccgaagacggcagcaugagcaucaaaaaugaggaggaagaacagacguuaacgauccuuauaaggacaggucuucuggucaucagcggacuauucccugugucuauaccuauaaccgcagcagcuugguaccugugggaggucaagaaacaacgagcggguguauuaugggauguaccaaguccgccaccaguaggaaaagccgagcucgaagauggggcguaccguauaaaacaaaaaggaauuuuagguuauucacagauaggggcuggaguuuauaaagaaggaaccuuccauacgauguggcacgucacaagaggagcgguucuuaugcacaaggggaaaagaaucgagccaucgugggcggaugugaagaaagauuugauaaguuacggugggggcuggaaauuggagggugaauggaaggaaggugaagaaguucaaguguuagcauuggaaccugguaaaaaccccagagcaguacaaacaaaaccagggcuguuuaaaaccaacgcggguaccaucggagcugugaguuuagacuucucgcccggcacuucggguagucccauuauugauaagaaaggaaaaguaguagguuuauauggaaacggagugguuacgagaagcggggccuaugugucugcaauugcgcagaccgagaaaaguauagaagauaacccugaaauugaggacgacauauuucgaaaaaggaaacugaccauaauggaucuucauccaggagcaggaaagacaaaaagauauuuacccgcaauaguaagggaagcaaucaaacgaggacugcggacucucauccucgcgccaacgagaguuguggcagcagaaauggaagaagcguugagaggacuucccauaagauaucaaacuccugcuauacgagcagaacauacuggucgugaaaucguagauuugaugugucaugccacauuuacaaugagacuucuaucuccaguacggguuccaaacuacaaucuuaucauuauggaugaagcacacuuuacagacccggccaguauagccgcuagagguuacauaaguacuagaguagagaugggagaggccgcaggaauauuuaugacagcuaccccgcccgguagccgagacccauucccucagucgaaugccccuauaauggaugaggagagagaaauuccugaaaggaguuggucaaguggucacgaauggguaacagacuuuaaaggcaaaacuguaugguucguaccaucaauuaaagcggggaaugacauugcagcuugucugaggaaaaacgguaagaaaguuauacaacugagccgaaaaacauuugacucagaauauguaaagacaagaacuaacgacugggacuucguaguuacaacugacauaagugaaaugggagcgaacuucaaagcagaacgcguaaucgacccacgaagaugcaugaagccaguaauucuaacagauggggaggaaagaguuauuuuagccgggccgaugccugugacccauucuagcgcugcucaaagaagagguagaaucggcagaaaucccaaaaaugagaaugaucaauauaucuauaugggcgaaccucuagaaaacgacgaggauugugcccacuggaaagaagcaaagaugcuucucgacaacaucaacacgccagaaggaaucauaccgucuauguucgagccggaaagagaaaaaguagaugcaauugauggagaauacagacugagaggggaagcaagaaagacguuuguugaucuaaugagacggggagaccuacccguuugguuagcauaucgaguggcggcagagggaauaaacuaugcugacaggagauggugcuucgauggaaucaaaaauaaucaaauacuggaagaaaauguagaaguagaaauauggacuaaggaaggugagcguaagaaauuaaaaccgagaugguuagaugcucguauuuauucggacccauuggcauugaaagaguucaaggaguucgcagcagggaggaaaucauuaacucuuaauuuaauuacugagaugggaagauuaccaacauuuaugacccaaaaagcaagggaugcacuggacaaucuugcaguauugcauaccgcggaagccgggggccgcgcauacaaucaugcuuugagcgaacuucccgaaacccuugaaacauuguuguuacuuacacuacuugcgacggucaccgguggaaucuuccuuuuccuaaugaguggaagggguauugguaaaaugacacuuggaaugugcuguauaauaaccgcaaguauucuauuaugguacgcacagauacagccacacuggauagcugcaaguauaauauuagaguucuucuuaaucguguuacucauaccugagccagaaaaacaacguaccccgcaggacaaucaauuaacuuaugugguaauagcgauccuaacgguuguagcagcaaccauggcaaaugaaaugggauucuuagaaaagaccaagaaagaucuaggacuagguucaauuacaacacaacagccggaaucaaauauuuuagacauugaccugagaccagcaucagcauggacccuauacgcggucgccacuacuuuuguaaccccaaugcuuaggcauucaaucgagaacuccaguguuaaugugucucuuacagcuaucgcaaaccaagcuacgguacuaaugggacuaggaaagggauggccccucagcaaaauggauaucgggguaccauugcuagcaauagguugcuacagucaaguaaacccaauaacccuaacugccgcucucuucuuacugguagcucacuaugcuaucaucgggccgggacuucaagcuaaagccacgcgugaagcucagaaaagagccgcugcggggauaaugaagaauccuacaguagaugguaucacgguaauugaucuagacccaaucccauaugacccaaaauucgaaaagcagcucggucaaguuaugcucuuaguacuuugcguaacgcaaguacugaugaugcgaacuacaugggcguuaugcgaggcuuuaacccuagcaaccggcccgauaaguacauuaugggaaggaaacccggguagauuuuggaauacaacaauagcaguaagcauggcuaauaucuucagagguucuuacuuagcgggagcugggcuacucuucucaauuaugaaaaauaccacuaauacacggcggggaaccggaaauauuggagagacgcucggcgagaaauggaagucacgccucaaugcccuaggcaaaagcgaguuccaaauauauaagaaaucgggaauccaagaggucgauagaacuuuggcuaaggagggcauaaaaagaggagagacggaccaucaugccguaucuagagguucugcaaaacuacggugguucguagaaagaaauaugguaacgccugaagguaagguaguagauuuaggaugugggagggguggauggucauauuacuguggcgggcucaaaaaugugcgagaaguaaaaggucuaaccaaaggagggccgggacaugaggaaccaauucccaugagcacauauggguggaacuuagugcgacuucaaucagguguugaugucuucuuuaccccuccggaaaagugcgauacacucuuaugcgauaucggugaaucgaguccaaauccuaccguugaagccggcagaacguuacgcguccuuaacuuaguagaaaacugguugaauaacaacacucaauuuugcaucaaaguacuuaaccccuauaugccaucaguuauagagaaaauggaggcccuacagagaaaauauggaggugcauugguacguaauccucuaucacgcaauuccacucaugaaauguacugggugucaaaugcaagugguaacaucgucucaucaguaaacaugauaagcagaaugcuaauuaaccgcuucacgaugcgucacaagaaagcaacguacgaacccgaugucgaucugggaaguggaacacgaaauauaggaauagaaagcgaaauuccaaaucucgauauuauuggcaaaaggauugagaaaauaaaacaagagcaugaaacaucauggcacuaugaccaagaccauccauauaaaacaugggcauaucaugggucauacgagacaaaacaaaccgggagugcaagcaguaugguaaauggaguaguaagacuacuuacaaagccuugggacguagucccaaugguaacacagauggccaugacagacacaacuccuuucggacagcaaagaguauucaaagagaaaguggauaccagaacucaagaacccaaagaaggcaccaagaaacuaaugaaaauaacagcggagugguuauggaaagagcucgggaagaagaaaacaccaaggauguguacuagagaagaauuuacgcgaaaaguaagaucaaacgcugcauuaggagcuauuuuuacagacgaaaacaaauggaaaagugcuagggaagccguggaagauucaagguuuugggaguuaguagacaaagaaagaaaccuccaccuugaagguaagugcgagacauguguauacaauaugaugggaaaaagagagaagaaacuuggggaguucgggaaagcgaaggggaguagagcaauaugguauaugugguuaggagcccguuuccuagaguucgaagcacugggauuccugaaugaggaccacugguuuucacgagaaaauucccuaaguggcguugaaggggagggacuacauaaacugggcuacauuuuacgagacguuuccaagaaagaaggaggagcuauguaugcugacgauacugcuggaugggacacaaggauaacacuagaagaucugaaaaacgaggaaaugguaacuaaccacauggaaggcgaacauaagaaacuagccgaagcuauauuuaaacuuacguaccaaaauaaaguuguuagaguucaaagaccaacaccuaggggaacugucauggauauaauaagcagaagagaccagcgcgguagcggccaggucggaacguauggcuuaaacacuuuuacaaacauggaagcacagcuaauacgacaaauggagggcgagggaguauuuaaaucgauucagcauuugacuguaacugaggaaauagcaguacagaacuggcuugcuagggucggacgagagcgacuaucaagaauggcuauaagcggugaugauuguguuguuaaaccauuagacgauagguucgcuagugcacuaacggcccuuaaugauauggguaaaguacgaaaagauauacagcaaugggaacccagcagagguuggaacgauuggacacaaguaccuuuuugcucacaucacuuccaugaauuaauuaugaaagauggcagaguacuuguaguuccguguagaaaucaagaugaauugauuggccgugcacgaauaagucaaggugccgguuggucacugagagaaacagccugcuuagggaagaguuaugcccagauguggagucucauguacuuucauagaagggacuuaaggcuggcggcaaaugccauaugcagcgcuguccccagccacuggguaccaacuucccguacaacgugguccauacaugcaaaacacgaauggaugaccacagaagauaugcuaacuguauggaauagaguauggauacaggaaaauccuuggauggaagauaagacucccgucgaaagcugggaagaaauuccauaucuaggcaaaagagaagaucaauggugugguagucuaauaggacucacaucaagagcuacaugggcuaaaaauauccaaacagcuauuaaucaaguacgaagucuaauaggaaaugaagaauauacugauuacaugccaucuaugaaaagauuucgucgggaggaagaggaagcuggaguuuuaugguag

SEQ ID NO: 22486 - RNA, 9876 nt, Artificial Sequence
  derived and/or modified CDS sequence (opt6) from DENV-2__KF360005__SS-prME
acugcaggggugauuaucaugcgcaucccuacugcaauggcauuucaccuuacuacacgcaauggggaaccucauaugaucguuucaaaacaagaaaaagguaaaucuuuauuauucaaaacagaagauggcguuaauauguguacacuaauggcgauggaccuaggagaauuaugugaagauacgauaacauauaauugcccacuauugcggcaaaacgaaccugaagacauugauuguugguguaauagcacaaguacuuggguuacauauggcacuugcacugcgacaggagaacaucgacgugagaaaagaucuguugcgcuaguuccucauguagggauggguuuagaaacaagaacagaaaccuggaugucaucagagggcgcauggaaacaugcucaaaggauugaaacguggauccuucgacauccggguuucacaauaauggcagcuauucuagcuuauaccauaggaacuacauauuuccaacgaguacucauauuuaucuuauuaaccgcaguugcaccaucuaugacaaugcggugcaucgguauaucuaacagggauuucguagaaggcguaucugguggaucuuggguagauauuguguuagagcacgggaguugugugacaacaauggcuaaaaacaaaccgacacuagauuuugaguuaaucaaaacugaagcgaaacaaccagcuacauuaagaaaauacuguauagaagcaaaauuaaccaauacaacgacugccagucguugcccaacccagggggagccgaguuugaaugaggagcaagauaaaagguuuguuugcaaacacuccaugguagguagaggcuggggagaugguuguggacucuuuggaaaaggggguauuguuacuugcgcuauguucacuugcaagaaaaauauggagggaaaaauaguacaacccgaaaauuuagaguacacuauagugguaacaccccauucuggugaggaaaacgcaguaggaaaugacacagguaaacacggaaaagaaaucaaaguaacgccccaaaguuccauaacagaggcggaguuaacaggcuaugguacaguaaccauggaauguagcccgaggacaggacuggauuuuaaugaaaugguauugcugcaaauggaaaacaaagcauggcuuguccacagacaaugguuccuagaucuaccacuaccuugguuaccaggcgccgauauacagggaagcaauuggauacaaaaagagacccugguaacauuuaaaaacccucacgccaagaaacaggacguaguaguacuugguucccaggaaggagcguuacacacugcacugacaggugcaacggagauucaaaugucuagcgguaauuuacuauucacuggacaucuaaaguguagauugaggauggacaaacuucaguuaaaagguaugucauauucaaugugcacagggaaauucaaagucguaaaggaaauagcagaaacucaacaugggacgauaguuguuagaauacaauaugagggagacgguucgccauguaaaauaccuuuugaaauaauggauuuggaaaaacgccaugugcuugggagauuaauaaccguaaauccgauuguaacagaaaaagauucaccaguuaauauagaagcggaaccaccuuuuggcgacucguacauaauuauaggagucgagccaggccaacuuaaacuuuccugguucaagaaagggagcucuauugggcaaauguuugaaacuaccaugcggggugcaaagagaauggcgauacuaggggauacagcaugggauuucggaucauuaggaggagucuucacaaguaucggaaaagcguugcaccaaguguuuggugcaauuuauggagcugccuuuagcgggguaucuuggacaaugaagauacucauuggcgugguaaucacuuggaucggaaugaauagcagaucuacaagucucuccgugagcuuaguacucgugggaguugucacucuuuaucuugggguaaugguucaagcggacagugggugcguagugucuuggcguaauaaagaacugaaaugugguucuggaauauucauaacagacaauguucacacauggacagaacaauacaaauuccaaccagaaaguccaucaaaguuagcuagcgcaauacagaaagcacaugaagaaggaauaugcggaauuaggagcguaacacguuuagaaaaccuaauguggaaacaaauaacuccggagcuaaaucacauacugucagagaaugaaguuaaauugagcaucaugacgggugauauaaaaggaauuaugcaagcaggaaaaaggaguuuaaggccacagccaacugaacuaaaauacagcuggaaaacgugggguaaagcgaaaaugcucuccaccgaaccacauaaucagacauuucucaucgacgguccugaaacagccgaaugcccgaauacuaacagggccuggaacucuuuagaaguagaggauuacggcuuuggaguauucacuacaaauauaugguuaaaguuaaaagaaaggcaagauguauuuugugacagcaaacuaaugagcgcagcgaucaaagauaaccgagcgguacaugcagacauggguuacuggauagaaucagccuuaaaugauaccuggaaaauagaaaaggccagcuucauagaaguuaaaaguugucauuggccaaaaucucacacguuauggagcaacggcguacuagaguccgagaugauaauacccaaaaauuuugcaggacccguaucacaacauaauuauagaccaggauaccauacacagacugcggggccguggcaccuagguaaauuagagauggauuucgauuucugcgaaggaacaacaguagucguaacagaggauugcgguaaucgaggaccuagucuuagaacuacuacggcauccgguaaacucaucacugaaugguguugccgcucaugcacgcuaccaccguuaagguacagaggggaggaugguugcugguaugggauggaaauucggccauugaaagagaaagaagaaaacuuagucaacucucuuguuacagcaggacacggacagauugacaacuuuucacuaggagucuuggguauggcuuuauuuuuagaggagaugcuccgaacccgcguagggacaaaacacgcuguacugcucguugcugucucauucaugaccuugaucacaggcaacaugaguuuuagagaccuugggcguguaaugguuauggucggugcagcaaugacggacgauauugggaugggugucacuuaccucgcacugcuugcugcauucaaaguaagaccuaccuucgcagcaggucuacuuuuaagaaaacuuaccucaaaagaauuaaugaugacaacgauuggaauaguacucuuaagucagucaacuacaccagaaacaauauuagagcucacagacgcauuagcauuggguaugaugauccuaaagauuguacgaaauauggagaaauaucaacucgcaguuacaauuauggcaauuuuaugugugccuaaugcagucauauuacagaacgccuggaaaguaaguuguacgauucuagccgcuguaucaguuucaccauugcuccuaacaaguagccaacaaaaagcugacuggauaccuuuggcuuuaacgauuaaaggauuaaauccuacugcaaucuuccucaccacuuugagcagaacuaauaagaaaaggucuuggccgcugaaugaggcuauaauggcuguuggaauggucaguauauuagcaucuagccuacuaaagaaugauauaccuaugaccgguccucuaguagcuggcggacugcucacaguaugcuauguguuaaccggcagaucugcugaccuagagcuggaaagagcugcagacguccgaugggaagaucaagccgaggucucaggaucaucgccaauauuaagcauaacuaucucugaggacggaaguauguccaucaaaaacgaggaagaagaacagacuuuaacaauacuaauacguacaggacuauugguuauaucgggcuuguuuccaguaucaaucccaaucacugcugcggcuugguaucuaugggaaguuaagaaacaacgcgcgggggugcuaagugcagugccaucuccaccgcccguugggaaagccgaguuagaagauggagcuuauagaauuaaacaaaaaggcauucuaggauauagucaaauuggggccgguguuuacaaagaaggaacauuucauacaauguggcauguaacccgaggcgcgguacuuaugcacaaaggcaaacguauagagccuucgugggcagaugugcgcaaagaucucauaaguuauggagggggaagaaaguuagaaggugaguggaaagagggggaagaggugcaagugcuggcucuugaaccuggcaaaaauccgcgugcaguacaaacaaagccugguuuauuuaagacaaauacugggacaauaggcgcaguuagcuuggacuuuucaccaggggccucaggaaguccaauuguugacaagaaaggaaaaguagugggauuauacgguaaugguguagucaccagaagcgggacuuaugucagcgcgauagcccaaacggagaaaaguauugaagauaaucccgaaauugaagaugacauauuucgcaagaaaagauuaacaauuauggacuuacauccaggcgcaggaaaaacaaaaagguacuuaccggcgauagugagagaagcaaucaagagaggacugagaacucuaauauuggcuccgacaagaguaguagcagcugaaauggaagaggcucuaaggggacuaccaaucagauaucagacgccagcaaucagagccgaacacaccggaagagaaauuguagauuuaaugugccaugcuaccuucacgaugagacucuuaucgccagugaggguuccaaauuauaauuuaaucauaauggaugaagcucauuucacugauccagcgaguaucgccgcccgagguuacauaucaacacgcgucgagaugggagaagcugccggaauauuuaugacagcaacuccuccagggagccgagauccauuuccucaaucuaaugcuccgaucauggaugaagaaagagaaauuccagagagaucauggaacucaggacaugagugggugacugauuucaaggguaagacggugugguucguacccucgaucaaagccggaaaugauaucgcugcuuguuuaagaaagaaugguaagaaaguuauucagcuaucaagaaaaacguuugacucggaauauauuaaaacgaggacuaacgacugggauuucguagugacaacugacauaucagaaaugggagcuaauuuuaaagcagaacgaguuauugauccaagacggugcaugaagccuguaauacucacugacggagaagaacgugucauacuagccggccccaugccgguaacacacagcucggcugcacaaagaagaggccgaauuggaagaaaucccaagaaugaaaaugaucaguacaucuauaugggagaaccgcuagagaacgaugaagauugugcgcauuggaaagaagcuaaaaugcuauuagauaauauaaacacucccgagggaaucauaccuaguauguucgaaccugaaagggaaaagguggaugcaauagauggagaguauagauuacguggagaggcccggaagacguucguagaccuuaugcguagaggggaccuucccguguggcuagcuuaccggguugcggcugaaggaauaaauuaugcugaucggagauggugcuuugacggaauaaagaacaaccaaauauuggaagaaaauguagaaguugaaauauggacaaaagagggagaacguaagaaauugaaaccgagaugguuggaugcucggauauauuccgaucccuuggcauuaaaagaauuuaaagaguucgcggcaggucgaaagucacugacgcuaaaucuuauaacugaaaugggacgacuuccaacauucaugacucagaaggccaggaaugcauuagacaaucuugcgguguuacauacagcagaggcaggcggcagagcuuacaaucaugcucuauccgagcuccccgagacucuugagacccucuugcuucuuacccuauuagccacuguaacuggaggaauauuucuuuuucuuaugucuggaaaaggcauuggaaagaugacccugggaaugugcuguauaauuacagccuccauauuacuaugguacgcacaaauacaaccucauuggauagcagccaguauaauacucgaguuuuuccuuauaguccuucugauaccugaacccgagaaacaaaggacuccacaggauaaccaauuaacuuaugugguuauagcaauacuuacuguaguggcagcgacuauggcaaaugaaaugggcuuuuuagagaaaaccaagaaagauuucggguuagggaguauugcuacacaacaaccagaaucuaauauccuagauauagaucuucguccugcuucggcuuggacacuauacgccgucgcaacaaccuucauaacaccgaugcuacgucacagcauagaaaauucaucagucaacgucagucuaacagccauagcuaaccaagcgacaguauuaauggguuuagggaaggguuggccgcuaucaaagauggacauagggguaccauuacuagcaaucggaugcuacagucaaguuaaccccauaacuuuaacugcugcgcuauuguuacugguggcacauuacgccauaauugguccugguuuacaagcaaaggccacaagagaagcacagaaaagggcugccgcuggcauaaugaaaaacccuacugcugauggaauaaccguaauagauuuggauccuauccccuacgaucccaaauucgaaaagcaauuaggccaaguaauguuauuaguauuauguguaacacaagugcucaugaugcguaccaccugggcguuaugcgaagcucugacccuagcaaccgguccuauaucuacacucugggaagguaguccgggaagauuuuggaauacaacaaucgcuguaucuauggcuaauaucuuuagaggaucauauuuagcaggagccggacuauuguucucaauuaugaaaaauacaacaaacacaagacgaggaacgggcaacacaggagaaacauuaggugagaaauggaagaaucgacuuaauucguuaggcaaaagcgaguuccaaauuuacaaaagaucagggauacaagaaguggauagaacucucgcaaaagaggguauaaagagaggugagacagaucaucaugcaguaucaagaggcagugcgaaauugaggugguucguugagcgcaaccuuguuacgccggaagguaagguaguagauuuaggaugcggacguggagguuggagcuacuacuguggaggacuaaagaacgugcgggaagugagaggauuaacaaaaggaggaccuggacaugaagaaccuauuccuaugucgaccuauggauggaaucuagugagguuacagucgggaguagauguguucuucacgccaccagaaaaaugcgauacacuacuaugugacauuggcgagagcagcccuaacccuacaguagaagcuggucguacccugaggguauuaaaccuagucgagaacuggcugaacaacaacacccaauucuguauuaagguauugaauccauauaugccaagugugauagagaaaauggaaacuuuacaaagaaaauauggaggcgcuuuagucagaaauccuuugucuagaaauagcacacaugaaauguacugggucucaaaugcaucggggaauauagugaguagcgugaauaugauaucaagaauguugauaaauagauucacaaugcgccauaagaaagcaacauaugagccagauguagaccucgguucagguacacggaauauagggauagaaucagaaacgccgaaucuagauauuauuggcaagaggauugagaaaauaaaacaagaacaugagacgucauggcauuaugaccaggaucauccuuauaaaaccugggcauaucacggaucuuacgaaacgaaacaaaccggaucagccaguaguguuguaaacggagucguucgucuauugacaaagccaugggacguuauaccaauggugacccaaauggcuaugacggauacuacaccauuugggcaacaaagaguauuuaaagaaaaaguggauacucgaacucaagaaccaaaagaaggaacuaaaaagcuaaugaagauuacagcugaauggcucuggaaggaauuagggaagaagaaaacacccagaaugugcacuagggaagaauuugcgagaaaggugagaucgaaugccgcauuaggcgcuauauucacagacgaaaauaaauggaaaucugcccgagaagcuguagaggacucuagauuuugggagcuuguggauaaagagagaaaucuucacuuagaagggaaaugcgaaacuuguguauauaauaugauggggaagcgagagaagaaaauaggugaauuugggaaggcaaaaggaagcagagcaguaugguauauguggcuaggcgccagauuucuagaauuugaagcucuuggguucuuaaacgaagaccacugguuuuccagagaaaauagcuuaucuggaguagagggagaaggacuucauaaacuuggauauauccuaagggaaguaucaaagaaagaagggggagcaauguaugcggaugauacggcuggaugggacacuagaaucacuuuagaggaucuaaagaacgaggaaauggucacaaaccauauggaaggggaacacaagaaauuagcugaagcaauauuuaaacuaacuuaucaaaauaaagucguuagaguccagagaccaacaccgaggggaacuguaauggauauaaucagccgaagagaccaacggagcagcggacaggucggaacauacggauugaacacauucacuaauaugggggcacaauuaauucgucaaauggagggcgaaggaguauucaaaggaauccagcaucuuacugccacagaggaaguugccguacaggacugguuggcuagggucggacgagagcgacuaucucgaauggcgauaagcggugacgauuguguuguuaaaccgcuggaugacagauucgcaagcgcucuuacugcucuaaacgauaugggaaaaguacgaaaagacauacaacaaugggaaccaucuagaggauggaaugauuggacucaaguaccuuucuguucacaucauuuccaugaguuaauaaugaaagacggacggguguugguaguaccuugccguaaucaagaugaauugauagggagagcaagaauuagucaaggcgcagguuggagucugagggaaacugcaugucugggcaaaagcuacgcacagauguggucauuaauguauuuucaucgaagaggauuaagacuagcggcaaaugcaauaugcagugcuguaccaagucacuggguaccuacaucccgaacuacauggagcauccaugcacgacacgaguggaugacaacugaagacaugcuuacuguuuggaaucguguauggauccaagagaaucccuggauggaagauaaaacaccgguugagucgugggaggaaauacccuaccuuggaaaacgcggcgaucagugguguggaaguuuaaucgguuuaacaagucgagcuacaugggcucgaaauauacaaacagccauuaauagaguuagaagucuuauagggucugaaggauauaccgacuacaugcccucgaugaaaagguucaggcgagaagaggaugaagcaggaguauugugguga

SEQ ID NO: 22487 - RNA, 9876 nt, Artificial Sequence
  derived and/or modified CDS sequence (opt6) from DENV-2__KJ010185__SS-prME
acggcugguguuauaauuaugcuuauucccacagcaauggcguuucaucuaacuacucggaacggugaaccucauaugauagugucuaaacaagaaaaagguaaaagucuacuuuuuaaaacagaagacggggugaauaugugcacauugauggcaauggaucuaggcgaauugugugaagacacuauaacauacaacuguccacugcuacgacaaaaugaaccggaggauauugauuguuggugcaaugcaacaucaacaugggucacguauggcacguguacagcaacaggcgaacauaggagagaaaaacguucaguugcucuagugccucacgucgggaugggcuuagaaacuaggacagagacguggaugucaucagaaggggcuuggaaacacgcucaacgaauugaaacguggauauuacgacauccuggauuuacaauaauggcugcuauucuagcuuacacaauaggcacaacauacuuucagagagucuuaauuuuuauucuauuaacggcaguugcgccgucaaugacaaugcguuguauaggaauaagcaauagagauuucguggaagguguaagcggagggaguuggguagacauaguacuagaacaugguagcugugucacaacuauggccaaaaauaaaccaacacuagauuuugaacuaauaaaaacagaggcgaaacagccggcuacucuacgaaaauauuguauugaagcaaaacucacuaauacuacuacagccaguagguguccaacccaaggugaaccauccuugaaugaagaacaagacaaaagauuugugugcaaacauaguaugguugauaggggaugggguaauggaugcggauuauucgguaaaggaggcaucgugaccugcgcaauguuuacuuguaagaaaaacauggaggguaaaauaguccaaccagagaauuuggaguacacaaucguuguaacaccucacucaggggaagagaaugcaguuggaaacgauaccggcaaacacgguaaagaaauaaaaguaacuccacaaucaucgauaacugaggcagaauugacaggguauggaacaguuaccauggaaugcucacccagaacagguuuagacuuuaacgaaaugguucuacuccaaauggagaauaaagcauggcuggugcaccgucaaugguuccuggaucuaccauugccauggcugccuggggcagauauucaaggcucaaacuggauacaaaaagaaaccuuaguaacguucaaaaauccucaugcuaagaaacaggaugucgucguacugggcagucaagagggggcgaugcacacagcguuaaccggagccaccgaaauacagaugagcagcggaaacccacuauuuacgggacauuugaagugcagguugaggauggauaaacuacaacuuaaggggaugucauauaguaugugcacgggaaaguuuaaagugguaaaggagauagccgaaacucaacacgggacaauuguuguucguauccaauaugagggggauggauccccauguaagauuccauuugaaauaauggauuuagagaagaggcacguuuuaggucgucuuaucacaguaaauccuaucguaacugagaaagauucuccaguaaauauugaagcagaaccuccguucggagacucuuauauuaucauagggguggaaccuggacaacuuaaauuaaguugguuuaagaaagggucuucuauaggucagauguuugaaacuaccaugcgaggugcgaaaagaauggcuauauuaggggacacugccugggacuucggaucacuuggaggcguuuucacaagcauaggaaaagcucuacaucaaguauuuggugcgauauauggugcagcauucucaggcguaucguggacaaugaaaauauuaauaggugucguuauaacauggauaggaaugaauaguagaucuacuucguugagugugaguuugguacuuguuggagucguuacacuuuaucuuggggucauggugcaagcggauucaggcugcguaguuagcuggaaaaacaaagaauuaaaauguggaagcggcauuuucuuuacagauaacguacauacuuggacagaacaguauaaguuucaaccugaaucccccagcaaacucgcaagugcaauacagaaggcucaugaagaaggaauuugcgguauacgaaguauaaccagauuagauaauuuaauguggaagcaaauaaccccagagcuaaaccauauauugagugaaaaugagguuaaauuaaguaucaugacgggagauauaaagggaauaaugcaagccggaaagcguucauuaagaccucaaccuacugagcuaaaauauucuuggaaaaccugggguaaagcuaaaauguugucuacagagccacacaaucagaccuuucugauagacggucccgaaacggcgcaaugcccaaauacaaacagagccuggaacucuuuggaaguugaagacuauggguuugggguguuuacaaccaauaucugguugaaacuaaaggaaagacaagacguauucugcgacucaaaauugaugucugcagcuauaaaagauaauagagcgguucaugcagauaugggauacuggauagaaucggcgcuuaaugauacguggaaaaucgaaaaagcguccuuuauagaaguaaaaagcugucauuggccgaaaagucacacacuuuggucuaauggaguacuagaauccgaaaugauaauucccaagaauuucgcagggccugugucacaacacaauuacagaccaggauaucacacccaaacagcaggacccuggcacuuaggaaaguuagaaauggauuuugacuucugcgaaggaacuaccguaguagucacugaggauugugguaauaggggacccaguuugcguacuacgacagcaucaggaaaacuaauuacggaauggugcugcagaucauguacucuaccaccacugcguuauagaggggaagacggcugcugguauggcauggaaauacggccauugaaagaaaaagaagagaaucucgucaacucuuuggugacugcaggccauggccaaauagauaauuucaguuuaggagugcuaggaauggcguuguuuuuggaagaaaugcuuagaacgagggucggaacgaaacacgccguccuccuaguugcaguaucguucaugacacuaauaacaggaaauaugucauuuagggauuuagguagaguuaugguuauggucggcgcugcgaugacagaugacauugguaugggaguuacauauuuagcacuucucgcagcauuuaaagugcgacccacguuugcagcggggcuacuacuaaggaaauuaaccaguaaagagcuaaugaugaccacuauagguaucguucuauugucgcaaagcacaacaccugaaacuauucuggagcuuacggacgcccuggcauuaggaaugaugaucuuaaaaauaguaagaaacauggaaaaguaccaguuagcgguaacuauuauggccauucuaugugucccgaacgcgguuauacuacaaaaugccuggaaaguaagcuguacuauacuugcggcuguaucaguaagcccguuacuauuaacgaguucacaacaaaaggcugauuggauaccgcuagcacucacuauuaaaggucuuaaucccacagcaaucuuuuugacaacauugucucgaacgaauaagaagcgaagcuggccacuaaacgaagcuauuauggcgguuggcaugguaaguauacuagccuccagucuccugaaaaacgacauucccaugacuggaccucuagucgccggagggcuacuaacaguaugcuacgugcuaacaggcaggucagcggauuuggaauuggagagagcagcugacgucaggugggaggaucaggcugaaaucaguggaucuucaccaauauuaagcauuacaauuucggaagacggaagcaugucaauuaaaaaugaagaggaagaacagacacuaaccauacucauuagaacgggccuuuuagucauaagcggguuguuucccguaucaauuccaauaacagcagcagcuugguauuuaugggaaguaaagaaacaacgugcugggguauuaugggauguaccaaguccgccgccuguagguaaggcugaauuagaggacggggcauaucgaauaaaacagaagggaauacuaggguauucacaaauaggggccggugucuauaaagaagguacauuucauacgauguggcacguuacaagaggggcgguguuaaugcacaaaggaaaacguauagaaccuucaugggcggacguuagaaaggaucucauuaguuauggugguggauggaaguuagagggagaguggaaagaaggagaagaaguacaaguauuggcgcuagaacccgguaaaaauccccgggcugugcaaacaaaacccggauuauuuaaaacgaacaccggaacgaucggggcagugucccuugauuuuagucccggaacuucuggaucaccaauaguggacaaaaaggguaagguuguaggccuauaugggaauggaguaguaacaagaaguggaacuuacgugagugcaauugcucaaacugaaaagagcauugaagacaacccagagauagaagaugacauauuucgaaagaagcgauuaacuaucauggaccuccaucccggggcaggaaaaaccaaacgauaccugccugcgaucgucagagaagcgauaaagcgaggucugagaacacuaauacuugcacccacacggguaguugcugcugaaauggaagaggcccugagaggcuugccaauacgauaucagacaccagcaauaagggccgagcauacagguagggaaaucguagaccuaaugugucaugccacuuuuaccaugcgacugcucagucccguacgagucccaaacuacaaccuuaucauaauggacgaagcccacuuuaccgauccagcauccaucgcagcacguggauauauuagcaccagaguagaaaugggggaggcugcugggauauucaugacagcaacuccaccagguucacgcgaucccuuuccacaaucgaaugcaccaaucauggacgaagaacgggagauucccgagagaaguuggaacucuggucaugaaugggugacugauuuuaagggaaaaacaguaugguuuguaccauccauuaaagccgggaacgauauagcugccuguuuaaggaaaaauggcaagaaaguuauucaauuaucaagaaagacauuugauagugaauauauaaaaacaagaaccaaugauugggacuuugugguaacaacggauauuucagaaaugggugcgaauuuuaaagcagaaagaguaauagacccacgacgaugcaugaagccaguaauuuuaaccgauggagaagaacguguaauacuagcuggaccgaugccuguaacucacagcuccgcagcgcaacggagaggacguauaggacgaaaucccaaaaacgaaaaugaucaauauauauauaugggagaaccacucgaaaaugaugaagacugcgcacauuggaaagaagcaaagauguuacuagacaauauaaacacuccagaagggauaauuccuaguauguucgaaccugagagagaaaaaguagacgcgaucgauggugaauaucggcuacgaggagaagcuagaaaaacguucguggaucuaaugagaagaggggaucuaccgguguggcuagccuacaggguagcggcagaaggcauaaauuaugccgauaggcgaugguguuuugaugguauuaagaauaaucaaauauuagaagaaaacgucgaaguagaaauuuggacaaaagaaggagaaaggaagaaauugaaaccccguugguuagacgcgaggauuuauucagacccccuugccuuaaaggaauuuaaagaguucgcggcgggaagaaaaagucugaccuuaaaucucauaaccgaaauggggaggcuuccaacuuucaugacacagaaagcaaggaaugcucucgauaaucuagcaguacuccauacggccgaggcgggcgggagagccuauaaucacgcgcuaucggaguugccugaaacccuagaaacuuuauuacuccuaacacuauuggcuacagucaccggagggauauuucuuuuucuaaugucuggaaaagguauaggaaagaugaccuuaggaauguguuguauuauuaccgcuucaauacuauuaugguaugcgcaaauucagccgcauuggauugcggcuucuauaauuuuggaguucuuucucauaguuuuacuaaucccagagccagaaaaacaaagaacaccacaggauaaucaauuaacauacguaguuauagcuauacuaacggugguggcagcgacaauggcuaaugaaauggguuucuuagagaaaaccaagaaagauuuuggauugggcucaauagccacucagcagccagaaucuaacauccuagauaucgaucuacgcccugcuucagcuuggacauuguaugcaguagccacaaccuucauuacaccaaugcugaggcacaguauagaaaacuccaguguaaauguaucccuaacugcaauagcaaaucaagcaacugugcuaauggguuuaggaaaaggguggccguugucuaaaauggauauuggagucccacuauuagcuauaggauguuauucucaaguaaauccuauaacgcugacugcugcgcuacucuuauuaguagcacacuaugccaucauuggaccggggcuacaagcgaaagcuaguagggaggcucagaaacgugccgcagcgggaauuaugaaaaauccuacgguagaugguaucacaguaauagaccuagacccaauuccauaugauccaaaauuugaaaaacaacuuggccaaguaaugcuauuaauccuaugcguaacucaaguucugaugaugaggacaacaugggcccucugugaagcguuaacauuggcaaccgguccuauaucaacgcuuugggaaggaaaucccggaagguuuuggaacacgacuaucgcagugucuauggcaaacauuuuccgagguucauaccuggccggugcaggauuauuauuuuccauaaugaaaaauacgaccaauacaagaagagggacuggaaacacuggugaaacguuaggcgaaaaguggaaaaauagaguaagucuguuaggaaaaagugaauuucagauuuauaaacgaagugguauccaagaaguggauaggacauuggcuaaagaaggaauuaaaagaggugaaacggaucaucaugcgguguccagagguagugcuaaacuucgcugguuugucgaaaggaaucuaguuacaccugagggaaaaguaguagauuuggguugugggcgagguggguggaguuacuauuguggcggguugaaaaauguaagagagguaaaagggcuuaccaaaggaggaccagggcaugaggaaccuauuccuaugagcacauaugguuggaaucuugugcgucuccugacaggagcagacguauucuuuacuccuccagaaaaaugugacacauugcuuugcgacauuggugagaguaguccuaaccccacuguggaagcggggagaacauuaaggguauuaaaccucguugaaaauuggcuaaacaacaacacccaauuuugcauaaaggucuugaauccuuacaugccaaguguaauugaaaagauggaaacuuuacaaagaaaguacggaggugcccuaguccgcaacccccucucaagaaauucaacacacgagauguauuggguuaguaaugcaucaggaaauaucguaagcaguguaaacaugauaaguaggauguuaaucaacagauuuacaaugcggcauaagaaagcuacauaugaucccgauguggaccuugggagcggaacgaggaauaucgggauagagucagagaccccaaauuuggauauaauugggaaacguauagagaaaauaaagcaagaacacgaaaccuccagacacuaugaccaagaccauccauauaagacgugggcguaucauggcucauaugagaccaaacaaacuggaagcgcaaguucaacagugaauggggugguaagacuacugacaaaaccgugggauguuauaccaaugguaacccaaauggccaugacagauaccaccccauucggacaacaacgaguguuuaaagaaaaagucgauacuagaacccaagaaccaaaggaaggaaccaaaaaguuaaugaaaauuacagcugaguggcucuggaaagaguuagguaagaagaaaacaccuagaauguguacacgagaggaguuugccagaaaaguucguuccaacgcagcguuaggcgcgauauucacagaugaaaauaaauggaaaucugcgagagaggcgguugaagauucgagguuuugggagcuaguggacaaagaacgaaaccugcaccuggaaggaaaaugcgaaaccuguguguauaauaugaugggcaaaagagagaagaaaauuggagaauuuggaaaagcaaaagguagcagagcuauuugguauaugugguuaggagcaagauuucuggaauuugaagccuuaggauucuuaaaugaggaucauugguuuaguagagaaaauuccuuaagcggggucgaaggugaaggguuacauaaauugggauauauacuaagagaaguuagcaagaaagaaggcggagcuauguacgcugacgauacagcuggaugggauaccagaauaacauuagaagaccucaaaaaugaagagauggucacuaaucacauggagggugaacauaagaaacuagcagaagcaauauucaagcuaaccuaucaaaauaaaguaguucggguacaacgaccgacaccaagagguacggucauggauauaaucucgcgaagagaucagagagggucuguucaagugggcacauaugguuugggaacauucacaaauaugggugcccaauuaaucagacagauggagggagaagggguguuuaaagguauacagcaccucacggcaacugaagaaguagcaguacaagauuggcuugcgagagucggcagagaacgucucuccagaauggcaauuuccggagacgauuguguaguuaaaccucucgacgaucguuucgcaagcgcuuuaacagcucuuaacgauaugggcaaaguacgaaaggacauacaacaaugggaacccucuaggggguggaaugacuggacacagguaccauucuguucucaucauuuccacgagcuaauaaugaaagauggccgaguauuaguagucccuugccgaaaucaagaugagcucauaggacgugcaagaauaucccagggugcaggauggagccucagggaaacagcaugccuaggaaagucauacgcacaaauguggucacucauguauuuucauagaagagaucuacguuuagcggcaaacgcuauauguucggcaguuccaucccacugggugccaacaaguagaacuacauggagcauacacgcugggcacgaguggaugacuacagaggacaugcuuacagucuggaaucggguauggauucaagagaacccauggauggaagacaagaccccugucgagaguugggaggaaauccccuaucuaggaaaacgugaagaucaguggugcggaucguuaauuggacuaacgagccgugcgaccugggcucguaacauucaaacggcaauaaaucaaguaaggagccuaauaggcucagaagaauacacagauuauaugccaucaaugaagagauuuggccgagaagaggaagaggccggaguauuaugguag

SEQ ID NO: 22488 - RNA, 9876 nt, Artificial Sequence
  derived and/or modified CDS sequence (opt6) from DENV-2__KJ010186__SS-prME
accgcuggugucauuauuauguuaauaccuaccgcaauggcguuucaucuaaccacgagaaauggggaaccgcacaugauuguaucuaaacaagaaaaaggaaaaucucuguuauuuaaaacugaagaugggguaaauauguguacccuuauggcaauggacuugggagaacuuugugaagauacgauaacauauaauugcccacugcuaagacaaaaugaaccagaagauauagacuguugguguaaugcuacaagcacauggguaacguacggaacauguacagcaaccggagaacauaggagggagaaaagaucaguagcauuagucccacaugucggaaugggauuagaaacaaggacggaaacauggaugagcucggaaggagcauggaaacaugcucaaagaauugaaacauggauucuacgucauccagguuuuacuauaauggcugcaauacuagcauauacaauuggaacaaccuacuuucaaagagucuuaauuuuuauacuguuaacagcaguggcgccaucaaugacaaugcguugcauagguauaagcaauagggacuucgucgaaggaguuucagguggaucuuggguugacaucgucuuggaacauggaaguuguguaacaacaauggccaaaaauaaaccgacucuggacuucgaauuaauaaaaacggaagcaaaacaaccggcgacacuaagaaaauacuguauagaagcuagguuaaccaacacaacuacagcaucaagaugcccuacacaaggagaacccucuuuaaaugaagaacaagauaaacgauucguauguaaacacagcaugguagaucggggauggggaaauggaugugguuuauuugggaaagguggaaucguaaccugcgcaauguucacaugcaagaaaaauauggagggaaagauaguacaaccggaaaauuuagaauacacuauugucguuacuccacauagcggagaagaaaacgcaguagguaaugacacggguaagcaugguaaggaaauaaaaguaacgccacaaucaucaauaacugaagcugaacuuacaggauauggaacgguaacuauggagugcucaccucgaacgggacuagacuuuaacgaaaugguguugcuacagauggaaaacaaagcaugguuaguacacagacagugguuucuggaccuuccacuaccuuggcuaccaggagcagauauucaaggcagcaacuggauucagaaagaaacuuugguaacuuuuaagaaaccccaugccaagaaacaagauguuguuguuuuaggaagucaagagggugcaaugcauacggcucuaacaggagcaacagagauucaaaugagcucggguaaccugcuauucacugggcaccuaaagugcagacuaagaauggacaaguuacaacuaaaggggaugucauacaguaugugcacugguaaauuuaaaguaguaaaagagauagcagagacgcaacauggaaccauugugguuaggguccaguacgaaggagauggaucgccuugcaaaaucccuuucgaaaucauggaucuugaaaaacgacauguucucggaagacuaauuacaguuaauccaauuguaacugaaaaagauucaccgguaaacauagaagcagaaccaccauuuggugacaguuauaucauaauaggaguugaaccaggucaguuaaaacuuaguugguuuaaaaaggguucgaguauaggccaaauguuugagacaacuaugcguggggcgaaaagaauggcgauauuaggcgauacagcaugggauuucggcuccuuaggugguguauuuacaaguauugggaaggcauugcaucaaguuuuuggagcaauauauggagcagccuuuuccgggguuucuuggacuaugaaaauccuaaucggaguuguuauuacuuggauugguaugaacucaagaucuacuucguuaagcgucucccuaguauugguaggcguagugacuuuauauuugggugugaugguccaagcagacucaggguguguuguaucauggaaaaauacugcauugaaaugcgggucagguaucuuuauaacugacaauguacacacauggacggaacaguacaaguuucagccagaaucuccaucaaaguuagccucggcaauacaaaaagcucacgaggaagggauaugcgggauucgaagcguuacuaggcuugaaaaccugauguggaagcagaucacaccugaauugaaucauauucucucggaaaaugaggucaaauugucgaucaugacgggugacauaaaaggcauucuacaagcugguaaaagaucauuacguccgcagccaacagaguuaaaauacagcuggaaaaccuggggaaaggccaaaaugcucuccacugaaagucauaaucaaaccuuucuuauagaugguccagagacugccgaauguccuaauaccaacagggccuggaacuccuuagaaguagaggauuacggauucggaguauucacaacaaacaucuggcuaaaauugaaggagaggcaggacguguuuugugauuccaaauuaaugucggcagcgaucaaggauaauagagcagugcaugcggacaugggauauuggauugagucagcauugaaugauacuuggaaaauugaaaaagccagcuuuauagagguaaaaucuugccauuggccuaaaagucacacccuauggaguaacgggguccuugagucugagaugauuauaccgaaaaauuuugcaggaccaguaucacaacauaauuauagaccugguuaucacacccaaacagcugguccguggcaucuagggaaacucgaaauggauuuugauuuuugcgaaggaacuacuguaguuguuaccgaagacuguggaaauagaggaccaucacuacgaaccaccacugcuucaggcaaauugaucacagaaugguguugccguaguugcacuuuaccuccacuacguuaccgaggagaagaugguuguugguacgggauggaaaucaggccauuaaaagaaaaagaggaaaaccuggugaacagcuuagucacagccggacacggccagauugauaauuucagccuugguguuuugggaauggcacuauuucuggaagagaugcuaagaacacgaguaggaaccaaacacgcaguucucuuagucgcaguauccuucaugacacugauaaccggaaacaugucauuucgcgaccugggucgaguaauggugauggucggagcagccaugacagaugauauuggcaugggcguaacuuaccuagcauuauuagccgcauuuaaaguuagaccgaccuucgcagcuggacuucuauugcgaaaauuaacaucgaaagaacuuaugaugacaacuauaggcauugucuuauugucacaauccacuacgcccgaaacgaucuuagaacuuaccgaugcuuuagcccugggcaugaugauacuuaagauuguuaggaacauggaaaaguaucaacuugcgguaacaaucauggcaauuuuaugugucccuaacgcugucauacuacaaaaugcauggaaaguguccuguacuauucuggcagcugucucaguuucaccucuauuauugaccagcagucaacaaaaagcugauuggauuccauuagcuuugacuauaaagggacucaacccuacggccaucuuccuaaccacauuaucgcgaacgaauaagaagaggagcuggccccuaaacgaagcaauaauggcugugggcauggucucuaucuuggcaucaagucucuugaaaaacgauauaccaaugaccgguccccucguugcgggaggauuauugacgguuuguuacgugcuaacaggacgaagugcggaccuagaguuagagagagccgcagauguaaggugggaagaucaggcagaaauuucuggaucuuccccuauccuuaguauaaccaucucggaggaugguaguaugagcaucaaaaaugaagaagaagaacaaacauuaacaauacugauuaggacagggcuccuaguaauuucuggacuauuuccugugucuauuccaaucacggcggcugccugguaucuuugggaggucaagaaacaaagggccgguguucuaugggacguaagaucauacccucccguggguaaagcagaacuugaagacggagcauacagaauaaagcaaaaaggaauauugggguacucacaaauaggugcaggaguuuauaaggaaggaacauuccacacgauguggcaugucacacguggugcaguauugaugcacaagggaaaaaggauagaaccuucaugggcugacguuagaaaagauuugauuucuuauggaggaggguggaaauuagaaggggaguggaaggaaggugaggagguccaaguguuggcauuagaaccaggcaaaaauccacgcgcagugcagacgaaaccggguuuauuuaaaacuaauacaggaacuauaggagcagucagccuagacuuuaguccagguacgagcgguagcccaaucguugacaaaaaggguaaagugguuggacuauacggaaacgggguggugacaagaagugguacguauguaucagccauugcucaaacagagaaaucuauugaagacaauccggagauagaagacgacauauuuaggaagaaacgacuaaccauaauggacuuacacccaggugcuggaaagaccaaacgauaucucccagcaauaguuagggaagcaauaaagcgaggacuuagaacgcugauccucgcaccaacaagaguuguagcagccgagauggaggaggcuuuacgaggacuuccgauaagguaccagacacccgccaucagggcugaacauacuggacgagaaauaguagacuuaaugugucaugcaacguuuacaaugcgcuuacuuucaccagucagggucccgaauuacaacuuaauaauaauggaugaagcgcauuuuacagauccggcaucaaucgcggcgagaggguacauuucuacuagaguggaaaugggagaagcugccggaauauucaugacugcgaccccaccaggaucaagagauccuuuuccgcaaagcaaugccccaauuauggacgaagaaagagaaauacccgaaagaagcuggaacuccgggcaugaguggguuaccgacuucaaagggaagaccgucugguuuguaccaucuauaaaagccgguaacgauaucgcagcuugcuuaaggaaaaacggaaagaaaguuauccaauuaaguagaaaaacguucgauucggaauauauaaaaacgcgaacaaacgacugggacuuuguuguaacuacugauauuagcgaaaugggggcuaacuuuaaagcugaacgggugauagacccgaggcgaugcaugaaaccgguaauuuuaacagauggugaagagagagugauauuagcugggcccaugccgguuacacauucaucagcagcacaaaggagaggaagaauagggagaaauccgaaaaacgaaaacgaucaguacauauauaugggagaaccuuuagagaacgacgaagacugcgcccauuggaaagaagcaaaaaugcuauuagacaacaucaauacgccagaaggaauaauuccaucgauguuugaaccggagcgagaaaaagucgaugcaauagacggcgaauaccguuuacgaggagaagcccgaaaaacguuuguugaucuuaugagacggggugaucuaccaguuuggcuggcguacagaguugcagccgaagggauaaauuacgcugauagacgauggugcuucgaugguauuaaaaauaaucaaauauuagaagaaaacgucgaaguagaaauuuggacgaaagaaggggagagaaagaaacuuaaaccgcgcugguuagaugcucguauauauuccgauccacuagcacuaaaagaauuuaaagaauuugcagcuggacgaaaaucguugacauuaaauuuaaucacagaaaugggcagauuacccacuuuuaugacucaaaaggcaagaaaugcucuagauaaucuagcagugcuacauaccgcggaggcaggaggccgagcguauaaucacgcacuuucggaacuaccugaaacacucgaaacccugcuacuuuuaacguuauuagcaacagucacagggggaaucuuucuauuuuuaaugucugguaaggguaucggaaaaaugacuuuaggaaugugcuguauaauaacggcauccauacuccuaugguaugcccagauacagccucauuggauagcugcuucaauaauauuagaauuuuuccuaauaguauuacuuauuccagaaccagaaaaacaaaggaccccucaagauaaccaacuaacuuacguuguaauugcuauucucacaguuguagcggcuacuauggcgaaugaaaugggguuccuagagaaaacuaagaaggauuuuggucucggaucuauagcuacucagcaaccagagucgaauauccucgauauagaucuaagacccgcuagugcguggacauuauaugccgucgccacaacguuuaucacaccaaugcuucggcauagcauugaaaauucuagcguuaaugucucucuaacagcgauagcgaaccaagcuaccguauuaaugggccucggaaaaggauggccuuuaaguaaaauggauaucggugugccacuacuugcgauaggcuguuauucucaagucaacccaauaacacuaacagcagcacugcuucuacucguugcccacuacgccaucauuggaccaggucuacaggcuaaagcuacccgagaagcucaaaaacgcgcugcagccggaaucaugaaaaacccaacuguagauggaauuacaguaauugaccuggauccaauaccauaugauccuaaauucgaaaaacaguugggacagguaaugcuacuuguauuaugugugacccagguguuaaugaugagaaccacaugggcacuuugugaagcccuaacgcuggccacaggaccgauuaguaccuuaugggaaggaaacccuggaagauucuggaauacaacaauagccguuucaauggcuaauauauuccgaggaaguuacuuagcaggggcugggcuucuguucucgauaaugaaaaacacaacuaacacaaggaggggaacaggcaacaccggugaaacacuaggugagaaauggaaaaaucgguuaaauucccuuggaaaaagugaauuucagauuuauaaaaggucagguauacaagaaguugauagaacguuagccaaagagggaauuaagagaggagagacggaccaucaugccgucucaaggggaucggcaaaauugagaugguuuguagaaaggaauuuaguaaccccagaaggaaaaguaguggacuuagguuguggccgagggggaugguccuauuauuguggagguuuaaagaacgucagggaagugaaaggacuaacaaaaggcggucccggacacgaagaaccuaucccgaugucaacauacggcuggaacuuaguccgccuucaaagcggggucgauguguucuuuacaccaccagaaaaaugugauacacuccuuugcgauauaggagagucaaguccuaauccuacuguagaagccgggaggacauugagaguacuuaaccucguggaaaauugguugaauaauaauacucaauucugcauaaagguuuugaauccauauaugccaagcguuaucgagaaaauggaaacauuacagcguaaguauggaggcgcuuuaguuagaaacccauuaucccgaaacagcacucaugaaauguauugggucucaaacgccuccgguaacauagugagcuccguaaauaugauaucacgaaugcuaauuaauagauucacuaugcgucauaagaaagcaacauacgagccagauguagaucuaggaagcggaacuaggaauauaggaauugaaucagagacaccuaacuuagauauaauuggaaagcgaaucgagaaaauaaaacaagagcaugaaacuagcuggcauuaugaucaagaucauccguauaaaacgugggcuuaucaugguuccuacgaaacuaagcaaaccggaucugcuaguucaaugguaaauggagucgugcgguuacuuacgaaaccuugggauguuauuccuaugguuacacaaauggcuaugacugauacaacuccuuuuggacaacaaagaguauuuaaagagaaaguagacacuagaacacaagaaccuaaagagggcacuaagaaauuaaugaagauaacagcggaauggcuguggaaagagcuggguaagaagaaaaccccaagaaugugcacaagagaggaguucgcgcggaaaguccguucaaaugcagcucuaggcgcaaucuuuacagaugagaauaaauggaaaucugcuagggaagcuguggaggauucuagauucugggaauuaguggacaaagagaggaacuuacaucuagaaggaaagugcgaaacuuguguauauaauaugaugggaaaacgagagaagaaaauuggugaguucgggaaagcuaaaggaucacgagcaauuugguacaugugguuaggugcaagauuucuugaguuugaagcauuagguuuucugaaugaagaucauugguuuaguagggaaaacaguuuaucaggaguagaaggagagggccuacauaaguuagguuacauacugagagaaguaucaaagaaagaagggggugcuauguacgcugaugauaccgcaggaugggauacccguauaacguuagaagaucucaaaaaugaagagaugguaacuaaccacauggaaggugagcacaagaaacuagcggaagccauuuuuaaauuaacguaucaaaacaaagucguacgcguccagagaccaacuccucgcggaaccgucauggauauaauuagccgcagggaccagcguggcaguggucagguaggaacauacgguuuaaacaccuuuacuaacaugggcgcucaauugauacgccaaauggagggugaagggguauucaagggcauacaacacuugacggcaaccgaagaagucgccguacaggauuggcuggcgaggguagguagggagagacuuuccagaauggcuauaucgggggacgauugcguaguaaagccacucgaugaucguuucgcuaaugcauuaacagcacuuaacgacaugggcaaaguacgaaaagacauacaacaaugggaacccagucgaggguggaacgacuggacacaggugccguuuuguagucaccacuuucacgagcuaaucaugaaagauggaaggguauuagugguaccaugccgaaaccaggacgaacuuauaggcagagcaagaauuagccaaggugcuggauggucauuaagagagaccgccugcuuagguaagucauaugcgcaaauguggaguuugauguacuuccauagaagagaccuacguuuagcggcaaacgcgauuugcagugcuguacccagucauugggugccaacaucuagaacaacuuggucuauucaugcaaggcacgaauggaugacaacugaagacauguuaaccguauggaacagaguuuggauacaggaaaauccuuggauggaggauaaaacaccuguggagagcugggaagaaaucccauacuuggggaaacgcgaagaccaguggugcggauccuugaucggcuugacuagcagagcaacaugggcgagaaauauucaaacggcuaucaaccagguaagaagccucauuggcagugaggaguacacugauuauaugcccaguaugaaacgauucagacgugaagaagaagaagccggagucuugugguaa
